United States Patent 11,931,406 (FLAVIVIRUS VACCINE) - sequence listing, part 75

SEQ ID NO: 25774 - RNA, 9873 nt, Artificial Sequence
  derived and/or modified CDS sequence (opt11) from DENV-3__GQ868628__SS-prME
accagccugugccuaaugaugaugcugcccgcgacccuggcauuccaccucaccagccgggacggcgagccacggaugaucguggggaaaaacgagcgcggcaagucacugcuguucaagaccgcgagcgggaucaauaugugcacucucaucgccauggaccugggugagaugugcgacgacaccguaaccuacaagugccccuuaaucgccgagguggagccugaggauaucgacugcuggugcaaccucaccagcacaugggugaccuacgggacgugcaaccaggccggagagcaccggcgagacaagcgguccgucgccuuggcgccacacgugggcauggggcuggacacccgcacccaaaccuggaugagcgccgagggcgccuggcgacaaguggagaagguagagacgugggcccuccgccacccgggguucaccauacuggcgcuguucuuagcccauuauaucggcaccucacugacccagaagguggugauauucauccugcucaugcuggucacgcccaguaugacaaugcggugcgugggggucggcaaccgcgacuucguugaaggccuguccggggcaaccuggguggacgugguccucgagcacggcggcugcgugacaacgauggcuaagagcaagcccacgcuggacaucgagcugcagaaaaccgaggccacccagcuagcgacgcugcggaagcugugcaucgaggguaagaucaccaauaucacuaccgacucccgcugccccacgcagggcgaggccacucuaccggaggagcaggaucagaacuacguuugcaagcacaccuacguagacagagggugggggaacgggugcggccuauucgggaagggcagcuuggugaccugcgccaaguuccaaugccucgagcccaucgagggcaagguuguccaguacgagaaccugaaguacacgguaaucaucaccgugcauaccggggaccaacaccaggucggcaacgacacccagggggugacggucgagauaacgccccaggccuccaccguggaggccguccugccagaauauggcacccucgggcuggaguguagcccgcgaaccggccuggacuuuaacgagaugauccuccugacgaugaagaacaaggcuuggaugguccaccggcaaugguucuucgaccugccgcuucccuggaccaguggcgccacaaccgaaacgccaaccuggaaccgcaaggagcuucuugugaccuucaaaaacgcccacgcaaagaagcaagagguagucguguuagggagccaggagggcgcuaugcacaccgcgcugacgggggcuaccgagauacagaacuccggcggaaccagcaucuuugccggccaccugaagugccggcucaaaauggauaaguuggagcugaagggcaugagcuaugccaugugccucaacaccuucgugcugaagaaggaagucagcgaaacgcagcacggaaccauacuuaucaagguggaauacaaaggcgaggacgcaccgugcaaaauucccuucagcacggaggacggacagggcaaggcgcacaacggucgccuaaucaccgccaaccccguggucacgaagaaagaggagccagugaacaucgaagccgagccgcccuucggggaguccaacaucgucaucgguaucggggauaaagcgcucaagauuaacugguacaagaaggguagcuccaucgggaagauguucgaggcgaccgcucggggcgcccgccggauggccauccugggcgacacagccugggacuucgggagcgucggcggggugcugaacucccucggcaagauggugcaucagaucuucgggucggcguacacggcccuguucucgggcgucagcuggaucaugaagaucggaaucggggugcuacuuacuuggaucggccuaaacuccaagaacaccagcauguccuucagcugcaucgugaucgguaucauuacccuguaccucggcgccgucgugcaggccgacauggguugcgugaucaacuggaagggcaaggaacuaaagugcggcagcgggaucuucgucaccaacgaagugcacacguggaccgagcaguauaaauuccaggccgacagccccaagcgccuugcgacugccaucgccggcgcgugggagaacggggugugcggcauccgcuccaccacgagaauggagaacuuacuguggaaacagaucgcaaacgagcuaaacuacauccucugggagaacaacauuaagcugaccgucguggugggggacaucaucggcguccuggagcagggcaagcgcacccuaacgccccaaccgauggagcuuaaguacagcuggaagacgugggggaaggccaagaucgugaccgccgagacccagaauuccagcuucaucaucgauggccccaacacccccgagugccccuccgccagccgggccuggaacgugugggagguagaggacuacggguucggcguguucacgaccaacauuuggcugaagcuccgcgaaguguauacccagagcugcgaucaccggcugauguccgcggcgaucaaggacgagcgggccguccaugccgauauggguuacuggaucgagagccagaagaacggguccuggaaguuggaaaaggcgagcuucaucgaggugaagaccugcgcguggccgaagucccacacguuauggucgaacggcguacuggaguccgacaugauuaucccuaagagccuggccggucccaucucccagcauaaccaccggccgggcuaccacacgcagaccgcggggcccuggcaccucggcaagcuggagcuggacuucaacuacugcgagggcaccaccgucgugaucaccgagaacugcgggacgcgcggccccagccucaggaccaccacggucagugggaaacugauccacgaguggugcugucggagcugcacccuuccgccgcuccgguacaugggagaggacgggugcugguacggcauggagauccgcccuaucaacgagaaggaggaaaacauggucaagucccuggugagcgcuggcucggggaagguggacaacuucaccaugggcguccugugccucgcaauccuguucgaggaaguaaugcgggggaaguucggcaaaaagcauaugaucgcgggugugcuguucaccuucguccuccugcugucuggccagaucacguggagggauauggcccacacccucaucaugaucgggucaaacgccagugaccggauggggaugggcgugaccuaccuggcccugauugccacguucaagauccagcccuuccuugcguuaggguucuuccugcgcaagcucacuucgcgggagaaccugcugcucggcguggggcuggcaauggccaccacccugcagcuccccgaggacaucgagcagauggcaaacgggaucgcacugggccugaugaccuuaaaguuaaucacgcaauuugagaccuaccaguuguggaccgcgcucgucucccuuaccugcuccaauacgaucuuuacccugaccguggccuggcgcaccgccacgcucauccuggccggggucucccugcucccgcuaugccagagcuccagcaugcggaagaccgacuggcugcccaugaccguggccgccaugggagugccgccccugccgcuguucauuuuuucccugaaggacacccccaagcgucgcagcuggccccucaacgaagggguaauggccgugggccugguguccauccuggccagcucccuccugcggaacgacgucccgauggccgggccccugguggccggcgggcuccugaucgccuguuacgucaucacggggaccagcgccgaccugaccgucgagaaagccgccgacgugaccugggaggaggaagcggaacagacgggagugagucacaaccucaugaucaccguggacgacgacgggaccaugcgcaucaaggacgacgaaaccgagaacauccuuaccgugcugcuuaagacggcccugcugaucgugagcggcaucuuccccuacuccauacccgccacccuccuggucuggcacaccuggcagaagcaaacccagcggaguggcgugcugugggacgugcccuccccgcccgagacgcaaaaggcagagcucgaggaggggguguaccgcauuaagcaacagggcaucuucgggaagacccagguggggguggggguccagaaggagggcguguuccacaccauguggcaugugacccggggcgcuguccugacgcauaacggaaagcgccuggaacccaacugggccagcgucaaaaaggacuugaucuccuacggcgggggcuggcgccugagcgcccaguggcagaagggcgaggagguacaggucaucgcuguggagcccggcaagaacccgaagaacuuccagaccaugcccggcaucuuccaaacuaccaccggggagaucggagccaucgcgcuugauuucaagccaggcaccagcggcuccccgaucauuaaccgcgagggcaagguggucgggcuguacggcaacggcguggugaccaaaaacggcggguacgucucgggcaucgcccaaaccaacgccgagcccgacggccccacaccagaacucgaggaagagauguucaagaagcggaaccugaccaucauggaucugcacccggggucaggcaagacccgcaaguaccuccccgccaucgugcgugaggccauuaagcgccggcugcgcacccugauacucgcgcccacgcgggucgucgccgccgagauggaggaagcgcuuaagggucugcccauccgcuaccagaccaccgcuacuaagagcgaacacacgggccgcgagaucguggaccucaugugccacgcgaccuucaccaugagacugcugagcccggugcguguccccaacuacaaccuugugaucauggacgaggcacacuuuaccgaccccgccucuauugccgcccgcggguacaucuccacgcgggugggcaugggcgaggcggccgccaucuucaugacagccacgccgcccgggaccgcggaagccuucccccagagcaacgcccccauccaggacgaggagcgcgacauccccgagcgcuccuggaacaguggcaacgaauggauuacggauuucgucgggaagaccgugugguucgugccaagcaucaaggccggcaacgacaucgccaacugcuugcggaagaacgggaagaaggucauccagcugucccgcaagaccuucgacaccgaguaccagaagacgcggcucaacgacugggacuucguggugaccaccgacaucuccgagaugggcgcuaacuucaaggccgaccgcgugaucgacccccggcgcugccugaagcccgugauccugacagacggccccgagcgggugauccucgccggcccgaugccggucaccgcagccagcgcugcccagcgccggggucgcguggggcggaacccccagaaggagaacgaccaauauaucuuuaccggccagccccugaacaaugacgaagaucacgcccacuggaccgaggccaagaugcugcucgacaacaucaacaccccggaggggaucauacccgcccuguucgagcccgagcgcgagaaguccgcggccauagacggcgaauaccggcugaagggggagagucgcaagaccuuuguagaauugaugcggcgcggggaccugcccguguggcuggcucacaagguggccuccgagggcaucaaguacaccgaccguaaguggugcuucgacggggagcgcaacaaccagauccucgaggagaacauggacgucgagaucuggaccaaggagggcgagcggaagaaacugcgcccgcgcuggcuggacgcacggaccuacagugacccccuggcccugaaggaguucaaagacuucgccgcuggucgcaaguccaucgcccuggaccucgugaccgagaucgggcgggugcccagccaccuugcgcaccgcacacggaacgcgcuggacaaccucguaauguugcacaccagcgaacacggcggucgcgcauaccgccacgccgucgaggaguuaccggagaccauggaaacccuacugcugcucggccugaugauucugcucaccgggggcgcgaugcuguuccugaucuccggcaaggggaucggcaagaccagcaucgggcugauaugcgugaucgucuccaguggcaugcuguggauggcggacgugccucuacaguggaucgcauccgccaucguguuggaguucuuuaugaugguacugcugauccccgagcccgagaagcagcgcaccccgcaggacaaccagcucgccuacguggugaucgggauacugacccuagccgcgaucgucgccgccaacgagaugggccuccuugagacgaccaagcgggaccugggcaugagcaaggaacccgggguggugucccccaccagcuaccucgacgucgaccuacaccccgccuccgccuggacccuguacgcgguggccacgaccgugaucacgccgaugcuccgccauacgaucgagaacucgaccgccaacgucuccuuagccgcgaucgccaaccaggccguggugcugaugggccucgacaagggguggcccaucagcaagauggaucugggagucccccugcuagcccugggguguuacucccaagugaacccccugacacucacugccgcggugcugcugcucgucacccacuacgccaucauuggcccgggccugcaggccaaagcaacgcgggaggcccagaagcgcaccgcggccgggaucaugaagaaccccacuguggacggcaucaugaccaucgacuuggauccagugaucuacgacagcaaguuugagaagcagcucgggcaagucaugcugcuggugcucugcgccguucagcugcugcucaugcggacuuccugggcccugugcgaagcccugacacucgcgaccggccccaucacaacucugugggaggggagcccggggaaguucuggaauaccaccaucgcggucuccauggccaacaucuuccguggcucguaccuagccggggcgggccuagccuucuccaucaugaaguccgucgggaccggccggcgaggcacggggagccagggagagacccugggggagaaguggaagaagaagcugaaccagcuaucccggaaggaguucgaccuguacaagaaguccgggaucaccgagguggaccgcaccgaggcgaaggaggggcugaagcggggcgagaccacgcaccacgccgucucccguggcagcgccaagcuccagugguucguggagcggaacauggugauucccgaggggcgcgucauagaucugggaugcggccgcggcggguggaguuacuacugcgcgggccugaagaaggugacagaaguccggggcuacaccaagggcggccccggucacgaagagcccgucccgaugagcaccuacggcuggaacaucgugaagcuuauguccgggaaggacguguuuuaccugccgcccgagaaaugcgacacgcugcugugcgacaucggcgagagcucccccucuccgaccgucgaggaaucccgcaccauccgggugcucaagaugguugagcccugguuacgcaacaaccaguuuugcaucaagguccuaaaccccuacaugccuaccgugaucgagcaccucgagcggcugcagcgcaaguacggagggauguuaguccggaacccgcucagccgcaacuccacacacgagauguacuggauaagcaacggcacggggaacaucgucuccagcgugaacauggucucccgucuucugcucaaccgcuucaccaugacccaccggcgccccacgaucgaaaaagacguggaccugggcgccggcacccggcacgucaacgccgagcccgaaaccccgaacauggacgucaucggggagcgcaucaaacggaucaaggaggagcauuccuccaccuggcacuacgacgaugagaaccccuacaaaacgugggccuaccacggcagcuacgaggucaaggccaccgggagcgcguccagcaugaucaacggcguggucaagcugcucaccaagcccugggacguggugccgauggucacccagauggccaugacggacaccacuccguuugggcagcagcgcguguuuaaagagaagguggacacccggacgccccgccccaugcccggcacccguaaggucauggagaucaccgccgaguggcuguggcgaacccugggccgcaacaaaaagccgcggcuaugcacgcgcgaggaguucaccaagaaggugcguaccaacgccgccaugggggcgguguucaccgaggagaaccagugggacuccgcccgcgccgccgucgaggacgaggaauuuuggaagcugguggaccgggagcgcgaguuacacaagcucggcaagugcgggagcugcgucuacaacaugaugggcaagcgggagaagaagcugggagaguucggcaaggcgaaaggcucccgcgccaucugguacaugugguugggggcgcgguaccuagaguucgaagcccugggauuccugaacgaggaccacugguucagccgcgagaacuccuacaguggugucgagggcgaggggcuccacaaguuaggcuauauccuacgggacauauccaagaucccugggggggccauguacgcagacgacacggccggcugggacacccgcaucaccgaggacgaucuccacaacgaagagaagaucacccagcagauggaccccgagcaucggcagcuggccaacgccauauuuaagcugacuuaccagaacaagguggugaagguccagcgccccaccccgaaggggacgguuauggacaucaucuccagaaaggaccagcgcggcaguggccaaguggggaccuacggccuuaacaccuucacaaacauggaggcccagcuugucagacagauggaaggggaaggugugcugagcaaggcggacuuagagaacccccaccuccuagagaagaagaucacccaguggcucgagaccaaggggguggagcgccugaagcggauggccaucucgggcgacgacugcguagugaagcccaucgacgaccgauucgccaaugcccuccucgcguuaaacgacaugggcaagguccggaaggacauuccccaguggcagccgagcaagggguggcacgacuggcagcagguccccuucugcucccaccacuuccacgagcugaucaugaaggacggccgcaagcuagugguucccugccgcccccaggacgagcugaucgggcgggcgcgcaucagccagggcgcaggauggucccugaaggagaccgccugccucggcaaagccuacgcccagauguggucccugauguauuuucaucggcgcgaccugcgucuggcguccaacgcgaucugcagcgccguacccgugcacuggaucccgacgagccgcaccaccugguccauccacgcccaucaucaguggaugacaaccgaggacauguuaacaguguggaaccgggucuggaucgaagauaaccccuggauggaggacaagacccccgugaccacgugggaggacguaccguaccuggguaagcgcgaggaccaguggugcgggagccucaucggccugaccucccgggcgaccugggcucagaacaucuuaaccgcuauccagcagguccgcagccucaucggggaugaggaguucuuagauuacaugcccucaaugaagcgguuccgcaaggaggaggagagcgaaggugcuaucugguga

SEQ ID NO: 25775 - RNA, 9873 nt, Artificial Sequence
  derived and/or modified CDS sequence (opt11) from DENV-3__FJ639727__SS-prME
acuagccucugcuugaugaugaugcugccggcgacgcuagccuuucaucugaccucccgugacggagagccgcggaugauaguggggaagaacgaacgaggcaagagccugcuuuuuaagaccgcgagcgggaucaacaugugcacccucaucgccauggaccuuggcgagaugugcgacgauacagugaccuacaaaugcccgcugaucgcagagguggaaccagaggacaucgacuguugguguaaucuaacgucuaccugggugaccuaugggacgugcaaccaggcgggggagcaccgucgggauaagcgguccgucgcguuggcgccgcacguggguaugggcuuagacacucgcacgcagacauggaugagcgccgagggggccuggcgucagguggagaaggucgaaacuugggcccuccggcauccuggguucacuauccuggcguuauuccucgcacacuauaucgggacaucguugacccaaaaggugguaaucuucauacuguugaugcuggucaccccaagcaugacuaugcggugugugggaguagggaaucgggacuucgucgaaggcuuguccggagcgaccuggguggacgucguccucgaacacggggggugcgugaccacgauggccaagagcaaaccaacgcuggauaucgagcuucagaagaccgaggccacccagcucgcgacccuccgaaagcugugcauagaaggcaagaucaccaacauuacaacugacuccagaugcccaacgcaaggggaagccacacucccggaggagcaggaccagaacuacguguguaaacacaccuacgucgaccgcgggugggguaaugggugcggccuguucgguaaaggcucgcuggugaccugcgcuaaauuccaaugccucgagcccaucgaaggcaaggugguucaguacgagaaccugaaguacacggucaucauaaccguacacacaggggaccagcaucaggucggcaacgacacccagggggugacaguagagaucacgccccaggcguccacgguggaggccgugcucccagaguauggcacucucgggcuggagugcagcccacgcacuggcuuggacuucaacgagaugauccuucugacgaugaaaaacaaggcguggaugguucaccggcagugguucuucgacuuaccacuccccuggaccuccggcgccaccacugaaacaccaaccuggaaccguaaggagcuacuagugacuuucaagaacgcccacgccaaaaagcaggaaguggucguacuaggcucgcaggagggcgccaugcacacagcguuaacgggggcuaccgagauccagaacuccggggguacgagcauauucgccggccaucugaagugccggcucaagauggacaagcuggagcugaaaggcauguccuacgccaugugccucaauaccuucgugcugaaaaaggaagucagcgagacgcaacaugggaccauccucaucaagguggaguacaagggcgaggacgccccgugcaagauccccuuuagcaccgaggacgggcaagguaagucccauaacgguaggcugauaacggcaaaucccguggucacgaagaaggaagaacccgugaacauugaggccgagccgccauucggcgagaguaacaucguuaucgguauaggggacaaggcccucaaaaucaacugguacaagaagggcuccagcaucgggaaaauguuugaagcaaccgcgcggggcgcacgccgaauggccauucugggcgacaccgccugggacuucggcucagucggagguguguuaaacucauuaggcaagauggugcaccagaucuuugggucagccuacacagcgcuguuuagcggagucuccuggaucaugaaaauuggcaucggagugcugcucaccuggauuggucugaacagcaagaacaccuccaugagcuucuccuguauugugaucgguaucauaacucuauaccucggggcaguaguccaagcagauauggggugcgugaucaauuggaaagggaaggagcuaaagugcggaucggggaucuucgucaccaacgaggugcacacauggaccgagcaguacaaauuucaggcggauuccccuaagcgacuggccaccgcuaucgcuggcgccugggagaacgggguuugcggcauccgcagcacgacacggauggaaaaccuacuguggaaacagauagcaaacgagcugaacuacauccucugggagaacaacaucaagcugacugucgugguaggggacaucaucggcguccuggagcaaggcaagcgcaccuuaacgccccagccgauggagcuaaaguacucauggaaaacaugggggaaggccaagaucgucaccgcagagacccagaauagcuccuuuaucaucgacggccccaauacuccggagugcccgagcgcaucucgagccuggaaugugugggaggucgaagacuacggauuugggguguucaccaccaauauauggcucaaacuccgcgagguguacacacaguccugugaccaccgguugauguccgccgcgaucaaggacgaacgggccguccacgcugauaugggauacuggauugaaucucagaagaacgguucuuggaaacuggaaaaggccagcuuuaucgaggugaaaaccuguacguggcccaaaagccauacccugugguccaauggcguguuagagagcgacaugaucauuccuaagagccuggccggacccaucucgcagcacaaccacaggccuggcuacuauacacagaccgcugggccuuggcaucucggcaagcuggagcuggacuuuaacuauugugagggcacaacggucgugaucaccgagaacugcgggacccggggucccucccuuagaacuacgaccguuagcgguaagcugauccacgaguggugcugccgcuccugcacgcugcccccccuccguuauaugggcgaagacgggugcugguauggcauggaaauccgccccaucaacgagaaggaagagaacauggucaagucuuugguguccgcaggaucggggaagguggacaacuuuaccauggggguccugugccucgccauacuguuugaggaagugaugcgggggaaguucggaaagaagcacaugaucgcuggggcacucuucacauucgugcugcuguuauccggccagaucacguggcgcgacauggcgcacacccucaucaugaucgggagcaacgccagcgaucgaauggggaugggcgugaccuaccuggcccuaaucgccacguucaagauccagcccuuccucgcgcuugguuucuucuugcggaagcucaccucccgggagaaccugcuguugggagugggacuggcuauggccaccacccugcagcuuccggaagacaucgagcagauggccaacgggauagcccuaggccuuaugacgcucaagcugaucacccaguucgagacguaccaacuauggaccgcguuggugagccugacguguuccaacacgauauucacccugacuguggcauggcgaacggccacccucauucuggcaggggugagccuguugccguugugccaguccagcuccaugcggaagacggauuggcuuccuaugaccgucgccgccaugggcgugccgccccugccgcuguucaucuuuagccuuaaagacaccccgaagcgccgcaguuggcccuugaacgagggggugauggccguuggcuuagucucaauccuugcguccucucugcugcggaacgaugugcccauggccggaccccuggucgccgggggccuccugauugccugcuacgugauaaccgggacuuccgccgaucugaccguggaaaaggccgccgacgucacgugggaggaggaggccgagcagaccggcgucagucacaaucuaaugaucaccguggacgaugacgggaccaugcgcaucaaggacgacgagaccgaaaacauccuaacgguccugcucaagaccgcgcugcugaucguuucaggcaucuuuccuuacucuaucccggccaccuuacuuguguggcacaccuggcagaagcagacacagaggaguggaguccugugggacgugccgagcccgcccgagacccaaaaagccgagcucgaagaaggggucuaccgcaucaagcagcagggcauuuucgggaaaacacaggucggcgucgggguucagaaggagggcguuuuccacaccauguggcacgugacacgcggcgccguccugacacacaacgggaaacggcuggagcccaacugggccucugucaaaaaagaccugaucagcuauggcggggguuggcgccucuccgcgcaguggcagaaaggugaggagguccaggucauugcagucgagccgggcaaaaacccgaagaacuuccagacaaugcccggcaucuuucagaccacgaccggggagaucggagccaucgcccuggacuucaagcccggcaccuccggcagcccgaucaucaaccgggaggguaagguggugggguuauacgggaacggggucgugaccaaaaacggcggcuauguuuccggcauugcacaaacuaacgcagagcccgacggccccacccccgaguuggaggaggagauguucaagaaacggaaucucaccaucauggaccuucaccccgggucagguaagacccgcaaguacuuaccggcaaucgugcgggaggccauuaagcgccggcuucgcacccuaauccucgccccaacgcgggugguggcggccgagauggaggaggcguugaagggguuacccauccgauaccagaccacugccacgaaguccgagcacacaggucgggagauuguagaccucaugugucacgcuaccuuuaccaugcgccugcugucaccaguucgcgugccgaacuacaauuugguagugauggacgaggcgcacuucacggacccggcguccaucgccgcgcgcgguuacaucucaacacgagugggcaugggcgaagccgcggcuauauucaugaccgcgacgccucccgggacagccgaggcguucccacaauccaacgcuccgauccaagacgaggagagggacauacccgagcgcucguggaacucgggcaacgaguggaucaccgacuucguugggaagaccgugugguuuguaccauccauuaaggcggguaacgacaucgccaacugccugcgcaagaauggcaagaaggucauccagcugagucgcaaaaccuucgacacggaguaucagaagacccggcuaaacgacugggacuuugugguaaccaccgacaucagcgaaaugggcgccaauuuccgcgcugaccgggucaucgacccccgacggugccugaaacccgugauccugacggacggacccgaaagagugauccucgccggcccgaugcccguaaccgccgccucugccgcgcagcggcgaggccggguuggacguaacccccagaaagagaacgaccaauauaucuucaccggucagccucugaacaacgacgaagaucaugcccacuggacagaagccaagaugcugcucgacaauaucaacacgccggaggguaucaucccagcccuguucgaacccgagagagaaaagagcgcugcuauagacggagaguacaggcuaaagggggagucucguaagacguucgucgaguuaaugcgcaggggggacuuaccggucuggcuggcccacaagguggccagcgaggguaucaaauacaccgaccgcaaguggugcuucgacggggagcgaaacaaucagauacucgaagagaacauggacguugagaucuggaccaaagagggcgagcgcaagaagcugcgcccgcgguggcuugacgcccgcaccuacagcgacccccuggcgcugaaggaguucaaggacuucgccgccgggcgcaagagcaucgcgcuagaccucguaacagagaucgggcguguacccucgcaccucgcccaccggacccgcaaugccuuggacaaccucguuauguugcauacuucugaacacggagggcgggccuaccgccacgcggucgaggaacuaccggagaccauggagacgcuccuccugcucggccuaaugauacugcucaccgggggggcaaugcuguuccugaucagcggaaaagguaucgguaagaccagcaucggauuaaucugcgucauugugucaagugggaugcuauggauggccgacgugccccugcaguggauagcgagugccaucgugcucgaguuuuuuaugaugguccuucugauccccgaacccgaaaagcagcguacgccacaagauaaccaacucgccuauguuguaaucgguauuuuaacguuagcagccauagucgcggccaaugagaugggccuccuggagaccaccaagcgggaucugggcaugucuaaggagccggggguuguaagccccacauccuaucucgaugucgaccuacaccccgcaucggccuggacccuguaugcagucgcgaccaccgucaucacccccauguuacggcacacaaucgaaaauuccaccgccaacguaagccuggcggccauagcgaaccaggccgugguccugaugggucucgacaagggguggccuaucagcaagauggacuuaggcguuccccugcucgcccuggggugcuacagccaggugaacccacuaacccucaccgcggccguucugcuguuagucacgcacuacgcaaucaucggcccaggccugcaggccaaggcaacgcgugaggcccaaaaacggacggcugcagggaucaugaagaaccccaccguagacggcaucaugacgaucgaccuggaccccgugaucuacgacucuaaauucgagaagcaacucgggcaagucaugcugcuggugcucugcgccgugcagcuacugcuuaugcgaaccagcugggcucucugugaggcucuuacccucgccaccggccccaucacuacccuuugggagggcaguccggggaaguucuggaacaccaccaucgcggucagcauggccaacauuuuccggggcucauaccuggccggggccggccuugcguucagcaucaugaaguccguugguacaggccgccggggcacagggagucagggcgaaacccugggggagaaguggaagaagaagcugaaccagcucucgcgcaaggaguucgaccuguauaagaaaagcggcauuacggagguggaccggaccgaggccaaggagggacugaagcgcggcgaaacgacccaccacgccgucagccggggcuccgccaaguugcaaugguucguggaaagaaacauggugauaccggaaggccgcguuaucgaccugggaugcgggcggggaggauggaguuacuacugugccggcuuaaagaaggugaccgagguucgcgguuacaccaagggggggcccgggcacgaggagccggucccgaugucaacguacggauggaauaucguuaagcuaaugagcggaaaggacguuuucuaccucccgcccgaaaagugugauacccuguuaugcgacaucggcgaaaguucccccaguccaaccguugaggagagccgaacgauccgcgucuuaaagaugguggagcccuggcugaggaacaaccaauucuguaucaaggucuugaacccauacaugcccacggugauagagcacuuggagcgccuacagcgaaaguacggagggaugcuugugcgcaacccccucucccggaauagcacccacgagauguacuggauauccaacggcacugggaacauuguuagcagugucaacauggucagccgccuguugcucaaccgguucaccaugacgcacaggcgccccaccaucgagaaggacgucgaccugggcgcgggaacccgccaugugaacgcagagccugaaaccccgaacauggaugugauuggugagcggaucaagcggaucaaggaagaacacucuagcaccuggcacuacgacgacgagaauccguauaaaaccugggccuaccaugggucguacgaggugaaggccaccggguccgcuucuuccaugaucaacggcguagucaaguuacuaaccaagcccugggaugucguccccauggucacgcagauggcgaugaccgacacgaccccguucgggcagcagaggguguucaaagaaaagguggacacacgcacaccccggcccaugccgggcacccguaaagugauggaaauuaccgccgaauggcuguggaggacgcuuggccggaacaaaaagccgcgccucugcacccgggaggaguucaccaagaagguacggacgaaugccgccaugggagcgguguuuaccgaggaaaaccagugggacucggcacgggccgccgucgaggacgaagaauucuggaagcugguggacagggaacgggagcugcauaagcuugguaagugcggguccugcgucuacaauaugaugggcaaaagggagaagaagcugggugaguucggcaaagcgaaaggcucgcgggcgauuugguacauguggcugggggccagguauuuggaguucgaggcccugggcuuccugaaugaggaccacugguucucccgggagaacagcuacuccggggucgagggggaggggcuccacaagcugggguacauacuacgcgacaucucuaagauccccggcggggcaauguacgcugaugauacugcuggaugggacacccggauaacggaggaugaccugcacaaugaggaaaagaucacucaacagauggauccugagcacagacagcuugccaacgccaucuuuaagcuaaccuaccagaacaagguugucaagguucagagacccacgcccaaggggaccgugauggauauaaucagccggaaggaccaacggggcagcgggcagguggguaccuauggauuaaacacauuuacgaauauggaggcccagcuaguccgccagauggagggggaaggcguucuaagcaaggccgacuuagaaaacccccaccucuuggagaagaagaucacccaguggcucgagacaaaggggguugagagacugaaacggauggcuauaagcggcgacgacugcguuguaaaacccauagacgaccguuuugccaacgcccugcuggcccugaaugacaugggcaagguaaggaaggacaucccccaguggcagcccuccaagggauggcacgacuggcagcagguacccuuuuguagccaccacuuccaugagcugaucaugaaggauggucguaaacucgucgugcccugucggccccaagacgagcuaaucgggcgcgcccggaucagucagggcgccggguggagccugaaggagacggcaugccucggcaaggccuacgcacagauguggagccugauguauuuccaccgccgggaccugcgccucgcaaguaaugcuaucugcagugcuguuccugugcacuggaucccuacuucccgaaccaccuggaguauucacgcacaucaccaguggaugacgaccgaagacaugcugaccguguggaaccgcguuuggauugaagacaacccauggauggaggacaagacgcccgugacgaccugggaggacgugcccuaccugggcaaaagggaagaccaguggugcgggucacuaaucggccugaccagccgugccacaugggcacaaaacauucuuacagcaauucaacaaguccguucccuaauuggagaugaggaguuccuggauuacaugcccucgaugaagcgauuucggaaggaggaagaguccgagggcgccaucugguaa

SEQ ID NO: 25776 - RNA, 9873 nt, Artificial Sequence
  derived and/or modified CDS sequence (opt11) from DENV-3__GQ868629__SS-prME
acuagccuaugccucaugaugauguugcccgccacccuggccuuucaccucaccagcagagacggcgagccccguaugaucguggguaagaacgagcgaggcaaaagccugcuguucaaaacugcgagcgggaucaacaugugcacccuaauagcuauggaccugggcgagaugugcgacgacaccgucaccuacaagugcccuuuaaucgcggagguggagccugaagacauugauugcugguguaacuugaccagcaccugggugaccuacgggacgugcaaccaggcuggcgagcaccguagagacaagagguccguugcccuggcgccacacguggggaugggacuggacacccguacucagacuuggaugucugcagagggcgcauggaggcagguugagaaggucgaaaccugggccuugcgccacccgggguuuaccauauuggcacucuuccucgcccacuacauaggcacuucccugacccagaaaguggucaucuucauccuucucaugcuggucacgcccagcaugaccaugcguugcgugggggugggcaaccgcgacuucguugaagggcuguccggggcgaccuggguggacguaguucuggagcacggagguugcgugaccacaauggccaagagcaagcccacacucgacaucgagcugcagaagacugaggcaacccagcuugcgacgcugcguaagcugugcauugagggcaaaaucacaaauaucaccaccgacucccgcugcccgacgcagggggaggccacacucccggaggagcaggaucagaacuaugugugcaagcauaccuacgucgaucgggggugggguaacggaugcggccuguuugguaagggaagccuagugacaugcgccaaguuccagugccucgagcccaucgagggaaaggugguccaguacgagaacuugaaguauacggugaucaucaccgugcacaccggggaucaacaccaggucggcaacgauacccaaggcgugacggucgagaucacgccccaagccuccaccguggaggccgugcuccccgaguacggcacauuggggcuggaaugcagcccgcgcaccggccuagacuucaacgaaaugauacuccugacuaugaagaauaaggcguggaugguccaucggcagugguucuucgaccugccccuaccguggacguccggggcuauuaccgagacccccacguggaaccgaaaggagcuguuggugaccuucaaaaacgcccacgccaagaagcaggagguggucgugcucgggagccaggagggcgccaugcacaccgcacugacaggggccacugaaauccaaaacuccggcgggaccucgaucuuugcgggacaccugaagugccggcucaaaauggacaaguuagagcugaaagguauguccuacgccaugugccucaacacuuuugugcugaagaaggagguaucggagacacagcacggcacgauccuuauaaagguggaguacaaaggcgaggacgccccgugcaagaucccauucagcacugaagacgggcaaggcaaagcgcacaacggucgcuuaaucacugcuaaccccguggucaccaagaaggaggagccggugaauaucgaggccgagcccccauucggggagucgaacaucguaaucggcaucggcgauaaagcccucaagaucaacugguacaagaagggaaguuccaucggcaagauguuugaggcgacggcccgaggcgcccgccggauggccauccucggcgauacggcuugggauuuuggcagcgucgggggugugcugaacucccucggcaagauggugcaucagauauucggaagugcguacaccgcccuguucuccggcgugagcuggauaaugaagauuggcauaggagugcugcucaccuggaucggccugaacucuaagaacacaagcaugucauucucgugcaucgugaucgggaucauuacccuguaccucggcgcggugguccaggccgacauggggugcgugaucaacuggaaggggaaggagcugaaaugcggguccgggauauucgucaccaacgaggugcacaccuggacggaacaauacaaguuccaggccgacagucccaagagacuagcgaccgccaucgccggagccugggagaacgguguguguggcaucaggucaaccacucggauggagaaccuccuguggaagcagaucgccaacgagcucaacuacauccugugggagaacaacaucaaacugacgguaguagugggggacaucauaggugucuuagaacaagggaagcgcacgcugacuccucagccgauggaacugaaguacagcuggaagaccugggggaaggcgaaaauugucacagccgagacacagaacucuagcuucaucauagacgggcccaacacuccugaaugcccuagcgcgagccgcgcauggaacgugugggaagucgaagauuacggcuucggcgucuucaccacaaauaucuggcucaagcucagggagguguacacccagagcugugaccaucggcuuaugucggcggcuaucaaggacgagcgugccguucaugcagacaugggcuacuggaucgagagccagaaaaacgggucauggaaacuggagaaggccagcuuuaucgaggucaagaccugcaccuggccgaagucccacacccucuggucaaacgggguguuggaguccgacaugaucauccccaagucucuggcuggcccuauuagucagcauaaccaccggccaggcuaccauacgcaaacggcggggcccuggcaucucggcaagcuggagcuagauuucaacuacugcgaggguaccacggucgugaucacggaaaacugcggcacgcgcgggcccagccuccggaccaccacggugucggggaagcucauccaugagugguguugucgcagcugcacccugcccccacugcgguacaugggcgaggaugguugcugguacggaauggagauucgccccaucaacgagaaggaagagaacauggucaagucccuggugucugccggcucagggaaaguggacaacuucacaaugggaguccugugccucgccauccuguucgaagaaguaaugcggggcaaguucgguaagaagcacaugauagccgggguguuguucacguuuguccuucuacugucuggccaaaucacauggcgagauauggcucauacccucauaaugauuggcuccaacgcuucggaucggaugggaaugggcgugacguaucuggcccugaucgccaccuucaaaauucagccuuuccuagcccugggauucuuccugcgcaaguuaacaaguagagagaaucugcugcuugguguaggucucgcaauggccaccacauuacagcuaccugaggacaucgaacaaauggccaacgguauugcccuuggcuugaugacccugaaacugaucacgcaguucgagaccuaccaguuguggaccgcucucguguccuugaccugcagcaacacgauauuuacccugacuguggcauggcgcaccgcgacgcucauauuagccggcgucagccuguuaccgcugugccagagcuccagcaugaggaaaaccgacuggcugccaaugaccguggcugcgaugggcgugccuccccuuccgcuguucauauuuucccugaaagacaccccaaagcgucgcagcuggccccucaacgagggggugauggcaguggggcugguguccauccuggccuccucccuccuacggaaugauguccccauggcaggcccgcuggucgccggaggguuacugauagccuguuaugugauuacggguacgagcgccgaccugacagucgagaaggccgccgacguuacaugggaggaggaggccgagcagacgggcguuucccacaaucucaugaucaccgucgacgacgacgggaccaugcgcaucaaggacgacgagaccgagaacauccugacuguguuacucaagacagcccuacugaucgugagcggcaucuucccguacuccauccccgccacacuccuggucuggcauaccuggcaaaagcaaacgcaacggaguggcguacugugggacgugccaagcccgcccgagacgcagaaggccgaguuagaggagggggucuaucgcaucaagcagcaaggcaucuuugggaagacccagguuggcguggggguccaaaaggagggcguguuccacaccauguggcacguuacccggggugcuguccugacgcauaaugggaaacgucuggaaccaaacugggcgucugucaagaaggaccuuauauccuacggcgguggcuggcggcuuuccgcgcaguggcaaaagggggaagaagugcaggucaucgcuguggagccuggcaagaacccuaagaauuuccagaccaugccaggcauauuccagacuaccacgggugagaucggcgccaucgcccuggacuucaagcccgggaccaguggcuccccgaucauaaaucgagagggaaaggugguagggcuguaugggaacgggguagugacaaagaacggggguuacgucagcggcauagcucaaaccaaugcagaacccgacggacccacgcccgagcuagaggaagagauguucaagaagcggaacuuaaccaucauggaccugcacccgggaagcggcaagacccggaaguaccuccccgccaucgugcgggaggcuaucaaacgacggcugcgcacccugauucuugcgcccaccagaguggucgcggcagaaauggaggaggccuuaaagggccugccgauccgcuaucagaccaccgccaccaagagcgagcacaccggccgggagauugucgaccugaugugccacgcgaccuucaccaugcgccuccuguccccgguucguguucccaauuacaacuuaguuaucauggacgaggcacacuuuacagauccugcaagcaucgccgcaaggggcuacaucuccacgcgggugggcaugggagaggccgcggcuaucuucaugacagccacgccgccggggaccgcggaggcuuucccccagagcaaugcccccauccaggacgaggaacgcgacaucccugaaagaaguuggaacagcggcaacgaguggaucacggauuucguagguaagaccguaugguucguacccuccauaaaggccggcaacgauauagccaacugccugagaaagaacgggaagaaagugauccagcugaguagaaagacguuugacacugaguaucagaagaccagacuuaacgacugggacuucguggugaccaccgauauuuccgagaugggcgccaauuucaaggcugaccgaguaaucgaucccaggcgcugucugaaacccgugauucugaccgacggucccgagaggguuauccuugcaggucccaugcccgucacggcugccagcgccgcacagcgccggggccgcguuggccggaauccacaaaaggagaacgaccaguauauuuucaccggccagccccuaaacaacgaugaggaccaugcccauuggaccgaggccaagauguuacucgacaacaucaauacuccugaggggaucaucccggcccuguucgaaccggagcgcgaaaaaucagcagcuaucgauggagaauaccggcugaagggcgaaagccggaagacuuucgucgaguugaugcggagaggggaccuccccguguggcuggcgcauaagguggccucugagggcaucaaguacaccgaucggaaguggugcuucgauggggaaaggaacaaccagauacuggaggagaauauggauguagaaauauggaccaaggagggugaacggaagaagcugcgcccgcgcuggcuggacgccagaacuuauucggacccccucgcgcugaaagaguuuaaggauuucgccgcgggcaggaaaaguaucgcuuuggaccucguaacagagaucgggcgggugccuagccaccuggcccaccgcacccgcaacgcgcuggacaaucuggucaugcugcauaccucugagcauggagggcgcgccuaucggcaugcaguggaggagcuaccggagaccauggaaacccuccuacugcucgggcugaugauucugcuaaccggcggggccaugcuguuccugaucuccgggaagggaauugggaagaccucgaucgggcuuauuugcgugaucguuagcagcggcaugcuguggauggccgacgugcccuuacaauggaucgcguccgccaucguguuagaguucuucaugauggugcugcuuaucccagaacccgaaaagcagcguaccccgcaggacaaucaauuagccuauguuguuaucgggauacugacccuugcugccaucguagcggcuaacgagaugggccuccuagagacgacaaagcgggacuuaggaauguccaaggagcccgggguagugucacccacaagcuacuuagacguggaccugcacccugccuccgcguggacccuguacgccguggcgacaaccguaaucaccccgaugcucaggcacacaauugagaauagcaccgcaaacgucucccuugcagcuaucgcaaaucaagccguugugcugaugggccucgauaaggguuggcccauuucgaagauggaccugggcguaccacuguuagcacugggcugcuacucccaggugaacccccugacccucaccgccgccgugcugcuucucguaacucacuacgccaucaucggcccgggucugcaggccaaggccacacgggaggcgcagaagaggaccgcagcugguauuaugaagaacccuaccguggacggcaucaugaccaucgaucuggauccugugauuuacgauaguaaguucgagaagcaacucgggcaggucaugcugcugguucucugcgccguucaacuguugcugaugcguaccuccugggcccugugcgaagcccuuacccucgcuaccggcccgaucaccacgcugugggagggcagcccgggcaaauucuggaacaccaccaucgcgguuucgauggccaacaucuuccgcggcagcuaccuggccggggccggccucgcguuuuccaucaugaagucagucggcaccggucgucgcggcaccgggucccagggcgaaacucugggcgagaaguggaagaaaaaguuaaaccagcuguccaggaaagaguucgaccuuuauaagaaguccggcaucaccgaaguggacagaaccgaagcgaaggaagggcuaaagagaggcgagacuacacaccacgccgugucucgaggcagcgccaagcuccagugguucguggaacggaacauggugauucccgaggggcgcguaaucgaccuggggugugggaggggagggugguccuacuauugugcuggccuuaagaaggucaccgaggugcggggcuacacgaagggcgggcccgggcacgaggagcccgucccaaugagcacauacggcuggaacauugugaaguuaaugucagguaaggacguguucuauuugccacccgagaaaugcgacacgcugcuaugcgacaucggcgaauccuccccuagcccgacagucgaagagucgcgcaccauacguguacucaagaugguggagcccuggcuuaggaacaaucaguucugcaucaagguccugaaccccuacaugcccaccgugaucgagcaccucgagcggcugcagcgcaaauaugguggaaugcugguaaggaacccguugagucgcaacuccacccacgaaauguacuggaucaguaacggcaccgggaacaucgucuccuccgucaacauggugucccggcugcuacuuaaccgcuucaccaugacccaucgccgcccgacuauugaaaaagauguugaccugggcgccgggacgcgucacgugaacgcagagcccgaaaccccgaauauggacguaaucggcgagcgcaucaagcggaucaaggaggagcauaguuccacguggcacuaugacgacgagaaccccuacaagacgugggccuaccacggcagcuacgaggugaaggccaccggaagcgccuccagcaugaucaacgggguugucaaguugcugacuaaacccugggacguggugccgaugguuacacagauggcgaugacggauaccacaccauucggucaacagcgcguguucaaggagaagguggacaccagaacgccccgccccaugccaggcacucgcaaggucauggagauuaccgcugaguggcuguggcgcacccuggguaggaacaagaagccgagauugugcacgcgcgaggaguucaccaagaagguucggacuaacgccgccaugggggcggucuucacugaggagaaucagugggacuccgcacgcgccgccgucgaggacgaggaguucuggaagcugguggaccgcgagcgcgaacuccacaagcucgggaaaugcgggucaugcguguauaacaugauggggaaacgggagaagaaauuaggagaguucgggaaagccaagggcuccagggcgauuugguacauguggcuaggggccagauaccucgaauuugaggcguuaggguucuugaacgaggaucacugguuuucacgcgaaaauuccuacucaggggucgaaggcgaaggguuacacaagcugggauacauacuccgcgacaucuccaaaauccccggcggggccauguaugccgacgacacggcgggcugggacacccgcaucaccgaggaugaccuccauaacgaggagaagauuacccaacaaauggaccccgagcaccgacagcuggccaacgccauuuucaagcucacauaccagaacaagguggugaagguccagcgacccaccccgaaggggacagugauggacaucaucagcagaaaggaccagcgcgggagcggccagguagggacauacgggcuaaacaccuuuacuaauauggaggcucagcuuguccgccagauggaaggggaaggggugcuguccaaggcugaccucgagaacccucacuugcuggagaaaaagaucacccaauggcucgagacgaaagggguggagcgcuugaagaggauggccauuuccggcgacgacugcgucgugaagcccaucgacgaccgguuugcaaacgccuugcucgcguugaacgauaugggcaagguccgaaaggauaucccccaguggcaaccaagcaagggguggcacgacuggcagcagguccccuucugcucccaucacuuccaugaacugaucaugaaagacggcagaaaguuaguggugcccugcaggccccaagacgaacugaucgggcgggccaggaucagccagggcgcggggugguccuuaaaggagacagccugucucggaaaagccuacgcccagauguggucucuaauguacuuccaccggcgugaucuuagacuagccucaaacgcgauuugcagcgcugugccgguccauuggauuccaaccucgagaaccacuugguccauccaugcccaccaccaguggaugacuacggaggacaugcugacgguguggaaccgggucuggaucgaggacaaucccuggauggaggacaagaccccugugaccacgugggaggacguucccuaccuugggaaacgcgaggaccaguggugcgggagucucaucggccugacuucacgggccaccugggcgcaaaacauucugaccgcaauucagcaaguacgcagccucauuggcgacgaagaguuccuggacuacaugcccucuaugaagcguuuccgcaaggaggaggagagcgagggcgcuauuugguga

SEQ ID NO: 25777 - RNA, 9873 nt, Artificial Sequence
  derived and/or modified CDS sequence (opt11) from DENV-3__FJ639728__SS-prME
acaucucugugccugaugaugauguuaccagcaacacuggcauuccaccucacaucaagagauggggaaccgaggaugauagucggcaaaaacgaacgaggaaaaucccucuuguucaaaacugcgagcgggaucaacaugugcacauuaauugcgauggaccuuggcgaaaugugcgaugauacggucaccuauaaauguccgcucauagccgaaguugaaccagaagacauagacugcugguguaaucuaacauccaccuggguaacuuacgggaccugcaaucaggcaggagaacaucggagggacaaacgcagcgucgcgcuagcgccgcacgucggaaugggacucgauaccagaacgcaaacauggaugagugcggagggggccuggcggcaaguagaaaaaguggagaccugggcuuugcgucauccggguuucacgauucucgcccucuuucuggcucacuauaucgggaccucgcugacacagaaaguaguaaucuucauacuccucaugcuugugacaccguccaugacuaugcgcugcguaggcgucggcaaccgggauuuuguggaaggacucagcggggccaccuggguggacgugguacuugagcauggagggugcguaaccacaauggccaaaagcaaacccacgcuagacaucgaacuccagaagacggaagcaacacagcuagccacccuaaggaaauuauguauagagggcaagauaacgaacauaacaaccgauaguaggugcccaacccaaggugaggcgacacucccggaagaacaagaccaaaacuauguuugcaagcacacauacguagaccgaggguggggaaauggaugugggcuuuucgggaaaggaucccuggugacaugcgcgaaguuccagugccuggagccgauagaggggaaggugguucaauacgaaaacuuaaaguacacggugauaaucacuguacacaccggagaccagcaucaaguaggcaacgauacacagggggucacggucgaaaucacaccccaagccagcaccgucgaggcaguacucccagaauacgguacucuggggcuagaguguuccccucgcacgggauuggauuucaacgaaaugauccugcucacaaugaaaaacaaggccuggaugguacaccgacaaugguucuucgaucuaccgcugcccuggacgagcggagcaacaaccgagaccccaacauggaauagaaaggaacuauuaguaaccuuuaaaaacgcccaugcuaagaagcaggagguaguggugcucgggucacaggaaggcgcuaugcauaccgcacucacaggagcuacugaaauacaaaacagcggcggaacaagcaucuucgccggacaccuaaaaugccggcugaaaauggacaagcuagaacugaaaggaaugucguaugccaugugccugaacacguuuguccuuaagaaggaaguaagcgaaacucaacauggcacaauacuaauaaaaguugaauacaagggcgaagaugcacccugcaagaucccguuuucaacagaagauggacaaggaaaagcgcacaauggcagacuaaucacagcgaaccccgugguaacaaagaaggaagaacccguaaacaucgaggcugagccaccuuucggcgaauccaacauugucauaggaauuggcgacaaggcccugaaaauuaacugguauaagaaaggcagcucaauugggaaaauguucgaagcaacugcgagaggugcgaggcggauggcaauccucggcgacacggccugggacuucggauccgucggaggaguacuuaacucccucggaaagaugguacaccaaauuuucggaucagcguacaccgcacuauucuccggaguaucauggauaaugaagauaggaauuggaguacuccuaacuuggauugggcuaaacucaaagaacacgagcaugaguuucagcugcaucgucauagguauaauuacgcuauaccuuggcgcagucguacaagcggacaugggaugcguuaucaauuggaaagggaaggagcuaaaaugcgggaguggcauauucguuacgaacgaaguccacacuuggacggaacaauacaaauuucaagcggauucacccaagcgacucgcaacugccaucgcgggagccugggagaacgggguuugcgggauuagaucaacaacaaggauggaaaaccucuuguggaaacaaaucgcaaacgagcuaaacuauauccuuugggagaauaacaucaaauugaccgucgucgucggagacaucaucgggguacuggagcaagguaaacgaacucucacaccccaaccgauggaacuaaaauacaguuggaaaacauggggcaaagccaaaaucgugacggcagaaacacaaaacagcucuuuuauaauagacgguccuaacacuccugagugcccaagcgcgcucagggcguggaacgucugggaagucgaggacuacggcuucggcguuuucaccaccaacauauggcuaaaacuacgggaaguauacacccaaucaugcgaccaccgacuuaugagcgccgcgaucaaagacgaaagagcaguccacgcugacaugggauauuggauagaaucucagaaaaacggcucauggaaacuagagaaggcuucguuuauagaagucaaaacaugcaccuggccuaaaucacacacccuguggagcaacggcguccuugagucggacaugaucauaccgaaaagccuugcggggccaaucucacagcacaaccaucggcccggauaccacacgcagacagcuggcccguggcacuuaggaaaacucgaauuagacuuuaacuacugcgaggggacgacggucgucauuaccgagaacugugggacgcgcggaccgagccuuaggacgaccaccguguccggaaaacucauacacgaauggugcugccgaagcugcacacuacccccacuacgguauaugggcgaagacggaugcugguacggaauggaaauacgacccaucaaugaaaaggaagagaauauggucaaaagccuggucuccgcagguucuggcaaggucgauaacuuuacgaugggcgugcugugccuggcuauacuguucgaagaagucaugagggggaaauucgggaagaaacauaugauagcaggaguccuauuuacauucguauugcuuuuaagcggccagauaaccuggcgcgacauggcccacacguuaauaaugauaggcagcaacgcauccgaccgcaugggcaugggcguaaccuaccuagcgcuuaucgcgaccuucaagauacagcccuuucuugcucucggguucuuccuuagaaagcucaccagccgcgaaaaccugcuacuaggagucggacuggcgauggcgacuaccuugcaacugccggaagauaucgaacagauggccaacggaauagccuugggcuuaaugacacuaaaacugauaacccaauuugagacauaucaguuguggacggcgcucguaucgcugacaugcagcaacacgaucuucacgcuuaccgucgcguggcgcacagcgacgcuuauacuagcaggagugucacugcuaccgcucugccaguccagcucaaugcgcaagacagacuggcucccaaugacagucgcggcuauggggguaccgccccuaccccucuucaucuucucccugaaagacacacccaaaaggagguccuggccgcuaaacgagggagugauggccguggggcucguaagcauacuagccaguucacuacuccguaacgacgugccaauggccgggccacuugucgcaggaggccuccugauugcaugcuauguuaucacaggcacgagcgcugaucucacuguugaaaaggcagcagacgucaccugggaggaggaagcugaacaaaccggggucucacacaaccugaugauaacgguugacgacgaugguaccaugaggaucaaagacgaugaaacagaaaacauccuaacggugcuccucaaaacagcccuacuuauuguuaguggcaucuuuccauacuccaucccugcaacguuacucgucuggcacacuuggcaaaagcaaacacagaggagcggcguccuaugggacgugccaagucccccagagacgcagaaggccgaacuggaagaggggguauaccgaaucaaacagcaaggaaucuucgggaaaacgcaaguaggugugggagugcagaaggaaggugucuuccacacaauguggcacguaacacggggagccguacuuacgcauaacgggaagaggcuagagcccaacugggcauccgugaagaaagaccucaucuccuacggaggaggauggaggcucuccgcgcaguggcaaaagggggaagaaguucaggugaucgcaguagaacccggaaagaacccgaagaacuuccagaccaugcccgggaucuuccaaacaacuacaggagagaucggggccauugcccuugacuuuaagccugguacaagcggcagcccgauaauuaaucgagagggcaaagugguggggcucuacggaaauggaguuguaaccaaaaacggcggguacgucagugguauagcgcaaaccaacgccgaaccagacggacccaccccagaauuggaagaggaaauguucaagaaacgcaaccugacgauaauggaccuacacccugggagcgggaaaaccaggaaguaccuccccgcuauuguucgcgaagccauaaaaagacgacucaggacgcugauuuuggcgccaacucgaguuguagcagccgagauggaagaggcucugaaagggcucccgauacguuaccaaacaacugcaacgaaaagcgaacacacugggcgcgagaucguggaccucaugugucacgccacauucaccaugagacuccuauccccugugcggguccccaacuauaacuuaguaauaauggaugaggcucauuuuacagacccugcgagcauagcugcgcgaggauacauaucgacccgagucggcaugggagaggcggcagcaauuuucaugacggcaacaccaccaggaacugccgaagccuucccacagagcaacgcaccaauccaagaugaagaacgugacauccccgagcggucguggaacucuggaaacgaauggaucacggacuucgugggaaagacugucugguuuguccccucuaucaaggccggcaacgauaucgccaacugucuaaggaaaaaugggaagaaagugauacaacucagccggaaaaccuucgacacggaguaccagaagacccgacuuaaugauugggacuucgucguaacgacagacauuucagagaugggagccaacuucaaagcagauagggugauagacccgcgucgcugcuuaaaaccagugauacuaacggacggacccgaacgcgucauacuagcggggcccaugccggugacagcggccagcgccgcacagaggcgagggagaguuggccggaauccgcaaaaggagaacgaccaauacaucuucacgggccagccccuaaacaacgacgaagaucacgcacacuggacggaagcaaagaugcugcucgacaauauuaauacgccugaggggauaauaccggccuuauucgagccagagagggaaaaguccgccgcgaucgacggcgaguaccgacucaagggagaaucgcgcaagacguuuguagagcuaaugagacgcggcgaccuaccaguauggcuagcacacaaagucgcguccgaggguaucaaauacacagaccggaaguggugcuucgacggagaacgcaauaaucagaucuuagaagagaacauggauguagaaauauggacaaaggaaggcgaacgaaagaaauuaagaccaagguggcuagaugcaaggacauauagcgacccgcucgcucuaaaagaauuuaaggacuucgccgccggacguaaaaguauagcauuagaccuagugacugaaauagggcguguaccaagccaccuagcacacaggacgcgaaacgcucucgacaaucuggucaugcuccacacgucggaacacggaggccgagccuauagacacgccgucgaggaacuucccgagacuauggaaacccuccugcuucucggguugaugauccugcuaacgggaggcgccauguuauuccucauuuccgggaaagggaucggaaaaacgaguauaggacucaucugcgucauagucagcagcggaaugcuauggauggcggacgugccccuccaauggauagccucagcgauuguccuagaguucuucaugaugguacuucuaaucccugaacccgaaaaacaacgcacaccacaagacaaucaacuagccuacguagucauuggaauacucacguuagcggcgauaguggcagccaacgagaugggauuacuagaaacaaccaaacgggacuuagguaugagcaaagagcccggcgucgucucgcccaccuccuacuuggacguagaucuacaccccgccagugcauggacucuauacgcaguugccaccacgguaauaacuccgaugcuaagacacacaauagagaacaguacugcaaacguaagccucgccgcuauagcaaaccaagcggucgucuuaaugggacuggauaagggcuggccaauaaguaaaauggacuuaggcgugcccuuacuugccuugggguguuacagccagguaaauccgcuaacacucaccgcggcggugcuucugcuuguaacccacuacgcaauaaucggccccggguuacaagcaaaggcgaccagagaagcacagaagcgcacagcugccgggaucaugaaaaaucccacggucgauggcauuaugaccaucgaucuagaucccgugauauacgacagcaaauucgagaaacagcucgggcaagucaugcuucucguucucugugcgguucagcuacuguuaaugaggacaucaugggcccuaugugaagcgcucacccucgcgacggggccaauaacaacgcugugggagggaucucccggcaaauucuggaauacgacgaucgcagugucgauggccaacauauuccgcggaucguaccuagcgggagcgggacuggcguucagcauaaugaaaagcguggggacagggcgucggggaaccggcucgcagggcgagacauuaggugaaaaauggaagaaaaagcuaaaccagcucagcagaaaggaguucgaccucuacaaaaagagugggaucacagaaguagaccgcacggaagcgaaagaaggucuaaaaaggggagagacgacccaccaugcaguaaguagaggguccgccaaauuacaaugguucguagagcgaaacaugguaauccccgagggaagaguuaucgaucucggaugcgguagagggggauggucuuauuacugcgcaggccucaagaaaguaacggaaguccgaggguacaccaagggcggaccgggccacgaggagccggucccgaugucgacguauggguggaauaucguaaagcuaaugagcgguaaagacguguucuaucuaccacccgagaagugcgauacguuauuaugcgauauaggugaaagcucgccgucucccacgguagaagagucgcgcacaauccggguccuaaaaaugguagaacccuggcuacgcaacaaccaauucuguaucaaaguacuaaacccguacaugccuacuguaauagagcaccuagagcgccuacaacgaaaguacggagggaugcucguccguaacccgcuauccaggaacucgacccacgaaauguacuggauuaguaacgggacagguaacaucgugagcaguguuaacaugguaucacgacuauugcugaaccgauucacgaugacacaccgacgcccgacgauagagaaggacguggaccugggagcggguacacgccacgugaacgcggaacccgagacgccaaauauggacguaaucggggaacgaauaaaacgaaucaaggaagaacacuccucaacguggcacuacgacgaugaaaauccauacaaaaccugggccuaccacggcagcuacgaggucaaagccacgggauccgcauccaguaugaucaacggagucguuaaauugcucacaaagccaugggaugucguacccauggucacacagauggccaugaccgauacaacaccguucggucagcaaaggguauuuaaagaaaaaguugacacacggaccccgcgcccaaugccgggaacaagaaagguuauggaaauaacagccgaguggcucuggcgcacgcucggccggaauaagaaaccgaggcucuguacccgggaggaguucaccaagaaagugcgcacgaaugccgccaugggggcuguauucaccgaagaaaaucaaugggacagcgcgcgagcggcgguggaagacgaggaguuuuggaagcuaguggaucgggaacgagaacuccauaagcuaggcaaauguggaagcugcguauauaacaugauggguaagagggagaagaaacuaggagaauuuggcaaagcaaaaggguccagggcaaucugguacauguggcugggggcacgauaccuggaguucgaagcccucggcuuccuaaacgaagaucacugguuuucgcgggaaaauuccuacucgggugucgaaggcgaagggcugcauaaacucgguuauauccugagggacaucagcaagauuccagguggggccauguacgcagacgacacugccgguugggacacgaggaucacggaggacgaucuacacaacgaggaaaagaucacccaacagauggaccccgaacaccgacaacucgcaaacgcaaucuucaaacucaccuaccaaaacaagguaguaaaggugcaaagaccuacaccuaaaggaaccgugauggacauaauaucacgaaaggaccaacgagggucgggccaagucggaacuuacggccuuaacacguuuacuaauauggaagcacaacugguacgccaaauggaaggagaaggcguacuuucgaaagccgaccuagagaacccccaucugcuggaaaagaaaauaacgcagugguuagagaccaaggggguggagagacugaagaggauggcgauaucaggugacgacugcgucgucaagcccauagacgaccgcuucgcaaacgcgcuccuagcccugaacgacauggggaaaguaagaaaagacaucccgcaguggcaaccaucaaaaggcuggcacgacuggcaacaagugcccuucuguucacaccacuuccacgaacugauaaugaaggacggccguaaacucguaguacccugcagaccgcaagacgaacuaauaggcagggcccgaaucucccaaggcgcaggguggucacugaaagaaacggccugcuuaggcaaagccuacgcucaaauguggucacucauguacuuccacaggcgagaccuacgucuagccagcaacgcaauuuguucugcagugccaguacacuggauaccgacaucaagaaccacguggagcauucaugcccaccaucaauggaugaccacugaggauaugcuaacugucuggaacagaguauggauagaagacaacccguggauggaagacaagacaccugugacaacaugggaagaugugccauaucuaggaaaacgcgaggaucaguggugcggcagucucaucggccucaccagcagagcaaccugggcccaaaacauuuugacggcaauccaacaggucagaagucucaucggggaugaggaguuccuagacuauaugcccucaaugaagcgcuuuagaaaggaagaggaauccgagggggccaucugguag

SEQ ID NO: 25778 - RNA, 9873 nt, Artificial Sequence
  derived and/or modified CDS sequence (opt11) from DENV-3__FJ639729__SS-prME
accagcuuaugccucaugaugaugcugcccgccacccuggccuuccaccucacgucgagagacggcgagccccggaugauugugggaaagaaugagcgcgggaagagcuugcuguucaagacagcgagcgguauaaauaugugcacccucaucgccauggaucugggcgaaaugugcgacgacacgguuaccuacaagugcccccugaucgccgagguggagccggaagauaucgauugcuggugcaaucucacaucgaccugggucaccuacggaacgugcaaccaggccggugagcaucguagggacaagcggagugucgcccuggcgccccacgugggcaugggacuggacacucgcacccagaccuggaugagcgcagaaggcgccuggcgucagguggagaaggucgaaacgugggcccuccggcacccgggauucaccauccuggcccuguuucuugcccacuacauaggaacuuccuuaacacagaagguggucaucuucauccugcucaugcuggucacacccagcaugaccaugcggugcguugggguaggcaaccgcgacuucgucgaaggauugucaggagccaccuggguagaugugguucuggagcacggcgguugugugacuacaauggccaagagcaaacccacucuggauaucgagcugcagaagaccgaggccacgcagcucgcgacgcugcggaaguuguguaucgagggcaagauuaccaacauuaccacggacagucgcugccccacacaaggcgaggcgacccucccggaggagcaagaccagaauuaugugugcaagcacaccuacguggacagagggugggguaacggauguggguuguuugggaaaggcagccucgugacaugcgccaaguuccagugccucgagcccaucgagggaaaggugguccaguacgagaaccugaaauacaccguuaucaucacugugcacaccggggaccaacaucaaguaggcaacgacacccaaggcgugacggucgagaucacuccccaagcaucgaccguggaggccguccuccccgaguacggcacacucgggcuagagugcagcccgcgcaccggccuggacuuuaacgagaugauacucuuaacgaugaagaauaaggcauggaugguccaccggcagugguucuucgaccugccucuccccuggacuucgggugccaucaccgagacccccacuuggaaccguaaggagcuacucguaacguucaagaaugcccacgccaagaagcaggaaguugucgugcuugguucucaagagggcgccaugcacaccgcacugacuggggccacggagauacagaacuccggcgggaccagcaucuuugccggccacuugaagugucggcuuaagauggauaagcuggaguuaaaggggauguccuacgcuaugugucuuaacacguuuguccugaagaaggaagucagcgagacgcagcacgggacgaucuuaauaaagguggaguauaaaggcgaggacgcccccugcaagauccccuucucgacugaggacgggcagggcaaggcgcacaacggccgccugauuaccgcgaaccccgucgucacuaagaaagaagaacccgucaauaucgaggccgagccgcccuucggggaguccaacauaguuaucggcauuggggauaaggcguuaaagauaaacugguacaagaagggcagcuccaucgggaagauguucgaggcaacggcccggggcgcccggcggauggccauccugggggacacagccugggacuucggaagcgucggcggggugcugaacucccucggcaagauggugcaucagaucuucgggagcgcguacacagcccuguucuccggggucagcuggaucaugaaaauuggcaucggggugcuguuaacuuggaucggacugaacuccaagaacacgagcauguccuucagcugcaucguuaucgggauuaucacauuauaccucggugcugucgugcaagccgacaugggcuguguuauuaacuggaaggguaaagagcuuaaaugugggucagggaucuucgugaccaacgaggugcacaccuggacggagcaguacaaauuccaggccgacagucccaagcgccuagcaacggccaucgccggggccugggagaacgggguguguggcaucagaucgacgacccggauggagaaucuacuguggaaacagaucgccaacgagcugaacuacauccugugggaaaacaacaucaagcugacggucguggugggagauaucaucggcguacuggagcagggcaaacgcacucugacgccccagccaauggagcugaaauacagcuggaagaccugggggaaggcuaagaucgugacggccgagacucagaacagcagcuucaucauugacggucccaacaccccggagugcccauccgccagccgugcauggaacguuugggagguggaggacuacggguucgguguguucaccacgaacaucuggcugaagcuuagggagguguacacccagaguugcgaccaccgacugaugucagcggcgauaaaggacgagcgcgcggugcaugcugacaugggauacuggaucgagagccagaaaaauggcucguggaagcuggagaaagcaucauucaucgaggugaaaaccugcaccuggccgaagucucacacacucuggagcaauggcgugcuggagagugacaugaucauccccaagagucuggcgggccccaucucacagcacaaccaccggccgggauaccacacucagaccgcugggccauggcaccucggcaagcuggagcuggacuucaacuacugcgagggcaccacugucgucaucacggagaacugcgguacccgcggacccagccucagaaccaccacggugagcgggaagcugauccacgaauggugcugucgcagcugcacccugcccccacuccgcuacaugggugaggaugggugcugguacggcauggagauccggccaaucaaugagaaggaggagaacauggucaaaucauuagugagcgccggaucugggaagguagauaacuucaccaugggcgugcugugccuugccauccuguuugaagaggugaugagagggaaauucggcaagaagcacaugaucgcugggguucuuuucaccuuuguccugcugcugagcggccagaucacguggcgcgacauggcucacacccucaucaugaucggcuccaacgccagugaucggauggggaugggagugaccuaucuggcccugauugccaccuuuaaaauccagccauuccucgcccuggguuucuuccugcgcaagcucaccagcagggagaacuuacugcucggcguaggccuagcuauggccaccaccuuacaacuccccgaggacaucgaacagauggcaaacgggaucgcccuaggccugaugacccucaagcucaucacccaguucgagaccuaccagcuguggaccgcacucguuucccugaccuguaguaacacgaucuucacccugaccgucgcguggcgcaccgccacgcucauacuggccggggucucccucuugccgcuuugccagagcuccucuaugcgaaagaccgauuggcugcccaugaccguggccgcgaugggcgugccgccacugccacuguucaucuucagucugaaagacacccccaagcgccgcagcuggccccucaacgagggggucauggccgucggccuggucuccaucuuggcuagcucacucuuaaggaacgacguuccuauggccggcccgcugguggccgggggguuacugauugcuuguuacgugaucacggguacuagcgcugaccugacggucgagaaggcagccgaugugacuugggaggaggaagcggagcagacgggcgucucccacaaccucaugaucacugucgacgacgacggcacuaugcgcauaaaggaugacgaaaccgagaacauccugaccgugcugcucaagacggcgcugcuaaucgugagcgggaucuuccccuacagcauccccgcuacccuucugguuuggcacaccuggcaaaaacagacccagcguagcggggugcuuugggacgugcccuccccgccggagacgcagaaggcagagcucgaggagggaguuuaccguaucaagcagcagggcauauuugggaagacccaggugggcguugggguccagaaagaggggguguuccacacaauguggcacgugacccgaggcgccgucuugacgcacaacggcaagaggcuggagccuaacugggcaagcgugaagaaggaccuuaucucauauggcgggggcuggcggcugagcgcgcaguggcaaaagggcgaggagguucaggucaucgccguggaaccgggcaagaacccaaagaacuuucaaaccaugccgggcauuuuccagaccaccacuggagagaucggcgccauagcccuggacuuuaagcccgggacaucgggauccccgaucaucaaccgcgaggggaaaguugucgggcuuuaugguaacggaguggugaccaagaacggcggguaugucaguggcaucgcgcagaccaacgccgagcccgacggccccacccccgaguuagaggaagagauguuuaagaagaggaaccugacaauaauggacuuacacccggggucgggcaagaccaggaaguaucuccccgccauagugagggaggccaucaagcgccggcugcgcacccucauucucgcccccacgcgggugguggcggcggagauggaagaggcgcugaaggggcuacccauucgcuaccagaccacagcgaccaagucagaacacacgggcagggagauaguggaucucaugugccaugcuaccuucacgaugcgccugcugucgcccguccggguccccaauuacaaccuggugauuauggacgaggcucacuuuaccgaccccgccagcaucgccgcccgcggauacauauccacgcggguggguaugggggaagccgcggccaucuucaugacugccacgccgcccgggaccgccgaggcguuuccacagagcaacgccccaauccaagacgaggagcgcgacauccccgagcgauccuggaauagcggcaacgaguggauaacggacuuugucggcaagaccgugugguucgugcccuccaucaaggccggcaacgacaucgcuaauugccuucggaagaacgggaagaaggucauacagcuaagccgcaaaaccuucgacacggaauaccagaagacccgccucaacgacugggauuuugucgugacaaccgauaucuccgagaugggcgcaaauuucaaggccgaucgcgucauugaccccaggcgcugccugaaacccgugaucuuaacagacggcccugagagggugaucuuggcggggccgaugccugucacagccgcaucggccgcgcaaagacgaggccgcguggggcggaacccccagaaggagaaugaccaguacaucuucaccggccagccacucaacaacgacgaggaucacgcccacuggacagaagccaagauguugcucgacaacaucaacacaccugaaggcauuauccccgcccuguucgagcccgagcgcgagaaaucugccgcgaucgacggcgaguaccgacugaagggcgagagucgcaagaccuucgucgagcucaugcgacgcggagacuuacccguguggcuggcccacaagguagccuccgagggcauuaaauauacggaucggaaguggugcuucgacggggagcgaaacaaccagauccuagaagagaacauggacgucgagauauggaccaaagaaggcgagcggaagaaguugcgcccgcgguggcuggacgcccguacuuacagcgacccccucgcgcugaaggaguuuaaggacuucgccgccggacguaagaguaucgcgcuagaccucgugaccgaaaucggacgagugccgagccaccucgcgcacaggacgcggaaugcguuggacaaucucgucaugcuacauaccagcgaacacggcgggcgcgcguaucggcaugccguggaggaauugccggagacgauggaaacccuccucuuacucggacugaugauccugcucaccggcggagcgaugcuguuccugauuuccgguaaagggaucggcaagaccagcauagggcucaucugcgugauagucuccagcgguaugcuuuggauggcggacgugccauugcaauggaucgcauccgccauagucuuggaguuuuucaugauggucuugcugauacccgagcccgaaaaacagagaacuccccaggacaaccaguuggccuauguggugaucggcaucuugaccuuggccgcgaucgucgcagccaacgagaugggacuccuggagacgacuaagcgggauuuaggcaugagcaaggagcccgggguagugucgcccaccagcuacuuagacgucgaccugcaccccgcauccgccuggacccuguacgcuguggcgacgacaguaaucacaccgaugcuccgccacacgaucgaaaauucaacggccaacguuucccuggcugccauagcaaaccaggcggugguguugaugggacucgacaagggguggcccauuagcaaaauggaccugggcguucccuuguuggcccuagggugcuacagucaggugaacccccugacgcucacagccgccgugcugcugcucgucacccauuacgcgauaauaggaccggggcugcaggccaaggcuacgagggaggcacaaaagcgcaccgccgcgggcaucaugaagaacccuaccguagacggcaucaugacgaucgauuuggaccccgucaucuacgauagcaaguuugagaagcaguugggccaggucaugcugcuggugcucugcgcuguacagcuccugcucaugcggacguccugggcccugugugaggcucugacccuugccaccggcccgaucaccacgcuuugggagggcagcccagggaaguucuggaacacaaccaucgcgguauccauggcgaacauauuccgcggcaguuaucuggccggagccggcuuagcguucuccaucaugaaguccgugggaaccggccggcgugguacuggcagccagggugagacccuaggggagaaguggaagaagaagcugaaccagcucucccggaaggaguucgaccuguacaagaaauccggcaucaccgagguggaccgaaccgaggccaaggaggggcugaagcggggggagacgacgcaccacgcugucucccgcggcucugcgaagcuucagugguucguugagcggaauauggugauccccgaggggcgcgucaucgaccuaggcugcgggaggggcgggugguccuauuacugcgcgggucucaagaaggugaccgagguaagaggcuauaccaagggcggccccgggcacgaagagcccgucccaaugagcaccuauggcuggaacaucgugaagcuaauguccggaaaagacguguucuaccugccgcccgaaaagugcgacacucugcugugcgacaucggcgaauccagccccagcccgaccguagaagagucccgcaccauccgggugcuuaagauggucgagcccuggcugaggaauaaccaguuuuguaucaaaguccucaaccccuacaugccgaccguaaucgagcaccucgagcggcugcaacgaaaguacggagggaugcuggugcggaacccacucagccgcaauuccacgcacgagauguacuggaucucaaauggcaccgggaacaucguaagcagcgugaacauggucucccgccuccugcucaaccgcuucaccaugacccaucggcggcccacgaucgaaaaagauguggaccugggcgcgggcacccggcacgugaacgccgagcccgagaccccgaacauggacgucauaggcgagcgcaucaagcggaucaaggaggagcacagcuccaccuggcacuaugacgacgagaaccccuauaagacgugggcuuaccacggaagcuacgaggucaaggcuacugguucagccucgagcaugaucaacggcguggucaaauuacucacgaagccuugggacguggugcccauggucacucagauggcuaugacggacaccaccccauucgggcagcagcgcguguucaaggagaagguggacacccggacgccucgccccaugcccggcacccggaaggugauggagauaaccgcugagugguuguggcgcacccugggccguaacaagaagccgcgccucuguacccgcgaggaguucacuaagaaggugaggaccaacgcagccaugggcgccguguucacugaagaaaaccagugggacuccgcgcgugccgcggucgaggacgaagaauucuggaagcugguggaccgggagcgcgagcugcauaaguuaggcaagugcgggagcugcguguacaacaugaugggcaagcgcgagaagaagcugggggaguucggcaaggccaagggcuccagggcgaucugguauauguggcuaggggcaagauacuuagaguucgaagcgcuggguuuccugaaugaggaccauugguucagccgugagaacuccuauaguggugucgaaggcgaggggcuucacaaguuaggauacauccugcgagauaucuccaaaaucccgggcggagccauguacgccgacgacacggcgggcugggacacucgcaucacggaagacgaccuccacaacgaggagaaaaucacccagcagauggaccccgagcaucggcaacuggcgaacgccaucuuuaagcugacguaccagaacaaaguggucaagguacagcgccccacuccgaaagggaccgugauggacaucauuagcagaaaggaccagcgcggcagcggccaggugggcaccuauggccucaacaccuucacgaacauggaagcccaguuaguucggcagauggagggggaaggcguacugucuaaggccgaucucgaaaacccccaucucuuagagaaaaagauaacccaauggcucgagaccaaagggguggagagacugaagcggauggcuaucagcggcgacgacugcgugguuaagccuaucgaugaccgcuuugccaacgcccugcuagcccugaacgacaugggaaaagugaggaaggacaucccccaguggcagccgagcaagggcuggcacgauuggcaacagguucccuucugcucccaccauuuccacgagcuaaucaugaaggacggcaggaaacuggucgugcccugccguccacaggaugagcugauuggaagggcgaggaucucucagggcgcgggguggucucugaaggagacugcgugccucggcaaagccuacgcccagauguggaaccugauguacuuccaccggcgcgaucugcggcuugccagcaaugcuaucugcagugccgucccagugcacuggaucccgacaucgcguaccaccuggagcauucacgcccaucaccaguggaugacgacggaggauaugcucacaguuuggaaccgggucuggauugaggauaaucccuggauggaggacaagaccccggugacaacgugggaagacguuccguacuugggcaagcgcgaggaccaguggugcggaucccucauagguuuaaccucacgagccaccugggcacagaacauccugaccgcuauccagcaaguccgcuccuuaaucggggacgaggaguuucuggacuacaugcccagcaugaagcguuucagaaaggaggaggaguccgagggcgccaucugguga

SEQ ID NO: 25779 - RNA, 9873 nt, Artificial Sequence
  derived and/or modified CDS sequence (opt11) from DENV-3__FJ639730__SS-prME
acgagccugugccucaugaugaugcuuccagcgacccuggccuuccaccucaccagccgggacggcgagccacggaugaucguggggaagaacgagaggggcaaaagccugcuguucaagaccgcaucaggcaucaacaugugcacacugaucgcuauggaccuaggcgagaugugcgacgauaccguaaccuacaaguguccguuaaucgcagagguggagcccgaggacaucgauugcuggugcaaucucaccagcacauggguaaccuacgggacuugcaaucaggccggcgaacacagacgcgacaagagauccguggcacuggcgccccacgugggaauggggcuagacacacgcacccagaccuggaugucggcugagggcgccuggcgccaaguagagaaaguagagacuugggcccuccgccacccgggguucacuauccuggcucuguuccuagcccacuauauuggcacaucucugacgcaaaagguaguaaucuucauacugcugaugcuggugacgcccucaaugaccaugcggugcgugggggugggcaaucgcgacuucguggagggccuguccggggccacuuggguggacguggucuuagaacacggcgggugcguaaccacgauggccaaaaguaagcccacucuggacauugagcuccagaagaccgaggccacccaacucgccacacugcguaaacugugcaucgaggguaaaaucaccaacaucacgaccgacucgcgcugucccacgcaaggagaggccacucucccagaggagcaggaccagaauuacgugugcaagcacacauacgucgaccggggguggggcaacgggugcggacuauucgguaagggaagccuugugaccugcgccaaguuccaguguuuggagcccauugagggcaaggucguucaauaugagaaucugaaguacacggugaucauaaccgugcauaccggagaccagcaccaggugggcaaugacacccagggggugacggucgaaaucacgccgcaggccagcacgguggaagcggugcugccggaauacgggacccuugggcuggagugcuccccacgcaccgggcuggauuucaacgagaugauacuccugacgaugaaaaacaaggcguggaugguccaccggcagugguucuuugaccuaccccuccccuggaccuccggcgccaccaccgagacccccaccuggaaucgcaaggaauugcuggugaccuuuaagaacgcccaugcuaagaaacaggagguggucgugcucgguucacaggagggcgccaugcacacugcccugacgggugccaccgagauccagaauuccggcggcaccagcaucuucgccggacaccugaagugcaggcuaaagauggacaaacuggaacugaagggcaugaguuaugccaugugccucaacacguucgugcugaagaaggaggucucggagacgcagcaugggaccauccucaucaagguggaguacaaaggcgaggacgcaccgugcaagauacccuucaguaccgaggacgggcagggcaaggcgcacaacggccgcuuaaucaccgccaaucccguggucacgaagaaggaggagcccgugaacaucgaggccgagccgcccuucggggagaguaacauuguaaucgguaucggggauaaggcccucaagaucaacugguacaagaagggauccucgaucgggaaaauguucgaagcuacagcccggggugcgcgcaggauggccauccuaggcgacacugcgugggacuucggaagcguaggcggcguccugaacagucucggcaagaugguccaccagaucuuugggagcgcauauacagcccuauucucugggguuagcuggauaaugaagaucggcaucggggugcugcucacguggauuggccugaacaguaagaacaccagcauguccuuuagcugcauagugaucgggaucaucacgcuguaccucggcgcggucguccaggccgacauggggugcgccaucaauuggaagggcaaggaacugaagugcggguccgggauauucguaacuaacgaggugcacacauggaccgagcaguacaaguuccaggcggacucacccaagcgacuggccacggccaucgccggcgccugggagaacggggugugcggcauccggaguacaacgcgcauggaaaaccuccuguggaaacagaucgccaacgaacugaacuacauauugugggaaaacaacauuaaacuuaccguaguggugggcgacaucaucggugugcuggagcagggcaagcgcacccucaccccgcagccgauggagcugaaguauagcuggaaaacguggggcaaggccaaaaucgucacugccgagacccagaacuccagcuucauuauagacggcccuaacacacccgaaugcccauccgcaagcagagcguggaacgugugggaaguggaggacuacggguucggcguauucaccacuaacauuugguugaaacuccgcgagguguauacccaguccugugaccacagacugauguccgccgccauaaaggacgagaaagcuguacacgccgacaugggauauuggauugaaagucagaagaacggguccuggaaacuggagaaggcgucauucaucgaaguaaagaccugcaccuggccgaaaucacacacccucuggagcaauggcgugcuggaauccgacaugaucaucccaaagucguuagccggucccauuucccagcacaaucaccgcccggguuaucacacccagaccgccgggcccuggcaccuaggcaagcucgagcuggacuuuaacuauugcgagggcacuacagugguaaucacugagaacugcggaacccgcggccccagccucaggaccacgacaguuucugggaagcugauccacgaguggugcugccggagcugcacccugccuccccuucgcuacaugggcgaggaugguugcugguacggcauggagauccggccuaucaaugaaaaggaagagaacauggugaagucuuuagucagcgccggcagcgggaagguggacaacuucaccaugggcguccugugccucgccaucuuguuugaggaagucaugcgcggaaaguuuggcaagaagcacaugaucgcgggggugcucuucacguucguucugcuguuauccggacagaucaccuggcgugacauggcccacacauugaucaugauuggcucgaacgccagcgaccgaaugggcaugggcguuaccuacuuagcccugaucgcuaccuuuaaaauccagccuuuccuggcgcugggguucuuccugcggaaguuaacuucucgggagaaucuguugcucggcgugggccucgccauggcaacaacccugcagcuuccggaagauaucgagcagauggcuaacggaaucgcgcuuggucugaugacacucaaacucaucacccaguuugagaccuaccagcuuuggaccgcccucgucucccuuacaugcagcaacaccaucuuuacccugaccgucgccuggcggacugccacccuaauacucgcggggguuucauugcuuccucugugccagagcuccagcaugcgaaagaccgacuggcugcccaugaccgucgcagccaugggugugcccccccugccgcuguuuaucuucucccugaaggacacgccuaagcggcgcucauggcccuugaacgagggggucauggccgugggccugguguccauccuggccucuucccuccugcgcaaugacgugccgauggccgguccacuggucgcaggcgggcucuuaaucgcgugcuacgugaucacugggaccagcgcugaccugaccguugagaaggccgcggauguuaccugggaagaggaggcggagcagaccgguguaucccacaaucucaugaucacuguggacgacgaugggaccaugagaaucaaggacgacgagacagagaacauccugacgguccuucuuaagacagcccuguugauugugagcggcaucuucccauacuccauucccgccacacuccugguguggcacacuuggcagaaacagacgcagcgaagcggcguccugugggauguaccauccccgcccgaaacccaaaaggccgagcucgaggaagguguguaccgaaucaaacagcagggaauauuugggaaaacucaggucggcguugggguacagaaggaagguguguuccauacuauguggcaugucacacguggugcgguacugacccacaaugggaaacggcuggagcccaacugggccagcgucaagaaggaccucauauccuauggcgggggcuggcgccuaaacgcccaguggcagaagggggaggaaguccaggugaucgccgucgagcccggcaaaaacccgaagaacuuccagacaaugccaggcaucuuucaaacgaccaccggggagaucggcgccaucgcccuagacuuuaagcccgggaccagcggaucgccuauaauaaacaaggaagguaagguggugggguuauacggcaacggaguggugacaaaaaacggcggguacgugucuggcaucgcccagaccaaugcggagcccgacggccccacaccggagcucgaggaggagauguucaagaagcggaaccugacuaucauggaccugcacccggggagcggcaagacccgaaaauaccuccccgcaauuguacgggaggccaucaagcgccggcuuagaacgcugaucuuagcgccgacccgggugguggccgcggagauggaggaggcucugaaggggcugcccauaagguaccagacgacugcaacgaaaucagaacacaccggucgugagauaguagauuuaaugugucacgcgacguucacaaugcgccugcugagcccgguacgugugccuaacuauaaccugguaaucauggaugaggcccacuucaccgauccggccucgaucgccgccagaggcuacauuucgacccgggugggcaugggcgaggcggccgccaucuuuaugaccgccacgccucccgggacggcggaggccuucccccaguccaaugcccccauccaggacgaggagcgcgacauccccgagcggagcuggaacuccgggaacgaguggaucacggacuucguggggaagacugucugguucgucccgagcauuaaggcggguaacgacauugcuaacugccugcgcaagaacgggaaaaaggugauucagcugucccgcaagaccuucgacacugaguaccagaagacgcggcuuaaugacugggacuuugucguaacgacagacaucucggagaugggugcuaacuucaaggccgaccgcgugaucgacccccgucgcugcuuaaaacccguuauccuuacggacgggccugagagagucauccucgcagggccgaugcccgugacggccgccuccgcggcccagcgccggggccgcgucgggcggaacccccagaaggagaacgaucaguacaucuucacuggccagccgcuuaauaacgacgaggaucacgcccacuggacggaggcaaagaugcugcuggacaacauaaacacccccgaggggauuauacccgccuuguucgagcccgagcgagagaaaagcgcggcuaucgacggcgaguaccggcugaaaggagaaucacgaaaaaccuucguggagcucaugcggcguggggaccugccagucuggcucgcccacaaggucgccagcgaaggcauaaaguacacagaucggaaguggugcuucgacggggaacggaacaaccaaauacucgaggagaauauggacguggaaaucuggacaaaggagggcgagcggaagaagcuccguccgcggugguuggacgcgcgcaccuacucggacccacucgcccugaaggaauucaaggauuucgccgccggccgcaagucaaucgcgcucgaccuggucacggaaauagggcgggugcccucccaccuggcacauaggacccggaacgcacuugauaacuuggugaugcugcacaccuccgagcacggggggcgcgccuaccggcacgcuguggaggaacugccggagacgauggagacguugcuauuacucggccugaugaucuugcuuacuggaggcgccaugcuauuucugaucagcggaaagggaaucggcaaaaccuccaucgggcucaucugcguuaucgugagcuccggcaugcuuuggauggcggacgucccucugcaauggaucgcuagcgcaaucguacuagaguucuucaugaugguccuguugauccccgaaccagagaaacagaggacgccgcaggacaaucagcucgccuacguagugaucgggauacuaacccucgccgcuaucguggcggccaacgagaugggcuuacuugagaccaccaagcgggaccuuggaauguccaaggaaccugggguugucucucccaccuccuaccucgacguggaccuacaccccgcgagcgcuuggacguuguacgccgucgccaccaccgugaucaccccgaugcuacgccacacuaucgagaacuccacagccaacgugucgcuggcugcgaucgccaaccaagccgucgugcugaugggcuuggacaagggguggccgaucaguaagauggaccuggguguuccccugcucgcccuagguugcuacagccaagucaacccccugaccuugacggccgcgguccugcugcuaguaacgcacuacgccaucaucggcccuggccugcaggccaaggcuaccagagaggcacagaagcgcaccgcggccgggaucaugaagaaucccaccgucgacggaauuaugacgauugaccuggaccccgucaucuacgacuccaaguuugagaaacagcucggccagguaaugcugcucguucucugcgccgugcaacugcuacuaaugcggacuagcugggcccugugcgaggcccugacccuagcgaccggcccuaucacgacacugugggagggcuccccggggaaguuuuggaacacgaccaucgcugugucaauggccaacauauuucgcggcaguuaccuugccggugcgggccuugccuucaguaucaugaaguccguugggacggggcgccgggggacggggagccaaggcgagacuuuaggggaaaaauggaagaagaaguugaaccagcucucucggaaggaguucgagcuguacaagaaguccggcaucaccgaaguggacaggacggaagccaaggaaggguugaagcggggcgagacgacccaccacgccguuagccgcggcucagcuaaauugcaaugguucgucgagcggaacauggugauucccgaggggagggugauagacuuaggcugugguaggggcggcuggagcuacuauugcgcuggacugaaaaaggugacggaggugcgcggcuacaccaagggugggccaggucacgaggagccaguuccgaugucgacguacggcuggaacaucguaaaguuaaugucggggaaggacguguuuuaccuaccgcccgagaagugcgauacccugcugugcgacaucggcgaguccagccccagucccaccguggaggagagcagaaccauccgcgugcucaagaugguggagcccuggcuacgcaacaaccaguuuugcauuaaaguacuaaaucccuacaugccgacgguaauugaacauuuggagaaguugcagaggaaguauggggggaugcugguccguaauccccucucccgcaauucaacgcacgagauguacuggaucuccaacggcacaggaaacaucgugagcuccgucaacaugguuucacgccugcugcucaaucgguucaccaugacgcaccgccgucccaccaucgaaaaagacgucgaccuuggcgccggcacacgccacgugaacgcggagccagagaccccgaacauggacgugaucggagaacgaauuaagcguaucaaggaagagcauucuucuacguggcacuacgacgacgagaaccccuacaaaaccugggccuaccacgguuccuacgagguuaaggcuaccggaucggcuagcuccaugaucaacggcgucgugaaauuacugaccaagcccugggacguuguccccauggugacgcagauggccaugacagauacuacaccguucgggcagcagcgggucuucaaagagaaaguugacacgcguacgccccggccaaugccuggcacacgaaaggugauggagauuaccgccgaguggcuguggcggacgcugggucgcaacaagaagcccaggcuauguacccgugaggaauucaccaagaaggucagaaccaacgcagcaaugggggcuguguucacagaggaaaaucaaugggacagcgcacgcgccgccguggaggacgaagaguucuggaagcuggucgaccgcgagcgcgagcuccacaaacucggaaagugcggguccugcguguacaacaugauggggaagagggaaaagaaacuaggggaguucgguaaggcgaaggggagccgggccaucugguauauguggcucggugcgcgcuaccucgaguucgaggcgcugggcuuucucaacgaggaccacugguucucccgggagaauaguuauuccgggguagagggugaggggcuccacaaacuaggauacauacugcgugacaucuccaagauacccgggggggcuauguaugcggacgauaccgccggcugggacacccggaucaccgaggacgaccuccacaacgaggaaaagaucacgcaacaaauggacccugagcaccgccaacuugccaacgccaucuucaagcugaccuaccagaacaaagucgugaagguccagcggcccacucccaaagggaccgucauggacaucauuucccgcaaagaccagagaggcagcggccaaguaggcacauacggccucaacacuuucacaaacauggaggcccaacuggugcggcagauggagggggaggguguccuguccaaggcggaucucgagaacccccacuuguuagagaaaaagauuacucaguggcucgaaaccaaggggguggagcggcugaaacgcauggcgauuagcggcgacgacugcguaguuaagccuaucgaugaccgguucgccaacgcccuucucgccuuaaacgacaugggcaagguacgcaaggauauuccgcaauggcagccuagcaagggguggcacgacuggcagcagguccccuucugcagccaccauuuccacgagcugauaaugaaagacgggcggaagcucguagugcccugccgcccccaggacgaacugauaggccgggcgcggauuagccagggcgccgguuggagccugaaggagacugccugccucggcaaggccuacgcgcagauguggagucugauguacuuccaccgccgggaccuacgccucgccuccaacgccauaugcuccgccgugccuguccacuggauccccacgucgcggaccaccuggucgauccaugcccaccaccaguggaugacaacagaggacaugcugacuguauggaaucgcguuuggauagaggacaauccauggauggaagacaaaacacccgucacuaccugggaggacgugccauaccugggaaagcgggaggaccaauggugcgggucccuaaucggucuaaccagcagggcaacaugggcucaaaacauucugacggcaauccagcagguccggagcuuaaucggggacgaggaguuucuugacuacaugcccagcaugaagagauuucggaaggaggaggaaucugagggcgcuaucugguaa

SEQ ID NO: 25780 - RNA, 9873 nt, Artificial Sequence
  derived and/or modified CDS sequence (opt11) from DENV-3__KF955464__SS-prME
acgucccugugccucaugaugaugcugcccgcgacccuggccuuccaccucaccucucgggacggcgagccccggaugauaguggggaaaaacgagcgcgggaaaagccugcuguucaagaccgcaagcgggaucaacaugugcacucucaucgccauggauuuaggggagaugugcgacgauaccgucaccuacaagugccccuuaaucgcugaggucgaacccgaagacaucgacugcuggugcaauuugaccagcaccugggugaccuacgggaccugcaaccaggccggcgagcaccggagagacaagcgcucaguggcccuggcaccacacgugggcauggggcuggacacucgcacccagaccuggaugagcgccgagggcgccuggcgccaaguggagaaggucgagacuugggcucucagacaccccggguuuacgauacuggcacucuuccucgcgcacuacaucggcacuucccugacccagaagguagucaucuucauccugcucaugcuggucacuccuucuaugaccaugcggugugugggaguaggcaaccgcgauuucgucgaggggcugucaggggcuaccuggguggacgugguacucgaacacggcggcugcgugaccacgauggccaaauccaagccuacccucgauaucgagcugcagaaaacagaagccacccagcuugcgauccugcggaaguugugcauugagggcaagauaacgaacauuacgacugacagucgcugccccacccagggcgaggcuacgcucccggaggagcaggaucagaacuacgucuguaagcauaccuacgucgaccggggcugggguaacggcuguggacuuuucgggaagggcagccugguuaccugugcuaaauuccaaugccucgagccuaucgagggcaaggugguccaguacgaaaaccugaaguacaccgugaucaucacggugcacaccggugaccagcaccaggucggcaacgacacacaggguguuaccgucgaaaucacgccccaggcguccacuguggaggcgguccugcccgaguacggcacccuggggcuggagugcagcccgcgcaccggccuggauuucaacgaaaugauccucuugacaaugaagaacaaagcguggaugguccaccggcaaugguucuucgaucuaccccuuccuuggacguccggagccaccacagagacccccacguggaaccgcaaggagcugcuggugaccuucaagaaugcccaugccaaaaagcaggagguggucgugcucgggagccaggagggugccaugcauaccgcgcugacuggggcaacggagauucagaacuccggcggcaccaauauauucgcaggucaccuaaagugccggcucaagauggacaaguuagagcucaagggcaugaguuacgcuaugugccuuaacacguucguccugaaaaaggaggucagcgagacccaacacgggacgauucugauaaagguagaguacaagggcgaagacgcgccgugcaagauccccuucagcaccgaggacggccaaggcaaggcccacaacggucgccugaucacagcaaaccccgucgucaccaaaaaggaggagcccaucaacaucgaggccgagccgccauuuggggaaagcaacauugugaucggcaucggggacaaggcccucaagauaaacugguacaagaagggcuccagcaucgguaaaauguucgaagcgacggcgcggggcgcccgcagaauggccauccucggcgacaccgccugggacuucggguccgucggcgggguucuuaacagccuaggcaagaugguccaccagaucuucggguccgcguauaccgcgcuauucagcggcguguccuggaucaugaagaucggcaucggcguccugcucaccuggauuggccugaacagcaagaacacgucuaugagcuucuccugcauuguaaucgggauaaucacccucuaccucggagccgugguccaagccgauaugggaugcgugaucaacuggaagggcaaggaacugaaaugcgguaacgggaucuucgugaccaacgagguccacacguggaccgagcaguacaaguuucaggccgacagccccaagcgacuggcgacugcaauugccggugccugggagaacggagugugcggcauccgcuccaccacacguauggagaaccuucuguggaagcagauugccaacgagcugaacuacauccucugggaaaacaacauaaagcugacgguagucgugggggacaucaucggcgugcuggagcagggcaagcgcacccucacaccccagccgauggagcugaaguacagcuggaagaccugggggaaggcgaaaaucguaaccgccgaaacgcagaacaguucauucaucaucgaugggcccaacacgcccgagugccccuccgcuagccgggccuggaacgugugggagguggaagacuacggguucggcguuuucaccacgaacaucuggcugaaacuccgcgagguguacacucaguccugcgaccaccgguugaugagugccgccaucaaggacgagcgcgcugugcacgccgacauggguuacuggauugagucucagaagaacggcuccuggaagcuggagaaggccagcuucaucgaggucaagacuugcaccuggccgaagucccauacucucuggagcaacggggugcuggaauccgacaugaucaucccgaaaagccucgcggggcccauaucccagcacaaccaccggccgggcuaucacacgcagaccgccggccccuggcaucucggcaagcuggagcuggacuucaauuacugugaggguaccaccguggucaucgccgagaacuguggaacgagaggccccagccuccggaccacgaccguauccgggaagcugauccacgagugguguugccgcagcugcacucugcccccacuccgguacaugggcgaggaugggugcugguauggcauggaaauccgccccaucaacgagaaggaggagaacauggugaagucccuggucagcgccggcucagggaagguagacaauuuuaccaugggcgugcuuugccucgcaaucuuguucgaggaagucaugcgggggaaguuugguaaaaagcacaugaucgcgggggugcuuuucaccuucgugcuccugcugagcggacagaucaccuggcgcgacauggcccacacgcucaucaugaucggcuccaacgccagcgaccggauggggaugggcguaaccuacuuggcucugaucgccacauucaagauucagcccuuccucgcgcugggauucuuccugcgcaagcucacaucccgugagaaccugcuuuuaggcgugggccuggccauggccacgacccugcagcuuccggaggacaucgaacagauggcaaacgggauugcgcuggggcugaugacccucaaacugaucacucaguucgagacguaucaacuguggaccgcacucgugagccugaccugcagcaacaccauauucacccugaccgucgcauggcggaccgccacccucauccuggccggggugucgcuacucccgcugugccaaucauccagcaugcgcaagacugacuggcugcccaugaccgucgccgccaugggugugccgccccugccguuguucauauucucacugaaggacacccccaagcgcaagagcuggccacucaacgaaggagugauggccgucgggcugguguccauccuggccagcucccuccugcgcaaugacguacccauggccgggccgcuggucgccggagggcuccugaucgccuguuacgugaucacgggcacaagcgccgaucugaccguggagaaagccgccgacguaaccugggaggaggaggcggagcagaccggggugucccacaaccucaugauaacgguggacgaugacgggacaaugcgcaucaaggacgaugagaccgagaacauccugaccgucuuacuuaaaacagcccuccugaucgugaguggcauuuuccccuauuccauccccgccacguugcugguguggcacacauggcagaagcaaacccagcggagcggggugcugugggacgucccguccccgccagagacacagaaggcugagcuggaggaaggcguguaccggaucaagcagcagggaauauucgggaagacgcaggucggcgugggggugcaaaaggagggcgucuuccacaccauguggcacguuacaagaggggccgugcucacccacaacgggaagcggcuggagcccaacugggcgucugucaagaaggaccucaucucauacggugggggcuggcggcugagugcccaguggcagaaaggggaggaaguccaggugauagccguagaacccggcaagaacccgaagaacuuucagacgaugccaggcauauuccagaccacaaccggcgagauuggcgcaaucgcacuggacuucaagccugggacguccggcagcccgaucaucaaucgagagggaaaggugguggggcuuuauggcaacggcgucgugacaaagaacggcggcuauguaagcggcauagcacagaccaaugccgaaccggaugggccgaccccggagcucgaggaggagauguucaaaaagcgcaaccugacgaucauggacuugcauccgggguccgggaaaaccagaaaguaccuccccgccaucguccgcgaagccaucaagaggcgccugcggacucugaucuuggcgcccaccagagugguggccgccgagauggaggaggcgcugaaggggcuaccgauccgguaccagacgaccgccaccaaguccgagcacaccggacgcgagaucgucgaccucaugugccacgcgaccuuuaccaugcggcugcuuuccccagugaggguacccaauuacaaccucaucaucauggacgaggcccacuuuacagaccccgccagcaucgccgccagaggguauaucagcacucgcgucgguaugggcgaggcggccgcuauauucaugacggccacgccgccagggacagcggaggccuuuccccaguccaacgcacccauccaggacgaggagcgggauauccccgagcgcuccuggaauagcggcaacgaguggaucaccgacuucguggggaagacggugugguucguccccuccaucaaggccggcaacgacaucgcgaauugucugcggaagaacgggaagaaggugauccagcugaguaggaagacauucgacacggaguaucagaaaaccaggcuuaacgauugggacuuuguggucacgaccgacaucuccgagaugggcgcgaacuucaaggccgaccgggugaucgacccucgccggugccugaaacccguaaucuugaccgacggaccagaacgcgucauccucgccgggccgaugcccguuaccgccgccucagcggcccagaggcgcggucggguggggcgcaacccccaaaaagagaacgaccaguacauuuucacgggccagcccuugaacaacgacgaggaccaugcacacuggaccgaggcuaagaugcuacucgacaauauuaacacgccggaggggauaauacccgcccuuuucgagccugaacgagaaaaguccgcggccaucgacggugaguauaggcugaagggcgagagccggaagaccuucgucgagcucaugcgacguggcgaccuuccaguguggcuggcccacaagguggccuccgagggcauuaaguacacugacagaaaguggugcuucgacggugagaggaacaaccaaauccucgaagaaaacauggaugucgagaucuggacgaaggaaggcgagcgcaagaaacuccggccgcgcuggcuggacgcucguaccuacagcgacccccucgcccugaaagaguucaaggacuuugcggccggccggaaaagcauugcccucgaucuggugaccgaaaucgggcguguccccagccacuuggcgcaucgcacccgcaacgccuuagauaauuuaguuaugcugcacacuuccgagcacggcgggcgggcguaccggcacgccguggaggagcugccggagacgauggagacccuccuacuccucggccugaugauccuauuaaccgggggcgccauguuauuccugaucagcgguaaggggaucggcaaaacgucgaucggguugaucugcgucaucguguccagcggcaugcuguggauggcugacguaccccugcaguggaucgccucagccaucguucuugaguucuuuaugauggugcuguuaauucccgagcccgagaaacagcggaccccucaggacaaccaauuggccuacgucgucauagggauccugacucuggccgcgaucgucgcugccaacgagaugggccuccuagagaccacaaagagggaccugggcaugagcaaggagcccggggugguuucacccaccagcuaccucgacguggaccugcacccggccucagccuggacccuguacgcgguggccaccaccgugaucaccccuaugcuccggcacaccaucgagaacagcaccgcaaacguaucccucgccgcgaucgccaaccaggcugugguucugauggggcuagacaagggguggccaaucucaaagauggaccugggcgugccacuucucgcgcugggcugcuacucccaggugaacccccugacgcucaccgccgcgguccugcugcucgucacccauuacgccaucaucgggccgggccugcaggccaaggcuacccgcgaggcucagaaacggacggcggccgguaucaugaagaaccccaccguugacggcaucaugaccauugaccuggaucccgucaucuaugacagcaaguucgagaagcagcucggccagguaaugcuacuugugcucugcgcgguccagcugcugcucaugaggacgucaugggcgcugugcgaggcucuuacacucgccaccggccccauaaccacgcugugggagggcagcccggggaaguucuggaauacgaccauagccgucucgauggcgaacaucuuccgaggcagcuaccuggcaggggcgggccucgccuucagcauaaugaaguccguggggaccggccgucgcggcaccgggucccagggcgagacguuaggcgagaaguggaaaaagaagcugaaccagcucagccgcaaggaauuugaccuguauaagaaauccggcaucacagaggucgaucggaccgaggccaaggagggccugaagcgcggcgagaccacccaccacgccgugucccggggcagcgccaagcuccagugguucguggagcgcaacauggucauucccgaggggcgggugaucgaccugggcugugggcggggaggauggucuuacuacugcgcgggccugaagaaggugacggagguaagaggcuacacgaagggcgggcccgggcacgaggagcccgugccgaugagcaccuacggauggaacaucgugaagcucauguccgggaaggacgucuucuaucugccgcccgagaagugugacacucugcugugugauaucggcgaguccucccccagcccuacgguggaggaaucccggaccauaagggugcuccggauggucgagcccuggcuacguaacaaucaguuuugcaucaaaguccugaaccccuacaugcccaacguaaucgagcaccuagagcgccuucagcgcaaguacggcgggaugcugguucguaacccguuaucgcgcaauucaacgcacgagauguauuggaucuccaacgggaccgggaacaucguguccagcgucaacauggugucccggcuccugcuaaaccgguucacgaugacgcaccggcgcccaaccaucgaaaaagacguugaccugggcgccggcacucggcacgucaacgccgaacccgagacgccgaacauggacgugaucggggagcguauaaaacggaucaaggaggagcacucauccaccuggcacuacgacgacgagaaccccuacaagacgugggccuaucacggcagcuacgagguuaaggccaccgggagcgcgagcagcaugaucaacggagucgugaagcugcucaccaaacccugggacguggucccgauggugacccagauggccaugaccgacaccaccccguucgggcagcaaaggguuuucaaggagaaggucgauacacggacgccgcggccgaugcccggcacccgaaaaguuauggagaucacggccgaauggcuguggcguacccugggacgcaacaagaaaccgcggcucugcacccgcgaagaguucaccaagaaagugcggacaaaugccgccaugggggcugucuuuacagaggagaaccagugggacuccgcacgggccgccguggaagacgaggaguucuggaagcucguggauaaggagcgagaauugcauaaguuagguaaaugcgggagcugcgucuacaacaugaugggcaaacgcgaaaagaaacuuggggaauuuggcaaggcaaagggcucccgggccaucugguacauguggcuuggggcccgguaccucgaguucgaggccuuaggcuuccugaaugaggaccacugguucagccgggagaacuccuacuccgguguggaaggcgaagggcuccacaagcuaggguauauccugcgcgacaucucuaagauacccggcggggccauguacgcggacgacaccgccggcugggauacucgcaucacggaggacgaccugcacaaugaggagaagaucacccagcagauggaccccgagcaucgucagcuggccaacgccaucuucaaauugaccuaccagaacaagguggucaaggugcagcgccccacaccgaaagguacugugauggauauuaucagcaggaaggaccagcggggcucgggccaggucgggaccuacggccuaaacaccuucaccaacauggaggcccaguuagugcgccagauggaaggggaaggcgugcugagcgaggcggaccucgagaauccgcaccuccuggagaagaaaaucacccaauggcuugagacgaagggggucgagcggcugaagcgaauggccaucuccggcgacgacugcguagugaagccuaucgacgaccgguucgccaacgcacugcucgcccugaacgacauggguaaaguccgcaaggacauuccacaguggcaaccgagcaagggguggcacgauuggcaacaagucccauuuugcucacaccacuuccacgagcugaucaugaaggacgggcggaaacucguggucccgugccgcccgcaggacgagcugaucgggcgcgcgaggaucagccagggcgcaggguggucgcuuaaggagacggccugccucggcaaagccuacgcacagauguggagccugauguacuuccacagacgagaccugcgccucgcguccaacgccaucuguagcgccgucccugcccacuggauccccaccuccaggacgacguggagcauccacgcgcaccaucaguggaugaccaccgaggacaugcugaccguguggaaucgcguuuggaucgaggacaacccuuggauggaggacaagacgcccgugacaaccugggaggacgugcccuaccugggcaaacgggaggaccaauggugcggaagccuuaucggccugaccucuagagccacgugggcccagaacauccugaccgccauccagcagguccgcucccucauuggggacgaggaguuccuugacuacaugcccaguaugaagcgcuuccggaaggaggaagaauccgaaggcgccaucugguga

SEQ ID NO: 25781 - RNA, 9873 nt, Artificial Sequence
  derived and/or modified CDS sequence (opt11) from DENV-3__FJ639731__SS-prME
accucacugugccuuaugaugaugcucccggcaacacuagcauuucauuuaacgagccgagauggggaaccuagaaugaucguagggaaaaacgaacgcgguaaaucgcugcuauucaaaacggccucaggcauaaacauguguacacugaucgcgauggaucucggagaaaugugcgacgauacggucacuuacaagugcccucuaauagcggaaguagaacccgaagacaucgacuguuggugcaaccucacaucgacaugggucacguauggcacgugcaaccaagcuggagaacacaggcgggacaagagaucaguagcccucgcaccgcaugucgggaugggauuggacacacgaacacaaacuuggaugagcgcggaaggugccuggcgccaaguagaaaagguugagacaugggcacucagacacccaggcuucacuauauuagccuuguuuuuggcacacuacauaggaacuucccucacgcaaaaggucgucaucuucauccuauugaugcucguaacgccauccaugacuaugagaugcguaggcgucggcaacagagacuucguagagggccucuccggagcuacuuggguagacguaguccuagaacacgggggaugugucacaaccauggcuaaaucaaaacccacccucgacauugaacugcagaaaacagaggcuacgcaauuagcgacacuacgaaaguugugcaucgaaggaaaaauaaccaacauaaccaccgacucucgauguccaacacaaggcgaggcaacacucccagaagaacaggaccagaacuacgucugcaaacacaccuacgucgacaggggauggggaaacgguugcggacuauucggaaaaggaucgcucguaacgugugccaaguuucaaugccucgaaccaauagaaggaaaagucguccaauacgagaaucucaaauacaccgucauaauaaccguccacacgggagaccaacaccaaguuggcaacgauacucagggcguaacggucgagaucacgccacaggcuucgacaguagaagcggucuugcccgaauacggcacguugggacuagagugcucaccgcggaccggauuagacuucaacgaaaugauccuguuaacaaugaagaacaaggccuggaugguccauagacaaugguucuucgaccugccgcugccauggacaagcggcgcaacaacagaaacgccgacauggaaccgaaaagagcuccucguaacauuuaaaaaugcccaugccaagaaacaagaggucguuguacugggcagccaggagggugcuaugcacacggcacugacaggcgccacagaaauccaaaacagcggaggaacgucaaucuucgccggucaccuaaagugcagacugaaaauggauaaacucgagcucaagggcaugucguacgcaauguguuuaaacaccuucguacugaagaaagagguaagcgagacacaacacgguacggugcuuauuaagguggaguacaaaggggaggacgcgccaugcaaaauaccuuuuucaacggaagacgggcagggaaaggcgcacaacggccgacucauaacggcgaacccuguagucaccaagaaagaagaaccaguaaacaucgaagcggagccucccuucggugagucgaacaucguaauagguaucggcgauaaagcgcucaagauaaacugguauaagaagggcucaucaauugggaagauguucgaagccacagcucggggcgcgaggagaauggccauccugggcgauacagcaugggauuucgguucgguaggcggcgucuuaaauagucucgguaaaaugguacaccagaucuucggcucagcauacaccgcccuauucuccgggguauccuggaucaugaaaauagggauaggaguacuccuaacauggaucggccugaacucgaaaaauacaagcaugagcuucagcugcauuguuaucgggaucaucacccuguacuugggagcagucguccaagcggauaugggcugcgcgauaaacuggaaagggaaagagcuaaaaugcggaucaggaauuuuuguaacuaacgaagugcauacuuggacagaacaguacaaguuucaagcggacucccccaaaagacuagcaacggcaauagcaggggcaugggagaacggcgucugcggcauccgcucaacuacacgcauggaaaaucugcuuuggaaacaaaucgccaaugaacuaaacuacauacucugggaaaacaauaucaagcucaccgugguugugggagacauaauagggguucuagaacaaggaaagcggacacugacuccgcagccuauggaacucaaguacagcuggaaaacaugggggaaagcuaagaucgucaccgcugaaacccaaaacagcaguuucauaauagacggcccaaauacgcccgagugcccuagugcgucccgugcguggaacguuugggagguagaagauuacggauucgggguauucacuacaaacaucugguugaaacugcgcgaaguauacacacaauccugcgaccaccggcuuauguccgcugcaauuaaagaugagcgggcgguacacgcagauaugggauacuggaucgaaagccagaaaaacgggucauggaagcuagaaaaggcaucauucaucgaaguaaagacaugcacguggccuaaaagucacacacuguggucaaauggaguauuggaaucugacaugaucauaccuaaaagucuagccggaccaauuagccaacauaaccaucgaccgggauaucacacgcagacggccggcccuuggcaccucggaaaacuugaacuggacuucaacuauugcgaaggaaccaccgucguaaucacagaaaacugugguaccagggggccaagccuacguaccacaacagucagcgguaaacucauccaugaguggugcuguagguccuguacccuaccaccccugcgcuauaugggagaagacgggugcugguacggaauggagaucaggccaauaaacgaaaaagaggaaaauaugguaaaaucgcucgucagcgcgggcuccgguaagauggacaacuucaccaugggcguucuaugcuuggcaauauuauucgaagaagugaugagagggaaauucgggaagaagcacaugauagccggaguccucuucacauucguacuccuacucucaggucaaauaacguggcgugacauggcccacacacucauaaugaucggcucgaacgcgagcgaccgaaugggcaugggggugacauaccuagcccucauagcuacguucaaaauacaaccauuuuuggcccuuggguucuuccuaagaaagcucaccucgagagagaaccuacuucuaggagucggacucgccauggcgaccacacuccaauugcccgaagacauagaacagauggcaaauggaaucgcacugggacucaugacccugaagcuaaucacgcaauuugaaacauaccaacucuggacagcccucguaagccucacaugcagcaauacaauuuucacccucacaguugcauggcggacagcgacccucauucuggcaggagugagucugcuaccauuaugccaaaguuccagcaugcgcaagacggacuggcugccuaugacaguggcggcgaugggagucccuccacuaccccuguucauauucagccuaaaagacacaccgaagagaagaagcuggccucuaaaugaaggcguaauggcagucggguuagucucaauacuggcaucgagccuccuccggaaugacgugccaauggcuggcccauuggucgcgggaggacuccucauugcuuguuacguaaucaccggcacgagcgcagaccugacaguagagaaggcggcugacgucacaugggaagaagaagccgaacagacuggggucucccacaaccuaaugaucaccguggacgaugacgggaccaugagaaucaaagacgacgaaacggagaacauacugacaguucugcucaagacugcguugcuaaucguaagcggcauauuucccuacagcauaccagcaacauugcucguauggcacacauggcagaaacaaacccagagaagcggaguacugugggacguucccucgccgccggaaacacaaaaagcugaauuggaagagggcgucuacaggauaaaacagcagggcaucuucggaaaaacgcaaguuggagugggcguacaaaaggagggcguauuucacacgauguggcacgugacgcgaggcgcggugcugacgcacaaugggaaaaggcuagagccaaacugggccagcgugaaaaaggacuuaaucucuuaugggggcggauggcgacuaaacgcccaguggcaaaagggcgaagaaguacaggugaucgccgucgagcccgguaaaaacccgaaaaacuuccaaacaaugcccggcauauuucagaccacuacaggggagauaggagcuaucgcccucgacuucaaaccaggcaccuccggaucgccuaucauaaacaaagagggcaaggugguaggauuauacggaaacgggguggucaccaaaaacggcggguaugucucuggcauagcacagaccaaugccgaaccugauggcccaacacccgaauuagaggaagaaauguuuaagaagaggaaccuuacgauaauggaucugcaccccggaucgggcaaaacucguaaauaccucccagcuauaguccgagaagcaaucaagagacgacugcggacguugauacuagcaccuacacgaguaguagccgccgaaauggaggaagcccucaagggccucccaauaagguaccaaaccacggccacaaagucggaacacacaggccgggagauuguagaccugaugugucaugcaaccuuuaccaugagguuacucuccccaguaagagugcccaacuacaaccuggucauaauggacgaggcccauuucacggacccggcaaguauugcagcccgaggauacaucucaacgcgaguagguaugggggaagcggccgccauauucaugacagcuacucccccgggaaccgccgaagcauucccccagucaaacgcccccauccaggacgaagaacgcgacaucccagaacggagcuggaauaguggcaacgaauggaucacagacuucguaggaaagacagucugguuuguaccauccauaaaggcgggcaacgacauagcaaauugccuaaggaaaaaugguaagaaaguaauacaacucucacggaagacauucgauaccgaauaucagaaaacacggcuaaacgacugggauuucguuguaaccacggacaucuccgaaaugggcgcgaacuucaaagcugaucgggugaucgacccucgccggugccucaaaccagucauccuaacagacggccccgagcgagucauccucgccggaccaaugccuguaacagccgcauccgccgcgcaaagaaggggcagggugggccggaacccacaaaaagaaaacgaccaguauauauucacugggcaaccgcuuaacaacgacgaagaccaugcccacuggaccgaagccaagaugcuguuagacaacauaaacacucccgagggaaucauacccgcccuauucgagccggaacgagaaaagucggccgcgauagacggggaauauaggcugaaaggcgaaaguagaaaaacguuuguagagcuaaugcggagaggcgaccucccuguguggcuugcccacaaaguggccagugaaggcaucaaauacacugaccggaaauggugcuucgacggagagaggaacaaccagauucuggaagagaacauggauguagagauauggacgaaagagggugaaagaaagaaacucagaccuagauggcuagacgcaagaacauacucggacccccuggcgcucaaagaauuuaaagacuucgcagcggggcgaaaauccauagcgcuagaucuagucacagagaucgggagagucccgucccaccucgcacacaggacaaggaaugcacuggacaaucuugucaugcuucacacaucagagcacgguggacgagcauacaggcacgccguggaagaacugccagaaacaauggagacacuccuguugcuagggcuuaugauacuucugacagggggcgcaaugcuuuuucugauaaguggcaaaggaauaggaaagaccagcauaggacuaauaugcguuaucgugucuucugggaugcucuggauggcggacguaccguuacaguggaucgcuucggcgauagugcuggaauuuuucaugauggugcuacuaaucccagaaccagaaaaacaacggaccccgcaggacaaucaauuagcuuacgucgucaucggaauacuaacacucgcagcaaucgucgcagcuaacgaaaugggccugcuagaaaccaccaaaagggaccucgguaugagcaaagagccagggguugugucuccgacaucauaccuugacgucgaucuacacccagccuccgccuggacauuauacgcuguagcaacgacaguaauaacaccgaugcugaggcacacaauagaaaacuccacggcgaaugucucccuggccgcgauagccaaccaggcuguagugcuuaugggccuagacaagggcuggccgaucuccaaaauggaccuaggaguaccgcuucuggcauugggaugcuacucccaggucaacccacuaaccuuaacggcagcagugcuacucuuaguaacgcacuacgcaauaaucgguccgggccuucaagccaaggcaacaagagaagcacagaaaaggacagcggcgggaauaaugaaaaauccuaccguggacgggaucaugaccauagaccuggaucccguaaucuacgacucaaaauucgaaaagcaacuaggacaaguaauguuacucguacugugcgcgguacaguugcuucucaugcgaacuucuugggcucugugcgaggcccuaacacuggcaaccggacccauaacgaccuuaugggaaggaaguccagguaaguucuggaauacaacaaucgcagucucaauggcaaacaucuuucguggaagcuaccuagcaggagcaggccuagcguuuucgauaaugaaguccgugggcacagggcggagaggcaccgggagccaaggcgaaaccuugggagagaaauggaagaagaaacucaaucaacucucaagaaaagaguucgaucuauacaaaaagaguggcauaaccgaagucgaccgaaccgaagcaaaggaagggcucaaacguggcgagacuacccaucaugccgugagcagagggagcgccaagcuacaaugguuuguagaacggaauaugguaauaccggagggucgagucaucgaucuaggguguggccgcggugggugguccuauuacugugcaggacuaaagaaaguuacugaagugcgcggcuacacaaaaggcgggccaggacaugaagaaccuguaccuauguccacauacggauggaacaucguuaaacucaugucaggaaaggacgucuucuaucuaccgcccgaaaagugugacacccugcucugugacaucggcgaaagcucaccgagccccaccgucgaggaaucccggacgauccgaguccuaaaaauggucgagccauggcuaagaaacaaccaauuuuguaucaaggugcucaacccuuacaugccgacggugauagaacaccuggagaggcuccaacguaaguacggaggcaugcucguccgaaacccccucagccgaaauagcacacaugagauguacuggauuucuaacgguacgggaaacauaguaucaaguguaaacaugguaucgagacuccuacuuaaccgauuuacuaugacacacaggaggccgaccaucgagaaagacguugaccuaggcgccgggacaagacaugucaacgcugaaccagaaacgccuaacauggacguaauaggagagagaauaaagcgaaucaaggaagaacauucguccacguggcacuaugacgacgaaaaccccuacaaaacaugggcauaccacggcagcuacgaaguaaaagcgacgggcuccgcaaguuccaugaucaauggggucgugaagcuccucaccaagccgugggaugugguuccaauggugacccagauggccaugacagauaccacucccuuuggccaacaaagggucuuuaaagaaaagguagacacccguacaccccgcccaaugccggggaccagaaaagucauggagaucacugccgaguggcuauggcggacuuuaggacgcaauaagaaaccgagacucugcaccagagaagaguucacaaagaagguaaggacaaaugcugccaugggagccgucuucacugaagaaaaucaaugggacuccgcccgagccgcuguggaagacgaagaguucuggaagcuagucgaccgcgaacgggaacugcacaaacuugguaaaugcggcagcugcgucuauaacaugaugggaaagcgcgagaagaaacugggcgaauuuggcaaagccaaagggagcagagcgaucugguauauguggcuaggcgcccgauacuuagaguucgaggccuugggauucuuaaaugaggaccauugguucagucgcgaaaacagcuacuccggcgucgaaggggaaggccuucacaagcucggcuacaucuuacgugacaucagcaagauaccaggcggcgcgauguacgcggaugauaccgcagggugggacacgcgaauuacggaagacgaccugcacaaugaagagaaaauaacgcagcaaauggaccccgagcaccgacaauuggcaaacgccauauuuaaacuaaccuaucaaaacaagguagugaagguccaaagaccaacgccuaaaggcacggucauggacaucaucagcaggaaagaccaacggggauccggucaagugggcacguauggauugaacaccuuuaccaauauggaagcccaguugguccgccaaauggaaggcgagggaguacuuagcaaggcagacuuggaaaacccucaccuccuggagaagaaaaucacgcaguggcucgagacaaaaggaguagagcgucucaaaagaauggcgauaucaggcgacgacugugucguaaagccaaucgacgaccgauucgcaaacgcgcuacucgcccucaacgacaugggaaaagucaggaaggacauaccccaauggcaacccucaaaaggauggcaugacuggcaacagguaccauucugcucccaucacuuccacgagcugauaaugaaagacggccgaaagcuggucguuccauguaggccccaagacgagcugaucgggcgagcacgcauaucucaaggagccggauggagcuuaaaagaaacggcgugccuagggaaagccuacgcacaaauguggucccucauguauuuucaccggcgcgaccuacgccuagcgagcaaugccaucuguagcgccgugccagugcacuggauaccuacgaguagaacaaccuggucuauacacgcgcaccaccaguggaugacgaccgaggauaugcuaacagucuggaacagaguguggauugaagacaauccauggauggaggacaaaacucccgucaccacgugggaagauguuccuuacuuaggaaaacgcgaggaccaguggugcgggagccugaucggacucacaucucgggcgacaugggcacaaaacauccucaccgcaauacagcaaguaagaucucugauaggcgaugaggaguuccucgacuacaugccaaguaugaagcgauuccggaaagaagaagagagcgaaggcgccaucugguaa

SEQ ID NO: 25782 - RNA, 9873 nt, Artificial Sequence
  derived and/or modified CDS sequence (opt11) from DENV-3__HM181933__SS-prME
acaagucuaugccuuaugaugauguuaccggccacucucgcguuucaccugaccagccgggacggcgaaccaagaaugaucguaggcaaaaacgaacgggggaaaagccuacucuucaaaaccgcuagcggaauaaauaugugcacgcuaaucgcuauggacuugggagaaaugugcgacgacacggucacauauaaauguccacugaucgcagaaguggaaccagaagacauagauuguugguguaaccucacuucaacauggguaacauacggaaccugcaaccaagccggggaacaccgucgcgacaaaaggucaguagcauuagcgccgcacgucgggaugggccuagauacacguacccagacauggauguccgccgaaggagcuuggagacagguggaaaaaguggaaacaugggcgcugcgccacccagguuuuacaaucuuagcacuguuccuggcgcacuauauaggaacaucccucacacaaaaagucgugaucuucauacugcugaugcucgugacgccuucgaugaccaugcgcugcgugggggucgggaaccgcgacuucguugaaggauuaucgggagccacgugggucgacguaguacucgaacacggcggaugugugacgacgauggcgaaaaguaaacccacccuggauauagagcugcagaaaacugaagcuacccaacuggccacguuaaggaagcucugcauagagggcaagaucacaaacauaacgacagacagcagaugcccaacccaaggggaggcaacacuaccggaggaacaagaccaaaacuacgucuguaagcacacguauguggaccgaggcuggggaaacggaugcggauuauuuggcaaaggaagccucguaacuugcgcaaaauuccagugucuagagccaauagaggggaaagucguccaauacgaaaaccuaaaguauacaguaauaaucacagugcacacaggggaccaacaccaagugggcaacgauacacaaggcgugaccguagagauaaccccacaagcuagcaccguagaagcgguucuacccgaauauggaacgcugggucuggaaugcagcccgcggacagggcuagacuucaacgaaaugauacuauuaacgaugaagaauaaagcguggauggugcaccgacagugguucuucgaucucccacuucccuggaccagcggggcuacgacugagacuccaacuuggaaccgaaaggaauuacuggugacuuuuaaaaacgcgcaugccaagaaacaagaaguagugguccucggcagccaagagggagccaugcauacugcacuaaccggcgcuaccgaaauccaaaacucuggcggcaccuccauauuugcuggacaccugaaaugcagacugaagauggacaagcuagagcuuaaaggaaugaguuacgcgaugugcuuaaacacguucgugcugaaaaaggaggucucugaaacgcaacauggcacgaucuugauuaagguugaauacaaaggagaagacgcgccauguaaaaucccguucucgaccgaagacgggcagggcaaagcacauaacggaaggcugaucaccgcaaacccagucgucacgaagaaggaagaacccguaaacauagaggccgagccaccauucggagaaucaaacaucgugauagggaucggagacaaagcccuaaaaaucaauugguacaagaaagggagcucuaucggaaagauguucgaagccacagcccggggcgcccgucgcauggcuauccucggagacacggcaugggacuuuggcuccguaggagggguucugaacagccugggaaaaaugguccaccagauuuuugggucagcuuacacagcauuauuuagcggaguaagcuggaucaugaaaauuggaaucggcgugcuccugacauggauuggauuaaacuccaaaaacaccucaauguccuucuccuguaucgugaucgggaucaucacacucuaccuuggcgcggucguucaagccgacaugggcugcgcgauaaacuggaaggguaaagagcuaaaaugugguagcgggauuuucgugacgaacgaaguccacaccuggacggaacaauacaaguuccaagcggacuccccgaaaaggcuugccacagcaauugccggagcgugggagaacgggguaugcgguauucgcucaacaacucggauggagaauuugcuuuggaaacaaauagccaacgaacuaaacuacauacucugggaaaacaacaucaaacuuacggucguggucggagauaucauaggcgugcuggagcaaggcaagcgaacacuaaccccacagccuauggagcuaaaauacagcuggaaaaccugggguaaagcaaagaucgugacagcagagacccaaaacucauccuucauuauagacggacccaacacucccgaaugccccagugcauccagggcguggaacgugugggaaguagaggacuacggcuucggcgucuucacgacaaauauuuggcucaaacugcgggaaguguacacccaaucgugcgaccacaggcugaugucagcagcaauaaaagaugagagggccgugcacgcagacaugggcuacuggauagaaagccagaaaaauggaaguuggaaacuagagaaagcgucauucaucgaaguaaaaacaugcacguggcccaaaagccacacacucuggucgaacggcguacuggagagcgauaugauaauaccuaaaucguuggccgggcccauaucacaacacaaccacaggccuggcuaccauacucaaacugcuggcccauggcacuugggcaaacuggaacuggauuucaacuauugugaaggaaccacuguaguuauaacagaaaacugcggaacacgaagacccucacuccgcacgacuacaguaagcgggaaauugauccacgaaugguguuguagauccugcaccuuaccgccgcuccgcuacaugggcgaggacggaugcugguacggaauggaaauaagaccaauaaacgagaaagaggaaaauauggugaaaagccuagugucagcagggagcggcaaaguugacaacuucaccaugggugugcugugcuuagcuaucuuauuugaagaagucaugcguggcaaguucggaaagaagcacaugauagcagggguauuauucaccuuugugcuccucuugagcggccagauaacauggagagacauggcucauacgcuaaucaugauaggcagcaacgccucugauagaaugggcaugggugucaccuaccuagcucucaucgcgacuuucaaaauacaaccauuccuggcccugggguucuuccucaggaaacucaccaguagagaaaaccuacugcuaggagucggccuggcgauggcaaccacccuacaauuacccgaagacauugaacagauggcaaauggaauugcucugggccucaugacacuuaaacuuaucacacaguucgagacguaccaauuauggacggcuuuagucucucucacaugcagcaacaccauuuucacucugacaguggccuggaggacugcuacuuuaauauuagccgguguuucguuacuccccuugugucagucgagcaguaugaggaagacagacuggcuuccgaugacaguagccgcaauggggguuccaccccugccucucuucauauucucccugaaggauacaccaaaaagacggaguuggccucuaaacgaaggggucauggccguaggcuuggucucaauacuagcaaguagucuacugagaaacgacguaccgauggccggcccccucguggcaggagggcuacucauagcguguuacguaaucacagggacauccgccgaccucacaguagaaaaggccgcagacguaacgugggaagaggaagccgagcaaacaggaguaagccacaacuuaaugauaacgguggacgaugacgggacgaugagaauaaaggacgacgaaacugaaaacauccuaacggugcuccuaaaaacagcacuacugauagugaguggaauuuuccccuacucuaucccagcgacgcuacuuguuuggcacacguggcagaaacagacccagcgcuccggagugcuaugggacgugccaagcccacccgagacacaaaaagcagagcucgaagaggggguguaucguauaaagcaacagggcauauuugguaagacgcaaguaggcguuggcguacagaaagagggcguuuuccacacaauguggcacguuaccagaggggcuguucucacgcacaacggaaagcggcuagagccaaauugggcgagcguuaagaaagaccucauaucauaugguggagguuggcgcuugaacgcgcaauggcaaaaaggggaggaaguccaggugauagccgucgagcccggcaaaaacccaaagaauuuccaaacgaugcccggaaucuuucaaacaaccacgggcgagaucggcgcuauagcacucgauuucaagccagguaccaguggaucaccaauaaucaaucgcgaggguaaagucguaggucuguacggcaauggaguaguaaccaaaaaugggggcuacguuagcgggaucgcgcaaacuaacgcagagccagacgggccgaccccagagcuugaagaggaaauguuuaagaaaagaaaucuuacgauaauggaccuccacccgggauccggaaaaacaaggaaauaccugcccgcuauaguaagagaagcaaucaaacgccgacugcggacacuaauacuagcaccaacgcgcguaguugcugcggaaauggaagaagcccugaaaggauugccgauacgcuaccaaaccaccgcgacgaaauccgagcacacuggccgcgagauuguagacuugaugugccaugcgacguucacaaugcgccuccuauccccuguaagagugccaaauuacaaccucgugauuauggacgaagcgcacuucaccgacccggccaguaucgcugccagagguuacauuucgaccagaguaggaaugggggaggcggcagccaucuucaugacagccacacccccaggaacggcagaagcauucccccaguccaaugcgccaauccaagacgaggaaagggacauaccggaacgcagcuggaacagcgguaacgaguggaucacagacuucguaggcaaaaccgucugguucgugccaucaauuaaagcaggcaacgacaucgccaacugccugcggaaaaacggcaaaaaggucauacaacuaucaagaaaaaccuuugacacagaguaccagaagacgcguuugaacgauugggacuucgucgugacgaccgacauaagcgaaaugggagcaaacuuuaaggcagacagaguaauagacccccgcagaugccucaagccagugauacugaccgacggaccagagagaguuauccucgcgggcccaaugcccguaacagcugccagcgcagcccaacgccgcggacgaguuggucggaauccccaaaaggaaaacgaccaguacaucuucaccggucagccgcuuaauaacgacgaagaccaugcacauuggacagaagcaaagaugcuguuagacaacaucaacaccccagaggggaucaucccagcccuauucgagccggagagggagaaaagcgcagcaauugacggugaauaccgccucaaaggggaaucgcgaaagacuuucgucgagcuaaugcgaaggggagaucuuccaguauggcuagcccacaagguagcauccgaagggauuaaguacacggacagaaaaugguguuuugauggcgaaagaaacaaccagauacucgaggagaacauggacguagaaaucuggaccaaagaaggugaaaggaagaaacuucgcccacgguggcucgacgcacgaaccuacuccgacccucuagcgcuuaaagaguucaaggauuucgccgccggaagaaaaagcaucgcgcuagaucuaguaacagagaucggcagaguccccagccacuuagcgcaucguacaaggaaugcgcuagacaacuuagucaugcuacacacaagcgaacacggaggccgagcauacaggcacgcugucgaggaauuaccggaaacuauggaaacacuucuccuacucggauuaaugaucuuacuaaccggcggagccaugcuuuuccucaucucuggaaaggguauagggaaaaccagcauaggccucauaugcgucauuguaagcagcggaaugcucuggauggcggaugucccacugcaguggauugcgagcgcaaucguucucgaguucuucaugauggugcuacugaucccagaaccggagaaacagagaacuccacaagacaaccaacuagcauacgucguaauagggauacuaacgcucgcagcgauaguagcagcgaacgaaaugggccuacucgaaacgaccaagcgugauuuaggaauguccaaagagcccggcgucguaucgccgacguccuaucuagacguagaccuccacccagcaucagcguggacacuauacgcugucgccacaaccguuaucacccccauguugagacacaccauagaaaacucgaccgcgaacgucagccuugcggcgaucgcuaaccaggcagucguguuaaugggacucgacaaagguuggccaaucucaaaaauggaucuaggcgucccgcuacuggccuuaggguguuacucucagguaaauccacucacacuuaccgccgcgguacuccuauuggucacacacuaugcgauaaucgggccaggccugcaagcgaaagccacacgcgaggcccagaaacguacagcagcgggcaucaugaagaauccaaccguagauggaaucaugaccauugaccucgacccugucaucuacgacucuaaauucgaaaaacagcuaggucaggucaugcuccuaguccuaugugcgguacagcuacuccugaugcgaaccagcugggcucucugugaggcauuaacgcuagccaccggaccaauaaccacguuaugggaggggagcccgggcaaauuuuggaacacaacaauugccguuagcauggccaacaucuuuaggggcagcuaccucgcgggagcgggacuggcguucucaauaaugaaguccguaggcacagguagaaggggaacggguagucagggagaaacguuaggagaaaaguggaagaagaaauugaaccaacucucccgaaaagaguucgaucuauacaagaaaagugggauaacggaaguagaucgcacggaagcuaaggaaggccuaaagagaggcgaaacaacgcaccaugcgguaagcagaggcuccgcgaagcuccagugguucguagaacgaaauauggugaucccugagggucggguaaucgauuuagggugcgggcgaggaggauggucauacuauugcgccggacuuaaaaagguaacagaaguccggggcuauaccaaagggggaccaggccacgaagaaccaguacccaugagcacauacggguggaacauaguaaaguugaugagcggcaaggacguauuuuaccucccacccgagaagugcgacacgcugcucugcgacauaggagaaucaagcccaucaccuacaguugaggagucacguacgauacgaguccuaaaaaugguagaacccuggcuucgaaauaaucaguucuguauaaaaguguuaaacccuuacaugccgaccguaauagaacauuuggagcggcuccaacgaaaauacggagggaugcuaguacgaaacccacuuagccgaaauucaacacaugaaauguauuggauuagcaacggcaccggaaacauaguaagcucagucaacaugguaucaagacuccuacucaacagguuuacgaugacgcaucgcagaccaaccaucgagaaagacgucgaccuaggagccggcacgcgucacguaaaugcagagcccgagacccccaauauggacgugauaggugagcgcauaaagcggauaaaagaagaacacucgucuacauggcacuaugacgacgaaaacccauauaagaccugggcuuaccauggcucauacgagguaaaggcgacaggaagcgccucgucuaugaucaauggggugguaaagcugcuaaccaaaccaugggacguaguccccauggugacccagauggccaugacggacacuacuccguucggccagcaaagagucuuuaaggaaaagguagacacccggacuccacgcccuaugccgggcacucgaaaaguaauggaaauaacagcggaauggcuauggagaacacuaggacgaaacaagaaaccacgccuguguacuagggaagaguucacgaagaaagucaggacaaacgccgcaaugggcgccgucuucaccgaagaaaaccaaugggacagcgcgcgcgcugcagucgaagacgaggaguucuggaagcuaguagacagagagagagagcuacacaaguuagguaagugcggcagcugcguauacaauaugaugggcaaaagagaaaagaagcucggggaguuuggcaaagcaaaagggucaagagcgauaugguacauguggcucggcgcccgauaucuggaauuugaggcccuaggcuucuugaacgaggaccacugguucagccgcgaaaauuccuacucaggcgucgagggcgaaggacuacauaaacuaggcuacauacuucgggacaucuccaagauaccaggaggcgcaauguacgcagaugacacugcuggcugggacacaagaauuaccgaggacgaccuacacaaugaagagaaaauaacacagcaaauggauccagaacaucgccaacuugcaaacgccauauucaaauuaaccuaccaaaacaaagugguaaaaguccaaaggccaacgcccaaaggaacaguaauggacauaauuagcagaaaagaccaacgagggagcggacaagugggcaccuacggucucaacacguucaccaacauggaggcccaacucguacgccaaauggagggggaggguguacuuagcaaagcggaccuggaaaacccucaccuucuggaaaagaagaucacgcaguggcucgagacgaaaggcguagaacgacucaagaggauggccauauccggugacgacugugugguaaaaccgauugacgacagguucgcgaacgcgcugcucgcacugaacgacauggggaaagucaggaaagacauuccgcaguggcagccguccaagggcuggcacgacuggcagcaaguuccguucugcucucaccacuuucacgaacugaucaugaaagacggacgaaagcuagucguaccaugucggccccaagacgagcuaauagggcgugcacguaucucucaaggagcaggguggucacuaaaagaaacagcaugccugggcaaagcguacgcccagauguggagccucauguacuuucaccgacgcgaccuacggcuugcgagcaacgcaaucuguagcgcaguaccgguucauuggauaccaaccagccgcacaacguggucaauucacgcucaccaccaauggaugacgaccgaagacaugcuaacagucuggaaucguguuuggauagaagacaauccauggauggaggauaaaacgccaguaacgaccugggaagacguaccauaucuagggaaacgcgaagaucaguggugugggucccucauaggucuaaccucccgggcaaccugggcccagaacauacuaacagcgauacagcagguccgcagccucauaggggacgaagaguuccuggauuacaugccuaguaugaagcgauucaggaaagaagaggaaucggaaggcgcgaucugguaa

SEQ ID NO: 25783 - RNA, 9873 nt, Artificial Sequence
  derived and/or modified CDS sequence (opt11) from DENV-3__JF295012__SS-prME
accagccugugccucaugaugaugcucccggccacccuggccuuccaccucaccagccgggacggggaaccccggaugaucgugggcaagaacgagcgcggcaaaucccugcuguucaagaccgcuagcggcauaaacaugugcacccugaucgccauggaccugggcgagaugugcgacgauaccgugaccuacaagugcccccugaucgcggagguggagcccgaggacaucgacugcugguguaaccucaccuccaccugggugaccuacgguaccugcaaccaggccggcgagcaccgacgcgacaagcgguccguagcccuggcgccccacguggguauggggcuugacaccaggacacagaccuggaugucagcagagggcgccuggagacaaguggagaaggucgaaacgugggcccuccgccauccgggguuuaccauccuggcucuauuccucgcgcacuacauaggcaccucccuuacccagaaaguggugaucuucauccugcuuaugcuggucacgccgagcaugacuaugagaugcgugggugugggcaaccgugauuucguggaaggucuauccggggcuaccuggguggacgugguucuugagcacggggguugcgugacuacgauggccaagagcaaaccgaccuuagacaucgagcugcagaagacggaggccacccaacucgccacucugaggaaauugugcaucgagggcaagaucaccaacaucaccaccgauucccgcugccccacgcaaggcgaggccacccucccggaagagcaggaccaaaacuauguguguaagcacaccuacgucgauagagggugggggaacgggugugggcuguucgggaaaggcagccuggugaccugcgccaaguuccaaugucucgagccuaucgagggcaaggugguccaguaugagaaucugaaguauacggugaucaucacuguucacaccggggaccaacaccaggucgguaacgauacccagggugugacggucgagauuacgccccaggccuccaccguggaggccgugcucccggaguacggcacccucgggcuugagugcagcccgcgcacagggcuggauuuuaacgagaugauacuccugacgaugaagaacaaggcguggaugguccaccggcaaugguucuucgaucugccccucccauggacuuccggcgccaccaccgagacgcccaccuggaacaagaaagaacuucuggucaccuucaagaacgcucacgccaagaagcaggaagugguuguccucgggagccaggagggcgccaugcacaccgcgcugacgggugccaccgagauccagaacuccggugggaccagcaucuucgccggccaucucaagugccgccuaaagauggacaagcuggagcugaagggcaugaguuaugccaugugccucaacaccuucguguugaagaaggagguaagcgagacgcagcacggcaccaucuugaucaaaguggaguacaagggcgaggacgcuccgugcaagauacccuucucaacagaggaugggcagggcaaggcacacaacggcagacuaaucaccgccaaucccguggucacuaaaaaggaggagccaguuaacaucgaagccgagccgccauucggagaguccaacaucgugauaggcaucggggacaaggcccucaagaucaacugguacaagaaaggcagcuccauuggaaagauguucgaggcgaccgcucgcggcgcgagacgcauggccauccugggggacacggccugggacuucgguucgguugguggaguguugaacagccucggcaagauggugcaccaaaucuucggaucggcguacaccgcccuuuuuaguggcgucucauggaucaugaagauaggaauagggguguuacugacguggauuggacugaauuccaagaacaccagcauguccuucagcugcaucgugauagggaucauuacacucuaucucggcgccgucguccaggccgacauggggugcgugaucaacuggaagggcaaggagcugaagugcggaucggguaucuucgucaccaacgaggugcacacguggaccgagcaguauaaguuccaggccgacagccccaagcggcuggcgacagccaucgccggcgccugggagaacggggugugcggaaucagguccaccacgcgcauggagaaccuccuguggaagcagaucgccaacgagcugaauuacauccuuugggagaauaacauuaagcugacagucguggugggggacaucauugggguucuggagcaagggaagaggaccuuaacgccccagccgauggagcugaaguacagcuggaagacgugggggaaagccaagaucgugacagccgaaacccagaacucauccuucauaaucgacggacccaacacccccgagugcccguccgccagucgcgcauggaacgucugggaagucgaggauuacggguucggggucuucacgaccaauauauggcuuaagcuacgggagguguacacccagagcugcgaccaccgccugauguccgcggccaucaaggacgagcgggccguacacgccgacaugggcuacuggaucgagagccagaagaacgggucauggaagcucgagaaggccagcuuuaucgaggucaaaacguguaccuggccgaagucccauacacucuggucaaaugggguacuagaauccgacaugaucaucccuaagagccucgcgggucccaucucccaacauaaccaccgccccgguuaccacacccagacugcggggcccuggcaucuuggcaagcuggaguuggauuucaacuacugcgagggcaccacggucgugaucaccgagaacugcgggacgcggggcccgagccuccgcaccacgaccgucuccggcaagcugauucacgaguggugcuguaggagcuguacgcugcccccgcuccgcuacaugggcgaggaugggugcugguacggcauggagauccggcccauuaacgagaaggaggaaaacauggugaagucgcuggugagcgccggcuccgggaagguggacaacuuuaccaugggcgucuugugccucgccauccuguuugaggaggugaugcgagggaaauucggcaagaagcacaugaucgccggugugcuguuuacguuuguccuccugcugagcggccagaucaccuggcgggauauggcgcacacccucaucaugaucggguccaacgccagcgaccgcauggggaugggcgugaccuaccuggcacugauugccacguucaagauccaacccuuccucgcccugggauuuuuccugagaaaacucacuagccgagagaaccugcugcucggcgucggcuuagcgauggccaccacccuccagcuccccgaggacauagagcagauggcaaacgggauugcccugggucugaugacguuaaagcugauaacgcaguucgagaccuaccagcuguggacagcacucguaagccugacgugcucaaacaccaucuucacccuaaccguggccuggcggacugccacccucaucuuggccggagucucccugcucccgcugugccagagcuccagcaugcgcaagaccgacuggcugccuaugaccguggccgcgaugggcgugcccccgcuaccgcuguucaucuucucccugaaggauacgcccaaaaggcgcuccuggccccuaaaugaaggcgucauggcagugggucuaguuagcauucuggccagcucuuuacugcgcaaugacgugcccauggccggcccgcuggucgcgggggggcuccucauugcguguuacgucauaaccgggaccuccgccgaccugaccgucgagaaggccgccgacgugacgugggaggaagaggcugagcagaccggcgucucccacaaucucaugaucaccgucgacgaugaugggaccaugcggaucaaggacgacgagacagaaaacauccucacggugcugcucaagaccgcgcugcugaucgugagcgggaucuuccccuacuccauccccgccacguuguuagucuggcacaccuggcagaagcagacucagcgcagcggaguucuaugggacgugcccuccccgcccgagacccaaaaggccgagcucgaggagggcgucuaccggauuaagcagcaaggcauuuucggcaagacucaaguggguguggggguccagaaggagggcguauuccacaccauguggcacgugacgcggggugccguccugacccacaacgguaagcggcuggagcccaacugggccagcgugaagaaggaccucaucuccuacggcggcggcuggcgcuuaucugcgcaauggcagaagggggaggagguacaagucaucgcaguggagcccggcaaaaacccgaagaacuuccagaccaugcccgggauauuccagaccacaacgggggagaucggcgcuaucgcccuggauuuuaagccggggacaagcggauccccgauuauaaaccgggagggcaaagucguggggcuguauggaaauggaguagugaccaagaacggcggguacgugucugguaucgcacaaaccaacgcugagcccgacgguccgaccccugagcucgaggaggagauguucaagaaaaggaaccugaccauuauggaccugcaccccggguccggaaagacccggaaguaccuaccagccauagugcgcgaggccaucaaacggagacugcggacgcugauacucgcccccacccgcgugguugcggccgagauggaggaagcucugaagggguuacccauccgguaucagaccaccgccacaaaaagcgagcacaccggacgcgagaucguggaccucaugugccaugccaccuucacuaugcgacuacuguccccggugcgcgugcccaacuauaaccucgucauaauggacgaggcgcacuuuacggaccccgccagcauugccgcccgggguuacaucuccacccgcguggggaugggcgaggcugcugccaucuuuaugaccgccacgccucccgggacagcggacgcguucccgcaaagcaacgcccccauccaggaugaggagcgggacauccccgagcgcuccuggaauagcggcaaugaguggaucacggacuucgcugggaagaccgucugguucgugcccucuaucaaggccggcaaugacauagccaacuguuuacggaaaaacgggaagaaggugauccagcuaagccggaagacauucgauacggaguaccagaagaccaaacucaacgacugggacuucgucgugaccaccgauaucuccgagaugggugcgaacuuuaaggcagaccgcgugaucgacccccgaaggugccugaaacccgucauccuaacugacggccccgaacgggugauucucgccgggccgaugcccgugaccgcggccagcgcggcccaacgacgcggccggguugggcggaacccacaaaaggagaacgaucaguacaucuucaccggccagcccuugaacaacgacgaagaucacgcccacuggaccgaggccaaaaugcugcucgacaacauuaauacccccgaggguaucauccccgcccuguucgaaccggaaagagagaagagcgccgcgaucgacggcgaguaucgccugaagggcgagagccgcaaaacuuucguggagcuaaugcggaggggugaucugcccgucuggcuggcucacaaaguugccuccgaaggcaucaaguacaccgauagaaaaugguguuucgacggggagaggaacaaccaaauccuggaggagaacauggacgucgagauuuggaccaaggagggcgagcggaagaagcuccgcccgcgauggcucgacgcacggaccuacagcgauccguuagcuuugaaagaguucaaggacuucgcagcgggccgcaagucuaucgcucuggacuuggucacggagaucgggcgagugcccagccaccuggcucaccgcacccgcaacgcacucgauaaccucgugaugcuccacaccucugagcauggcgggcgugccuaccggcaugccgucgaggaacugccggagacuauggagacauugcugcugcucggccugaugauccuguugaccgggggcgccauguuguuccugaucuccggcaaggguaucggcaagaccuccauaggccucaucugcguuaucgugagcagcggcaugcuguggauggccgacguuccccugcaguggaucgcauccgccaucguccucgaguucuucaugaugguccugcugauccccgagccggagaaacagcgcaccccgcaggacaaccagcucgcguacgucgugauagguauccugacacuggcugcaaucgucgccgccaacgaaaugggucuccuggagaccacaaagcgggacuugggcaugagcaaggagccaggggucguuuccccuaccagcuaccuggacguggaccuccaccccgccucugccuggacacuguacgcagucgccacuacagucauaaccccaaugcuucgccauaccauagagaacaguaccgccaacgugucccuggccgcgaucgccaaucaagccguagugcugaugggucucgauaagggguggccgauaagcaagauggaccugggggugccccugcucgcccuggggugcuacucccaggucaacccucugacccucaccgccgcggugcugcuguugguaacgcacuacgccauuaucggccccggccugcaggccaaagccacccgagaggcccagaagcgcaccgcggccgguaucaugaagaaucccaccgucgacgggaucaugacgaucgaccuggaccccgugaucuacgacagcaaguucgagaagcaguuaggacaggugaugcuguuaguacucugcgccgugcagcuguuacucaugcggaccuccugggcccugugcgaggcacugacccuugcgacuggccccaucacaacgcugugggagggcagcccagggaaguucuggaacaccacgaucgcuguguccauggccaauaucuuccgcggcagcuaccuugccggcgccggcuuggccuucuccaucaugaagucggucgggacgggccgucgcggcaccgggucacagggagagacccugggggagaaguggaagaaaaagcugaaccagcucagucggaaggaguucgaccucuacaagaagucuggcaucaccgagguggacagaaccgaagccaaagagggccugaagcggggcgaaacgacccaccaugccguaagucgcggcucggccaagcuccagugguuuguagagcguaacauggugauccccgaggggcgcguuaucgaccugggcugcgggcggggcgggugguccuauuacugcgcugggcuaaagaaagucaccgaggugcgcggcuacaccaagggugggcccgggcacgaggagccugugccgaugagcacguacgguuggaacaucguaaaacucauguccggcaaggacguguucuaccugccgccugagaagugcgacacccuguuaugugauaucggggagagcucccccuccccgacgguugaagagucccgcaccauccgggucuuaaagaugguggagcccuggcuccgcaacaaccaguucugcaucaaggugcugaacccguacaugcccacggucauugaacaccucgagcgccugcaacgaaaguacggcgggaugcuggugcgcaacccgcucucacgcaacuccacccacgagauguacuggauaagcaacgggaccgggaauaucgucucuucagucaacauggugucacggcuacugcucaaucgcuucacgaugacgcaccggcgccccaccaucgagaaggacgucgaccugggcgccggaacccggcacgugaacgcugagcccgagacaccgaacauggacgugaucggcgagcgcaucaagcgaaucaaggaggagcauagcuccacguggcacuaugaugacgagaaccccuacaagacaugggccuaccacggcagcuacgaagucaaggcaaccgguucggccuccucuaugaucaauggcguggugaagcuacugaccaagcccugggaugugguccccauggugacgcagauggccaugaccgacaccaccccguucgggcagcagcgcgucuucaaggagaagguugacacuagaacgccccgucccaugcccgggacccgaaaggugauggagauaaccgcagagugguuguggagaacgcugggccgaaacaagaagccgcgccucugcacucgcgaggaguucaccaagaagguccgcaccaacgccgccaugggcgcgguuuucacagaggagaaccagugggacuccgcccgcgccgcuguggaggacgaggaguucuggaagcuggucgaccgggaacgcgaacugcacaagcucggcaagugcgggagcugcguguacaacaugaugggaaagagagagaagaagcuaggcgaguucggcaaggcgaagggcucacgcgccaucugguacauguggcuuggggcgcgguaccucgaguucgaggcccugggcuuccugaaugaggaccacugguucagccgcgagaacaguuacuccgggguggaaggugaagggcuucacaagcugggcuacauccucagggacauuuccaagauccccggaggggcuauguacgcggacgacaccgccggcugggacacgcgcaucacggaggacgaccugcacaacgaggaaaagaucacgcaacagauggaucccgagcaccggcagcuugccaacgcgaucuucaaguuaaccuaccaaaauaagguggugaaggugcagcgccccaccccgaaggggaccgucauggacauuaucagccggaaggaccagcgcggcucgggucagguggggaccuacggccucaacacguucaccaacauggaggcucaguuggugcggcagauggaaggggagggcguucugagcaaggcggaccuagagaacccucaccuccuggagaagaaaaucacccagugguuagagacaaaggggguggaaaggcugaagcggauggccaucuccggcgacgauugcgucgucaagcccaucgacgauagguucgcaaacgcccugcucgcgcuaaacgacaugggcaaagugcggaaggauauuccccaauggcagccgagcaagggguggcacgacuggcagcagguucccuucugcucccaccacuuccacgagcuaaucaugaaggaugggcguaagcucgucgugcccugccggccgcaggacgagcuuaucgggcgcgcgcgcauuucgcaaggcgcuggcuggucccugaaggagacagcgugccucggcaaggccuacgcccagauguggagccuuauguacuuccacaggcgggacuugaggcuugcguccaaugcgaucugcagcgccgugccgguccacuggauccccacaagcaggaccaccugguccauccacgcacaccaccaguggaugacgaccgaggacaugcugacaguauggaaucggguguggaucgaggacaaccccuggauggaggacaagacccccgucacaaccugggaagacgugccguaccugggcaagcgggaagaccaguggugcgggagccucauaggccugaccucucgggcgacaugggcacagaacauccugacggccauccagcaagucagaagccucaucggggacgaagaguuccuggacuacaugcccagcaugaagcgguucaggaaggaagaggagagcgagggagccaucugguga

SEQ ID NO: 25784 - RNA, 9873 nt, Artificial Sequence
  derived and/or modified CDS sequence (opt11) from DENV-3__FJ898463__SS-prME
accagccucugccucaugaugauacugcccgccgcucuggcguuccaccucaccagccgggauggggagccgcggaugaucguggggaagaacgaacgggguaagucgcugcucuucaaaaccgccagugggaucaacaugugcacacucaucgccauggaccucggagagaugugcgacgacaccgugaccuauaaguguccccacaucaccgagguggagccugaggacaucgacugcuggugcaaccugaccagcaccugggugaccuacggaaccugcaaccaggccggagagcacagacgcgacaagcgguccguggcccucgcgccgcacguaggcauggggcuugacacgcggacccaaaccuggaugagcacggaaggagcauggcgccaagucgagaagguggaaaccugggcccugcgccacccgggguucacuauacuugcccuguuucuggcgcacuacaucggcaccucccucacgcagaaggucgucaucuucauacugcugaugcucgucacacccagcaugaccaugcggugcguggggguaggaaaccgcgacuucguggagggcuugagcggcgccaccuggguugacgugguccuggaacauggcgggugcgugacaacuauggcuaagaacaaacccacccucgacaucgagcugcagaagaccgaggccacgcagcuggccaccuugcgcaagcugugcauagaaggcaagaucaccaacauuacuacggacagcagaugucccacgcagggugaggcagugcugccggaggagcaggaccagaacuacgugugcaagcauaccuacgucgaccggggguggggcaacggaugcggcuuauucgggaagggcucccugguuaccugcgcaaaauuccagugucuggagccgaucgagggcaagguagugcaguacgagaaccuaaaguacacggucauaaucaccguucacaccggcgaccagcaccagguggguaacgagacccagggggucacggccgagaucacuccccaggccuccaccaccgaggcaaucuugcccgaguacggcacccugggccucgagugcuccccacgcacgggccuggacuucaacgagaugauccuucucaccaugaagaacaaggccuggaugguacaccggcagugguucuucgaucugccucugcccuggacaagcggggccaccaccgagacucccaccuggaaccggaaggaguuacugguaaccuucaagaacgcccacgccaagaagcaggaagugguggugcuggggucucaggagggcgccaugcacacggcucucaccggugcuacagagauccagaacagcggcgggaccuccaucuucgcuggccaccuaaagugccggcugaagauggauaaauuagaacugaagggcaugagcuacgcgaugugcacgaauaccuucguccugaagaaggagguguccgagacccaacacgggaccauacucaucaagguggaguacaagggcgaggacgccccguguaagauucccuucucaacugaggacgggcagggcaaagcucauaacggcaggcugauuacagcaaacccugucguaaccaagaaggaggagccagugaacaucgaagcagagccgcccuuuggggagagcaacaucgucaucggcaucggggacaaugcccucaagauaaacugguacaagaaaggguccucgaucgggaagauguucgaggcaaccgcaagaggcgcacgccggauggccaucuugggcgauacggccugggacuucggguccgugggggggguucuuaacagccuggggaagaugguccaccaaaucuucgguagugccuauaccgcccucuucagcggcguguccugggugaugaagaucgggaucgggguccuccucaccuggaucggccugaauagcaagaacacuuccaugagcuucuccuguaucgcgauugggaucaucacgcucuaucugggcgccgugguucaggcugacaugggaugcgugaucaacuggaaggguaaggaguugaaguguggcuccgggaucuucgugaccaacgaggugcacaccuggaccgagcaauauaaguuccaggcggacuccccuaagcgccucgccacggccauugccggcgccugggagaacggggucugcggaauccgcagcaccaccaggauggagaaccugcuguggaagcaaaucgccaacgaguugaauuacauccugugggaaaauaauauuaaacugaccguggucguuggggacauaaucggcgugcucgagcaaggcaagcgcacucugacgccacagccgauggagcugaaguacucuuggaagacgugggggaaagccaagaucguuaccgcggagacacagaacaguucuuucaucaucgacggccccaacaccccagaaugccccagcgccuccagggcguggaaugucugggagguggaggacuacggguuuggcguguucaccacgaacaucugguuaaaguuacgcgaaguauacacccaacugugcgaccaccgguuaaugagcgcugccguaaaggaugaacgcgccguccaugcagacaugggauauuggaucgagucgcagaagaacgggucuuggaagcuggaaaaggcgagccugaucgaggugaagacgugcaccuggccgaaaucccacacgcucuggagcaauggcguucuggaguccgacaugauuauucccaagagccuggccgggcccaucucacagcacaaccacaggccgggcuaccauacccaaacggccggccccuggcaccucggcaagcuugagcuggacuucaacuacugcgagggcaccaccguggucaucacugagaacugcgggacgcgcggucccagcuugcggaccacuaccguguccgggaagcugauucacgaguggugcugccggagcugcacgcugcccccacuccgguacaugggagaggauggcuguugguacggaauggagauccggcccauauccgagaaggaggagaauauggucaagucguugguauccgccggcagcgggaaaguggacaacuucaccaugggcgugcuaugcuuagcaauccuguuugaggaagucaugcgggggaaguucgguaagaagcacaugaucgcggggguguucuucaccuucgugcugcuccuauccggacaaaucaccuggcgcgacauggcucacacccugaucaugaucgguagcaacgcgagugaccggauggggaugggcgucaccuaccuagccuuaaucgccaccuucaagauacagccuuuccuggcguuaggguucuuccugcgcaaacuaaccagccgcgaaaaccuccugcuaggcgugggacuggccauggcuacaacccuucagcugccugaggacaucgaacagauggcgaacgggaucgcgcucggccugauggccuuaaaacuaaucacccaguucgagacauaccagcuguggacagcccuaaucagccuaaccugcagcaauaccauguucacucuaacaguggcauggcgcaccgccacccugauacuggcgggggugagccugcugccggugugccaaaguagcuccaugaggaaaaccgacuggcuacccauggcggucgccgccaugggcguuccgccccucccgcuguucaucuucagccucaaggacacacugaagcgccgcuccuggccccucaacgaggggguaauggccgucggccucgugagcaucuuagcgaguagccugcucagaaacgacgugccaauggccggcccccuggucgccggcggacugcucaucgccugcuacguuaucaccgggacguccgccgaccugacuguagaaaaggcugccgauaucacgugggaggaggaggcggagcagacgggcgucagccacaaucugaugaucaccguggaugacgacggcaccaugcggaucaaggacgacgagaccgagaacauccucacgguccuguugaagaccgcccuccugaucgucuccggaguguucccguacagcauccccgccacgcugcucguguggcacacuuggcagaaacagacucagcguagcgggguucugugggauguucccagcccgcccgagacccagaaggcugagcuggaggaggggguguauagaaucaagcagcaaggcaucuuugggaagacucaggucgggguugggguucagaaggagggagucuuccacacaauguggcacgugacccggggugccgugcucaccuacaacgggaagcgcuuagagcccaacugggcuuccguaaagaaggaucugauuagcuacggcggggguuggcggcucuccgcccaguggcaaaagggugaagaaguccaggugaucgccguagagcccgggaaaaaccccaagaacuuccaaaccaugcccggcaccuuccagacgaccacgggcgagaucggcgccaucgcccuggauuucaagcccgggaccagcggcagccccauuaucaaccgcgagggcaagguggucgggcuguacggcaacggggucgugacgaagaacgggggauacgugaguggcaucgcccagacgaacgcagaaccggacgguccgacucccgagcuugaggaggagauguucaagaagcguaaccucaccauuauggacuugcauccagggagcggcaagacgcgcaaauaccugccugcgauuguccgagaggcaaucaagagacggcuccgcacccugauucuugcccccaccaggguggucgccgccgagauggaagaggcgcucaagggucucccuauccgcuaucagaccacggccacuaaguccgagcauacuggacgggaaaucgucgaccugaugugccacgcuaccuucacgaugcgcuuguuaucgccagugcgggugccgaacuacaaucucauuaucauggacgaggcgcacuucacugaucccgccuccaucgcggcccgcggcuauauaucaacgcgggucggcaugggcgaggccgccgcgaucuucaugacugccacgccgcccgggacagccgacgcauucccgcaguccaacgcccccauccaagacgaagagcgcgacauccccgagcgcagcuggaacuccggcaaugaguggauuaccgauuucgcggguaagaccgugugguucgugcccagcauuaaggccggcaaugacaucgccaacugccuccggaagaacgggaagaaggucauccaguugucccgcaagacguucgacaccgaguaccaaaagaccaagcugaacgacugggacuucguggugaccacggacaucagcgagaugggcgccaacuuuaaggccgaccggguaaucgacccgcgccggugucucaagcccgugauucugacggacgggccggaacgugucauccuggcagggcccaugccggucaccgcagcguccgcugcccaacgacguggccggguggggcgcaacagccagaaggagaacgaccaauacaucuucaccggucagccccuaaacaacgacgaggaucacgcccacuggacagaggccaagaugcuacuggacaacaucaacacgcccgaggggauaauccccgcacuuuucgaaccggaacgugagaaguccgccgcgauagacggcgaguaccgccugaagggcgagagccgaaagacuuuuguggaacugaugcgccgcggggaccuacccgucuggcuggcgcauaagguggccuccgagggaaucaaguacaccgaucgcaaauggugcuucgaugggcagaggaacaaccaaauccuugaagagaacauggacgucgaaaucuggaccaaagaaggcgagaagaagaagcuccgcccacgguggcuggacgcccgcacguacagugauccccuggcccucaaggaguucaaggauuucgcggccggucgaaaauccauugcccuggaucuggugacagagauuggacgggugccgagccaccucgcccaucguacccggaacgcacuugacaaucuggucaugcuccacaccagcgaacauggcggccgcgcguaccggcacgcggucgaggagcugcccgagacgauggagacccuucuucugcuggggcucaugauacuuuuaaccggaggcgcgaugcuguuccugaucuccggcaaagguaucggcaagaccagcaucgggcugaucugcgugauugccuccagcggcaugcucuggauggccgagaucccccuucaguggaucgcguccgccaucguccuggaguucuucaugauggugcuccugaucccggagcccgagaaacagaggacuccacaggacaaccagcuggccuacguggucaucgguauccucacccuggccgccaucaucgcggcgaaugagaugggccugcucgagaccaccaagcgcgaccuuggcaugucaaaagaaccaggugugguuuccccaacgagcuaccuggacgucgaccuccacccugccuccgccuggacccuguacgcgguagccacaaccgucauaacucccaugcuccgccacacuauagagaacaguaccgccaacgucucccucgccgccaucgccaaccaggccgucguucugauggggcuggacaagggguggcccaucagcaagauggaccucggcgugccccugcuggccuugggaugcuacucccaagugaauccccugacccugacggcugccgugcugcuguugaucacccacuacgcgaucaucgggccuggccuccaggcaaaggccacgcgggaggcccagaagagaaccgcggcgggaaucaugaaaaaccccacggucgacggcauuaugacaauagaccuggauccggugaucuaugauagcaaguucgaaaaacaacugggccaaguaaugcucuuagucuugugcgccgugcagcuccuucugaugcggaccuccugggcccuuugcgaggccuugacccuagcuacgggcccuaucaccacacugugggagggcagcccggggaaguucuggaacaccacgaucgccgugucgauggccaacaucuuccgaggcagcuaccucgccggggccggccuggcguuuuccaucaugaaguccguaggaaccggcaagcgcgguaccgggagccaaggcgagacccucggggagaaguggaagaagaagcugaaccagcuuucccgcaaggaauucgaccucuacaaaaagucaggcauuaccgagguugaccggacggaggccaaggaggggcugaagaggggcgagaccacccaccacgcugucucgcgggggagugcuaagcugcagugguucgucgagaggaacauggugauccccgaggggcgggugaucgaccucggguguggacgcggggguuggagcuacuacugcgcuggacugaagaaggugaccgaggugcgaggcuacacaaagggagggccagggcacgaggaacccgugccaaugagcaccuacggcuggaacaucguaaagcugaugagugggaaggauguguucuaccucccgcccgagaagugcgacacccugcugugcgacaucggcgaaagcucccccagccccacaguggaggagagucgcacgauacgcguacucaagaugguagagcccuggcucaagaacaaccaauucugcaucaagguccugaaccccuacaugcccaccgucauugagcaccuggaaagauugcagcgcaagcacggcgggaugcugguuaggaacccucugagccguaacuccacccacgagauguacuggaucucaaaugggacaggcaacaucguggcuuccgucaacaugguaagccgccuccugcugaaucgcuucacgaugacccacagacgcccgaccaucgaaaaagauguagaccucggagccggaacaaggcacgucaacgccgagccggaaacgcccaauauggacgugaucggggaacgcauuaagcggaucaaggaggaacacaacucaaccuggcacuacgacgacgagaacccguacaagacuugggccuaucacggcagcuacgaggugaaggccaccgggagcgcgagcucuaugaucaauggcgucgugaagcuccuuacgaaaccgugggacgucgugcccauggugacgcagauggcaaugaccgacaccacucccuucgggcagcaaagggucuuuaaggaaaagguggacacccgcacgcccagauccaugccgggcacgcggcgcguaaugggcaucacggccgaauggcucuggacgacccuggggcggaacaagaagccccgccugugcaccagagaggaguucacaaagaagguccgcaccaacgccgcgaugggcgccguauucacagaggaaaaccagugggauagcgccaaggccgccguggaggacgaggacuucuggaagcucgucgaccgcgagcgggagcugcacaagcuggggaaguguggcucuuguguguauaacaugauggggaagcgcgaaaaaaagcucggugaguucggcaaggcgaaggguagccgggccaucugguauauguggcugggcgcucgcuaccuagaguucgaggcccucggguuccugaacgaagaccacugguucagccgcgagaacagcuacucuggcguggagggugagggcuuacacaagcucggcuacauacugcgcgacaucagcaagauccccggcggggcuauguacgccgacgacacagcagggugggacacacggaucacagaggaugaccugcacaacgaggaaaagaucacccagcagauggaccccgaacaccgccagcucgcuaacgccauuuuuaaacugacauaccaaaacaaggucgugaaggugcagaggccgacuccgacgggcaccgucauggacaucaucucccgcaaagaccaacggggaucaggucaagugggcaccuacgggcugaacacuuuuacuaacauggaggcgcaguugauucgucagauggaaggcgagggggugcugagcaaggcggaucuggagaacccccaccuccccgaaaagaagaucacccaauggcuggaaaccaagggcgucgaaaggcuuaagcgaauggccauaagcggcgacgacugugugguaaagccgaucgaugaccgguucgccaaugcgcuccuugcccugaacgacauggggaagguacgcaaagacauuccccaguggcaacccagcaagggcuggcacgacuggcagcagguccccuucuguucucaccacuuccacgagcucaucaugaaggauggucggaaacugguggucccuugccgcccccaggacgaacugaucgggcgggcgcgcaucucucagggagccggcuggagccuccgugaaaccgccugccugggaaaggccuacgcgcagauguggucgcuaauguacuuccaccgccgcgaccuaagacuagcaagcaacgccaucugcuccgccgugccggugcacuggguccccacgagcaggaccacguggucaauucacgcccaucaccaguggaugacgacugaggauaugcugaccguguggaaucggguguggaucgaggauaacccauggauggaagacaaaacgcccguuaccacgugggagaacgugcccuaucuggguaagcgcgaggaucaguggugcggcucccugauugggcugaccucucgggccaccugggcacagaacaucccgacugcaauccagcaaguucggucccucaucggcaacgaggaguuccuagacuacaugcccuccaugaagcgcuuccgcaaagaggaagagucagagggggccaucugguga

SEQ ID NO: 25785 - RNA, 9873 nt, Artificial Sequence
  derived and/or modified CDS sequence (opt11) from DENV-3__GQ868616__SS-prME
accagccucugccucaugaugauccugcccgcagcccuggcguuccaccucaccucgcgggacggggagccacggaugaucgucggcaaaaaugagcgcgguaagagccugcuguucaagaccgccagcgggaucaacaugugcacccucaucgccauggaucugggggaaaugugugacgacaccgugacauacaagugcccacacaucaccgagguugagcccgaggacaucgacugcuggugcaaucugaccagcacuuggguuaccuacgggacguguaaucaggccggcgagcaccggcgcgacaagcgguccguagcccucgcaccucacgugggcauggggcuugacacccgcacccagaccuggaugagcacggagggcgccuggcgccagguggagaagguggagacgugggcccugcgccacccuggguucaccauccucgcccuguuccuggcgcacuauaucggcaccucccucacgcagaagguggugaucuucaucuugcugaugcucgugacccccagcaugaccaugagaugcgugggggucggcaaccgagauuucgucgagggcuuauccggggccaccuggguggacgugguccuggagcacggcgggugcgugacgaccauggccaaaaacaagcccacccucgacauugaguuacagaagaccgaagcgacgcagcuggccacccuccggaagcugugcaucgagggaaagaucaccaacaucaccacggacagucggugccccacccaaggcgaggcggugcugccggaggagcaagaccagaacuaugucugcaagcacaccuacguggacagagguuggggcaacggguguggccucuucggcaagggcagucuggugaccugcgccaaguuucagugccuggaacccaucgaggguaaaguugugcaguacgagaaccugaaauacacggugaucaucacuguccacaccggggaccagcaucaaguuggcaaugagacacaggggguuacggccgagaucacaccccaggccagcacuacagaggccauacugcccgaguacggcacccuggggcucgagugcuccccgcgcacgggucuggauuuuaacgagaugauccugcucaccaugaagaacaaggcauggaugguucaccggcagugguucuucgaccugccccuacccuggaccucgggggcgaccacggagaccccgaccuggaaccgaaaggaguugcuggugaccuucaagaacgcccacgccaagaagcaggaggucgugguacuggggucccaagagggagccaugcacacagcgcucacgggagccaccgagauccagaacagcggcgggacauccaucuucgccggccaccugaagugccgguuaaagauggacaagcuggagcugaagggcaugagcuacgccaugugcacuaacaccuucguucugaagaaggagguguccgagacccaacacggaaccauacucaucaagguggaguacaagggcgaggacgccccgugcaagauucccuucagcacggaggacgggcagggcaaagcccacaacggucgccugaucaccgccaaccccgucguaaccaagaaggaggagccggugaacaucgaggccgagccgcccuucggggagagcaacaucgucaucgguaucggggacaacgcacugaagaucaacugguacaagaaaggcucaagcauagggaaaauguucgaggcgaccgcccggggagcgaggaggauggccauccugggcgacacggcaugggacuucgggucugucggcggggugcucaacucacuaggcaagaugguccaccagaucuucggguccgcguacaccgccuuauucagcggcguguccugggugaugaaaaucggcaucggaguacuccugaccuggaucggucugaacagcaagaauaccucuaugaguuucuccugcaucgccaucgggaucaucacucucuaccugggugccguggugcaggcagacauggggugcgucaucaacuggaagggcaaggagcugaagugcggcucagggaucuucgugaccaacgaggugcacaccuggaccgaacaguacaaguuccaggcugacucccccaagcggcucgccacggccaucgccggggccugggagaacggggucugcgggauccgcucaacaacccggauggagaaccugcuguggaagcagauugcgaacgagcucaacuacauccugugggagaacaacaucaagcugaccgugguggucggagacaucaucggcgugcucgagcagggcaagcgcacgcugacgccccagccgauggagcugaaguacucuuggaagaccugggggaaggccaagaucgugacugccgagacgcagaacagcagcuucaucaucgacggccccaacacccccgagugccccagcgccucccgggcguggaacguaugggagguagaggauuacggguucggcguguucaccaccaacauauggcucaagcugcgcgaagucuacacccagcugugcgaccaccggcucaugagcgcagccgugaaagacgagcgcgccgugcacgccgacaugggcuacuggaucgagagccaaaagaacgggagcuggaagcuggagaaggcgagcuuaaucgaggucaagacgugcacauggccaaagucccacacccucuggagcaacggcgugcuggagagugacaugaucauccccaaaagccuggcggggcccauuucccagcacaaccaccggccggguuaucauacccagacggccgggcccuggcaccucgguaaacucgagcuggacuucaacuacugcgaggggaccacgguggucaucaccgagaacugcgggacgcgcgggcccagccuccggaccaccaccguguccgggaagcugauccacgaauggugcugccggagcuguacgcugccgccgcuccgguacaugggcgaggacgggugcugguacggcauggagaucagaccaauauccgagaaagaggagaacauggucaagagccuagucuccgccggcagcgggaagguggacaacuucaccaugggcgugcugugccucgccauccucuucgaagaggucaugcgggggaaguucggcaagaagcacaugauagcgggaguguucuucaccuucguguuacuccugucaggccagaucacauggcgcgauauggcccauacgcuaaucaugaucgggagcaacgcuagcgaccggaugggcaugggcgucaccuaccucgccuuaaucgccaccuuuaagauccagcccuuccuugcgcucggguucuuccugcgcaaacugacuucacgggaaaaccuccugcugggugugggccucgccauggccacgacucugcagcugccagaggacaucgagcaaauggccaaugggaucgcgcucggccuaauggcccugaagcucauuacgcaguucgagaccuaccagcuguggacugcucugaucagccugaccugcagcaacacaauguucacucugacggucgccuggcggaccgccacccuaauccucgcgggggucucucugcugccggugugccagucgagcaguaugcggaagaccgacuggcuccccauggccgucgccgccaugggcgugccgccccucccgcuguucaucuucagucucaaggacacgcugaagcgccgauccuggccccuuaacgagggggugauggcugucggccucgugaguauccuggcguccagccugcuccggaacgacgugcccauggccggcccccuggucgccgguggccuccucaucgccugcuacgugauuaccggcaccuccgccgaucugaccguggaaaaggcggccgacaucacgugggaggaagaggcugagcaaaccggcgucagccacaacuugaugaucaccguggacgacgacgguacgaugcgcaucaaggacgacgagacggagaacauccucacggugcugcugaagaccgcccuccugaucgucuccggcguguucccguacucaauccccgccacccugcucguguggcacaccuggcagaagcagacgcagcgguccggcguccugugggacgugcccagcccgcccgagacccaaaaggcggagcuggaggagggggucuauaggaucaagcagcagggcaucuucgggaaaacccaggucggcguggguguccagaaagagggcguguuccauaccauguggcacgugacgcggggcgcagugcucacauacaacgggaagcgccuggagcccaacugggccagugucaagaaggaucugaucagcuacggagggggcuggcggcucuccgcccaguggcagaagggggaggaaguucaggugaucgcggucgagcccggcaagaaucccaagaacuuccagaccaugcccggcaccuuccagacgaccacuggggagaucggcgccaucgcccuggacuucaagcccgggaccagcgguucucccaucaucaaccgcgagggcaaagugguggggcuuuauggcaacggggucgugacgaagaauggcggguauguuagugguaucgcccaaaccaacgccgagccggacggccccacccccgagcuagaagaggagauguuuaagaagcggaaccucacgaucauggaccuucaucccgggagcggcaagacgcgcaaguaccugcccgcgaucguacgggaggccaucaagagacgguugcgcacccugaucuuggccccaacccguguaguagccgccgagauggaggaggcgcucaagggauuacccauccgcuaccagaccacugccaccaagucggagcacaccggccgggagauagucgaccugaugugccacgccaccuucacgaugcgccuccugagccccgugcggguaccaaacuacaaccugaucaucauggacgaggcccacuucaccgaccccgccuccaucgcggcacgcggguacaucagcacacgggucggaaugggcgaggccgccgcgaucuucaugaccgccacgccgcccgggacagccgaugcauucccucaguccaacgcccccauccaggacgaggaacgggacauccccgagcgcagcuggaacuccggcaacgaguggauaaccgacuucgcggggaagaccgugugguucgugcccucaaucaaggccgggaacgacauugccaacugccuccggaagaacgggaagaaggucauccagcugucccgcaaaaccuucgacaccgaauaccagaaaaccaagcugaacgauugggacuucguggugaccaccgauaucagcgagaugggcgccaauuucaaggcagaccgagucaucgacccccgccggugccugaagcccgugauccuaacagacggucccgagcgcguaauccucgcggggcccaugccggucaccgccgccuccgcugcccagcggcgcgggcggguggggcgcaacucccagaaggagaacgaccaguacaucuucaccggccagccccuuaacaaugacgaagaccacgcgcacuggaccgaggccaagaugcugcuggacaacauuaacacgccugaagggaucauccccgcccucuucgagccggagcgggagaaauccgccgcgauagacggcgaauaccgccugaagggcgagagccggaaaaccuucguggagcugaugcgcagaggggaucugcccgucuggcuggcccacaagguggccuccgaaggcaucaaguacaccgaccgaaaauggugcuucgacggacagcggaacaaccaaauucuggaggagaacauggacgucgagaucuggacgaaggagggggaaaagaagaagcuccgaccccgguggcuagacgcgcgcacguacagcgacccccuggcccucaaggaguucaaggacuucgcggccgggcgcaaguccaucgcccuggaccuggugaccgagaucggccggguaccgagccaccucgcccaccgcacccggaacgcccuggacaaccuggugaugcuccacaccagcgaacacggcgggcgcgcguaccggcacgcggucgaagagcugcccgagacgauggagacccugcuccugcuaggccucaugauccugcuuacugggggcgccaugcuuuuccugaucucuggcaaggggaucggcaagaccagcaucgggcugaucugcgugaucgcguccagcggcaugcucuggauggccgagaucccccugcaguggaucgcguccgccaucguccuggaguucuucaugaugguucuccugaucccggagcccgagaagcagcgcacgccccaggacaaucagcuggccuacguagucaucgguauccucacacuggccgccaucaucgcggccaacgagauggggcugcucgagaccaccaagcgggaccugggcaugagcaaggagcccgggguuguguccccgacgagcuaccucgacgucgaccugcaucccgcuuccgccuggacccuguacgcgguggcaaccacggugaucacgcccaugcugcgccacacaauugaaaacagcaccgccaacgucucccucgcggccaucgcuaaccaggccguuguucugauggggcuugauaagggauggcccaucagcaagauggaccugggagucccgcugcuggcccucgggugcuacucgcaggugaacccccugacccugacggccgccgugcuccugcugauuacucacuacgcgaucaucggccccggccuccaggccaaggccacccgggaggcgcagaaaagaacggcagcggggaucaugaagaaccccacggucgacggcaucaugaccaucgcccuggacccggugauauacgacagcaaguucgagaagcagcugggccaggugaugcuccugguccugugcgcgguccagcuccugcugaugcggaccucgugggcccucugcgaggcgcugacccuugccacgggccccaucacgacccucugggagggcagcccagggaaguucuggaacaccacuauagccguguccauggcuaacaucuuucggggcagcuaccuggccggggcaggucuggccuucuccaucaugaaguccguggguaccggcaagcgaggcaccgggagccagggcgagacccucggggaaaaguggaagaagaagcugaaccaguugucccgcaaggaguucgaccucuacaagaagucaggcaucaccgagguggaccggacggaggccaaagagggguuaaagcgcggcgagaccacccaccaugccgugucccgaggcagcgccaagcugcagugguucguggagagaaacauggugauucccgagggacgggugaucgaccucgggugcgggagaggcgggugguccuacuacugugcggggcugaagaaggucaccgaggugcggggcuacacgaagggcgggccggggcacgaggagcccgugcccauguccaccuacggauggaauauagucaagcugauguccgggaaggacguguucuaccucccgcccgagaagugcgacacccugcugugcgacaucggcgagagcucgcccucgcccaccguggaggagucgcgcacgauccgcguccugaagaugguggagcccuggcucaagaacaaccaguucuguauuaagguacugaaccccuacaugcccaccgucaucgagcaccuggagcggcuccaacgcaagcacggggggaugcugguacggaacccccugagcaggaacuccacccaugagauguacuggauuagcaacggaaccgggaacaucguggcauccgucaacauggugucacgguuacugcuuaaucgcuucacgaugacccaccggcgccccacaaucgagaaggacguggaccucggugccgggacucggcacgugaacgcagagccagagacgcccaacauggacgugaucggggagcgcaucaagcguauaaaggaggaacacaacuccacguggcacuacgacgacgagaaucccuacaagacaugggccuaccauggaagcuacgagguaaaggcgaccggcuccgcgagcucuaugaucaauggcgucgugaagcugcugacgaagccuugggauguugucccaauggugacccagauggccaugaccgacaccacacccuucgggcaacaaagggucuucaaggagaagguggacacccggacgccccgguccaugccgggcacccggcgcguaaugggcaucacucccgaguggcucuggcggccccuggggcgcaauaaaaagccacggcugugcccgcgcgaggaauucacaaagaaggugcgcaccaacgcucccaugggcgcgguguucaccgaggagacgcagugggccagcgccaaggccgcuguggaggacgaggacuucuggaaacucgucgaccgggagcgcgagcugcauaagcuggggaagugcggcuccugcguguauaauaugauggggaagcgggagaagaagcucggggaguucggcaaggcgaagggcagccgcgccauaugguacauguggcuuggagcccguuaccuggaguucgaggccuugggguuccugaacgaggaccacugguucucccgcgagaacagcuacucgggcguggagggugagggccugcccaagcucggcuacauccugcgggacaucagcaagauacccgggggggccauguacgcggacgacaccgccgggugggacacccgcaucaccgaggacgaccugcacaacgaggagaaaaucacacaacaaauggauccugagcaucggcaacuggccaacgccaucuucaaauuaaccuaccagaacaaggucgugaaggugcagcgccccacccccaccggcaccgucauggacaucaucagucggaaggaccagcgcggcucaggccaagugggcaccuacggucugaauaccuucaccaauauggaggcccagcugauccggcagauggaaggcgagggggugcuuucuaaagccgaccuggaaaacccccaccucccggagaagaagaucacacaguggcuggagacgaagggcgucgagcgacugaagcguauggccaucagcggcgaugacugcguugucaagcccaucgacgaccgcuucgccaacgcccuccuggcccugaaugacauggggaagguccggaaggacauaccccaguggcagcccuccaagggcuggcacgacuggcagcagguuccguuuugcagccaccacuuccacgagcucaucaugaaggacgggcgcaagcuggugguccccugccggccccaggacgagcugaucggcagggcgcggaucagucaaggggccggcuggagccuccgggaaaccgccugucugggcaaggcguacgcgcagauguggucccugauguacuuccaccggcgggaccucagacuggccagcaaugccauaugcuccgccgugcccgugcauuggguccccacgagccggaccacuuggagcauccacgcccaccaccaguggaugaccaccgaagacaugcucaccguguggaaccgcguuuggaucgaggacaacccauggauggaggacaaaacuccugucaccaccugggagaacgugccguaccuugggaaacgggaggaccaguggugcggcucccugaucgggcugaccucacgcgcgacgugggcccagaacauccccaccgccauccagcagguacggucccucaucggcaacgaggaguuccuggacuacaugcccagcaugaagcgcuuccggaaggaagaggagucugagggugccaucugguga

SEQ ID NO: 25786 - RNA, 9873 nt, Artificial Sequence
  derived and/or modified CDS sequence (opt11) from DENV-3__GQ199887__SS-prME
accagccugugucucaugaugauccugcccgcagcccucgcauuucaccucaccucaagggacggggagccgcggaugauaguugggaagaacgaacgcggaaaaagccuacuguucaagaccgccagugggaucaacaugugcacccucauugcaauggaucugggagagaugugcgacgauaccgucaccuauaagugcccccacauaaccgagguagagccugaagacaucgacuguuggugcaaccuuaccucgaccuggguuaccuacgguacgugcaaccaggccggcgagcaccgacgcgacaaacggucagucgcccuugcaccccacguuggaaugggguuggacacccgcacccagaccuggaugucggcggagggcgccuggcgucagguggagaagguugagacuugggcgcugcggcaucccggguucacuaucuuagcgcuguuucuagcccacuacauuggcaccucucuuacccagaaggugguuaucuucauccugcugaugcuaguuacacccagcaugaccaugcggugcgucggggugggcaaucgcgauuucgucgagggucugagcggagccaccuggguggacgugguccuggagcauggagggugcgucaccacaauggcaaagaacaagccuacacucgacauugagcugcagaagaccgaggcaacccagcuggcgacgcucaggaagcuguguauagaggggaagauaacgaacauuacaacugacagccgcugccccacgcagggcgaagccguucugcccgaggagcaggaccaaaauuacgucugcaagcacacauacguggaccggggguggggcaacgggugcggccuauucgggaagggcucccuggucacgugugcaaaguuccagugccuggagucuaucgaaggcaaagucgugcaauacgagaaccucaaauacacgguaaucaucacagugcacacaggggaccagcaucaggugggcaacgagacgcaaggcgucacggccgagaucacgccgcaagccuccacaaccgaggcgauucuucccgaguacggcacacuggggcucgagugcucuccacgcacuggccuggacuuuaaugaaaugaucuuauuaacgaugaaaaacaaggccuggaugguucaccggcagugguuuuucgaucucccgcuucccuggacauccggcgccaccacggagacgccuacauggaaucguaaagagcuccuggugaccuucaagaaugcccaugccaagaagcaagaagucguggugcuggggagccaggagggcgccaugcacaccgcacuaaccggcgccacagagauccaaaacuccggcgggacgagcaucuuugcaggacaccugaagugccgacugaagauggacaagcuagagcugaagggcauguccuacgccaugugcaccaauacguucgucuuaaagaaggaagugucugagacccagcacgggacaauucucgugaaaguggaguacaaaggcgaggacgcgcccuguaaaaucccuuucagcaccgaagacgggcaaggcaaggcccacaacggccgucugauaacggcaaaucccgugguaacuaagaaagaggagccgguaaacaucgaggcugagccuccguuuggggaguccaacaucgugaucgguaucggggacaacgcacuuaagaucaacugguacaagaaggggucuucuaucgggaaaauguucgaggccaccgcccgcggcgcccgccggauggcuauccuuggcgauacagcgugggacuuugggucuguagguggggucuugaacucccugggcaagauggugcaucaaaucuuugggucagcauacacagcccuguucuccggcgugagcugggucaugaagaucggcauaggcgugcuccuaaccuggauaggccugaacaguaaaaauacgucgaugagcuucagcugcaucgcaauaggcaucaucacccucuaccugggugccguggugcaagcggacaugggcugcgucauuaacuggaaggguaaggaacugaaaugcggcuccgggaucuucgucacgaacgagguccacaccuggaccgagcaauacaaguuccaggccgauagcccgaagcgccucgccacagcuaucgccggcgcgugggagaauggggugugugguauccgcucgacgacccgaauggaaaaucuguuauggaagcagaucgccaacgagcucaacuacauacucugggagaacaacauaaaguuaaccguggugguaggagacaccaucggcguccuagagcaaggcaagcgcacgcuuacaccccagcccauggaguuaaaguacagcuggaagaccugggggaaggcgaagaucgucaccgcagagauccagaacucuagcuucauaaucgacggcccgaacacgcccgagugccccuccgcgucucgggccuggaacgucugggagguggaggacuacggguucggcguguucacuacgaacauuuggcucaagcugcgugaagucuacacacagcugugcgaccaccggcucaugagcgcggccgugaaggacgagcgcgccguccaugcggauaugggcuauuggaucgagucccagaagaacgggagcuggaagcucgagaaggccuccuucauugaagugaagaccuguacguggcccaagagccacacucuuuggaguaacggcguucucgaaucagauaugauuauuccuaaaucccuggccgggcccaucucccagcacaauuaccggcccggcuaccacacccagaccgccggucccuggcaccugggcaaguuagagcuggacuucaacuacugcgagggcaccaccguggugaucaccgagaacugcgggacccgagguccgucccugcggacgaccaccguguccggcaagcucauccacgaguggugcugcagaucaugcaccuuaccgccgcugcgguauaugggcgaggauggaugcugguaugguauggaaauucgcccgauaagcgagaaggaggagaauauggugaaaucacucgccagugcgggauccgggaagguugauaauuucaccaugggcgugcugugucuggccauccucuucgaagaggucaugcggggcaaguucggcaagaagcacaugaucgccgggguguucuucaccuucguacuacugcucucugggcaaaucaccuggcgggacauggcccauacccuuauaaugaucggcuccaacgccucugaccggaugggaaugggggucacguaucuggcgcucauugccacguucaagauacagccuuuccuggcccucggcuucuuucuccgaaagcugaccagccgggagaaccuucuccugggugugggucuggccauggcaaccaccuugcagcugccugaagacauugagcagauggccaacggaaucgcccugggcuugauggccuugaaguugauuacccaguucgaaaccuaucagcuuuggaccgcacugguaucccugacgugcagcaacaccauguucacacucaccgucgcguggcgcacggccacccugauccuggcuggggugucccuccugccggucugccagagcuccucgaugaggaagaccgacuggcugcccaugaccguggcugccaugggcgugccgccccucccccuauucaucuucagccugaaagacacgcucaagcgccgcagcuggccccugaaugagggggucauggcugugggucugguguccauccuugcuucgagccugcuucggaacgacgucccuauggccgguccccucguggccgguggcuugcuuaucgcaugcuacgucaucacugggacguccgcugaccucacuguggaaaaggcugcggacgugaccugggaagaggaagccgaacagacuggcgugucacacaaccugaugauaaccguagacgacgacggaacuaugcgcauuaaggacgacgagaccgagaacauccugaccguucuucugaagacggcccugcuaaucgugagcgguauauuccccuacuccauucccgcgacucugcucgucuggcauaccuggcagaagcagacucagcguagcggcguguuaugggacgugccuagcccgcccgagacacagaaagcggagcucgaggagggggucuaucguauuaaacagcagggaauacugggcaagacccagguggggguggguguucagaaggaaggcguguuucacacuauguggcacgugacgcggggcgcagucuuaacgcauaacgggaaacgccuggagccgaacugggcgagcgugaagaaggaccugaucaguuacgggggaggcuggcggcuauccgcgcaauggcagaaaggggaggagguacaggucauagcgguugagccuggcaaaaaucccaaaaauuuccagacaaugcccggaaccuuucagacuacaaccggcgagaucggcgccaucgcccuggacuucaaaccugggaccagcggcaguccgaucaucaaccgcgaagggaaaguagucgggcuguacggcaacgggguggugacaaagaacgguggguacguuagcggaaucgcgcagacuaacgcugagcccgacggcccgacgcccgagcuggaggaggagauguucaggaaacgaaauuuaaccauuauggauuuacacccggggucaggcaagacgcggaaguacuugcccgccaucgugagagaggcuauuaaacgccgccuccggacccuuauccuagccccaacacgcgugguggccgcggaaauggaagaggcccuuaaagggcucccuauccgguaucagacgacugccaccaagagcgaacacacugggcgugagauuguggaucugaugugccacgcaaccuucaccaugcgacuccuguccccuguacgggugcccaacuacaaccugaucaucauggacgaggcccacuuuaccgacccggcgucuauugccgcccgcggcuacaucuccacccgcgugggcaugggcgaagcagccgccauuuucaugaccgccacgccgcccgggacggccgacgccuuuccccagagcaacgcgcccauccaggacgaggagcgagacauuccugagcgcaguuggaacagcgggaacgaguggauuaccgacuucgccggaaaaaccgugugguucgucccuuccauaaaggcuggcaacgacaucgccaacugccuucgcaagaacgggaagaaggugauccaacugucgcggaagacguucgacaccgaguaccagaagaccaaguugaaugacugggacuucgugguuaccaccgacauauccgagaugggggcuaacuucaaggccgaccgcguaauugacccucgccgcugccucaagccggucauucugacggacggccccgagcgggucauccuggccggacccaugcccguaacugcggcuagcgccgcgcaacgccggggccgcgugggccggaacccgcagaaggagaacgaccaauacaucuucacaggccagccccugaacaacgacgaggaccacgcccacuggaccgaggccaagaugcugcucgacaacauaaauacccccgaggggaucauacccgccuuguucgaaccggagcgcgaaaaguccgcggcaauugacggggaguauagacucaagggcgagucuaggaagaccuucgucgaacugaugcgcagaggggaccuccccgugugguuggcucacaaggucgccuccgagggcauaaaauacaccgaccggaaguggugcuucgauggucaacggaacaaccagauccuggaagaaaauauggacguggagaucuggacaaaggaaggcgaaaagaagaagcuccggccccguugguuggacgcucgcacguacagcgauccucuggcccucaaagaguucaaggacuucgccgcgggucggaaguccaucgcgcuugaucuggugaccgaaauugggaggguuccgucgcaccucgcccaucggacccgcaaugcguuggacaaccuggugaugcuacacaccucugagcauggcgguagagcauaucgccacgccguggaggaacugccagaaacgauggagacuuugcuguuauugggccucaugauccuuuugacggguggcgucaugcuguuccugaucuccggaaaggguaucggcaaaaccuccauaggauugaucugcguuaucgccuccagugggaugcucuggauggcggacgugccccuccaauggaucgcgagugcgaucgugcucgaguucuucaugaugguguugcucauccccgagccagagaagcagcgaacuccccaggauaaucaguuggccuauguggucaucgggauacucaccuuggccgccaucaucgcugccaaugaaaugggccuucucgaaaccaccaagcgagaccugggcaugagcaaggagcccggggugguguccccgacgagcuacuuagacgucgaucuacacccugcauccgccuggacucuguacgccguggccacaaccgucaucacucccauguugcggcacaccaucgagaacagcacugccaacguaucccucgccgccaucgcgaaucaagccguggugcugauggggcuagauaagggguggccgauuucaaagauggaccucggagucccucugcuggcccucggcuguuacagucagguuaacccccugacucugacggccgcugugcuccugcugaucacccacuacgcgaucauuggcccuggccugcaggccaaagccacacgugaagcccagaagcggacggccgcggggauaaugaagaacccaacgguggacggcaucaugaccaucgaccuggaccccgugaucuacgacucuaaguuugaaaagcagcugggccaggugaugcuccucgugcuaugcgccgugcagcuccugcugaugcgcaccagcugggcccucugcgaggcccugacccuggcgaccggucccaucaccaccuuaugggagggcucgccugggaaguucuggaacaccacgaucgccguauccauggccaacaucuuccggggcagcuacuuggccggggccggccuggcuuucuccaucaugaaauccguaggcaccggaaagcgcggcaccgguagccagggcgagacccucggggagaaguggaagaagaaacugaaccagcugucacguaaagaguuugaccucuacaagaaguccggcauaacggagguagaccgcacggaggccaaggagggccucaagcggggcgagaccacucaccaugccguuucccgcggcagcgcaaagcugcagugguucgucgaacgcaauaugguaauccccgaggggcgcgugauagaccucgguugcggucggggcgguuggucuuacuacugugcggggcugaagaaggucaccgaggugcgcggcuacacgaaaggaggaccgggccacgaggaacccguucccaugaguaccuacggguggaauaucgucaagcucauguccgggaaagacguguuuuaccuacccccugagaaaugcgauacccugcugugcgacaucggcgagagcucccccagcccuaccguggaggagucccgcaccauccguguacugaaaaugguggagcccuggcuaaagaauaaccaauucugcaucaaggugcugaaccccuauaugcccacagucaucgaacaccuggagcgccuccagcggaaacacggcgguaugcuggugagaaacccccuuucgcgaaacuccacccacgagauguacuggaucucgaacggcacggggaacauagugaguagcgucaauauggucagucgacuacuacugaaccguuuuaccaugacccaccguaggccaaccaucgaacgagacguggaccucggggcgggcacgcgucacgugaaugccgagccggaaaucccgaacauggaugucaucggggagaggauaaagcgaaucaaggaggagcauaacagcacguggcacuacgacgaugagaaucccuacaagaccugggccuaccacggcuccuacgaggucaaggcaaccggaagcgcgaguucgaugaucaacggcguggugaagcuacuaaccaagccgugggacguggugccgaugguuacgcagauggcaaugaccgacaccacacccuucgggcaacagcgcgucuucaaagagaaagucgacacacgcacgccccggccgaugccuggcacucggaaggugauggaaauuacagccgaauggcuguggcgcacgcugggcagaaauaagcgcccccgccugugcacccgcgaagaguuuacuaagaaaguccggaccaacgcagccaugggagcgguguucacggaagaaaaucaaugggacucagccaaggccgccguggaagacgaggaguuuuggaaacucgucgaccgcgaacgugagcugcacaaguugggcaagugcggcuccuguguguacaacaugaugggaaagcgagagaagaaacucggagaguucggcaaagcaaagggcucacgcgcaauaugguacauguggcugggggcucgguaccuggaguucgaggcacuaggcuuccugaacgaggaccacugguucucucgggaaaacucauacuccggcguggagggggaagguuugcauaagcucggcuauauccugcgggauaucaguaaaauaccgggcggagcgauguacgcggaugacaccgcggguugggacacacgcauaaccgaagaugauuuacacaaugaggagaagauaacgcagcagauggacccggagcaucggcagcuggcaaacgccaucuuuaaacuuacauaccagaacaaagucguuaagguacagcgccccacaccaaccggcacugucauggauauuaucucccgaaaggaccaacgcgguucuggccaagucgggacauacggccugaacaccuucaccaauauggaggcccagcucguacgucagauggaaggagagggcguccuguccaaggccgaccuugaaaacccacaucuccuggagaagaagaucacccaguggcuggagaccaaagguguggagcgcuugaagcggauggcgaucucaggcgaugacuguguggucaagccgaucgacgacagguuugccaacgcguugcuggcucucaacgacauggggaaaguacgaaaagacauuccacaguggcagcccucuaagggguggcaugacuggcaacaggugccguuuuguucgcaucacuuucacgagcugaucaugaaggacggcagaaaauuaguugugccgugccguccccaggacgagcucaucgggcgcgcacgcauaucccagggcgcggguuggagccugcgugagaccgcuugccugggcaaagccuacgcccagauguggucccucauguacuuccaccgccgggaccugcgccuugcgagcaacgccaucugcuccgcggugcccguacacugggugcccacuagccggacgacuuggagcauccacgcccaccaccaguggaugacaaccgaagauaugcucaccguauggaaccgcgucuggauugaagacaacccguggauggaagacaaaacgcccgugaccacuugggagaacguccccuaccugggcaagcgagaggaccaguggugugggucccugauaggccucacaucucgcgccacuugggcgcagaacaucccuacugcgauccagcaaguccgcucauugaucgggaacgaggaguuccuggacuacaugccuagcaugaagagauuccggaaggaagaagaaagcgagggcgccaucugguag

SEQ ID NO: 25787 - RNA, 9873 nt, Artificial Sequence
  derived and/or modified CDS sequence (opt11) from DENV-3__GQ199888__SS-prME
accagccugugccucaugaugauccugcccgccgcgcuggcguuccaccucacaagucgcgacggggaacccaggaugaucgucgggaagaacgagcgcgggaaaucgcugcuguucaagacggccuccgggaucaacaugugcacccucauagccauggaucugggugaaaugugcgaugauaccgugaccuacaaguguccacacaucacugaggucgagcccgaggacaucgacugcuggugcaaccugaccagcaccugggugaccuacgggaccugcaaccaggccggggagcaccguagggacaaacgguccgucgcucucgcgccucaugugggcaugggacuggacacucgcacccagaccuggaugucagccgagggggccuggcgacagguggagaagguugagaccugggcccugaggcaccccggauucaccauucucgcgcuguucuuggcccacuacauaggcaccucgcucacgcagaaaguagucaucuucauccugcugaugcuggucacgcccucgaugaccaugcggugugugggggugggcaaccgcgacuuugucgagggccuguccggagccaccuggguugacguggugcuggagcacggcgggugcguuacgacgauggccaagaacaagcccacccucgacauugaacugcagaaaaccgaggccacccagcuggcgaccuuacgaaaacucugcaucgaaggcaagaucaccaacaucaccaccgauucacgcugccccacgcagggcgaggccgugcugcccgaagaacaggaccaaaacuacgucugcaagcacaccuacguggaccggggauggggcaacgggugcggccucuucgggaaaggcucccuggugaccugcgccaaguuccagugccuggagucgauugaaggcaagguggugcaguacgaaaaccuuaaauacaccguuaucauuacgguccacaccggggaccagcaccagguggggaaugagacccagggggucaccgccgagaucacaccccaggccuccacgaccgaggcgauccuccccgaguauggcacccuggggcucgagugcagcccccgcaccggguuggacuucaacgagaugauacugcucacgaugaagaacaaggcuuggauggugcaccgacagugguucuuugacuugccgcuacccuggaccuccggcgccacaaccgagacgcccaccuggaaccgcaaggagcugcugguaaccuucaagaaugcacacgccaagaagcaggaagucgucguacuggggagccaggagggcgcgaugcauacagcccucacuggcgccaccgagauccagaacuccggcgggacgagcaucuucgcaggccaccugaagugccgguuaaagauggauaaacucgagcuuaagggcaugucuuacgccaugugcacgaauacauucguccugaagaaggagguauccgagacccagcaugggaccauucuugugaaggucgaauacaaaggugaggacgcgccuugcaagaucccguucaguaccgaggacgggcaagguaaggcacacaacggccgguuaaucaccgccaaucccguggucaccaagaaggaggagcccgucaacaucgaggccgagcccccguucggggaguccaacaucgucaucggcaccggggacaaugcgcugaagauuaacugguacaagaagggcagcuccauaggaaagauguucgaggccacggcccggggcgccaggcgcauggccauucugggugauacugcgugggauuucgggagcgugggcggaguccucaacuccuugggcaagauggugcaccagauauucgggagcgcauacaccgcccuguucuccggugugagcugggucaugaagaucggcauuggagugcucuugacauggaucggccugaacuccaagaacaccagcauguccuuuagcugcaucgccauuggaaucaucacgcucuaucugggcgccgugguccaggcggauauggggugcgucaucaauuggaaaggcaaggagcuuaagugcggcuccgggaucuuugugaccaacgaaguccauaccuggaccgagcaguacaaguuccaagccgauagccccaagcgccucgcgacggcuaucgccggcgcgugggaaaauggggugugcggcauccgcuccaccacgagaauggagaaucugcuguggaaacaaaucgccaacgagcucaacuacauccugugggagaacaacaucaagcugacgguggucguaggggacacgaucgggguccucgagcagggcaagcgcacccugacgccucaacccauggagcucaaguacagcuggaagaccugggggaaggcgaagauagucacggccgaaauccagaacucaaguuucaucaucgacggcccgaacacccccgagugccccuccgcgagccgugccuggaaugugugggagguggaagacuacggguuuggcguguucaccaccaacaucuggcucaagcugagggaaguguacacccagcugugcgaccaccggcucaugagcgccgccgugaaagacgaaagagcaguccacgccgacaugggguacuggaucgaaagccagaagaaugggucauggaaacuagagaaggcgagcuucaucgaggugaagacguguaccuggcccaagucccacacccuguggaguaacggcguccucgagagcgacaugauuaucccgaaguccuuggccggaccgaucagccagcacaacuaccggcccggcuaccauacgcagacagccgggccuuggcaccuaggcaaacucgagcuggacuucaacuacugcgagggaaccaccguagugaucaccgagaacugugggacgcgcggcccaucccugaggaccaccaccguguccgggaaguugauccacgaauggugcugccgcucgugcacgcugccaccccuccgguacaugggcgaggacgggugcugguauggcauggagauccggccgauuucggaaaaggaggagaauauggucaaaagccucgccagcgcgggcucuggaaagguggauaauuuuaccaugggugugcugugucuggcaauccuuuucgaggaagucaugcgggggaaguucgggaagaagcacaugaucgccggggucuucuuuacguucgugcuguugcuaagcggacaaaucaccuggcgcgacauggcccauacccugauaaugaucggaagcaacgccagcgaccguauggggaugggcgucaccuaucuggcguugaucgccacguucaagauccagcccuuccuggcccugggcuucuuucuccgcaaacugacaagcagggagaaccugcucuugggcguggggcuggccauggcgacgacacuccagcugccagaagacaucgagcagauggccaauggaaucgccuuagggcucauggcccugaaauugaucacccaguucgagacauaccagcucuggacugcccucguguccuuaaccugcaguaauaccauguuuacccucacggucgcguggcgcacagccacccugauccuugccggggugucucugcuccccgucugccagucaaguagcaugaggaaaacagacuggcuccccaugacuguggcggccaugggggucccgccccucccucuuuucaucuucucacugaaggauacgcucaagcgccgcagcuggccucugaaugagggggucauggcggugggccugguguccauccucgccagcucccuauuacgaaacgaugugcccauggccggaccccucguggccgggggcuugcucaucgccugcuacgucaucaccgguaccagcgcggaccucacgguugagaaagccgccgacgugacgugggaagaggaggccgagcagaccggcguaucccacaaucugaugaucaccguggacgacgacgggaccaugcgcauuaaggacgaugaaacggagaacauccugacaguacuccugaagaccgcccugcucaucgugagcgggauauuccccuacuccaucccggcgacgcugcuggucuggcacacauggcaaaagcaaacccagcgaagcggcguucucugggacguucccagcccgcccgagacccagaaggccgagcuggaggaaggggucuacagaaucaagcagcaagggauccucgggaagacccaaguggguguggguguccaaaaggagggcguguuccacacgauguggcaugugacccggggugccguccucacccacaacgggaagcgccuggaaccgaacugggccagcgugaaaaaggauuuaauuagcuacggagggggcuggcgcuuaagcgcgcaguggcagaagggggaagagguucaagucaucgccguagagcccggcaaaaaccccaagaacuuccagaccaugcccggcacguuucagaccaccaccggagagauaggcgccaucgcccucgacuucaagccggggacgucgggcagcccuauuaucaacagagagggcaaaguugucgggcuguacggcaacggggucgugaccaagaacggcggguacguuagcggcaucgcccaaacaaaugcggagccagaugggcccacgcccgaauuagaagaggagauguuccggaagcguaaucucaccaucauggaccugcauccuggaucuggcaaaacccggaaauaccugccggccaucgugcgcgaggcuaucaagcggcgccuccggacccugauucuugccccgacccgcguggucgccgccgagauggaggaggcucuuaaggggcuccccauccgguaucagacgaccgccaccaagagcgagcauacuggucgcgagaucguggaccugaugugucacgccacguucaccaugcggcuccucucucccgugcgcgucccgaacuacaaucugaucauuauggacgaggcccacuucacagacccggcgagcaucgcagcccggggguacaucuccacucggguuggaaugggagaggcagcggcaaucuuuaugacggcaacgccgcccgggacugccgaugcauucccccagagcaacgcgccuauccaagacgaggagcgggauaucccugagcggaguuggaacagcggaaacgaauggaucacggacuucgccgguaagacgguaugguucguaccuaguaucaaggcgggcaacgauaucgccaacuguuuacgcaagaacgguaagaaggugauccagcucagcagaaagaccuucgacacagaguaccagaagaccaaauuaaacgacugggacuuuguuguaacgaccgacaucuccgagaugggggcgaauuuuaaagcggaccgcgugauugacccgcgucgaugccuaaagccggucauccugaccgacggccccgagcgggucauucuggccgggcccaugccgguuaccgccgccagcgccgcgcagcgcagaggaagggugggccggaauccgcagaaggagaacgaccaauacaucuucaccggccagccacucaacaacgacgaggaccacgcgcacuggacggaggccaaaaugcuucuggacaacauaaacacaccagaggggauaaucccugcccucuucgaaccggagcgggagaaaagcgcggccauugacggagaauacaggcuuaagggcgagagccgaaagaccuucgucgagcucaugcggcgcggggaucuccccguguggcuugcccauaaagucgccuccgagggcaucaaguacaccgaucgcaaguggugcuucgacgggcagaggaacaaccagauuuuggaggagaacauggacguggagauauggacgaaggagggcgagaagaagaagcuccggccacgcuggcuggacgcccgcacauacagcgacccccuagcgcucaaggaguucaaggacuucgcagccggcagaaagucgaucgcccucgaccuggugaccgagaucggucgcgucccgucucaucuugcgcaucggacucgcaacgcgcuggauaaucuggugauguuacacacgagcgaacacggcggacgggcauaucgccacgcaguggaggaguuacccgagaccauggagacccugcuccugcugggucucaugauccugcugaccgggggcgcgaugcuguuccugaucuccggcaaggggaucggcaaaacuagcaucgggcucaucugcgucaucgcauccagcggaaugcucuggauggcggacguccccuugcaguggaucgccucugccauagugcuggaguuuuucaugaugguauuguuaaucccggagcccgagaagcagcggacaccucaggacaaccaacuggccuacguggugaucgggauccugacccuggccgcuaucauagccgcaaacgagaugggccugcucgagaccaccaagcgcgaccuggggaugagcaaggaaccuggggucguguccccgaccucuuaccuggacguugaucuccaccccgccuccgcguggacccuguacgcaguagccaccacggugaucacccccaugcuacggcacacaaucgagaacagcaccgcaaacgugucccucgcggcgaucgcgaaccaggcggucgugcugaugggucuugauaagggauggccaauuagcaagauggaccucggaguaccucugcuggcccucgggugcuauucccaggucaacccccugacgcugaccgccgccgugcuccugcuaaucacccacuaugccaucaucggccccggccuccaggccaaggccacccgagaagcccagaagcgcacggcggccggcaucaugaagaaccccaccguggauggcaucaugacaaucgaccuggaccccgucaucuacgacaguaaguucgagaagcagcugggacagguaaugcucuuagugcucugcgcgguccagcuccuguuaaugcgcaccuccugggcacugugcgaggcucuuacguuagccaccggcccaauaaccacccucugggagggcagccccgggaaguucuggaauacgaccaucgccguguccauggccaacauauuccggggcagcuaccuggccggggcgggccuggccuucucgaucaugaaauccgugggaaccggcaagagaggcacagggagccagggcgagacccucggggagaaguggaagaagaagcugaaccaacugagccggaaggaguucgaucucuacaaaaaguccggcaucacggagguagaucguacagaggcuaaggaggggcugaagaggggugagaccacccaccacgccgugucccgcggcucagcuaaacugcaaugguucguggagcggaacauggucauccccgaagggcggguuaucgaccucggcugugggcggggcgggugguccuacuacugcgccggccugaagaaggugacagagguacgcggcuacacuaaaggcgggccggggcacgaggagcccguacccaugagcacuuacggcuggaacaucgugaagcugauguccggcaaggacgucuucuaccucccgcccgagaagugugacacacuucugugugauaucggugagucgucccccucccccacaguggaagagucucgcacgauccgggugcugaagaugguggagccguggcucaagaacaaccaguucugcaucaagguacugaacccguacaugcccacugugauagagcaccuggagcgccuccagcggaaacacggugggaugcugguccgcaacccccugucccguaacucgacccacgagauguauuggaucagcaacggcacggggaacauaguuuccagcgucaacauggucucacgccuccugcugaaccguuucaccaugacccaccgccggccaaccauugagcgcgauguggaccucggcgccgggacgcgccacgugaacgcggaaccggagauccccaacauggacgucaucggagagcguauuaagcggauaaaggaggagcacaacagcacauggcauuacgacgacgaaaacccguacaagacuugggccuaccacggauccuacgaggugaaggccaccggcagcgcgaguaguaugaucaacgggguagugaagcuguugacgaagccgugggacgugguccccauggugacgcagauggccaugacugacaccacgcccuucgggcaacagcgcguauucaaggagaaggucgacacccggacaccccguccgaugcccgguacccggaaggugauggagaucacugccgaauggcucuggcgcacuuugggacggaacaagcgcccccgccugugcacccgggaggaguucaccaagaagguccgcacgaacgcagcgaugggggccgucuucaccgaggagaaccaaugggacagcgcuaaggccgcuguagaggacgaggaguucuggaaacuugucgaucgagagagggaguuacacaagcugggcaaaugugggaguugcgucuacaacaugaugggcaagagagagaagaaguugggggaguucggcaaggcgaaaggcucccgcgccaucugguacauguggcuaggggcacgguaccuugaguucgaagcgcucggcuuccugaacgaggaucacugguucucccgcgagaauagcuauuccgggguggagggugaggggcugcauaagcucggguauauucugcgggacaucagcaagauccccggcggggccauguacgcagacgacaccgccggcugggacacacggaucacggaggaugaccugcacaacgaggaaaagaucacgcaacagauggacccggagcaccggcagcucgcuaacgccaucuucaaacucaccuaccagaacaaggucgucaaggugcagcgccccaccccaacagggacggugauggacaucaucucccggaaggaucagcgaggcucuggccaggucgguaccuacggccugaacaccuucaccaauauggaggcgcagcuugugcggcagauggagggggaggaugugcugucaaaggccgaucuggagaacccacaccucuuggagaagaagauaacgcaguggcuggagacaaaaggcguggagcgcuuaaagcguauggccaucagcggggacgauugcguggugaaaccgauugacgaccgcuucgcgaacgcccuacuggccuugaacgauaugggcaagguucgaaaggacaucccccaguggcagcccuccaagggcuggcacgacuggcagcaggucccguucuguagccaccacuuccacgagcugaucaugaaggacggacgcaagcugguggucccgugcaggccccaggaugagcugaucggucgcgcccgcaucucgcagggggccggcuggagccugcgggagacagcgugccuggggaaggcguacgcgcagauguggucccucauguacuuccauaggcgggaccugagacuggccagcaacgcuauaugcuccgccguucccguucacuggguucccaccucucggacgaccuggagcauucacgcccaccaccaguggaugacuacagaagacaugcucacgguguggaaccgcgucuggauagaggauaacccguggauggaggauaagaccccugucacuaccugggagaacgucccuuaccuuggcaagcgggaggaccaguggugcggcuccuugaucgggcuuacgucucgcgcgaccugggcccagaacauccccaccgcuauacagcagguccggucccugaucgguaacgaggaguuucuggacuacaugccgaguaugaaacgcuuccggaaagaggaggaaagugaaggggccaucugguag

SEQ ID NO: 25788 - RNA, 9873 nt, Artificial Sequence
  derived and/or modified CDS sequence (opt11) from DENV-3__GQ252674__SS-prME
acgagccugugccucaugaugauccugcccgcggcucuggcguuccaucucaccagccgggacggggagccgcgcaugaucguggguaagaaugagaggggcaagagccuucuguucaaaaccgcauccgguaucaacauguguaccuugaucgccauggaccugggggagaugugcgacgauaccgugacauacaagugcccccacauuacugagguggaacccgaggacaucgacugcuggugcaaccuaaccagcaccuggguuacauacggcacgugcaaccaggccggcgaacauaggcgagauaagcggaguguugccuuggcgccucacgucggaauggggcuggauaccagaacccagaccuggaugagugccgagggugcuuggaggcaagucgaaaaaguugagacgugggcgcugcgucacccgggcuucaccauauuggcgcuuuuucuugcacacuauauagguaccucacucacccagaaggugguaaucuucauacugcugaugcuaguuacgccuucuaugaccaugcguugugugggaauaggcaaccgcgacuucgucgagggccuguccggcgccaccugggucgacguggugcuggagcacggggggugugucaccacuauggccaaaaacaagccgacccucgauaucgaauuacagaagaccgaggccacccaacuggcuacgcuccgcaagcugugcauagagggcaaaauuacaaacaucaccacggacagccgcugcccgacgcagggcgaagccgugcugccggaagagcaggaucagaauuauguuugcaaacauaccuacgucgaucggggguggggcaacgggugcggcuuguuugguaaagggucccugguuaccugcgccaaauuccagugccuggagcccauagaagggaaggugguccaauacgaaaaccucaaguacaccguuaucauuacggugcacacaggggaucagcaccaggucggcaacgaaacccagggggugaccgccgaaaucacgccacaggccagcaccacagaggcuauccugcccgaguacggcacccuggggcucgagugcuccccgcgaaccggccuggacuucaacgagaugaucuuacucacgaugaaaaacaaggccuggaugguccaucggcagugguuuuucgaccugccccugccuuggacuagcggcgcgacgacggagacucccaccuggaaccgcaaggaacuacuagugacguucaaaaaugcccacgccaagaaacaggaggugguaguucuggggucccaggagggcgcgaugcacaccgcccucacgggggccaccgagauucagaacagcggcgggaccagcaucuucgccgggcaccugaagugccggcugaagauggauaagcuggagcugaaggggaugagcuacgccauguguaccaacacguucgugcugaagaaggaagucuccgaaacccaacacgggacaaucuuaaucaaaguggaguacaaaggcgaggacgcgccgugcaaaauccccuucagcacagaggacggucagggcaaggcacacaacggcagauuaauaacggccaacccaguagucaccaagaaggaggagccagugaacauagaggccgagccgccuuucggcgagucuaauaucgugauaggcauuggagacaacgcgcugaagaucaacugguacaagaaaggcuccucgaucggcaaaauguucgaggccaccgcccguggcgcccgccggauggccauccugggugacaccgcgugggauuuuggguccguugguggugugcucaauagccugggcaaaauggugcaucagauuuucggguccgcguacacggcacuguucagcggcgucuccuggguuaugaagauuggcaucggggugcuccugaccuggaucggccugaacuccaagaauaccuccaugagcuucuccugcauugccauagggauuaucacccuauaccugggggccguaguucaggcugacauggggugugugaucaacuggaagggcaaggagcugaagugcggcagcggaaucuuugucaccaacgagguacauacuuggacggagcaauacaaguuccaagcggacuccccgaagcgccucgcgacagcaauugccggagcgugggagaacggcgugugcggcauccgcagcacuacccgcauggagaaccuucuguggaagcagaucgccaacgaauuaaacuauaucuuaugggagaacaacauaaagcugacggugguggugggagacaccaucggcguccucgaacaaggcaagcguacacugacaccccagccgauggagcugaaauacucauggaagacaugggggaaggccaaaaucgugacugccgagacacagaacucaucauucauuauugacggacccaacaccccugagugcccgucggcgucucgggccuggaacgugugggaggucgaggacuacggguucggcguguucaccaccaacaucuggcucaagcugcgcgacguuuacacgcaacuaugcgaucauagacucaugagcgcugcagucaaggacgaacgcgcggugcacgcggacaugggcuacuggaucgaaagccagaagaauggguccuggaaguuggagaaagcgucucuuaucgaagugaagacuugcaccuggccgaagucucauacucucuggagcaacggcgucuuggagagcgacaugauaauccccaaaucucuggcagggccaauaucgcagcacaauuaucgcccuggguaccacacccaaacggcggggcccuggcaccucggcaagcuggagcuugauuuuaacuacugcgaagguaccaccguuguaauaacagagaacugcgggacgcgggggccaaguuugcggaccacuacaguuucugggaagcugauccacgaauggugcugccgcagcugcacccugccgccgcuccgguacaugggcgaggacgggugcugguacggcauggagauccgccccaucuccgaaaaggaggaaaacaugguaaaaagccuaguauccgccggcucugggaaggucgacaacuuuacaaugggcguauugugccuggcgauucuguucgaggaggucaugcggggcaaauucggcaagaaacacaugauugcagggguacuguucacguucgucuuauuacugucgggccagaucaccuggcgcgauauggcccacacgcucauuaugauaggaucgaacgccuccgaccggaugggaaugggcguuacauaucuggcgcugauagcaacauuuaaaauucagcccuuccucgccuuaggguucuuccugcggaaauuaaccagccgggagaauuugcuacuaggcguaggcuuagccauggccacgacgcugcagcugcccgaggauaucgaacaaauggcaaacgguaucgcccugggccugauggcucucaaacugaucacucaguuugagacuuaccagcuauggacggcgcucgugucacuuacaugcuccaauacuauacuaacccucacuguggccuggcgcaccgcgacuuugauccuggccggcguaagccuauuaccggucugccagucuagcucgaugcggaagaccgacuggcugcccaugacaguggccgcaaugggggugccaccccucccucuguucaucuucucccugaaggacacguuaaagcgccgguccuggccacugaaugagggcgugauggccgucggccugguuucaauccucgcuuccagccuguugcggaacgacguccccauggccgguccccucgucgccgggggccugcugaucgcuugcuaugugaucacugggaccuccgccgaccucacgguugagaacgccgcugauguuaccugggaggaagaagccgagcagaccggaguuagccacaaucugaugaucacaguugacgacgacggaaccaugcgaaucaaggacgacgaaaccgagaacauccugacugugcuccucaagaccgcauugcugauuguuuccggcauuuuuccauacagcauucccgccacccugcuuguguggcauacauggcagaagcagacccagcgguccggaguccucugggacguacccagcccgccggagacccaaaaggcggagcucgaagagggcguguaccguauaaagcaacagggcaucuucgguaagacacaggugggcguggggguucagaaggagggcgucuuccacacgauguggcaugucacucggggcgcaguacugacucacaacggcaaacgccucgagcccaauugggccaguguaaagaaggaccugauaaguuauggagggggcuggcgcuuguccgcccaguggcaacgcggggaggaaguccaagucaucgccgucgagcccggcaagaaccccaagaacuuccagacuaugcccgguacguuccagaccaccaccggggaaaucggcgcaaucgcccuggacuucaagcccgggacgucuggcagcccgaucauuaaccgugagggcaaagugguggggcucuacgggaacggggucgucaccaagaacggcggguaugugagcggcaucgcucagacaaacgccgagccagacggacccaccccugagcuagaagaagagauguucaagaagcgcaaccugacgaucauggacuuacacccggggaguggcaagacacggaaguaccugccagcgaucguccgcgaggccauaaagcggcgccugcggacccuaauccuggcccccacgcgcgucguggcagccgagauggaagaggcgcuaaaggggcuuccgauccguuaccaaacgaccgccacaaagagcgagcacacuggccgcgagaucgucgacuuaaugugucaugccacguucaccaugcgccuccucagccccgugcgcgugccuaacuacaacuuaaucauaauggacgaggcccauuucacugaccccgcaagcaucgcggcccggggguauaucuccacccgcguaggcaugggugaggcugccgcgaucuucaugacagcgacaccacccgggacugcugaugccuucccucaguccaacgcccccauccaagacgaagagcgggacauccccgagcgguccuggaauuccggaaaugaguggauuaccgauuucgcagggaagacagugugguucguccccagcaucaaggccgggaacgacaucgccaacugcuuacgcaaaaacgggaagaaggucauucagcucucccggaagaccuucgacaccgaguaccagaagacaaaacugaaugacugggacuucguugugacgaccgacaucagcgaaaugggagccaacuuuaaggcagaccgggucaucgauccuagacgcugucugaagcccgugauccuuaccgacggucccgagcggguaauccuggcgggucccauuccggucacagcagcaagcgccgcccaacgccggggccgcgucggacggaacccccaaaaagagaaugaccaguacauuuucaccggccagccgcuaaacaacgacgaggaccacgcgcauuggacggaagccaagaugcuccucgacaacaucaacacccccgaggggauaaucccggcccucuucgaacccgagagggagaaguccgcugcgauagacggcgaguauagacucaagggggagucacguaaaacuuucgucgagcugaugcggcgcggggaccugcccguguggcucgcccacaagguggccagcgaggggauuaaguacacagaccggaaauggugcuuugacgggcagcgcaacaaccaaauccuggaagagaacauggaugucgagaucuggacuaaggagggcgagaaaaagaagcugcggccgagauggcuggacgcuagaacguauucggacccgcuggcgcugaaagaguucaaggacuucgcggccggcaggaagucuaucgccuuggaccuagucaccgagaucgggcgcguaccaucccaccuggcccaccggacgcgaaacgcucucgacaaccucgugaugcugcacacgucggagcacggcgggcgcgcguaccggcacgcgguggaggaacuccccgagacaauggagacgcuacuguuacucggccuaaugauucuccugacgggcggagccaugcuguuccucaucagcgggaaggggauaggcaagacguccauuggccugaucugcgugauagcgagcuccggcaugcuguggauggccgaaaucccgcuacaguggaucgcgagcgccaucguccuggaguuuuuuaugauggugcugcucaucccagagcccgagaagcaacggacgccccaagacaaccaacuggccuacguggucauugggauccugaccuuggccgccaucauugcggcuaacgagaugggccugcuggagaccacaaagcgcgaucucgggauguccaaggagccggggguggugagccccaccucguaccucgacgucgauuugcacccugccagcgccuggacgcuauacgcgguggcuacgacggugauaacacccaugcugcggcacaccaucgagaacaguaccgccaacgucucuuuagcagccaucgcgaaucaagccguaguacuaauggggcuggacaagggguggccgauuucuaagauggaccugggcguccccuugcuggcccugggguguuacucucaggugaauccccucacgcugaccgccgccgugcuauuacuaauaacccauuaugcgaucauuggaccagggcugcaggccaaggccacccgcgaggcccagaagaggacggcggcgggaaucaugaagaacccuacggucgacgggauaaugaccaucgaccucgaccccgugauauaugacuccaaguuugaaaaacagcugggccaagucaugcugcucguuuugugugccguccaacuguuacuaaugcgcaccucaugggcucugugcgaggccuuaacgcuggcgaccggucccaucacuacccucugggaagggucucccggcaaguucuggaacacgacaaucgcggucagcauggcuaacaucuuccggggcucauaucucgcaggggccggccuggcguucucgauaaugaagucuguagggaccggcaagcgcggcacaggcagccagggggagacccugggugaaaaguggaagaaaaagcuaaaccaguugagccggaaagaguucgaccuguauaaaaagaguggcauaacggagguggaucgcaccgaagccaaggaggggcugaaacggggcgaaaucacccaccacgccgugagccgagguucagccaagcugcagugguucgucgaaaggaacauggugauuccugaggggcgcguuaucgaccuggguugcgggcggggcgggugguccuacuacugcgcaggucugaagaaggucaccgaggugcgcgguuacacgaagggagggcccggacacgaggagccugugccaauguccaccuauggcuggaacaucgucaaguugaugagcgggaaggacguguucuaccugccucccgaaaagugcgauacccugcucugcgauaucggggagucaucccccagccccaccguggaggaaagccgcacgauccgcguccugaagaugguggaaccguggcucaaaaacaaccaguuuugcauuaaagugcuuaaccccuauaugcccaccgucauugagcacuuggagcgccuccagcggaagcacgggggcaugcucgugcgcaauccccugucccggaacaguacccacgagauguacuggaucuccaacggcaccgggaacaucgugagcuccgugaacauggugagccgccugcuucuaaaucgcuucacgaugacccaccgccggccgacuaucgagaaggacguggaccugggagcgggcacucgucacgugaacgcggaaccugagacgcccaauauggacgugauuggggagcggauuaaacgcaucaaagaggaacacaacagcaccuggcacuaugacgaugaaaauccauauaaaaccugggcguaccacggcagcuaugagguuaaggccaccgguagcgccucuaguaugaucaacggcgucgugaagcuccugacgaagccgugggacgucgugcccauggucacacagauggcgaugaccgauaccaccccauucgggcaacagcgcgucuucaaggaaaaaguggacacucgcaccccgagaucuaugccgggcacccgcaaggugauggggaucacggcugagugguuguggcgaacccucggacgcaacaaacggccgcgccugugcacccgagaggaguucacaaaaaagguccguacgaacgccgccaugggcgcggucuuuacggaggagaaucaaugggacagcgccaaggccgccguggaggaugaggaguucuggaagcugguagaccgcgagcgggagcuacauaaacuuggaaaguguggcuccugcguguauaacaugauggggaagcgcgagaagaaguuaggcgaguucggcaaagcuaaggggagccgggcgaucugguacaugugguuaggcgcccgguaccuggaguucgaagcucuuggguuccucaacgaggaucauugguucucccgagacaacagcuauuccggcguugagggcgagggccugcacaaacugggcuacauccugcgcgacauaucaaaaaucccagggggggccauguacgccgacgauacugcggggugggacacccggauuacggaggacgaucugcacaaugaggagaagaucacacaacagauggauccggaacaucgccaguuggcgaacgcuaucuucaagcucaccuaccaaaauaaggucgugaaaguccagcggccgacccccacagguacugucauggacauaaucucgagaaaggaccagcgaggaagcgggcagguaggcaccuaugggcugaacacauucacaaacauggaaguacagcucguccgccaaauggagggugaaggaguucugucaaaagccgaucuggagaauccccaccuccccgagaaaaaaaucacccaguggcuggagaccaagggcguggagcggcuuaaaaggauggccaucagcggugaugacugcgucguaaagcccauugacgaccgguucgcgaacgcccugcuagcccuuaacgacauggggaaggugcgcaaggauaucccacaauggcagcccagcaagggcuggcacgacuggcaacagguaccguucuguagucaccacuuccacgagcugaucaugaaggacgggcggaagcucgugguccccugucgcccccaggaugaacucaucggccgcgcccgcaucucgcaaggggccggcuggagcuuacgcgagaccgcgugccuuggcaaggccuaugcucagauguggagccugauguacuuccaccggcgcgauuuacgacuagccucaaacgcuaucugcuccgccguccccguacacugggucccgacaagccgaacgaccuggucgauacacgcccaccaccaguggaugaccaccgaggacaugcugacggucuggaauaggguuuggaucgaggacaaucccuggauggagaacaagacucccgugaccaccugggagaacguccccuaccuggggaaaagagaagaccaguggugcggcucucucauaggacuuacgagccgggccaccugggcccagaacauaccgacggccauccagcagguccgcagcuugaucgguaacgaagaauuccuagauuacaugcccucaaugaagcgcuuccgcaaggaagaggaguccgagggggcgaucugguga

SEQ ID NO: 25789 - RNA, 9873 nt, Artificial Sequence
  derived and/or modified CDS sequence (opt11) from DENV-3__GQ199889__SS-prME
accagcuuaugccucaugaugauacuccccgccgcccuggcguuccaccucacuagccgggauggugagccacggaugaucguugggaagaacgaacgcgguaagagccugcuguucaagaccgcauccgggaucaacaugugcacgcucaucgccauggaccugggggagaugugcgacgacacagugacauacaagugcccccacaucaccgagguggagcccgaagacauugacugcuggugcaaucugaccagcaccugggucaccuacgggacuugcaaccaggccggcgagcaucggagagacaagcgguccguggcccucgcgccucacgugggcauggggcuggacacccgcacccagaccuggaugagcgcagagggcgccuggcgccaggucgagaaggucgagacaugggcacugcgccaccccggguucaccauccucgcccuguuccuggcccacuacaucggcaccucccucacccagaaggugguuaucuuuauccuacugauccucgucacgcccagcauggccaugcggugugugggggugggcaaccgcgauuucgucgagggccugucaggggccacuuggguugacgugguccuagagcacggcgguugcgugaccaccauggccaagaacaaacccacgcucgacaucgagcugcagaagaccgaggcgacccagcucgccacccuccggaaauuaugcaucgaggguaagaucacgaacaucacgaccgacagcagaugccccacccagggcgaggccauacugcccgaggagcaggaccagaacuacguguguaagcacacguacgucgaccgaggguggggcaacgggugcggcuuauucgguaagggcagccuggugacaugugccaaguuccagugccuggaguccaucgagggcaaggugguccaauacgagaaccucaaguacaccgugauaaucacggugcacacgggcgaccagcaccaagucggcaacgagacccagggggugaccgccgagaucacgccccaggcguccacuaccgaggccauacugcccgaguacggcacccuuggguuggagugcagcccccgcaccggccuggacuucaacgagaugauccugcucaccaugaagaacaaggcauggaugguccaccggcagugguucuucgaccucccgcuaccuuggacguccggcgcgaccacugagaccccuacguggaaccgcaaggagcuccuggugaccuuuaagaacgcccacgcgaagaagcaggagguggugguucuggggagccaagaaggcgccaugcacaccgcccucaccggggccacggaaauccagaacuccggagggacgagcaucuuugccgggcaccugaagugccggcugaaaauggacaagcuggagcugaaaggcauguccuaugcgauguguaccaacaccuuugugcugaagaaagaggucagcgagacgcagcacgggaccauccucaucaagguggaguacaagggcgaggaugcccccugcaagauccccuucagcacagaggacgggcagggcaaggcccauaacggccgccugaucaccgcgaaucccguagucacgaagaaggaggagcccgugaacaucgaggcggagcccccguucggggaguccaacaucgugauagguaucggggacaacgcucugaagaucaacugguacaagaagggcagcuccaucgguaagauguucgaggccaccgcccgcggcgcacgccggauggcgauccugggcgacaccgccugggacuucgggagcgucggcggggugcugaacucccugggcaagauggugcaccagaucuucgggagcgccuacaccgcccuguuuuccggcgucagcugggugaugaagauuggaaucggggugcuccugacauggaucggccuuaacuccaaaaacacaagcauguccuucagcugcauagccaucgggaucaucacccuauaccugggugcagucgugcaggcggacaccggcugcgugaucaacuggaagggcaaggagcugaagugcggcuccgggauauucgucacgaacgagguacacaccuggacagagcaguacaaauuccaggccgacagcccuaagcgccucgccaccgccaucgcgggcgccugggaaaauggggugugugggauccgguccacgacgcggauggagaaccugcuauggaagcaaaucgccaacgagcucaacuacauccugugggagaacaauaucaagcugacugucguggugggggacaccaucggcguucucgaacagggcaaaagaacgcuaacgccucagcccauggagcuaaaguacagcuggaagaccugggggaaggccaaaaucgugacugcggagauccaaaauuccagcuucaucaucgacggaccuaacacgccagagugccccuccgccagcagagccuggaacgugugggaggucgaggacuacggauucggcguguucaccaccaacaucuggcucaagcugcgcgagguguacacccagcugugcgaccaccggcucaugagcgccgccgucaaagacgagcgcgcgguacaugcggacaugggcuauuggaucgagucccagaagaacgggagcuggaagcuagagaaagccuccuucaucgaagugaagaccugcacguggcccaagagccacacccuguggagcaacggcguccucgagucugauaugaucaucccgaaguccuuagcggggccuaucucacagcacaacuaccggcccggcuaccacacccagaccgccgggccguggcaucugggcaagcucgagcuggacuucaauuacugcgaggggaccaccguagugaucaccgagaacugugggacucgcggccccucccugcggacgaccaccgucucugguaaacucauccacgaauggugcugccguucauguacgcugccgccccugcgguacaugggcgaggacgggugcugguacggcauggaaauccgcccgaucagcgagaaggaggaaaacauggugaagucccucgcgagcgccggcagcgggaagguggacaacuucacaaugggcguccucugccucgccauucucuucgaggaggugaugcgggggaaguucggcaagaagcacaugaucgcgggaguguucuuuacguuuguccuccugcucagcggccagauuaccuggcgcgacauggcccacacccugaucaugaucggcuccaacgcgagcgaccggauggggaugggcgugaccuaccuggcccucaucgccaccuucaagauccagcccuuccuggcccugggguucuuucuccguaaguuaaccagccgggagaaccugcuccugggaguggggcuggcgauggccacgacccuccagcugcccgaggauaucgagcagauggcgaacggcaucgcccugggccucauggcccuaaaguugaucacccaauucgagaccuaccagcucuggaccgcgcugauaucccugacgugcagcaacaccauguuuacgcugaccgucgccuggcgcacggccaccuuaauccuagccggcgugucccucuuacccgugugccagagcuccagcaugcggaagaccgacuggcuuccgaugacagucgccgcgaugggcgugccgccccugccccuguucauuuucucccugaaggauacgcucaagcgccgcagcuggccgcugaacgaggggguuauggcugugggccugguguccaucuuagccagcucccugcuucggaacgauguccccauggccggcccccugguggccgggggcaugcucaucgcgugcuacgugaucaccgggaccagcgccgaccugaccgucgaaaaagccgccgacgugacaugggaggaggaggcggagcagacaggcgugucccacaaccuuaugauuaccgucgacgacgacgggaccaugcgcaucaaggacgacgagaccgagaacaucuugacggugcuuuugaagacagcgcugcugaucgugagcggcaucuuccccuacuccaucccagccacacuccuggucuggcacaccuggcagaagcagacccagcggucuggcguucugugggacguccccagucccccggagacccagaaggccgagcucgaggaaggggucuaccgcauuaaacagcagggcauucuuggaaagacccaggugggcguugggguccagaaggagggcguguuccacaccauguggcacgugacgcggggcgccguccugacccacaacggcaagcgccucgagccuaacugggcgagcguaaagaaggaccugaucuccuacggagggggauggcggcuuagcgcccaguggcagaagggggaggaggugcaggucauugccguggagcccggcaagaaccccaagaacuuccagaccaugccaggcaccuuccagacgacaaccggggagaucggcgccaucgcccucgacuucaagccgggcaccagcggcagucccaucaucaaccgcgagggcaagguggucgggcuuuauggcaacgguguggugacgaaaaacggcggguacgucagcggcauagcccagaccuccgccgagcccgacggcccgacccccgagcuggaagaggagauguuccggaagaggaaccugaccaucauggauuugcacccagggagcggcaagacgcggaaauaccugcccgcuaucgugcgcgaggccaucaagcggcgccugcggacucucauacuggccccgacucgggugguagcagccgagauggaagaggcccugaagggacuccccauccgguaccagaccacggccaccaaguccgagcacacaggcagggaaaucguggaccugaugugccaugcgaccuucacaaugcggcuacucagucccgugagggucccgaacuacaaccugaucauuauggacgaggcgcauuucaccgacccggccuccaucgccgcccggggauacaucucgacccgcguggggaugggggaggcggcugccaucuucaugaccgccacgccgccaggcacugccgacgcguucccccaaucuaacgccccgauccaggacgaggaacgcgacauccccgaaaggagcuggaacucgggcaacgaguggaucacggacuucgccgggaagaccgugugguucguccccagcaucaaggccggaaacgacaucgccaacugcuuaagaaagaacgggaagaaggugauccagcucucccggaagacguucgacaccgaguaccagaagaccaaguuaaacgacugggacuucguggugaccaccgacaucuccgagaugggcgcgaacuucaaggcagaccgugugaucgaucccagacgcugccugaagccggugauacucaccgacggccccgagcgugucauccuugcagggccaaugcccgugaccgcggccuccgcggcccagcgucggggccgcguggggcggaacccucagaaggagaacgaccaguacaucuucaccggccagccccugaauaaugacgaagaccaugcgcacuggacggaggccaagaugcucuuagacaacaucaauacgcccgaagggaucauccccgcgcuguucgaaccggagcgcgagaagagugccgccaucgauggcgaguaucggcucaagggcgagagccgcaagaccuucguagagcugaugcggcgcggugaccugcccguguggcuugcccacaagguggccagcgagggcaucaaguacaccgacagaaagugguguuucgacgggcagcgcaacaaucagauccuggaggagaacauggacgucgagaucuggaccaaagagggugaaaagaagaaauugcggccccgcuggcuagacgcgcgcacguacuccgacccuuuagcucugaaggaguucaaggauuucgccgccggccggaaauccauugcccucgaccuggugaccgagaucgggcgcgucccgagccaccuggcgcaccggacccgcaacgcccucgacaaccugguaaugcugcacaccuccgagcacggcgggcgggccuaccgccacgccguggaggagcuccccgagacgauggagacccugcuccuacugggccugaugaucuuguugacugguggcgccaugcuguuccucaucagcggcaaggggaucggcaagaccuccaucgggcugaucugcgucaucgcgagcuccggcaugcuguggauggccgacgugccucuccaguggaucgccuccgccaucgugcucgaguucuucaugaugguccugcucaucccggagcccgagaagcagcggacaccccaggacaaccagcuggccuacgugguaaucgggauacuaacgcucgcggcaaucaucgccgccaacgagaugggccugcuggagaccacgaagcgagaucucggcauguccaaggagccuggcgucgugagcccgacguccuaccucgacguggaccugcaccccgcgagcgccuggacacucuacgccguugccacaaccgucaucacgcccaugcugcggcacaccaucgagaacuccaccgccaacgugucacuggcggcuaucgcuaaccaggccgucgugcucaugggccuggacaagggauggccaaucaguaagauggaccugggugugccgcucuuagcccuugggugcuacagccaggucaauccccuuacucugacggcggccgugcugcuccugaucacccacuacgcuaucaucggcccuggccuacaggccaaagccacccgcgaggcgcagaagcggacggccgccgggauaaugaagaaucccacgguggacgguaucaugacgaucgaccuggacccaguaaucuacgacuccaaguucgagaagcagcugggccaggugaugcuccucgugcugugugcgguccagcugcuccugaugcgcaccagcugggcccugugugaggcccucacccuggccacgggacccauuaccacccugugggagggcucccccgggaaguucuggaacaccacgaucgcagugagcauggccaacaucuucagaggguccuaccucgcgggggccggccuugccuuuagcauuaugaaguccguggggaccggcaagcgcggcaccgggucccagggcgagacccugggagagaaguggaagaagaagcucaaccagcucagccggaaggaguucgaccuguacaaaaaguccggcaucaccgaggucgaccgaacggaggccaaagagggguugaagagaggcgagacaacccgccacgccgugagccggggcuccgcgaagcugcagugguucguggagcggaacauggucaucccugaggggcgggugaucgaccugggcugcggucgcggcgguuggagcuacuacugcgcaggccucaagaaggugaccgagguccgcggcuacacgaagggcgggccagggcacgaggagcccgugcccauguccaccuacggcuggaacaucgugaagcugaugagcgggaaagacgucuucuaccugcccccggagaagugcgacaccuugcugugcgacaucggcgaguccucucccucccccacuguggaggagagccggacgauccgcgugcugaagauggucgagcccuggcugaagaacaaccaguuuugcaucaaggugcucaacccguacaugcccaccguuaucgagcaucuggagcggcugcagcgcaagcacggcgggaugcucguccggaacccccugucccggaacagcacccacgagauguacuggaucuccaacggcaccgggaacauuguguccuccgugaacauggugagccggcugcuccugaacagauucacaaugacacaccgucgcccuaccauugagcgggacguggaucugggcgccggcacccgccacguuaacgcggagccggagauacccaacauggacgucaucggggagcggaucaagcgcaucaaggaggagcacaacuccacguggcacuacgacgacgagaaccccuacaagacuugggccuaccacggcuccuacgagguaaaggcgaccgggagcgccuccagcaugaucaacgggguggugaagcuccugaccaagccgugggacgugguccccauggugacgcagauggccaugaccgacaccacccccuucggucagcagcggguguucaaggagaaggucgauacgcgcacgccucggccgaugcccggcaccaggaaggugauggagaucaccgccgaguggcuuuggcggacgcucgggcgcaacaaacgcccccggcuuugcacccgugaggaguucaccaagaagguacggaccaacgcggccaugggggccgucuucacggaagagaaccagugggacucagccaaggccgcgguggaggacgaggaguucuggaaacugguggaccgcgagcgggagcuccacaagcuggguaaguguggcagcugcgucuacaacaugaugggcaagcgagagaagaagcugggggaguucggcaaggccaagggcucucgggccaucugguacauguggcucggugcccgcuaucuggaguuugaggcccugggcuuccucaacgaggaccacugguucagccgggaaaauuccuacagcgggguggagggcgaggggcugcacaaacugggcuacauccuccgugacauauccaagauccccggcggggcuauguacgccgacgacaccgccggcugggacacccggaucacagaggacgaccuccauaacgaggagaagaucacgcagcagauggacccggaacaccgccagcuggccaacgccaucuucaagcucaccuaccagaacaagguggucaaagugcagcggcccacccccaccgguaccgugauggacaucaucagcaggaaggaccagaggggguccggccagguagggacguacggccugaacaccuucaccaacauggaggcacagcuggugcgccagauggagggggagggcguacucagcaaagccgaucuggagaacccccaccuccucgagaagaagaucacccaguggcuggagacaaagggggucgagcggcugaagcgcauggccaucuccggcgacgauugcguggugaagccgaucgacgaccgguucgccaacgcccuccuggcgcugaacgauaugggcaagguacgcaaggacaucccccaguggcagcccagcaagggguggcacgacuggcagcagguccccuucugcucccaccacuuccaugagcucaucaugaaggacggccgaaagcuggugguccccugcaggccccaggacgagcuaaucgggagagcccggaucagccagggcgccggguggucccuccgcgagaccgccugccugggcaaggcguacgcccaaauguggagccugauguacuuucaucggcgcgaccuccggcuugcuuccaacgcuaucugcagcgccguacccguucacuggguacccaccagccgcaccacgugguccauccacgcgcaccaccaguggaugaccacugaggacaugcugaccguguggaaccgggucuggaucgaggacaacccguggauggaggacaagacgcccgucaccaccugggagaacgugcccuaccucggcaagcgcgaggaccaguggugcgggagccuaauuggccugaccucccgggccacgugggcccagaacauccccacggccauccagcagguccgcagccucaucgggaacgaggaauuucuggacuauaugccguccaugaagcgguuucgcaaggaggaggagagcgagggcgccaucugguga

SEQ ID NO: 25790 - RNA, 9873 nt, Artificial Sequence
  derived and/or modified CDS sequence (opt11) from DENV-3__FJ882571__SS-prME
acaucgcuaugccuuaugaugauccuucccgcagcgcuagcguuccaccucacuagucgggauggcgagccccggaugaucgucgggaagaaugagcggggcaagagccugcuuuucaaaaccgccucugggaucaacaugugcacccugaucgccauggaucugggggagaugugcgaugacacugucaccuauaaguguccccacaucacggaggucgagcccgaggacauagacugcuggugcaacuugaccagcacaugggugaccuaugguacguguaaccaagccggcgaacauaggcgcgacaagcgguccgucgccuuggcaccccacgugggcauggggcucgacacccgcacucaaaccuggaugucugccgagggagccuggcgacagguggagaagguggagacgugggcccuccgccauccgggguucaccauccuggcgcucuuucuggcccacuauaucggaaccucccucacccagaagguugugaucuuuauccuucugaugcucgucacccccaguaugaccaugaggugcguggggguuggcaacagagacuucgucgagggccuguccggugccaccugggucgacguaguccuggagcacggcggguguguuaccacgauggccaagaacaagcccacccucgacaucgagcugcagaagacagaggcuacccagcuggcgacccuacgaaaacuguguauugaggggaagaucaccaauaucaccaccgacagcagguguccgacgcagggcgaagcagugcugccugaggagcaggaccaaaauuacgucugcaagcacaccuacguagaccggggguggggaaacggaugcggccuuuucgguaagggcagccuggugaccugcgccaaguuccagugcuuggagcccauagagggcaagguugugcaguacgagaaucuuaaauacacugugaucauuacggugcacaccggggaccagcaccaggugggaaacgagacgcagggggucaccgccgaaauuacgccccaggccucaaccaccgaggcgauccugccagaauacggcacgcugggguuagaaugcuccccgaggaccgguuuggacuucaacgagaugauacugcucaccaugaaaaacaaggcguggaugguccaccggcagugguucuucgacuuaccacugcccuggaccagcggugccacgacggagaccccaaccuggaaccguaaggagcugcucgucaccuucaagaaugcacacgccaagaagcaggaggucguggugcugggaucgcaggagggcgcgaugcacacggccuuaaccggggcuacagagauccagaauucaggagggacguccaucuucgccggccaccuuaagugccgccugaagauggauaagcucgagcuaaagggcauguccuacgcaaugugcaccaacacguuuguccugaagaaggaaguaucggaaacccagcacgggacgauucuuaucaaggucgaguacaaaggcgaggacgcuccguguaaaauccccuucagcaccgaagacgggcagggaaaggcccacaacggccgcuuaauaacggcgaaccccgucguaaccaagaaagaggagcccguuaacaucgaagcagagcccccguuuggagagaguaacauagucauaggcaucggcgacaacgcucugaaaaucaauugguacaagaagggcagcucgauagguaagauguucgaggcaaccgcccgcggcgcucguagaauggccauccucggcgacaccgcgugggacuucggcucggucgggggggugcucaacucgcuaggcaagaugguccaucagauauucggguccgccuacacggcgcuguucagcggcgugucgugggugaugaaaauaggaauugggguccuacuaaccuggaucggccugaacucuaaaaacacaucaaugucguucuccugcauagcaaucgggaucaucacccuuuaucugggcgccguaguacaagcggacauggggugcguuauuaacuggaagggcaaagagcugaaaugcgggagcgggaucuucgugacgaacgagguccacaccuggaccgagcaguacaaguuccaggccgacucccccaagcgcuuggcaaccgcuaucgcaggcgccugggagaacggugucugcggcauccggagcacgacccggauggagaacuugcuguggaaacaaaucgccaaugagcucaauuacauccugugggagaauaauauuaaacucaccgugguggucggugacacaaucggcguuuuggagcaaggcaagcgcacgcucacgccccagccuauggagcuuaaauauuccuggaagaccuggggaaaggccaagaucgugaccgccgagacacaaaauaguaguuucaucaucgacgggcccaauacacccgagugccccagcgcgucccgggccuggaacguaugggaaguagaggacuacggauuuggaguguucaccaccaacaucuggcucaagcugcgcgacguuuacacccagcucugugaucacaggcucaugagugccgccgucaaggacgagcgcgccgugcacgcugacaugggcuauuggauugagagccagaagaacggauccuggaaacuugaaaaggccagccucaucgaggucaagacgugcaccuggcccaagucgcacacccucuggagcaauggaguucuggaguccgauaugauaauccccaaaagccuggccggcccuaucagccagcacaacuacagaccgggguaccacacccagacggccggucccuggcaucucggaaagcuggagcuagacuuuaacuacugugagggcaccacaguugucauaacugagaacugcgggacacgcggcccgucucuccggacuaccacaguuuccgggaagcugauccacgaauggugcugucgaaguugcacgcugcccccgcuccgguacaugggcgaagacggguguugguauggcauggaaauccggcccauaucggaaaaagaggagaacauggucaagagucuaguguccgccggcagcggaaagguggacaacuucacgauggguguuuugugccucgccauuuuguucgaggaggugaugcggggcaaguucgggaaaaagcacaugaucgccggagugcuuuucaccuuuguuuugcuauuguccgggcaaauaacauggcgcgauauggcccacacacugauuaugauaggaagcaaugccuccgaccggauggguaugggcguuaccuaccuggcucugauagcgacguucaagauccagcccuuccuggcacugggguucuuccugcgcaagcugacuucucgggagaaccugcuguugggcguuggccuggccauggccacgacccuacaacuccccgaggacaucgagcagauggcgaacgggauagcccuggggcucauggcccuaaagcugauuacccaguucgagacauaccagcuguggaccgcgcuagugagccugaccuguagcaacaccauccuaacacuaacggucgccuggcgcaccgcgacgcugauccuggccggcgugagccugcugcccgugugccagaguagcuccaugcggaaaaccgacuggcugcccaugacgguagccgccaugggcguuccuccccucccucuguucaucuucagccugaaggacacccucaagcgccgcuccuggccguuaaacgagggggugauggccgugggccuagugagcauucucgccucgagccuauuaaggaacgacguccccauggcaggacccuuaguugcggggggccuucugaucgcauguuaugugaucacugguaccagcgcugaucucauuguagagaaggcggccgacgucacgugggaagaggaggccgagcagacaggcgucucucacaaccucaugaucacagucgaugaugaugggaccaugcgaaucaaggacgaugagaccgagaacauccugaccguuuugcugaagacagcccuguuaaucguaagcgguauauucccuuacagcauccccgccacuuuacuggucuggcacaccuggcaaaagcagacccagcgcucuggggugcucugggacgucccuucaccgccggaaacccaaaaggcggagcuggaagagggagucuacaggaucaagcagcagggcauccucggaaagacccagguggggguggguguccagaaggagggagucuuccacaccauguggcacguuaccagaggcgccguuuugacccacaaugggaaaagacuugagcccaacugggccucggugaagaaggaccugauuagcuacggcgggggcuggcgucugagcgcgcaauggcaaaaaggggaggaagugcaggucauugcgguagagcccggcaagaacccgaagaacuuccaaaccaugcccgggaccuuccagacgacuacgggcgagaucggagccaucgcccucgacuucaagccugggacaagcggcagccccaucaucaaccgcgagggcaaggugguggggcuguacgggaacggcgucgugaccaaaaacggagguuacgucucuggcaucgcgcagacgaacgccgagccggauggccccacccccgaacuagaggaggagauguucaagaagcggaaccucacaauuauggaccuccacccggggagcggcaagacucgcaaauaccugccggcgaucgugcgcgaggccauaaagagacgucuacgaacccugauacuggcacccacaaggguuguagccgccgagauggaagaggcacucaaggggcuccccauccgcuaccagaccacggccaccaagagugagcacaccggccgagaaaucguugaucugaugugucacgccacuuucacgaugcgccugcucagccccgugcgcgucccgaacuauaaucugaucaucauggacgaggcacauuuuacagaccccgcauccaucgcugcacgcggguacauaagcacccgagucggcaugggggaggcggccgcuaucuucaugaccgccacgccacccgggacagccgacgccuucccgcaguccaacgcgcccauccaggacgaggaacgagauauccccgaacgcagcuggaacucaggcaacgaauggaucaccgacuucgcgggcaagaccgugugguucguccccagcaucaaggcgggcaacgauaucgcaaacugcuuaagaaaaaacgggaagaaggucauccagcuaagccgcaagaccuucgacacagaauaccagaaaacuaagcugaacgauugggacuucgucguuaccacggacauaagcgagaugggggccaacuucaaagccgauagggugauagacccaagacggugccucaagcccgugauucugacagacggccccgaacgcguaauccuagcgggaccgaugccgguaaccgccgcguccgcggcacagcggcgcggccgggugggccgcaacccccagaaggaaaacgaccaauacauuuucaccggccagccacugaacaacgaugaggaucacgcccacuggaccgaggccaagaugcugcuggacaacaucaacacgcccgaggggaucauaccagcauuguucgagcccgagcgggagaaauccgcugcgaucgacggugaguaccggcugaagggcgagucccguaaaaccuucgucgagcugaugcgccgcggggaccuccccguguggcuggcucacaaaguagccagcgaagguaucaaguauacagaccggaaguggugcuucgaugggcagaggaacaaucagauccuugaggagaacauggacguggagauauggaccaaagagggcgagaaaaagaagcuuagaccccguuggcuggacgcccgcacguacagcgacccgcuggcccugaaggaauuuaaggauuucgcggcaggacgcaaaagcaucgcccuggaccuggugacggaaaucggucggguaccaucccaccuggcccaccgcacgagaaacgcgcucgauaaccucgugauguuacacaccagugagcacggcgggcgagcuuacaggcacgcugucgaggagcuuccugagacgauggagacccuccuccuccugggccucaugauccugcugaccgggggagccaugcuuuuucugaucagcggcaaggggaucggcaagaccuccaucgggcucaucugugucauugcaagcuccggcaugcucuggauggccgagauaccccuacaguggauagcguccgccaucgugcuggaauucuucaugauggugcucuugauccccgagccugagaaacagcguacgccccaggacaaucagcuggccuacgucgugaucggaauucucacgcuggccgccaucaucgcggccaacgaaauggggcugcucgaaaccaccaagcgggaccuuggcaugucaaaggaacccggggucguuucacccacaucauaccuagauguggacuugcaccccgccagcgccuggacacuguaugcgguggccacgacagugauuacgccuaugcugcgccacacgaucgagaauuccaccgccaaugugucccucgccgccaucgcuaaucaagccgugguccugaugggacuggacaagggguggccgaucuccaagauggauuuaggagugccccugcuggcacucggcuguuacagccaggucaacccccugacccugaccgccgccguccuccugcugaucacucacuacgcgauaauaggcccuggcuuacaggccaaggccacgcgggaggcccagaagcgaaccgccgcggggaucaugaaaaacccgacuguggacggcauuaugacuaucgaucuggaccccgugaucuaugacuccaaauuugagaaacagcuggggcagguuaugcuccuggugcugugcgcggugcagcucuuacugaugcggaccucgugggcucuuugcgaggcauugacccuggccacaggcccgauuaccacccucugggagggcucccccgggaaauucuggaauacgacgaucgcagucuccauggccaauaucuuccgcggcuccuacuuagcuggggcuggccuggccuucagcaucaugaaguccgugggcaccggcaagcgggggaccggcagccagggugagacccucggagaaaaauggaagaagaagcucaaucagcuuucacgcaaggaguuugaccucuacaaaaaauccggcauaaccgaggucgaucggacggaggcuaaggaggggcugaagcgcggugagaucacccaccacgcggucagccgaggcagugcgaagcugcagugguuuguugaacgaaacaugguaaucccggaggggcgggucaucgaccucgguugcgggcgcggcggauggagcuauuacugcgccggccuaaaaaaggugacagagguccggggcuacacuaaaggcgggcccgggcaugaggagccuguaccaauguccacguacggcuggaacaucgugaagcugaugagcgggaaggauguguucuacuuaccucccgagaaaugcgacacguugcugugcgacaucggcgaauccagcccuaguccaacaguggaggagagccguaccauccgcgugcugaagaugguugagccguggcuuaagaauaaccaguucugcauuaaggucuugaaucccuacaugccaacuguaauagagcaccuagagcggcugcagcgcaaacauggugggauguuaguccggaacccucugucucgcaauagcacgcacgagauguauuggaucuccaacggcaccgggaacaucguuagcuccgucaacauggugagccggcuccugcugaaccgcuucacuaugacgcaccgccggccgacaauagaaaaagacguagaccucggcgcggggacgcggcacgugaacgcggagccagaaaccccaaauauggacguaaucggggagcgcaucaagagaauaaaggaggagcacaacaguacuuggcacuacgacgacgaaaacccguacaaaacaugggccuaccacggcagcuaugaggucaaagcuaccgggagcgccagcagcaugaucaacggcguagucaaacugcucaccaaacccugggacguggugccaauggugacgcaaauggcgaugacugauacgacuccuuucgggcagcagcgcguguuuaaggagaagguggacacgcgaacgccucgcccgaugcccgggacccguaaggucaugggcaucaccgcagaguggcuguggcgcacacuggggagaaacaaacgaccccggcuguguacccgcgaggaguucacuaagaaggugcgcacuaaugccgccaugggcgcgguguucaccgaggagaaccagugggacucggccaaagccgccguagaggacgaggaguucuggaagcucguggaucgagagcgggaacugcacaagcuugggaaguguggcagcugcguauacaacaugauggguaagagggaaaagaagcucggggaguuugguaaagcgaagggcucccgcgcaaucugguauauguggcugggugcccgauaucuagaguucgaagcgcucgguuuccugaaugaggaccacugguuuucucgggacaacuccuacucugggguggagggggaggggcugcauaagcucggauacauccugcgcgacaucuccaagauccccggcggggcgauguacgcggacgacaccgccgguugggauacccgcaucaccgaggacgaccugcacaaugaggagaagaucacccagcagauggaucccgaacaccggcagcuggcuaaugccaucuuuaagcugacguaccagaacaaaguagugaagguccagcggcccacuccuaccgguaccgucauggacaucaucagccggaaggaccagcggggcagugggcaggugggcacauacggucuaaauacauucaccaacauggagguucagcucgugcggcaaauggagggcgagggaguguuaagcaaggcugacuuggaaaacccgcaccuacccgagaagaaaaucacccaguggcuggagacgaagggaguggagcgccugaaacggauggccaucagcggggaugauugcguggugaagcccauagacgaccgcuucgcgaacgcucuguuagcccugaacgacauggggaaggugaggaaagacauuccccaauggcagccuagcaagggaaugcacgacuggcagcaaguuccguucugcucccaucacuuccacgaacucaucaugaaagacgggcgcaagcuaguggucccgugccguccucaggacgagcugaucggccgcgcccggauaagccagggagccggguggucacuccgcgagaccgcgugccucggaaaggcuuacgcucagauguggagccugauguacuuccaccgccgggaccuccgccuggcauccaacgcgaucuguagcgccgugccggugcauuggguccccacauccaggacuaccuggucuauccacgcccaucaccaguggaugacgacggaggacaugcuggccguguggaauaggguguggaucgaggacaaucccuggauggaggauaagacccccgucacgaccugggaggacgucccuuaccucggaaagcgcgaggaccaguggugcggcucgcugaucgggcugacuuccagagccacgugggcucagaacauccucacggcgauccaacagguccguagccugaucggcaacgaggaguuucuagacuauaugcccuccaugaagcgcuuccggaaggaggaggagucugagggggcgauaugguga

SEQ ID NO: 25791 - RNA, 9873 nt, Artificial Sequence
  derived and/or modified CDS sequence (opt11) from DENV-3__FJ882572__SS-prME
accagccuaugcuuaaugaugauucugcccgccgcucuggccuuucaccucaccagccgcgacggggaaccccggaugaucguggggaagaacgagcgcggcaagucguuacucuuuaaaaccgccuccgggaucaacaugugcacucucaucgccauggaccucggggagaugugcgacgacaccgugaccuacaagugcccccauaucaccgagguggagcccgaagacaucgacugcugguguaaccuaaccagcaccuggguaaccuacgggaccugcaaccaggccggcgaacaccgucgcgacaagcgguccgucgcccucgcgccccacguuggcaugggcuuagacacccgcacccagaccuggaugagcgccgagggcgcuuggcggcagguugagaaggucgagaccugggcccugagacaccccggguucaccauccucgcgcuguucuuagcccacuacaucggcacuucccucacccagaagguggugaucuucauucugcugaugcuugucacacccagcaugacuaugcgcugcgugggcgugggcaaccgcgacuucgucgagggccuguccggggccacguggguggacgugguccuggagcacggcgggugcgugaccacgauggcaaagaacaagcccacccucgacauagagcugcagaagaccgaggccacccagcuggcgacucucagaaagcugugcaucgagggcaagaucaccaacaucaccaccgacagccgcugucccacgcagggcgaggccgugcugcccgaggagcaggaccagaacuacgucugcaagcacaccuacguggacagaggguggggcaacggaugcggccucuucgggaagggaucccuggugaccugcgccaaguuccagugucuggagagcaucgagggcaaggucgugcaguacgagaaccucaaguacaccgugaucauuacgguccacaccggggaccagcaccaaguugggaacgagacccaggggguuaccgccgagaucacgccccaggcuuccaccacugaggcuauccugcccgaguacggcacccuggggcucgagugcagcccccgcacgggacucgacuucaaugagaugauccugcucacuaugaagaacaaggccuggauggugcaccgccagugguucuucgaccuaccguuaccuuggaccuccggcgccaccacagagacgcccaccuggaaccgcaaagagcuccuggugacuuucaagaacgcccaugccaagaagcaggagguugucgugcuggggagccaggagggcgcgaugcacacagcccugacgggggccacggagauccagaacuccggugggaccagcaucuucgcaggccaccuaaagugccggcugaagauggacaagcucgaguugaaaggcauguccuacgccaugugcaccaauacguucguucugaagaaggaggugagcgagacccagcacgggaccauccucaucaagguggaguacaaaggcgaggacgcgcccugcaagauccccuucagcaccgaggacgggcagggcaaagcccacaacggccgccugaucacggcuaaccccgucgugacaaagaaggaggagcccgugaacaucgaggccgagcccccguucggugagagcaacaucgucaucgggaucggggacaacgcgcugaagaucaacugguacaagaagggcagcuccauugggaagauguuugaggccaccgcccggggcgcccgccggauggccauccugggagacaccgcgugggacuucgggagcgucggcgggguccucaacucccugggcaagaugguccaccagaucuucgggagcgccuacacggcccuguucuccggcgucagcugggucaugaagaucgggaucgggguccuccugaccuggaucggccugaacuccaagaacaccagcauguccuucucuuguaucgccaucgggauaaucacccucuaccugggcgccguggugcaagcggacacggggugcguuaucaacuggaagggcaaggagcugaaaugcggcuccgggaucuucgugaccaacgaggugcacaccuggaccgagcaguacaaguuccaggccgacagccccaagcgccucgccaccgccaucgccggagcgugggagaauggggucugcggcauacgauccaccacccggauggagaaccugcuauggaagcagaucgccaacgagcucaacuacaucuuaugggagaacaacaucaaguuaaccgucguggucggggauacgaucggcgugcucgaacagggcaaacgcacccugacgccccagcccauggagcugaaguacaguuggaagaccugggguaaagccaagaucgugacggccgagauccaaaacuccagcuucaucaucgacgguccgaacacccccgagugccccuccgcgucgcgggcauggaaugucugggaggucgaggacuacggcuucggcguguucacuaccaacaucuggcucaagcugcgcgaagucuacacccagcuaugcgaccaccggcucaugagcgccgcggugaaggacgaacgcgccgugcacgcggacaugggcuacuggaucgagucccagaagaacgggaguuggaagcuggagaaggccucauucaucgaggucaagacgugcaccuggcccaagagccacacacuguggucuaacggcguacucgagagcgacaugaucaucccgaagucccuggccgggccaauuagccagcacaacuaucggcccggcuaccacacgcagacggcggggccguggcaccugggcaagcucgagcucgacuucaacuauugcgagggcaccaccguggugauuaccgagaacugcgggacgcgcggcccuucccugcggaccacuaccgugagcgggaagcucauccacgaguggugcugccgauccuguacuuuaccgccccugcgguauaugggggaggacgggugcugguacggcauggaaauccguccgaucagcgagaaggaggagaacauggugaagucccucgcgagcgcgggcuccgggaaggucgauaauuucaccaugggggugcugugccuggccauccucuucgaggaggugaugcgggggaaguucggcaagaagcacaugaucgccggggucuucuucaccuucgugcugcugcucagcggccagaucaccuggcgcgacauggcccacacgcugauuaugaucggcucaaacgccagcgaccggauggggaugggugugacuuaccuggcgcucaucgcgaccuucaaaauccagccauuccuggcccuuggguucuuccuccgcaagcugaccagccgggagaaccugcuccugggcgucggccuggccauggcgaccacccuccagcugcccgaggacaucgagcagauggccaacgggaucgcccugggccucauggcccugaagcugaucacucaauuugagaccuaccagcucuggacggcguuaaucucguuaaccuguagcaauaccauguucacccucacgguggcguggcgcacugcuacccugauccuggccggggugucccuccuacccgucugccagagcuccucgaugcggaagaccgacuggcugccaaugacgguggccgccaugggcgucccgcccuuaccacuguucaucuucucccuuaaagauacccucaagcgccgcagcuggccgcugaacgaaggugugauggcagugggacuggucuccaucuuagcaagcucccugcugcggaaugacgugcccauggccggcccccucguggccgggggaaugcugaucgccugcuacgucaucaccgggaccagcgcagaccuuacgguggaaaaagccgccgacguaaccugggaggaggaggccgagcagaccggcgucucccacaaccucaugauuaccguggacgacgacgggacuaugcguaucaaggacgacgagacggagaauauccugaccgugcuucucaagaccgcccugcugaucgucagcggaaucuuccccuacuccaucccggcgacccuccugguguggcacacauggcagaagcaaacccagcggagcggagugcugugggacguccccagcccgccggagacccagaaggccgagcucgaggaggggguguaccgcaucaagcagcagggcauccugggcaagacccaggugggcguuggggugcagaaggagggaguguuccauacaauguggcacgucaccaggggcgccgugcugacccacaacgggaagcgacucgagccgaacugggccucuguaaagaaggaccugaucuccuacggcgggggcuggcgacugagcgcgcaguggcagaagggggaagagguccaggugaucgccguggagcccggcaagaacccuaagaacuuucagaccaugccuggcacuuuccagaccaccaccggggagaucggcgcaaucgcucucgacuucaagccggggacgagcggcuccccuaucaucaacagagaaggcaaggucguggggcuguacggcaacgggguggucaccaagaacggcggguacgugagcggcaucgcgcaaacguccgcggagcccgacggcccgacccccgagcuggaggaggaaauguuccggaagcgcaacuuaacgauuauggaucuccaccccgggagcggcaagacccggaaauaucugcccgccaucgugcgcgaggcuaucaagcggcggcugcgaacccucauuuuagcuccgacccgcgucguggccgcggagauggaggaggcccugaagggacuccccauccgguaccagacgaccgccacuaaauccgagcacaccggccgggagaucguagaccugaugugccacgccacguucaccaugagacugcucagccccguccgcguucccaauuacaaccucauuaucauggacgaggcccacuucaccgacccggccuccaucgccgcccggggguacaucagcacucgcgugggcaugggcgaggccgcggccaucuucaugacggccacuccgcccgggaccgccgacgccuucccccaguccaacgcaccgauccaggacgaggagcgcgacauccccgagagaagcuggaacuccggaaacgaguggaucaccgauuucgccggaaagacggucugguucgugcccagcaucaaggccggcaacgacaucgccaacugucugcgcaaaaacgggaagaaggugauccagcugagccggaagacauucgauaccgaguaccagaagaccaaguugaacgacugggacuucgucguaacgaccgacauaagcgagaugggcgccaacuucaaagcggaccgagugaucgacccacggcgcugccugaagccgguaauccucaccgacggccccgagcgggugaucuuggccgggcccaugcccgugaccgccgcaucagccgcgcagcgacggggccgcgucgggcggaacccacagaaggagaaugaccaguacaucuucaccggccagcccuugaacaacgacgaggaccacgcacacuggacggaggcgaagaugcuccuagacaacaucaacacccccgaggggaucauucccgcguuauucgagcccgagcgcgagaaguccgcggccauugauggcgaguaccggcuaaagggagagagccgcaagaccuucguggaacugaugcggagaggggaccugcccguuuggcucgcccacaaagucgccagcgagggcaucaaguacaccgaucggaaguggugcuucgacgggcagcgcaacaaccagauccuugaggagaacauggacguggagaucuggacgaaggagggcgagaagaagaaguugcggcccagauggcucgaugcccgcaccuacuccgacccccuggcucugaaggaguucaaggacuucgccgccggccggaaguccaucgcccuugaccuggucaccgagaucgggcgugugccgucccaccuggcucaccggacccgcaacgcgcucgacaaccucgugaugcugcauacguccgagcacggcggacgggcguaccgccacgccgucgaggaacuccccgaaaccauggagacccuucugcuacugggccugaugaucuuacugacugggggggccaugcuguuccucaucuccggcaaggggaucggcaaaacguccauugggcugaucugcgugaucgccagcuccgggaugcuguggauggcagaugugccccuccaguggaucgccagcgccaucguccuggaguucuucaugauggugcugcucauaccggagccggagaagcagcggacgccccaggacaaccagcuggccuacguuguuauugggauccuuacccucgccgcgaucauugccgccaacgagaugggccugcuggagaccacuaagcgcgaccucggcaugucgaaggaacccgggguggugucuccgaccuccuaucuggacgucgaccugcaccccgccagcgcguggacccucuacgccguggccacaacggugauaacccccaugcugcggcacacgaucgagaacuccacugcgaacgucagcuuagccgccauugccaaucaggccguggugcugaugggccuggacaagggguggcccaucaguaagauggaccugggcgucccccuccuggcccuggggugcuacucacagguaaacccccucacgcugaccgccgcggugcugcuccugaucacccacuacgccauaauuggccccggccugcaggccaaggccacccgcgaggcccagaagcgaacggcggccgguaucaugaagaaccccaccguagauggcaucaugacuaucgaccucgacccggugaucuacgacuccaaguucgagaagcagcucggccaggugaugcugcugguccugugcgccgugcagcuucuccucaugcgcaccagcugggcucugugugaggcguuaacgcuggcuacuggccccaucacuacccugugggagggcucccccgguaaguuuuggaacacgacaaucgccgugagcauggccaacaucuuccggggcucauaccucgcuggggcgggccuggccuuuagcaucaugaaguccgucgggaccggcaagcgcggcaccgggucccagggcgagacccugggggagaaguggaagaagaaacucaaccaguuaucgcggaaggaguucgaucuguacaagaagucgggcaucacugagguggaccgaaccgaggccaaggaggggcucaaacggggcgagaccacccaccacgccgugagccgcggcuccgccaagcuucaaugguucgucgagcgaaacauggugauccccgaggggcgcgugauagaccuuggcugcggaagaggcggguggagcuacuacugcgcgggccucaagaaggugacggaggugcgcggguacaccaagggcgggccggggcacgaagagcccgugcccauguccaccuacggcuggaauaucgucaaacugaugagcgggaaggacguguucuaccugcccccggagaagugcgacacccugcugugcgauaucggggaguccagccccucccccacgguggaggagagucgcaccauccgcguucuuaagaugguggagcccuggcugaagaacaaucaguucugcaucaagguccuuaauccguauaugcccaccgucaucgagcauuuggagcgucuacagcggaagcacggcgggaugcucgugcgcaacccacugucucggaauagcacccacgagauguacuggauuuccaacggcacggggaacauugugucauccgucaacauggugucucgccugcuccugaaccgguucaccaugacccaccggagacccaccauugagcgcgacguagaccugggcgcgggcacgcggcacguaaacgccgagccggagauccccaacauggacgugaucggugagcgaauaaagcggaucaaggaggagcacaacuccaccuggcacuaugacgacgagaaccccuacaagacgugggccuaccacggcagcuacgaggugaaggccacggggagcgcguccagcaugaucaacggcguuguaaagcuccugacgaagcccugggaugucgugcccauggugacccagauggccaugaccgacaccacgcccuucgggcagcagcgcgucuucaaagagaagguggacacccggacaccccgcccgaugcccggcacccgcaaggugauggagaucacggccgaguggcuguggcgcacucucggccggaacaaacgcccccgccugugcacccgggaggaguucaccaagaagguccgcacgaacgccgcgaugggggccguuuucacggaggagaaccagugggacuccgcuaaagccgccguggaggaugaggaauucuggaagcuggucgaccgggagcgcgagcuccacaagcugggcaaguguggcagcugcguguauaauaugaugggcaagcgggagaagaagcugggggaguucggcaaggcgaagggcuccagggccauaugguacauguggcuuggggcccgguaccuggaguucgaggcccuggguuuccucaacgaggaucacugguucagccgcgagaacuccuacagcgguguggagggcgaggggcugcacaaguuaggcuacauccugcgggacaucuccaagauccccggcggggcgauguacgcugacgacaccgccggcugggacacccggaucacggaggacgaccugcacaacgaggagaagaucacucagcagauggacccggagcaccggcagcuggccaacgccaucuucaaacucaccuaccagaacaaggucgugaaggugcagcgccccacgccuaccgggacgguaauggacaucaucagccggaaggaccagcgcggauccggccagguagggaccuacggccugaauaccuucaccaacauggaggcccagcuggugagacagauggagggggagggcguccucagcaaggcggaccucgagaacccccaccuccucgagaagaagaucacgcaguggcuggaaaccaaggggguggagcgccugaagcggauggccaucagcggagacgacugugugguuaagccaauagacgacagguucgccaacgcacucuuggcccugaacgauaugggcaagguucggaaggacauaccccaguggcaacccucaaagggguggcacgacuggcagcagguccccuucugcucacaccacuuccacgagcucaucaugaaggacggccgcaagcucgucguuccgugccggccccaggacgagcugaucgggcgcgcgcgaaucucacagggggccggguggucccuccgggagacugccugcuuaggcaaagccuaugcgcagauguggagccugauguacuuccaccgcagggaccuccgccuggcaucgaacgcgaucugcagcgccgugcccguccacugggugcccaccagccggacgaccugguccauacacgcccaccaccaguggaugacgaccgaggauaugcugaccguguggaaccgcguauggaucgaggacaacccguggauggaggacaagacucccgugaccaccugggagaacgugcccuacuugggcaagcgggaggaccaguggugcgggagccugaucggccugacgucccgcgccaccugggcccaaaacauccccaccgcaauccagcagguccggagccucaucgggaacgaggaauuccuggacuauaugccguccaugaagcgcuuccggaaggaggaagagagcgagggggccaucugguga

SEQ ID NO: 25792 - RNA, 9873 nt, Artificial Sequence
  derived and/or modified CDS sequence (opt11) from DENV-3__FJ882573__SS-prME
accucccuaugccuaaugaugauccuucccgccgcgcuggccuuccaccucacuucucgugacggggagccgcggaugaucguggggaagaacgagcgcggcaagucgcuccuuuuuaagacggccagcggaaucaacaugugcacgcucauugccauggaucugggcgagaugugugaugauacugugaccuauaagugcccccacaucacagagguggagcccgaagacaucgacugcuggugcaaccugaccagcacauggguaacguacgggacguguaaccaggccggcgagcaccggcgcgauaagcgguccgucgcccucgcgccccacgugggcaugggacuggacacccgcacgcagacuuggaugucugccgagggagccuggcgacaggucgagaaaguugagacgugggcccugcgccacccgggguucaccauacuggcccuguuccuggcccacuacauaggcaccucccugacccagaagguggugaucuucauccugcugaugcuggugaccccuucuaugaccaugcggugcguggggguaggcaauagggauuucguggaggggcugucuggggccacauggguggacgugguacuggagcacggcggaugcgucaccacuauggccaagaacaaacccacccucgacaucgagcugcagaaaacagaggcuacccagcuggcgacgcuccggaagcuauguaucgaaggcaagaucaccaacaucaccaccgacucccgcugccccacgcagggcgaggccgugcugccggaggagcaggaccagaacuauguguguaagcauacauacguggaccguggguggggcaacggcugcggccucuucgggaagggcucccuggugaccugcgccaaguuccaaugccuggagccuaucgagggaaaggucgugcaguacgagaaccucaaguacaccgugaucaucacgguucacaccggcgaccagcaccaggugggcaaugaaacccaggggguaaccgcggagaucacgccgcaagccagcacgaccgaggcgauccuucccgaguacggaacucuggggcucgagugcuccccgaggaccggccucgacuucaacgagaugaucuuacuuacgaugaagaacaaggcuuggaugguucaccggcaaugguuuuucgaccugccccugcccugggccaguggagccaccaccgagacacccacguggaaccgcaaggagcuccuggugaccuucaagaacgcccacgccaagaaacaagaggucgugguucuggguucccaggaaggcgccaugcacacugcccuaaccggggcgacggagauucaaaauuccggggguaccagcaucuucgccggccaccugaagugcaggcucaagauggacaagcuggagcugaaaggaaugucguacgcgaugugcaccaacacuuucguauuaaagaaggaagucagugagacgcaacacggcaccauucucauuaagguggaguacaaaggcgaggacgccccgugcaagauuccguucagcacugaagacgggcagggcaaggcacauaacggccgccugaucaccgcuaaucccguuguaaccaaaaaggaggaacccgugaacauagaggcggagccgcccuucggggagagcaacaucgucaucgguauuggagacaacgcccucaagaucaacugguacaagaagggcuccucuauagguaaaauguuugaggccaccgcccggggcgcucguagaauggcgauccugggcgacaccgcaugggauuucggguccgugggcggugugcucaacagccuugggaagaugguucaccagauauuuggguccgcauacaccgcccuguucuccggaguguccugggugaugaagauaggcaucgggguccuuuugacguggaucgggcugaacagcaagaacacgcccaugucguuuucguguaucgcgaucggaaucaucacucucuaccucggggcggugguccaagccgauauggggugugucaucaacuggaagggcaaggagcugaaaugcggaagcgguaucuucgucacgaacgaggugcacacuuggaccgagcaguacaaguuucaggccgacagccccaagcgucuggcgaccgcuaucgcuggcgccugggagaacgggguuugcgguauccgcucaaccacgcguauggagaaccugcuuuggaagcagaucgccaacgaauugaacuauauccugugggagaacaacaucaaguugaccguaguggucggggacaccaccggaguucucgagcagggcaagcgcacgcuaaccccgcagcccauggaauuaaaguacagcuggaagaccugggggaaggccaaaaucgugacugccgagacgcagaacagcucauucaucaucgacgguccuaacaccccagagugcccguccgccagccgggcauggaacguaugggaaguggaggacuacggguucggcguguucaccacgaauauuuggcucaaguugagagaaguauacacccaguuaugcgaucaccgucucaugucagccgcagucaaggacgagcgcgcuguucacgccgacauggguuacuggaucgagagccaaaagaacgggagcuggaaguuagagaaggccucacugaucgaagucaagacaugcaccuggcccaagagccacacccucugguccaacggcguacuggagucagacaugaucauccccaagagccuggcggggccgauuagccagcauaacuaucggcccggauaccacacccagacggcggggccguggcaccucggcaaacuggagcuggacuucaauuacugcgaggggaccacuguugucaucaccgagaauugcgggacacgcggccccucccuacgaaccaccaccgucagcgggaaacuaauccacgaguggugcugccgcuccugcacacugccgccccuccgguauaugggagaggacgguugcugguacgguauggagauccgcccuaucagcgagaaagaggagaauauggugaagucccuagucagcgcgggcagugggaagguggacaacuucaccaugggagugcuaugccuugccauucuguucgaggaagugaugcgcgggaaguucggcaagaaacacaugauugcugggguguucuucaccuucguguuacucuugucuggccagaucaccuggcgcgacauggcccacaccuuaauaaugaucgggucaaaugccagcgaucgaaugggaaugggcgucaccuaccucgcgcugaucgccaccuucaagauucagcccuuccuggccuugggguucuuccugcgcaaauuaacaucacgggagaacuuacuacugggugugggccuggccauggccacgacccuacaguuaccggaggacaucgagcagauggcgaacgggaucgcccucggccugauggcccugaagcucauuacacaguucgaaacauaccagcuguggacugcccuggugagccugaccuguagcaauaccaucuuuacccugacgguugcuuggcgcacggccacccugauucuggccgggguaucccugcugcccgugugucaaagcuccucgaugcggaaaaccgacuggcuccccaugacggucgcugcuaugggagucccgccgcuuccccuguuuaucuuuucauugaaggacacccugaagcgucgaucuuggccucugaacgagggggugauggcggugggccucguuagcauccuggccaguagccuucuccguaaugaugucccgauggccggcccguuaguggccggcggccugcucaucgcgugcuacgugaucaccgggacgagcgcugaccucacugucgaaaaggccgcggacgugaccugggaggaggaggccgagcaaaccggcgugucccauaaccucaugaucacugucgaugacgacggcaccaugcgcauuaaagacgacgagacggagaacauccucacugugcuguuaaaaaccgcuuugcugaucgucagcggcaucuuccccuacuccauccccgcgaccuuauugguauggcacaccuggcaaaagcagacccaacggagcggcgugcucugggacguucccagcccacccgagacccagaaggcagagcuggaggaaggggucuaucgaauaaaacaacagggcauccucgggaagacccagguuggcgugggaguccagaaggagggcguguuucacacgauguggcacgucacccggggcgccgucuugacccacaacggaaagcgcuuagagcccaacugggccagcgugaagaaagaccucaucagcuacggcgggggcuggcgccugagcgcgcaauggcaaaaaggggaggaagugcaggucauagcgguagagccggggaagaauccgaagaacuuucagaccaugccggguacguuccagaccaccaccggcgagauaggagcuauagcccuggacuucaaacccggaacguccggcagcccgauuauuaaucgggagggcaagguugucgggcuuuacggcaaugggguggugaccaaaaacgguggguacgucuccggcaucgcccaaaccaacgcugagcccgacgguccaacccccgagcuggaggaggagauguucaaaaagcggaaccugacgauaauggaccugcacccaggguccggaaagacccgcaaguaccuucccgcaauugugagggaggcgaucaagcgccggcugcgcaccuuaaucuuagccccaaccaggguggucgccgcggagauggaggaggcccugaaagggcugcccauccgcuaucagacgaccgcuaccaaaagugagcacaccggccgggaaauaguggauuuaaugugccacgccacguucaccaugcgccugcuguccccgguccggguccccaacuacaacuuaaucaucauggacgaggcccauuucaccgaccccgcgagcaucgccgcccgcggguauaucaguacccgggugggcaugggcgaggccgcggccaucuucaugacggcaacuccgcccgggacagcggacgccuucccccagagcaacgcgcccauccaggacgaggaacgggacauccccgagcgcuccuggaacagcggcaacgaguggaucaccgacuucgcugggaagacagugugguucgugcccuccaucaaagccggcaacgacaucgccaauugccugcgaaagaacgggaagaaggugauccaacuaagccgcaagacguucgacacggaguaucaaaagaccaagcucaacgacugggacuucguggucacgacagacauauccgagaugggggcaaacuucaaggcggaucgggugauagacccccgccggugccuuaagcccgucauccucacggauggccccgagcgcgugauuuuggcagggccaaugcccgugaccgccgccagcgccgcccagcgccgugguagaguggggcggaacccccagaaggagaacgaccaguacauauuuacaggacagccccugaauaacgacgaggaccaugcccauuggaccgaggccaagaugcugcucgacaauauaaacacuccugaggguaucaucccugcccuguucgagccggaacgagaaaaguccgcggcaauagauggcgaauaccggcugaagggcgagagcagaaagaccuucguggagcugaugaggcgcggggaucugcccguauggcucgcccacaaggucgccagcgagggcaucaaguacaccgaucgcaaguggugcuucgacggccagcggaacaaucagauacuggaagagaacauggacguggaaaucuggacgaaggagggcgagaaaaagaagcugcgcccgcgauggcuggacgcacgcaccuacagcgacccccucgcguugaaggaguucaaagauuucgccgcaggccgcaaguccaucgcacuggaccucguaaccgagauuggucgggucccuagccaccuggcccacaggacccggaaugcgcucgacaaucucguaaugcugcacaccucggagcauggcgggcgcgccuaccggcacgccguggaggaauuaccggagaccauggaaacacuccugcuccugggacugaugauccuccucaccgggggcgcuaugcuguuccugaucuccggcaagggaauuggcaagacgagcaucgggcucauuugcgucauagccucgagcggcaugcuguggauggcggaggucccccugcaguggaucgcauccgcaaucgugcucgaguuuuucaugaugguccuauuaauccccgagcccgagaagcagcgcaccccacaggauaaccagcuagccuacguggugauuggaaucuuaacccuggccgcgaugauagccgcgaacgaaaugggcuugcuagaaaccacgaagcgggaccugggcaugucaaaggagcccggggucguguccccgacuucauaucuagacguggaccugcaccccgccagugcguggacucucuaugcggucgccacuacggucaucacaccgaugcuccgacacaccaucgagaacagcaccgccaaugugucccuggccgcgaucgccaaccaggccgucguacugaugggccucgacaagggcuggccuaucucaaagauggaccugggcgugccacugcucgcguuaggaugcuacucacaaguaaacccccuuacgcucaccgccgcgguguuacugcucauuacccacuacgccaucaucggcccagggcuacaggccaaggccacccgggaggcccaaaaacgcacggcggcuggaaucaugaagaaccccaccguugauggcaucaugaccaucgaccuggaccccgucauauacgacagcaaguucgagaagcagcucggccaggugaugcugcugguucucugcgccguccagcugcuucucaugcgaaccucaugggcccugugcgaggcguuaacgcuugccaccgggcccaucaccacccugugggagggcucaccgggaaaauuuuggaacacgaccauugcuguguccauggccaacaucuuccgcggcagcuaccuagccggggccgggcucgccuucucgaucaugaaguccguggggaccgguaagcggggcacggggucccagggcgaaacgcugggugagaaguggaagaagaaacugaaccagcugagccgcaaagaguucgauuuguauaaaaaguccggcauuacugagguagacagaaccgaagcaaaagaggggcugaagcgcggcgaaaucacgcaccaugccgugucccggggcagcgcuaaguuacagugguucguggagcgcaacauggucgugcccgaagggcgggugaucgaucugggcugcgggcggggcggguggaguuacuacugcgccggcuuaaagaaagugaccgagguccggggcuacacgaaaggcgguccugggcacgaggaacccgucccgaugucaaccuacggcuggaacaucgucaagcucaugucagggaaggacguguucuacuuaccgccggagaagugugacacccugcugugcgacaucggcgagagcucccccucaccaaccguggaggaguccaggacaauccgcguucucaagaugguagagcccuggcucaaaaacaaccaauucugcaucaagguguuaaacccuuacaugccaaccgucaucgaacaccucgagcggcugcagcggaagcacggagggaugcuggugcgcaacccauuaagccgcaacagcacccacgagauguacuggaucuccaaugguaccgggaacaucguguccagcgucaacauggugucccgguuacucuuaaaucgcuucacuaugacccaccggcgccccacuaucgagaaggacguggacuugggcgccgguaccagacacgucaaugccgagccugagacuccgaacauggacguuauuggggaacgcgugaagcgcaucaaggaggagcacaacagcaccuggcacuacgacgacgagaaccccuacaagacgugggccuaccacggcuccuacgaagucaaggccaccgguagcgcguccagcaugaucaacggugugguaaagcugcucacaaagcccugggacguugugcccauggucacgcagauggccaugaccgauaccaccccuuucgggcagcagcggguguuuaaggagaagguggacacgcggacgccccggccgaugcccgguacucggaagguaauggaaauaaccgccgaguggcuguggcggacccugggccgcaacaagagaccgcggcucugcacccgcgaggaguuuaccaagaaggugcggacaaaugccgcgaugggagccguauucaccgaggagaaccagugggacagcgcuaaggcggccgucgaggacgaggaguuuuggaaguuagucgaccgggaaagggaguugcacaagcucggcaaauguggguccugcguguacaacaugaugggaaagagggaaaagaaauugggggaguucggcaaggcgaagggaagccgcgccaucugguacaugugguugggggcacgguaccucgaguucgaagcccuggguuuccugaacgaggaccacugguucucccgggagaacagcuacuccggggucgagggggaggggcuucauaagcucggcuacauacuacgggauauauccaagaucccuggcggggccauguaugcugacgacaccgcgggcugggacacucgcauuacggaagacgaccuucacaacgaagagaaaauaauccaacagauggaccccgagcaccggcagcucgcuaacgccaucuucaagcucacauaucagaacaaggucgugaagguccagaggcccacccccaccgggacuguaauggauaucaucagccggaaggaccagcgcggcagcggccagguggggacguacggccucaacacauuuaccaacauggaggcccaguuaguccgccagauggagggcgaaggcgugcuaaccaaggccgacuuggagaacccgcacuuacuggaaaagaaaauuacgcaauggcucgaggccaaagggguggagagacugaagcgaauggccauuuccggagacgacuguguagugaagcccaucgacgaucgcuuugccaacgcccucuuggcguuaaacgacaugggcaagguccggaaggacaucccccaguggcagccgagcaaaggcuggcaugacuggcaacaggugccauucuguagucaccacuuccacgagcugauuaugaaggacggacgcaagcucgugguucccugccggccgcaggacgagcugaucggucgcgcccguaucagccagggcgccgguuggucccugcgcgagaccgccugucucggcaaggcguacgcgcagauguggucucuaauguacuuccaccgccgggaccuaagacuagcaucaaacgccaucuguagcgcggucccggugcacugggugccuaccucccggaccacguggagcauccaugcgcaccaccaguggaugacaaccgaggacaugcugacggucuggaaccgaguauggaucgaggagaaccccuggauggaggauaagacucccguuaccaccugggagaaugucccuuaccugggaaaacgggaggaccaguggugcgguucccucauuggcuuaacgagccgcgccacaugggcgcagaacauccccacugccauucaacaggugcggucuuugaucgggaaugaggaguucuuagauuacaugcccaguaugaagagauuucggaaggaggaggagagcgagggagccaucugguga

SEQ ID NO: 25793 - RNA, 9873 nt, Artificial Sequence
  derived and/or modified CDS sequence (opt11) from DENV-3__FJ898440__SS-prME
accagccuaugucucaugaugauccuuccagcagcccuggcguuucaccucacgagcagggauggugaaccccgcaugaucguggggaagaacgaaagagggaaaagccugcuguucaagaccgccagcgggaucaacaugugcacgcuaaucgcuauggaucugggcgagaugugugacgauaccgugaccuacaagugcccccacaucaccgagguggagcccgaggauaucgauugcuggugcaacuugaccucgaccugggugaccuacgguaccugcaaccaggccggcgagcaccggcgcgacaagcggagugucgcccucgcaccccacgugggaaugggguuagauacccgcacccagaccuggaugucugccgagggcgccuggagacagguagaaaaggucgagacuugggcccugcgccacccgggguucaccauccucgcguuguuccuggcccacuacaucggcacuuccuuaacucagaagguggucauuuucaucuuacugaugcucguaacgccgagcaugaccaugcggugcguagggguggggaaccgcgacuucgucgagggccuguccggggccaccuggguggacgugguucuggagcacggcgggugcgugaccacgauggccaagaacaagcccacccucgauaucgagcuucagaagaccgaggccacccagcuggcgacgcuccggaagcuguguaucgaaggcaagauuacuaacauuacuaccgacaguaggugccccacucaaggcgaggccgugcugccggaggagcaggaccaaaacuacgucugcaagcacaccuacguggauaggggauggggaaacgggugcggccucuucgggaagggcuccuuggugaccugcgccaaguuccagugccuggaacccaucgagggcaaggucgugcaguacgagaaccucaaguauaccgugaucaucacgguccauaccggggaccagcaccaggucggcaacgagacccagggggucacugccgagaucacgccccaagccagcaucaccgaggcgauuuuacccgaguacggcacgcugggccucgaaugcagcccgcgaaccggccuggacuuuaacgagauggugcuguuaaccaugaaaaacaaggccuggaugguucaccggcagugguuuuucgaucuucccuuacccuggacaagcggagcuacgaccgagacacccaucuggaaccgcaaggagcuucuggucacguucaagaacgcccaugccaagaagcaggagguuguaguccuggggucgcaggagggggcgaugcacaccgcccucacgggggccaccgagauucaaaacagcggcggcaccuccaucuucgccggccaccugaagugccggcuuaagauggauaagcucgaacugaagggcaugagcuacgccaugugcaccaacaccuuugugcugaagaaggagguguccgagacccagcacgggacgauccuaaucaaagucgaguauaagggagaggacgcgccgugcaagauccccuucagcaccgaagacggucagggcaaggcacacaacggccgccugaucaccgccaaccccgugguuaccaagaaggaggagcccgucaauaucgaagcggaaccgcccuucggggagucaaacaucgugaucggcauuggcgacaacgcgcugaagaucaacugguauaagaagggcuccagcaucgggaagauguuugaggccacggcccggggcgcccgacggauggccauucucggcgacacggcaugggacuucggguccguuggcgggguacuaaacucccugggcaagauggugcaccagaucuucgggucggccuacaccgcccuguucagcggcguguccuggguaaugaagaucggcaucgguguccuccucaccuggauagggcugaacucuaagaacacgucuaugagcuucuccugcaucgccaucgggaucauaacccucuaccucggugccgugguacaagcugacacagggugcgugaucaauuggaagggcaaggagcugaagugcggcagcgggaucuuugugaccaacgagguccacacguggaccgagcaguauaaguuccaggcugacuccccgaagcgccucgccaccgccaucgccggggcgugggagaauggggugugcgguauccgcucuaccacgcguauggagaaccugcuguggaagcagaucgccaacgagcucaauuacauccugugggaaaacaacaucaagcugaccguggucguaggggacaucauuggcgugcucgagcaagggaagcgcacacugacgccucagccgauggaacuaaaguacuccuggaagacgugggggaaagcaaagaucgucaccgccgagacacagaacagcuccuucaucaucgacggccccaacacccccgagugccccagcgcgucccgugccuggaacgugugggaaguggaagacuacggguucggcgucuuuacaaccaauaucuggcucaaguugagagaaguguacacucagcucugcgaccaccgccuaaugagcgccgccgugaaggacgagcgcgccguacaugcggacauggguuauuggauugagagccagaaaaacggaucguggaaacuugagaaggcuagccugaucgaagugaagaccuguacuuggccgaagucccacacguuguggucgaacggcgugcuagaguccgacaugaucauccccaagagccuggccgggcccaucucccagcauaacuaucggccgggcuaccauacccaaaccgccgggcccuggcaccucgggaaguuagaacuggacuuuaacuacugcgagggcaccacggucgugaucaccgagaacugcgggacacgcggccccucccuccggacgacgaccgucucagggaagcugauccaugaguggugcugucguagcugcacccugcccccguugcguuauaugggcgaggacgggugcugguacggcauggagauccggcccauuucugagaaggaggagaacauggucaagagccuaguuucugccgguagcgggaagguggacaacuucaccaugggaguccugugccucgccauccuguucgaggaggugaugcgggggaaguucggcaagaagcacaugaucgccgguguguucuuuacuuuuguccugcuccuguccggccagaucacuuggcgcgacauggcccacacccugaucaugaucggcucgaacgccuccgacaggauggguaugggcgugacguacuuggcccugaucgcgacguucaagauccaacccuuccuggcccucggguuuuuccugcgaaaacugaccagccgggagaaucuccugcugggcgugggacucgccauggccaccacccugcaacugcccgaggacaucgaacagauggccaacggaaucgcccucggucugauggcauuaaagcucauaacgcaguuugagacguaccagcuguggaccgcucugaucagccugaccugcucaaacacgaucuucacgcuaacagucgccuggcgcaccgcgacgcugauccucgccggggugagccuucuaccggucugccaguccagcuccaugcggaagacggacuggcugcccaugaccguggccgccaugggcgugcagccccugccccuguuuaucuucagccucaaggauacccugaaacgccgcuccuggccgcugaacgagggggucauggccgucggccucgugagcauccuagcguccagccugcuccggaacgauguccccauggccggcccccugguggcugggggacugcucaucgcgugcuacgugaucacggguacguccgccgaccugaccguugagaaagcggccgacgugaccugggaggaagaggccgagcagacgggcgugucccacaaucugaugaucaccguagacgacgacgguacuaugcgcaucaaagacgaugagaccgaaaacauccucaccgugcugcugaagacggccuuacugaucguguccggcaucuuuccauacagcaucccggcgaccuuacucgucuggcacaccuggcaaaagcaaacccagcgguccggcgugcugugggacguacccucaccgccagaaacgcaaaaggcggagcuggaggaggggguuuacaggaucaagcagcaaggcauauucgggaagacccaagugggggugggaguccagaaggagggcguguuccacaccauguggcacgugacaaggggagccguccuaacguauaacgggaagcgacuugaaccgaacugggccuccgugaagaaggaccugaucagcuauggagggggcuggcggcucuccgcucaauggcagaaaggggaggaggugcaggucaucgcgguggagccaggcaagaaucccaagaacuuucagaccaugcccgguaccuuccagaccacgaccggggagaucggcgcgauugcccuugacuucaagccggguaccaguggcucgcccaucaucaaccgcgaaggaaaggugguagggcuguaugguaacgggguggugaccaagaacggcggcuacgucucaggcaucgcucagacgaacgccgagcccgacggcccuaccccagagcuggaggaggagauguucaagaagcgcaaccucaccauaauggaucugcacccagguagcggcaagacccgcaaguaccugcccgcgaucgugcgggaggccaucaagcgccggcuccguacccugauccuggccccaaccagaguggucgcugcagagauggaggaagcguuaaaggggcugcccauccguuaccagaccacugcaacaaagucggagcauacgggucgggagauuguggaccugaugugccaugccaccuucaccaugcgccugcuaagccccgugagagucccgaacuauaaccugaucauaauggaugaggcccacuuuacggacccggccuccaucgcggcacguggcuacaucucaacccgggugggcaugggcgaggcagcagcgaucuucaugacugccacgccgcccgggacggccgacgcuuucccgcaguccaacgccccgauccaggacgaagagagagacauccccgagcgcagcuggaacuccggcaaugaguggauuacagacuucgcgggaaagaccgugugguucguacccagcaucaaggcaggcaacgacauugccaacugccuacguaagaacgggaagaaggucauucagcugucccgcaagaccuucgauacggaguaccagaagaccaagcugaacgacugggacuuugucguaacuaccgacauuuccgaaaugggagccaauuucaaggccgaccggguuauagauccacgccggugccucaaaccggugauucucacggacggaccggaaaggguuaucuuagcagggccgaugcccgugacagccgccuccgccgcacagcggcgcggacggguggggcggaacccgcagaaggagaacgaucaguacaucuucacaggacagccucucaacaacgacgaggaccacgcgcacuggaccgaggcaaagaugcugcuggacaacaucaacacgcccgaggggaucauccccgccuuauuugagccggagcgggagaaguccgccgcaauagauggcgaguaccgucugaagggcgagagccggaagacguucgucgagcugaugcgucgcggcgacuuaccaguguggcuggcccacaaggucgccucagagggcaucaaguacaccgaccgcaaauggugcuucgacgggcagcggaacaaccagauucuggaggagaacauggacguggagaucuggaccaaggagggcgagaagaagaaacuccgcccccggugguuagacgcacgcaccuacagcgauccucuggcccuaaaggaguucaaggacuucgcggccggccgaaagagcaucgcccuggacuuggugacggagaucggaagggucccgucccaccucgcccaucgcacccggaacgcccuggacaaccuggucaugcuccacaccagcgagcacggcggccgcgcguaccggcacgccguggaggaacuacccgagaccauggagacucuuuuacugcugggccucaugauauugcugacagggggugccaugcuguuccuuaucucuggcaaaggcaucggcaagaccuccauaggacugaucugugucaucgcaagcuccggcaugcucuggauggccgagaucccccugcaguggaucgcgagcgccaucguacuugaguuuuucaugauggugcuccugauccccgagccggagaagcagcggacgccacaagauaaccagcuggccuacguggugaucggaauccucacgcuggcggccaucaucgcggccaacgagaugggcuuacucgagacuaccaagaaggaccugggcauguccaaggagcccgggguaguaucucccacguccuaccuggaugucgaucuccaucccgccagcgccuggacgcuuuaugccguggccaccaccgucauuacccccaugcugcgccacacgaucgaaaauuccaccgccaacgugagccucgccgccaucgcgaaccaagccgugguccugaugggccuagacaagggguggcccaucaguaagauggacuuaggcgugccgcugcuugcccucggauguuacagccaggugaacccccuaacccugaccgcggccguccuccugcugauuacgcacuacgcgaucaucggucccggccuacaggccaaggcgacccgggaggcccagaagcggaccgccgcggggauuaugaagaaccccaccguggacggcaucaugacgaucgaccuggacccugugaucuacgauuccaaguucgagaagcagcuggggcaggucaugcuucuugugcugugcgccgugcagcuacugcugaugcgcaccagcugggcccucugcgaggcccugacuuuggcgaccggccccauuacgacccucugggagggcucuccugggaaguucuggaacaccaccaucgccgucaguauggccaauaucuuccggggcuccuaccuggcgggggccggccuggcauucaguauaaugaaguccguggggacgggcaagcggggcacugggucucagggcgaaacccucggggagaaguggaagaagaagcugaaccagcuuagccggaaagaguucgaccucuacaagaagucaggcaucaccgagguggaccggacggaagccaaggaggggcugaagcgaggcgagaucacucaccacgcaguaagccgcggcagcgccaagcugcagugguucguggagcggaacauggugauccccgaggggcgcguaaucgacuuagggugcgggcggggcggguggagcuacuacugcgccggucugaagaaggugaccgagguucgcggcuacaccaagggcgggccggggcacgaagaacccguccccauguccaccuacggcuggaauaucgugaaacugaugagcggaaaggacguguucuaccucccgcccgaaaagugcgacacgcugcugugcgauaucggugaguccagccccucccccaccgucgaggagagccggacuauccguguguugaagaugguggagcccuggcucaaaaacaaccaguucuguaucaagguccugaaccccuauaugcccaccgugaucgagcaccuggaaaggcuccagcggaagcacggcggaaugcuggugcgcaacccccucucccggaauagcacacacgagauguacuggauuucgaauggcacugggaacaucguggccagcgugaacauggugucccgccuccugcuaaaccguuucaccaugacccaccgcaggcccacgaucgagaaggacgucgaccucggagccggcaccaggcacgugaacgccgagccggaaacccccaacauggacguuaucggggagcggaucaagcgcaucaaggaggagcacaacagcaccuggcauuacgaugacgaaaaccccuacaagacgugggccuaccacggaucauacgaggugaaggccacagggagcgcguccagcaugaucaacggcguggucaaacuucugaccaaaccaugggacgugguccccaugguuacccagauggccaugacugacacgacccccuuuggucagcagcgggucuucaaggaaaagguggacacccgcacgccccggagcaugccgggcacccgacgggucaugggcauuaccgccgaguggcucuggcgcacccuggggcggaacaagaaaccacgccugugcacgcgugaggaguucaccaagaaggugcgcacaaacgccgcgaugggcgccguguucaccgaggagaaccagugggacucggccaaggcagcggucgaggacgaggauuucuggaagcuaguggaccgcgaacgggaacugcacaaacuggggaagugcggcagcugcguguacaauaugauggggaaaagagaaaagaagcucggcgaguucggcaaggcgaagggcucucgggccauuugguauauguggcugggugccagguaccuggaauuugaggcgcucggguucuuaaacgaggaccacugguuuucucgggagaacaguuauagcggggucgagggggagggccugcauaagcucggguacauccugcgcgacauauccaagauccccgggggcgccauguacgcggacgacaccgccgggugggacacccggaucaccgaagacgaucuacacaacgaggagaagaucacccaacagaugaaucccgagcaccgccaacucgcgaacgccaucuucaagcugacguaccagaacaagguggugaagguccaacggccgaccccuaccggcaccgugauggauaucaucagccgaaaggaccagaggggauccggccaggugggcaccuacgggcugaacacauucaccaacauggaggcccagcucauccgccagauggagggcgagggggugcugagcaaggcggacuuagagaacccccaccuccccgagaaaaagaucacccaguggcuggagaccaagggcguggagcgucugaagcgcauggccaucuccggagacgacugcguggugaagccaaucgacgaucgguucgcuaacgccuuacuggcccugaaugacauggggaaggugcgcaaggauaucccccaguggcagcccagcaagggcuggcacgacuggcagcagguacccuucugcucccaccacuuccacgagcucauuaugaaggauggacguaagcucgucgugccuugucgcccccaggaugagcugaucggccgggcgcgaauaucccagggcgccggguggucccucagagaaacggccugccugggcaaagccuacgcgcaaauguggagccugauguacuuccacaggcgcgaccugcggcuggccuccaaugccaucugcucagccgugcccguccacuggguucccaccagucgcacgaccuggagcauucaugcccaccaccaguggaugacgaccgaggacaugcugaccguguggaaccgggucuggaucgaggacaacccuuggauggaggacaagacccccgugacaaccugggagaacguaccuuaccucgggaagcgugaggaucaguggugcgguagccugaucgggcucaccucccgggcaaccugggcucagaacauccccaccgccauccagcagguccguagccucaucggcaacgaagaguuccuggauuacaugccgaguaugaagcgguuccgcaaggaggaagaaagcgaaggcgccaucugguga

SEQ ID NO: 25794 - RNA, 9873 nt, Artificial Sequence
  derived and/or modified CDS sequence (opt11) from DENV-3__FJ898441__SS-prME
accagcuugugccucaugaugaucuuacccgcagcccuggcguuccaucucaccagccgcgacggcgaaccgaggaugauuguggggaaaaacgagcgcggcaagagccugcuguucaaaacggcuagugggaucaacaugugcacccucaucgcuauggaccugggugaaaugugugacgauacggucaccuacaagugcccccacaucacggagguggagccugaggacaucgacugcuggugcaaccugaccagcaccugggugacuuacgguacgugcaaccaggccggggagcaccggcgcgauaagcgauccguagcucucgcgccccacguagggauggggcuggacacccgcacccagaccuggaugagcgccgaaggcgccuggagacagguggagaaggucgagacgugggcccugcgacauccuggcuucaccauccuggcguuauuccuggcccacuacaucggcacgucccuuacccagaaaguggugauuuucauccugcucaugcucgucacgccgaguaugacaaugcggugcguggggguggggaaccgcgacuucgucgaaggcuuauccggggccaccugggucgacgugguccuggagcauggcgggugcgugaccacuauggccaaaaauaaacccacacuagauaucgagcugcagaagaccgaggccacucaacucgccacgcuccggaagcugugcaucgaggguaagaucaccaacaucaccaccgacucccgcuguccgacgcaaggcgaggcuguucugccagaggagcaagaccagaacuacgucugcaagcauacauacguggaccggggguggggcaacgggugcggccuauucgggaagggcucuuugguaaccugcgcgaaauuccagugccuggagccgauugagggcaagaugguacaguacgagaaccuuaaguauaccgugaucaucacggugcauaccggggaccaacaccaggucggcaacgaaacccaaggggugacagcugaaaucacaccccaggcgucaaucacagaggcgauccugcccgaguacggcacccugggccuagagugcuccccgcgcaccggccuggacuucaacgaaaugauccugcucacuaugaagaacaaagccuggaugguccaccggcagugguucuucgaucuuccucugcccuggacgagcggcgccacgaccgaaacucccacguggaaccgaaaggaacugcuggucacuuucaagaacgcacacgccaagaagcaggaggucgucgugcuggggucucaggagggcgccaugcacaccgcccuuacgggcgccacggagauccagaacucaggcgggacaaccaucuucgcggggcaccugaagugccgucugaagauggacaagcuagagcucaaggguauguccuacgccauguguaccaacacguuuguccugaaaaaggaggucagcgaaacucagcacgggaccauccucaucaagguggaguacaagggggaggacgcgccgugcaagauccccuucuccaccgaggacggucagggcaaggcacacaacggacgccugaucacggcuaacccgguggucaccaagaaggaggagcccgugaacaucgaggcugagccaccauucggggaauccaacauugugaucggaaucggggacaacgcgcuaaaaauaaacugguacaagaaaggaucuucuaucgggaaaauguucgaagcaaccgcccgcggggcacggcggauggcuaucuuaggcgacaccgcgugggacuucgggucaguuggaggggugcuuaacagucuaggcaaaauggugcaccagguguucgguagcgccuacacggcucuguucagcggcgugucgugggugaugaagaucggaaucgggguccuacuuaccuggaucggacugaacuccaaaaauacuagcauguccuuuagcugcauagccaucgggaucaucacccucuaccugggugcuguggugcaggcggacacggggugcguaaucaauuggaagggcaaggagcuuaaguguggcuccgggaucuucgucacuaaugaagugcacaccuggaccgagcaguacaaauuccaggcugauucccccaagcgccucgccacggccaucgccggcgcgugggagaacggugucugcggaauccgcuccaccacccgaauggagaaucuguuguggaagcagaucgcaaaugaacucaacuacauucugugggagaacaacaucaaguuaaccgugguggucggggacaucaucggcguccucgagcagggcaaaagaacucuuaccccgcagccgauggagcugaaguacagcuggaaaaccugggggaaggccaagauugugaccgccgaaacgcagaacuccucguucaucauagacggccccaacacccccgagugcccaagcgcgagcagagcauggaacgucugggagguggaggacuauggcuucggaguguuuaccaccaacauuuggcucaaacugcgcgaagucuacacccagcuaugugaucaccggcucaugagcgccgccgugaaggacgagagggccguccacgcggacaugggcuacuggauagagagccaaaagaaugggagcuggaagcuggagaaggccucacuaaucgaaguaaagacguguacauggccgaaaagccacacucuuugguccaacggugugcuggagucugauaugaucauucccaagucccuggccgggcccaucagccagcacaacuaccggcccgguuaucacacgcagacggcugggcccuggcaccucggaaagcuggagcuggacuucaacuacugcgagggcacgacuguugucaucacggagaauugcgggacgcgcggccccucgcuccggacuaccaccgugucggggaagcugauucaugaguggugcugccgcuccugcacucugcccccgcuccgguacaugggagaggacgggugcugguacgggauggagauccgcccaauaucagagaaggaagaaaacauggugaagucccuggucucugccggcucagggaaggucgacaauuuuaccaugggcgugcugugccucgcgauccuguucgaggaggucaugcgggggaaguucggcaagaagcacaugaucgugggcguguucuuuaccuucguccuccuucugucaggccagaucaccuggcgagacauggcacacacuuugaucaugaucggcagcaacgccagcgaucggauggggaugggcgucaccuaccucgcacuuauagccaccuuuaagauccagccuuuccuggcgcucggguuuuuccugcgcaagcugaccucccgggaaaaccuccugcuaggcgugggauuagccauggccacgacccugcagcugccggccgacaucgaacagauggcgaacgguaucgcacucggccugauggcccugaagcucaucacccaguucgagacauaccagcuguggacggcucugaucucccuaaccugcagcaacacgaucuucacccugacggucgccuggcgcaccgcgacacugauccucgcaggagugucccuccuaccggucugccagucauccucgaugcguaaaaccgacuggcucccaaugacgguugccgccaugggcgugcagccccuaccccuguucaucuucaguuugaaggacacccuaaaacgccgcagcuggccguuaaacgagggggucauggcgguggggcucguguccauacuggcgagcucccuacuccggaacgacguccccauggccggcccgcugguggccgggggccugcugaucgccugcuaugucaucaccgggaccucggcagaccugacugucgagaaggcggccgaugugaccugggaggaggaggccgagcagacgggcgugucccacaaccuuaugaucacuguagacgacgacgggacuaugcgcaucaaagacgaugagacugagaacauccucacagugcugcugaaaaccgccuuacugaucgucagcgguaucuuuccuuacagcaucccggccacccuauuagucuggcacacguggcagaagcagacccagcggucgggcguguuaugggacgugccuaguccacccgaaacacaaaaggcggagcuggaggagggggucuaccgcaucaagcaacagggaaucuucggcaagacccaggugggggugggaguccagaaagagggcgucuuucacacgauguggcacgucacccggggcgccguccucaccuacaacgggaagcgccuggagcccaacugggccagcgugaagaaggaccugaucuccuacggugggggauggcggcucagcgcccaauggcagaaaggggaggaggugcaggucaucgccguggagccaggcaagaaccccaagaacuuccaaaccaugcccggcacauuccaaaccaccacaggggagauaggcgcaaucgcgcuugacuucaagccggggacgucuggcagccccaucaucaaccgcgaggguaagguagucggccuguacggcaacggaguggucaccaagaacggcggguacguaucuggcaucgcacagacgaacgccgagcccgaugggccgacgccugagcuggaagaggagauguucaaaaagcgcaaccuuacgaucauggacuuacaccccggaagcggcaagacccgcaaauaccugcccgcgaucguacgggaggccaucaagcgcagacuucgcacccucauccuggccccgacccggguggucgcggccgagauggaggaggcccucaaggggcugccgauccgcuaccagacgaccgccaccaagagcgagcacaccggccgggaaaucguggacuuaaugugccacgcgacguucaccaugcgccugcugagucccgugcggguccccaacuacaaccugaucauaauggacgaagcccauuucacggaccccgcgagcaucgcggcccgcggguacaucuccacccgcgugggcaugggagaagccgccgcgaucuucaugaccgccaccccgcccgggaccgccgacgccuucccccagagcaacgccccgauccaggacgaggagcgggacauccccgagcgcuccuggaacagcgggaacgaguggaucaccgauuucgcggguaagaccgucugguuuguccccuccaucaaggcgggcaacgauaucgcuaacugccuccggaagaacgggaagaagguaauccagcugucucguaaaaccuucgacaccgaguaccagaaaaccaaacugaacgacugggacuucgugguuacaaccgacaucagugagaugggcgccaacuucaaggccgaccgcgugauugacccucgucggugucucaagccggugauccugaccgauggacccgagcgcgugauccuggcggggcccaugcccgugaccgccgccagcgccgcccagcggagaggccgggucgggcguaacccacagaaggaaaacgaccaauacauauucaccggccaaccucuaaacaaugacgaagaccaugcacacuggacagaggccaagaugcugcuggacaacaucaacacccccgagggaauuaucccagcccucuucgagccagaacgggagaaauccgcugcuaucgacggcgaguacagacugaagggcgagagcagaaaaacuuucguagaguuaaugagacgcggagaccuccccguguggcucgcacauaaagucgccuccgagggcaucaaauacacagaucgcaaauggugcuucgaugggcagcggaacaaucagauacuggaggagaacauggacguagagaucuggacgaaggagggcgagaagaagaagcuacgcccucgguggcuggacgccagaacauacagcgacccuuuggcccugaaggaguucaaggacuucgcggccggccgcaaguccauugcacuggaccuagucaccgagaucgggcgggucccgucgcaucuagcgcaucggacccggaaugcccuggacaaccuggucaugcuccacacguccgagcacggagggcgcgcguacaggcacgcaguggaggaacugcccgagaccauggagacucugcuccuguugggacucaugaucuuacugaccgggggcgcaaugcuuuuccugauaucaggcaaggggauuggcaagacgucgaucggguuaaucugcgucaucgccuccagcggcaugcucuggauggccgaaaucccccugcaauggaucgccuccgccauagugcuggaauuuuucaugauggugcuccugauccccgagccugaaaagcaacgcaccccacaagacaaccagcuggcauacgucgucaucgggauccucacucucgccgccaucaucgcggccaacgagaugggucugcucgagacaacgaaaaaggaccugggcaugagcaaggagcccgggguggucuccucgaccuccuaucuggauguggacuugcauccggccucggcguggacccuguaugcgguugccaccacggucauaaccccaaugcugcggcauaccaucgaaaacuccaccgcaaaugugucgcuugcagccaucgcgaaccaggccgugguccugaugggauuagauaagggcuggcccaucuccaagauggaccugggcgugccccugcuagcccucgggugcuauagccaggugaacccgcugacgcugaccgccgccguacuccuacugaucacgcauuacgcgaucauaggcccuggccuccaggccaaggccacgcgcgaggcucagaaacggacggccgcgggcaucaugaagaaccccaccguggauggcaucaugacgauagaccuagaccccgugaucuacgacuccaaguuugagaagcagcuggggcaggucaugcuccugguacugugugccgugcagcuccugcugaugcgcaccagcugggccuugugugaggcgcugacgcuggcgaccggcccgauaaccacccucugggaggguagccccgggaaguucuggaacacaacaauugccgucucuauggcuaacauauucagaggcuccuaccuggccggggccggccuagcguucagcauuaugaaaagcguggggaccgggaagcgcggcaccggcagccagggcgagacccuuggggagaaauggaagaaaaagcugaaccagcugucacggaaggaguuugaccuuuacaagaaguccggcaucacggagguggaucgcaccgaggcuaaggaggggcugaaacggggcgagaucacccaccacgcggucagccgcggauccgcgaagcuacagugguucguggagcggaauauggugaucccugaggggcgcgucaucgaccucggcugcggacggggcggguggagcuacuacugcgccggccugaagaagguaaccgaggugcgaggauacacgaagggaggcccgggacacgaggagcccguccccauguccaccuauggcuggaauauuguuaagcugaugacugggaaggauguuuucuacuuaccacccgagaaaugcgacacccugcugugcgacauaggcgagagcuccccgagccccaccgucgaggagucccggaccauccgagugcuaaagaugguagagcccuggcugaaaaacaaccaguucuguaucaagguccuaaaccccuacaugccaaccgugaucgagcaccuggagcgccuucagcgaaaacacggcgggaugcuggugagaaauccccuuagccggaacuccacacacgagauguacuggaucagcaacgggacggggaauaucgucgccuccgugaacaugguuagccgccuccuguugaaccgguuuacgaugacccaccgacggcccacaaucgaacgugacgucgaccucggcgccggcacccggcacgugaaugccgaacccgagaccccgaacauggacguaaucggggagaggaucaagcggaucaaagaggagcacaacucuacuuggcacuacgacgacgaaaaccccuacaagaccugggccuaccacggcagcuacgaggucaaggcuacggggagugcgagcuccaugaucaacgggguugucaagcugcugacuaagccgugggacguggugccgauggucacacaaauggccaugaccgauacuacccccuuugggcagcagcgcgucuucaaggagaagguggacacucggaccccgagaagcaugcccggcacgcguaaggucaugggcaucacggccgaguggcucuggaggacacuggggcggaacaagaagccucgccugugcacccgggaggaguucacgaaaaaggugcgcacgaaugccgcgaugggcgcgguauucaccgaagagaaccagugggacagcgcgaaggccgcagucgaggacgaggacuucuggaaacugguggaccgcgaacgggaacugcacaaacuugggaagugcggauccugugucuauaacaugaugggaaagcgugagaagaaacucggcgaguucggcaaggcaaaggggucccgggccaucugguauaugugguugggcgcccgcuaccuagaguucgaagcgcucggguuccuaaaugaggaccacugguucucccgggagaacagcuacucaggcguggagggggaaggccugcacaagcucggcuacauucugcgcgacaucagcaccauccccggcggagccauguacgcggacgacacggccgggugggacacucgaauuaccgaggacgaccugcauaacgaggagaaaaucacacagcagauggaucccgaacaucgccaauuagccaaugccaucuuuaagcugaccuaccagaauaagguggugaagguacagcggcccacucccaccgguaccgugauggacaucauaucccgcaaggaccagcggggcucgggacaggugggcaccuacgggcugaacacguuuacuaacauggaagcccagcucauccgccagauggagggcgaggggguccuuaguaaggcggaucuggagaacccccaccuccccgagaagaaaaucacccaguggcuggagaccaagggcguggagcggcugaagcgcauggccaucagcggcgacgacugcguagucaagcccaucgaugacagauuugccaacgcccuccuggcccugaacgacauggggaaagugcgcaaggacauaccgcaauggcagccuaguaagggguggcacgacuggcagcaaguucccuucuguucgcaccauuuccacgagcucauaaugaaggacgggcggaagcuagucguccccugucgcccgcaggaugagcugaucgggcgggcgcguauaucccagggggccggauggagccuccgggagacagccugcuugggcaaggcguacgcgcaaauguggucccugauguacuuccaccgccgcgaccuccgguuggccagcaaugcgauuugcuccgccguacccguccacuggguccccaccagccguaccaccuggucgauccacgcacaccaccaauggaugacgaccgaggacauguugaccguauggaaccgggucuggaucgaagacaacccuuggauggaggacaagacuccggugacgaccugggagaacgugcccuaccuugguaagcgagaggaccaguggugcggcagccugauaggacugacuagccgagcgaccugggcccaaaacauaccaacggccauccagcagguuaggucccuuaucggaaacgaggaguuccuggacuacaugcccucaaugaagcgauuucgcaaggaggaggaguccgagggcgcuaucugguaa

SEQ ID NO: 25795 - RNA, 9873 nt, Artificial Sequence
  derived and/or modified CDS sequence (opt11) from DENV-3__FJ898442__SS-prME
acuucccucugcuuaaugaugauccucccggccgcacucgcuuuccaucucaccuccagagacggcgagccuagaaugauaguugggaagaaugagaggggcaagucccuacuguucaagaccgcaucggggauuaacaugugcacccuuaucgccauggaccugggggagaugugcgaugacacggugacauauaaaugcccccacaucacggaaguggagccagaggauauugacugcuggugcaaccucacuucaaccuggguaacguaugggaccuguaaccaggcgggcgagcaccggcgcgacaaacggucuguugcgcucgcgccacacguaggcauggggcuggauacacgaacccagacguggaugucagccgagggcgcuuggcgucaaguugaaaagguugagacaugggcccugcgccacccagguuuuacgauacucgcucuguuccuggcccauuauaucggaaccucccucacccaaaaaguggucaucuuuauccugcugaugcucgugacaccauccaugacgaugcgcugugugggggugggcaaucgggauuucguugagggccuguccggugccacguggguggauguagugcuggagcauggcgggugcgugaccacgauggcaaagaacaagccuacccuagacauugaguuacaaaagacugaggccacccagcuggcaacacuccggaagcugugcaucgaaggcaagaucaccaacauuaccaccgauucacggugccccacucagggcgaggccguacucccugaggagcaagaucagaauuacgucuguaagcacaccuacguggaucgaggguggggcaauggaugcgggcucuucggcaaaggcucccuggugacgugugccaaguuccagugccuggagccuauagagggcaagaugguacaguaugagaaucucaaauauaccgugaucaucacgguacauaccggugaccaacaccagguaggaaacgaaacucaaggggugaccgccgaaaucacaccacaagccagcaucacugaggcgauucugcccgaguacggcaccuuaggucuagaaugcuccccgcgcaccggccuagauuuuaacgaaaugauccugcucaccaugaagaacaaagccuggaugguacacaggcaaugguucuuugacuugccacugcccuggacgucgggcgcgaccaccgaaacucccacguggaaucgaaaagagcuccucguaaccuuuaaaaacgcgcacgccaagaagcaggaagucgucgugcugggaagucaggagggugcgaugcacacggccuuaaccggagccaccgagauccagaacagcggcggaaccaccauauucgccggucaccugaagugccggcuuaagauggauaaacuagaguuaaaagggauguccuacgccaugugcacgaauacguucguguugaagaaagaagucagcgagacgcaacacgggacgaucuuaaucaagguggaguacaagggcgaggacgcgccgugcaagaucccuuucucgaccgaggaugggcagggcaaggcccacaacgggcgccucauuacggcuaauccgguuguuaccaaaaaggaagagccagugaauaucgaagcugagccuccguucggcgagagcaauaucguaaucggcauuggggacaacgcgcucaaaaucaauugguauaagaagggcucgucuaucgguaaaauguucgaggccaccgccaggggugcacgucgcauggccauccucggcgacaccgcgugggacuucgguagcguuggcggggugcuaaauucgcuggggaagauggugcaccagguuuucgggagugccuacacugcccuguucucgggggucuccugggugaugaagaucgggauagguguauuacugaccuggauuggccugaauucaaagaauaccaguaugucguucaguuguaucgccauuggaaucaucacccuuuaccugggcgcggugguucaggcggacacgggcugugucaucaacuggaagggcaaggagcuaaagugugguagcgggaucuucgucacgaaugaggugcauaccuggaccgaacaguacaaauuccaggccgauaguccaaagcgccucgcgacagccaucgccggcgcuugggaaaacggggucugcggcauccgcucaaccaccaggauggagaaucuccuguggaagcagaucgcuaaugaacucaauuacauucugugggagaacaauauaaagcuaacggugguggucggagacaucaucggcgugcucgagcaaggcaagcggacgcugacgccccagccgauggaguugaaguauagcuggaagacuuggggaaaagccaagaucgugacggccgaaacucagaacaguucauucaucauugacggacccaauacccccgagugcccauccgcgagcagggccuggaacguaugggaaguagaggauuacggguuuggaguguucacuaccaauaucuggcucaaguuacgagaggucuacacgcagcucugcgaccacagauuaaugucagccgccgugaaagacgagcgugcaguccacgcagauaugggcuauuggaucgagagucagaagaacgggagcuggaaguuggagaaggccucucucauagagguaaaaacguguaccuggcccaagagccacacccuuugguccaauggcguucuggagagugacaugaucauacccagaucccuggccgguccuauaagccagcacaacuaucgcccggguuaucauacccagacggccgggcccuggcaccuggggaagcucgagcuggacuucaacuacugcgagggcaccacuguagucauaaccgagaacugugggacccgcggccccagucuccgcaccacgacagugagcggaaagcucauacacgaguggugcugccguucaugcacuuuaccaccccugcgauauaugggagaggacgguuguugguacggcauggaaauccggcccaucagcgagaaagaagagaauaugguaaaauccuuaguauccgccggcucgggaaagguggacaauuuuaccaugggagugcugugccuggcgauccuauuugaagaggugaugcgcgggaaguucgguaagaaacacaugaucgccggggucuucuucaccuucgugcuucugcuguccggccaaaucaccuggcgggauauggcgcauacccugauaaugauaggaagcaacgccagcgaccgcauggggaugggcgucacuuaucuagcccuaaucgcgaccuucaaaauccaacccuucuuagcauuggguuucuuccugcggaagcucacaagccgcgagaacuuauugcuuggcgugggccuugccauggcuacgacacugcagcuacccgcagacauagagcagauggccaacggcaucgcguugggacugauggcccugaagcucaucacccaguucgagaccuaucaacuuuggacggcgcuuauaagucugacuugcucaaacaccaucuucacccucacaguggcguggcguacagcaacgcugauacucgcgggugucucucuacuaccggugugccagucuagcucgaugaggaaaacggacugguuacccaugaccguugccgcaaugggggugcaaccccugccgcuguucaucuucuccuuaaaagacacccugaaaagacggucuuggccgcugaacgaggguguaauggccgucggccucguguccauccuggcuagcucucuucuccggaacgacgugccaauggccggcccguuggucgccgggggacugcucaucgcuuguuacguuaucaccgggaccagcgcggaccucacgguggaaaaggccgccgacgucaccugggaagaggaggcggagcagaccggcgugucccacaaccugaugaucaccguggacgaugaugggacuaugcgaauaaaggacgacgagacggagaacauccuaaccguguuacugaaaaccgcacugcucaucguguccggcaucuucccauacuccauaccggcgacauugcucgucuggcauacguggcagaagcaaacacagcgcagcggagugcucugggauguuccaagcccgccugaaacccagaaggccgagcuggaggagggaguauacagaaucaagcagcaaggcauuuucgggaagacccaggucggcguaggugugcaaaaagagggugucuuucauacgauguggcaugugacucgcggggccguucuaaccuauaacggaaagagacucgagccaaacugggccuccgucaaaaaggaccugaucuccuacggcggcggcuggcgacuuucggcgcaguggcaaaagggagaggagguccaggucaucgcggucgaacccggcaagaaucccaagaacuuccagaccaugcccggcacguuucagaccaccacaggagagaucggagccaucgcacuggacuucaagccgggaacguccggcucaccgaucauuaaucgggaagguaaggucgucggccuguaugggaacggggucgugaccaagaacggcggcuacguuagcggcaucgcacagacaaaugcggagcccgaugguccuaccccggagcuggaggaagagauguucaagaaacguaaucucacgauuauggaccugcacccggggagugggaaaacacgaaaguacuugcccgccauuguccgggaggcaaucaagcggcgucuccguaccuugauccuagccccaacccgaguaguggcagcugaaauggaggaagccuuaaagggucugcccauccguuaccagacgacggcgacgaagucugaacacaccggacgagaaaucgucgaccuaaugugccacgccacauucacaaugaggcuccuuagucccguccgcguacccaauuacaaucugaucaucauggacgaggcccacuucaccgacccggcgagcauugccgccaggggguauauaucaacccgcguugguaugggcgaggccgcggccaucuucaugacggccacuccgcccgggaccgccgacgccuucccccagagcaacgcgccaauccaggacgaggaaagggauauccccgaacgguccuggaacagugguaacgaauggaucaccgacuucgcggguaagacggucugguucgugccaucgaucaaggccggcaacgacauugcuaacugccuucgaaagaacggaaagaagguuauacagcuaucucggaagaccuucgacacugaguaccaaaaaaccaaguugaaugacugggacuuuguggucacgacugauaucagcgagaugggcgccaacuucaaggcggacagaguuauagacccacgccgcugcuuaaagccggugauacugacagacgggccagagcgcgugauccuggcugggccaaugccugugacggcagccagugcugcucagcgucggggccgcguggggcggaacccucagaaggagaacgaccaguacaucuucaccgggcagccccucaacaacgacgaggaccacgcgcacuggaccgaggcuaaaauguuauuggauaauaucaauacccccgaggggaucauucccgcguuauucgaaccugagcgagagaaguccgcggccauagacggcgaauauagauuaaaaggcgagagccggaagacauucguggaacugaugcggcgcggggaccuuccugucugguuagcgcacaagguagccuccgagggcauuaaguacaccgauaggaaauggugcuucgacgggcagaggaacaaccagauacuugaggagaacauggacguagagauauggaccaaggagggugagaaaaagaagcuccggccccguuggcuggacgccagaaccuauagcgauccacuggcuuugaaggaguuuaaagacuucgccgccggccggaaaaguaucgcacuggaccuuguaacggagaucggacgcgugccgucucauuuagcccaccggacaagaaacgcgcuagacaacuuagugaugcuccacacgucggaacacggagggcgagccuaccgccacgcuguagaggagcuuccugaaaccauggagacauugcucuuacuaggcuugaugauacuccuuaccgggggggcaaugcuauuucugauaagcggcaagggaauagggaagacaucgaucgggcugauaugcgugauugcaagcagcggcaugcucuggauggcggagaucccccuacaauggauugccuccgcgaucguucuggaguucuucaugauggugcuccugauuccggagcccgagaagcagcguacuccccaggauaaccaguuagccuacguuguuaucggcauccugacucuugcggcaauaaucgccgcaaaugaaauggguuuacuggagaccaccaagaaagaccugggcaugagcaaagagcccgggguuguguccucgaccucuuaccuugacgucgaccuccauccggccagcgccuggacccuguaugccguggccacuacagucaucacccccaugcugcgccauaccaucgaaaauuccaccgcuaacguaagucuagcggcaaucgcuaaucaggcaguggugcucaugggacuggacaagggguggcccaucuccaagauggaccucggcguuccgcuguuagcccuugggugcuacagccagguaaauccccugacgcugaccgccgcagugcucuuacucaucacucauuacgccauaaucggcccaggccugcaggcuaaagcaaccagagaggcgcaaaagcgcacugcugcggggaucaugaagaaccccaccgucgacgguauuaugacaauagaccucgacccggugaucuaugacaguaaauucgagaagcagcugggucaggugaugcugcuuguccucugcgcaguccagcuccugcuaaugcggaccagcugggcgcucugugaagcacuuacccuggcuacggggccuaucaccacucucugggagggcucucccggaaaguuuuggaacacaacgaucgcagugagcauggccaauauuuuccgcggcucauacuuagccggggccggccuugcuuuuuccaucaugaaguccgucgggacgggcaagcgggggacggggagccagggcgagacgcuuggggagaaauggaagaaaaagcugaaccagcuaucccgcaaggaguucgaccucuacaagaaaucggguaucacggaaguggaccggacugaagccaaggaagggcugaagcgcggggaaauaacccaucacgccgugucacggggcuccgcgaagcuacagugguuuguagagcgcaauauggugauucccgaaggacggguuauagaccugggcugcgggcgcggcggguggaguuacuacugugcaggccuaaaaaaggucacagaggugcggggcuauaccaagggcggucccggacacgaggagcccgugccaaugagcacuuacggauggaacauaguuaagcuuaugaccgggaaggacguuuucuacuugccaccagagaaaugcgauacccugcugugcgauaucggcgaaucuucgccgagcccgacgguggaggagucccgcaccauacgcguccuuaaaaugguagagcccuggcugaagaacaaccaauucugcaucaagguguugaacccauacaugccgacuguaauugagcaccuugagaggcuccagaggaagcauggcggaaugcuggugcggaauccucuuagccgcaauuccacacacgagauguauuggauuuccaacggcacggggaacauugucgccucugucaacauggugucgcggcuuuuacucaacagguucaccaugacccaucggcggccgaccauagagcgggacguggaucucggggccggcacgcgccaugugaacgcugagcccgaaaccccgaauauggaugugauaggagagagaauaaaacgcaucaaagaagagcauaacucaacguggcacuacgaugacgagaaccccuacaaaaccugggcauaucaugguucuuacgaggucaaggcgacgggaucggccuccuccaugauaaacgguguugugaaacugcuuacaaagccaugggaugucguaccgauggucacccaaauggccaugaccgacacgacccccuucggacagcagagggucuucaaggagaaaguagauacgaggacgccgcggagcaugcccggcacgcgcaaggugaugggcauuacugccgaguggcucuggagaacauugggucggaacaagaagccucggcugugcacucgagaagaauucacaaaaaaggucagaacuaacgcggccaugggcgcugucuuuacugaggaaaaccagugggacuccgccaaagcggcgguggaagaugaggaauucuggaagcuagucgaccgggagcgcgagcuccacaaacugggaaaaugcggguccugcguguacaauaugaugggcaagcgggaaaagaagcucggagaguuugguaaggcuaaggguucccgcgcuauuugguacauguggcugggcgcccgguaccucgaauucgaggcccucggguuccuaaaugaggaccacugguucucgagagagaacaguuacuccggcguggaaggggaggggcugcacaaacucggcuauaucuuaagagacauuagcacuauccccgggggcgcaauguacgcagacgacacggcagggugggacacgcgaaucacggaggacgacuuacacaacgaggaaaaaaucacccagcaaauggaccccgagcaccggcaguuagccaacgcaaucuucaagcugacguaucaaaacaaagugguuaaggugcagcgcccgacgccgacagggacggucauggacaucauauccagaaaagaccaacgcggcuccggucaaguaggcaccuacgggcugaacacguucaccaacauggaagcgcagcuaauccggcaaauggagggcgagggcgugcuaagcaaagcugaccuugaaaacccccaccucccagagaaaaagaucacacaauggcuggaaaccaaggggguagagcgccugaagcgaauggcuauaagcggcgacgacuguguggucaagccaauagaugaccgauucgcgaacgcccuucuggcccuaaacgauauggggaagguacggaaggacauaccgcaguggcagccuucgaaaggcuggcaugacuggcagcagguccccuucuguucgcaucacuuccacgagcucaucaugaaggauggucgcaaguuggugguaccuugccggccgcaggacgagcucauuggccgggcgcggauaucccagggggccggcuggagccuuagggaaacugccugccucggcaaggcguacgcccaaauguggucucucauguacuuccaccggcgggacuugaggcuggcauccaaugcuauauguucggccgugccggugcacuggguaccgacgaguagaacuaccuggucuauucacgcccaccaccaauggaugacgaccgagaacaugcuaacgguguggaaccgcguguggauagaagacaacccuuggauggaagacaagaccccggucacaacuugggagaaugugcccuaccucgguaagagagaagaccaguggugcggcucacugaucgggcugacaaguagagcgacuugggcacaaaacaucccgacugcuauucaacaagugcgguccuugaucggcaacgaggaauuccucgacuauaugcccagcaugaagagguuccguaaggaagaggaguccgagggcgccaucugguga

SEQ ID NO: 25796 - RNA, 9873 nt, Artificial Sequence
  derived and/or modified CDS sequence (opt11) from DENV-3__FJ882575__SS-prME
acaagccucugccucaugaugauccuuccggcgacccuggccuuucaccuuacaucgcgcgacggagagccgcggaugaucguggggaagaacgaacgcggcaagucccugcuguucaagacagccuccgggaucaacaugugcacccucauugccauggacuugggugagaugugugacgacaccgugaccuacaagugcccccacaucaccgagguggaaccggaggacaucgauugcuggugcaaucugacuagcacgugggugacguacgggacuuguaaucaagcuggagagcaccggcgcgauaagcgguccguggcacuagcgccccacguaggcauggggcuggacacucggacgcagacguggaugagcgcggagggcgccuggcggcaagucgagaagguggagaccugggcccugcggcacccgggguucaccauuuuagcgcuguucuuagcgcacuauaucggcaccucacucacgcagaaggugguaaucuucauccugcugaugcucgucaccccgagcaugaccaugcguugcguaggggugggcaaccgcgacuucgucgaaggcuuauccggggcgacauggguggacgugguccuggagcacggcgggugcgugacgaccauggcuaaaaacaagcccacccucgacaucgagcugcaaaagaccgaagccacucagcuggccacccuccguaaacugugcaucgagggcaagauuaccaacauuaccaccgacagccgcugccccacgcagggggaggcgguacuaccggaggaacaggaccagaauuacgucugcaagcacaccuauguggaucggggguggggcaacgguugcggacucuucgggaaggguucccuggugacuugcgcuaaguuccagugccuggagccaauugaaggcaaggucgugcaguaugagaaccucaaguauacggugaucauaacaguccacaccggggaucagcaucagguaggcaacgagacucagggggucacggccgagaucacgccacaggccucuacaaccgaggcaauccugcccgaguacgguacacugggucucgagugcuccccgcgcacgggccuggauuucaacgagaugauccugcucaccaugaagaacaaggcguggauggugcaccggcagugguucuuugaccugccccugccguggaccucaggcgccaccacggagaccccaacuuggaacagaaaggagcugcugguuaccuucaagaaugcccacgccaagaaacaggaggucguggugcuggggucccaggagggcgccaugcacacggcgcucacgggggccacagagauccagaacagcggcggaaccucuaucuucgcaggccaccugaagugccggcugaaaauggacaaguuggaguugaagggaaugagcuacgccauguguaccaacaccuucgucuuaaagaaggagguuuccgagacucagcacgggaccauccucauaaagguagaguacaagggcgaggacgccccgugcaagauacccuucagcacugaggacgggcaggguaaggcgcacaacgggcgccugauaaccgcuaaccccgucgugaccaagaaggaggagcccgucaacaucgaggccgagccgccguucggggaaagcaacaucgucaucggcauuggagacaacgcauuaaagaucaacugguacaagaagggauccagcaucgggaagauguucgaagcgaccgcccggggcgccaggagaauggcgauacugggcgauacugcgugggacuucgggagcgugggggggauccucaacagccugggaaagauggugcaucagaucuucggguccgcguacaccgcccuguucagcggcgucucguggguuaugaaaaucggcauuggggugcuccucacguggauuggccugaacagcaagaacaccagcaugagcuucaguugcaucgccaucgggaucaucacguuguaccugggagcagucgugcaggccgauauggggugcgugauuaauuggaaaggcaaggagcuuaagugcggcagcgggaucuucgucaccaacgaggugcauaccuggacagaacaguacaaauuccaggcagacuccccaaagcgccucgccacggccaucgcuggcgcuugggagaauggggugugcggcauccguucaaccacucggauggagaaccugcuauggaagcaaaucgcgaacgaacucaacuacauucugugggagaacaacaucaagcugacugucgugguaggggauacgaucggcgugcucgagcagggaaagcgcacccugacuccacaaccuauggaguugaaguacagcuggaagacgugggggaaggccaagaucgugacggcugagacacagaacagcuccuucaucaucgacggccccaacacucccgagugccccagcgccucccgggcguggaacgugugggagguggaggacuacggguucggcguguucacaacaaacaucuggcugaaguuacgcgaggucuacacgcagcugugugaccaucgguuaaugucagcagccgucaaggaugagcgcgccgugcacgccgacaugggcuauuggaucgagucucagaagaaugggaguuggaagcuggagaaagcuagccugaucgagguuaagaccugcaccuggccuaaaucccacacccucuggagcaauggcguccuugaauccgacaugaucaucccgaagagccuagccggacccauuucccagcacaauuacaggccgggcuaccacacgcagaccgccgggcccuggcaccuaggcaaacuggagcuggauuucaacuacugcgagggcaccaccguggugaucacggagaacugcgggacccgcggccccagccuccggaccaccacggucuccgggaaacugauccacgaguggugcugccgguccugcacccugcccccgcuccgguacaugggcgaggacgggugcugguacggcauggagauucgccccaucagugagaaggaagaaaauauggucaagagccugguguccgccggcuccggcaaggucgacaacuuuacaaugggcgugcugugccucgccauccuguucgaggaggugaugcgggggaaguucggcaaaaagcacaugaucgccggugucuucuucacguucgugcugcuccuguccggccaaaucacguggcgcgacauggcucauaccuugauaaugauugguucuaacgccuccgaccgaauggggaugggagugacauaccucgccuuaaucgccaccuuuaaaauccaacccuuccuggcguuaggguucuuccuccgcaaauugacgagccgggagaaccucuuguuaggcguuggccucgcaauggccacuaccuugcagcugcccgaggacaucgaacagauggccaacgguaucgcucucgggcuuauggcucugaagcuaaucacacaauucgagacguaucagcuguggacggcccugaucagucuaaccugcuccaacaccauauucacguuaaccguugcuuggagaaccgcgacucugauccucgcgggagugucccugcugccggugugucaguccagcuccaugcggaagacggacuggcuccccaugaccguggccgccaugggggugccgccccucccgcuauucaucuucagcuuaaaggacacgcugaagcgccgguccuggccccuaaaugagggcgugauggccgugggacucgucagcauccuggccuccagccugcuccggaacgacguucccauggcaggccccuuaguggccggggggcuacucaucgccugcuaugucaucaccgggacgucugccgacuugaccguggagaaggcagcggacgugaccugggaggaagaggcagagcagaccggcgucagucacaaccuaaugaucacaguggaugacgaugggacuaugcgcaucaaggacgacgagacggagaacauucucacaguuuuacuaaaaaccgcccuccugauugucuccggcaucuucccguacagcauccccgccacgcugcucguguggcacaccuggcagaagcagacgcagcgguccggcguccugugggacguccccagcccgcccgaaacccaaaaggcggagcuagaagaaggaguguaccgcauuaagcagcagggaauccucgggaagacccaggugggggucggggugcagaaggaggguguuuuccacacgauguggcacgucacccgaggugcggugcucacacacaacggcaaacgccuggagcccaacugggccuccguaaagaaggacuugaucuccuacggaggagguuggcgguuauccgcccaauggcagaagggggaggaaguccagguuauagcaguggagccgggcaagaaccccaagaacuuucagacgaugcccggcaccuuccagaccacuacgggggagauaggcgcgaucgcccuggauuucaaaccgggaaccagcggcagcccuaucaucaaccgggagggcaaaguggugggucuauacggcaacgguguggucaccaaaaacggcggauacguguccggcaucgcccaaacuaacgccgagccggacggcccuacgccagagcucgaggaggaaauguuuaagaagcggaaccugaccaucauggaccugcaucccggguccggaaaaacccgcaaguaccucccggccaucguaagagaggcgaucaagcgccggcugagaaccuugauccucgcccccacgcgugucguggcggccgagauggaggaggcucuaaagggacuccccauccgcuaccagacaaccgcaaccaaguccgagcacacgggcagagagaucguggaccugaugugccacgccaccuucaccaugcgauuacugagccccguccgggugccgaacuacaaccucaucaucauggaugaggcccacuucaccgaccccgcuaguaucgcagcacgcggguacaucagcacgaggguggguaugggcgaggccgccgccaucuucaugaccgcgaccccgccugggaccgccgacgccuucccgcaguccaacgcccccauacaggacgaagagcgugacaucccggagaggagcuggaacaguggcaacgaauggaucacggacuucgcagguaagaccgucugguucgugcccagcaucaaggcgggcaacgacaucgccaauugucugcggaagaacgggaagaaggucauccagcugucccgcaagaccuucgacaccgaauaccaaaagacgaagcucaacgacugggacuucgucgucaccacugacaucagcgaaaugggagcaaacuuuaaggccgaccgaguuaucgacccgcgccggugccugaagcccgucauccugaccgacggccccgagcgcgugauccucgccgggcccaugccggugacagcggccuccgccgcgcagcggcgcggucgggucgggcgcaauccgcaaaaggagaaugaccaguacauauucacuggccagccccucaauaacgacgaggaccacgcccacuggaccgaggcgaagaugcugcucgacaacaucaacacuccagaggggaucaucccugcccuguucgagcccgagcgggagaaguccgcagcuaucgauggcgaguaucgccugaagggcgagucccggaagaccuucgucgaguuaaugcgucggggggaccugccggugugguuggcgcauaaaguggcgucagagggcauuaaguacacggaccgcaaguggugcuucgacgggcagcggaauaaccaaauacuugaggagaacauggacguggaaaucuggaccaaggagggcgagaagaaaaaacugcgcccacgguggcuggacgcccgcaccuacucggacccgcucgcccugaaggaguucaaggacuucgccgcggggcgcaagagcauagccuuggaccucgucaccgagauuggccgggugcccagccaccuggcccaucgcacgaggaaugcccuggacaaucucgugaugcugcacacuagcgagcacggcgggcgugcuuaucggcacgcuguugaggaguugcccgagaccauggaaacccuccugcugcucggccugaugauccugcucacggguggggccaugcuuuuccugaucagcggcaaaggcaucgguaagacauccaucgggcugauaugcgugauagcgagcagcgguaugcuguggauggcugagauaccgcugcaguggauagccagcgcaauagugcucgaguucuuuaugaugguucugcugaucccugagcccgagaaacagaggacgccacaggauaaccagcucgccuacguggugaucgggauacugacccuggccgcaaucaucgccgcgaaugagaugggccuccuggagacaacgaagcgggaccucggcauguccaaagagccagggguagugagccccacauccuaccucgacguggaccugcaccccgccuccgccuggacgcuguacgcaguugcuacuaccgugaucaccccgaugcucagacacaccaucgagaauuccacggcuaaugugagccuagcugcaaucgccaaccaggcggucgugcugaugggcuuagacaagggguggccgauuucgaagauggaucuuggcguaccccuucucgcucuggggugcuauagccagguaaacccccugacccucaccgccgccgugcuguugcucauuacgcacuacgccaucaucgggcccgggcugcaggcgaaggccacgcgggaggcccagaagcgcacagccgccgggaucaugaaaaacccaaccguggacggcaucaugaccaucgacuuggauccagucaucuacgacucuaaguucgagaagcagcucggccagguaaugcugcuggugcucugcgcggugcagcugcuuuugaugcggacgucuugggcucugugcgaggcucugacccucgccacuggccccauaacaacccugugggagggcucccccgggaaguucuggaacaccaccaucgcggugagcauggcuaauaucuuucguggcucguaccuagccggggccggccucgcguuuagcaucaugaaauccguggggaccggcaagcggggcaccggaagccaaggcgaaacgcugggggagaaguggaagaagaaacugaaccaacucagccgcaaggaauucgaccuguacaagaaguccgggaucacggaggucgaccggaccgaggcgaaggaggggcugaaacgcggcgagaucacccaccacgccgugagccggggcuccgccaagcuccagugguucguggagcgcaacaugguuaucccugaggggcggguuaucgacuuaggaugcgggcgcggcggguggagcuacuauugcgccggccuuaagaaggugaccgaaguccggggcuacaccaagggugggccggggcacgaggagcccguccccauguccacguacggcuggaacauagucaagcucaugagcggaaaggauguauuuuaucugccgcccgagaagugcgacacccugcugugcgacaucggcgaguccuccccuuccccaacgguggaggagagccggacaauuagaguccucaagauggucgagccuuggcugaaaaacaaccaguucugcaucaaggugcugaacccuuacaugccaacugugaucgagcaucucgaacggcugcaacgcaagcaugggggcaugcugguccggaaucccuugucacgcaacagcacccacgagauguacuggaucuccaacggcacagggaacauagugucaucggugaacauggucagccggcugcuccucaaccgcuucaccaugacucaccggcgcccgaccaucgaaaaggacguggaccugggcgccgggacgcggcacguggacgcggagcccgagacaccaaauauggacguuauaggggagcguaucaagcggaucaaggaagagcacaacuccaccuggcauuacgacgacgagaacccguauaagaccugggcauaccacgguagcuacgaggugaaggccacuggcuccgccagcagcaugaucaacggagucgucaagcuguugaccaagccuugggaugugguccccauggugacccagauggccaugaccgacacuacccccuuugggcagcagcgcguauucaaggaaaaggucgacaccagaaccccgcgccccaugcccggcacgcggaaggugaugggcaucaccgcggagugguuguggcgcacccuagggcggaacaagcgcccucgguugugcacaagggaggaguucacuaagaaggugcgcaccaaugccgccaugggagccgucuuuacagaggagaaccaaugggacucggcgaaagcggccguggaggacgaggaguuuuggaagcuaguggaccgggagcgugaacugcacaagcuggggaagugcggcagcugcguauauaacaugauggggaagcgggagaagaagcugggcgaguucggcaaggccaaaggcucccgcgccaucugguacauguggcuaggugcgcgguaccucgaguucgaggcccugggguucuugaacgaggaccauugguucagccgcgagaacuccuacagcggcguggagggugaggggcuccacaaacugggauacauccugcgcgacaucuccaagauaccagggggugcgauguaugccgacgacaccgccgggugggacacgcgcaucaccgaggacgaccuccacaacgaggagaagauaacccaacagauggaccccgagcaccgccagcuggcgaacgcaaucuuuaagcugaccuaccagaauaaagucgucaagguacagcgcccuacccccacuggaaccgucauggacaucaucagucggaaggaccagcgcggcucugggcaggucggcaccuacggccucaacaccuucacgaacauggaggcgcagcugguuagacaaauggagggagagggcguauuaagcaaggccgaccucgagaauccgcaccuccccgagaagaaaauuacccaguggcuagaaaccaaaggcgucgaacgccucaagagaauggcuaucaguggagacgacugcguggucaagcccauagaugaccguuucgcgaaugcgcugcuggcuuugaacgacaugggaaaaguccggaaagacaucccgcaguggcagccgucaaagggcuggcacgacuggcagcagguacccuucuguucccaucacuuccacgagcugaucaugaaggacgggcgcaagcuggugguccccugccggccccaggacgagcucaucggccgagcccggaucagccagggggccggcuggucccugagggagaccgcgugccugggcaaggccuacgcacagauguggagccuuauguauuuccaccggcgggaccugcgucuggccaguaacgcgaucugcagcgccgugccggugcauuggguccccacgucccggaccacaugguccauccacgcccaccaccaguggaugaccacggaggacaugcucacuguguggaaccgcguuuggaucgaggacaaucccuggauggaggacaaaacgcccgucaccacuugggagaacgucccguaccuggggaaacgggaagaccagugguguggcagucuuauagggcucaccucccgcgcgaccugggcacaaaauauccccaccgcgauccagcagguccgcagccugaucggcaacgaagaguuccucgacuacaugcccucgaugaagcgcuuucggaaggaggaggagagcgagggcgcaaucugguga

SEQ ID NO: 25797 - RNA, 9873 nt, Artificial Sequence
  derived and/or modified CDS sequence (opt11) from DENV-3__GQ199886__SS-prME
accagccucugccugaugaugaucuuacccgcagcccuggccuuucaccucacaagucgugacggggagccccggaugaucguggggaaaaacgagcgcggcaagagucugcuguucaaaaccgccucugggauuaacaugugcacccuaaucgccauggaccugggggagaugugcgacgauacggucacauacaagugcccccacaucaccgagguugagcccgaggacaucgacugcugguguaaccuuaccagcacuugggugaccuaugggacuugcaaccaggcaggcgagcaccggcgcgacaaacgguccgucgcccucgcgccccacgugggcaugggguuggauaccaggacccagaccuggaugagcgccgagggcgccuggcgccaggucgagaaggucgagacuugggcccugcgccaccccggguucacaauccuagcgcuguuccuggcccauuauaucggaaccucccucacccagaaggugguuaucuucauccugcugaugcucgucacgccauccaugacuaugcguugcguggguguggguaaccgagacuucgucgagggccuguccggggcaaccuggguggaugugguccuugagcacggugggugcgugaccacuauggcaaagaacaagccgacccucgacaucgaguuacagaagaccgaggccacucaguuagcgacgcucaggaagcuguguauagagggaaagaucaccaacaucaccaccgacagccgcugcccgacgcaaggcgaagcgguccugccggaggagcaggaccaaaacuacgugugcaagcacaccuauguggaucggggguggggcaacggcugcggccucuuugggaagggaucacuggugaccugugccaaguuccagugucuggagcccauugaggggaagguugugcaauacgagaaucucaaauacaccguuaucauaacaguucacaccggggaucagcaccaggugggcaacgagacucagggggucacagccgaaauuacgccccaggccagcaccaccgaggcaauccugcccgaguacggcacucugggccucgagugcaguccgcgaaccggccuggacuucaacgagaugauccuacuuacgaugaaaaacaaggcuuggauggugcaccgacagugguuuuucgaucugccccugcccuggacaagcggcgccaccaccgagacgccaacauggaaccgcaaggagcuacuggugaccuuuaaaaacgcucacgccaagaagcaggaggucgugguccuggggucgcaggagggcgcaaugcacaccgcccucacgggggcuaccgagauccagaacagcggaggaaccuccaucuucgccggacaccugaagugccggcugaagauggacaagcuugaauugaagggcaugagcuacgccaugugcacuaacacguucguacugaagaaggagguuagcgagacccaacaugggaccauucugauaaaaguugaguauaagggagaggacgucccuugcaagauccccuuuagcaccgaagacgggcaggguaaagcgcacaacggccgcuuaauuacggcaaauccggugguaaccaaaaaggaagaacccgugaacaucgaagccgagccgccuuucggagagagcaacaucgucauaggcaucggggacaacgcucuuaagaucaacugguacaagaaggguucgaguaucgggaagauguucgaggcgaccgcccggggcgcgcgccggauggcuauauuaggcgacaccgccugggacuucggguccgugggcggcguccucaacagccugggaaagauggugcaccagauauucggcucggcguacacggcccuauucucgggaguguccugggucaugaagauaggcaucgggguucuccuuacuuggaugggccucaacucgaaaaacacauccaugaguuuuuccugcauugcgaucgggauuaucacccucuaccucggcgccgucguccaggccgacaugggauguguuaucaacuggaagggcaaggagcuuaagugcggcagcgggaucuucgugacuaacgagguccauaccuggaccgagcaguacaaguuccaggcggacucacccaagcgccuugccaccgcuaucgccggggccugggaaaacgggguuugcggcauccguagcacgacccggauggagaaucugcucuggaagcagaucgcgaacgagcucaauuacauucuaugggagaacaauaucaagcugaccguggucgugggggauacaaucggcgugcucgagcagggcaagagaacacugacgccccagccgauggagcugaaguacagcuggaaaaccuggggcaaggcaaagauugucaccgccgagacgcagaacagcuccuucauuauagacggcccgaacacucccgaaugcccaagcgccucucgcgcguggaaugugugggaaguggaagauuauggguucggugucuucaccaccaacaucuggcucaaacugcgggaagucuauacccaacuuugcgaccaucggcugaugagugcugcgguuaaggacgagcgcgccguccacgccgauauggguuacuggaucgagagccagaaaaacggguccuggaagcuggaaaaggcgagccugauugaagugaagacgugcacauggccgaagucccacaccuuauggagcaacggggugcuggaaagcgacaugauuauccccaagucacuggcggggccgauuucccaacacaacuaccggccgggcuaccacacucaaacggccgggcccuggcaccuaggcaagcuugagcuugacuucaacuacugcgagggcacaaccgucguuaucaccgagaacugcgguacacgcggccccagccuccggaccaccaccguguccgguaagcugauccacgaguggugcugucgcaguugcacgcugcccccacuccgguacaugggggaggacggaugcugguacggcauggagauccggccaaucuccgagaaggaggaaaauaugguuaaaagccuagugagcgcuggcagcgguaagguggacaacuucaccauggguguccucugccucgcgauccuauucgaggaggugaugcggggaaaguucggaaaaaagcacaugaucgcugggguguucuuuaccuucguccugcuccugaguggccagaucaccuggcgcgacauggcccacacgcugauaaugauagguagcaacgccuccgaccguaugggaaugggcguaacuuaucucgcccugauugccaccuucaagauccaacccuuucucgcgcuuggguucuuccugcgcaagcugaccucucgggagaaccuccuacugggagugggucucgccauggccacgacgcugcagcugcccgaggauaucgaacagauggcuaacgggauagcucucggccugauggcacugaagcucaucacccaguucgagaccuaccaacuguggacugcccugaucagcuuaaccugcagcaacacuaucuucaccuuaacggucgccuggcguaccgccacauuaauccucgcgggagucagccugcugcccgucugccaaucaagcucaaugcguaagaccgacuggcuccccaugacgguggccgccaugggagugcccccccucccgcucuuuauuuuuagccugaaggacacccugaaacgcagguccuggccccugaaugagggggucauggccgugggucucgugagcauccuggccucgucucucuuacgaaacgacguucccauggcaggcccccuaguggccgggggacugcucaucgccugcuacgugaucaccgguaccuccgcagaccugacggucgagaaggcugccgacgugacuugggaggaggaagccgaacaaacugguguuagccacaaccugaugaucaccgucgacgacgacgggacgaugcgcauuaaggacgacgagacggagaauauccuaaccgugcuucugaagacugcccuacugaucgucuccggcaucuucccguauagcauccccgccaccuugcucguuuggcacacguggcaaaaacagacgcagagguccggcgugcugugggacguuccgagcccccccgaaacccagaaggccgaguuagaggaaggggucuaccgcaucaagcaacaggguauuuuugggaagacccagguggguguagggguccagaaggagggagucuuccacacgauguggcacguaacccggggggcuguguuaacguacaacggcaagcgccuggagcccaacugggccucugugaaaaaggaccugaucaguuacggggggggguggcggcucagugcucaguggcagaagggggaggaggugcagguuaucgccguggaaccuggcaagaaccccaagaacuuucaaacaaugccagggacauuccagacuaccaccggagagauuggcgcgaucgcgcuggacuucaaacccgggacuagcggcagccccaucaucaaucgcgaggguaagguggucgggcuguauggcaacgggguugugaccaagaauggcggcuacguaucaggcaucgcucaaaccaacgccgagccggacggcccaacuccugagcuggaggaagagauguuuaagaagcguaaccucacgaucauggaccugcacccgggaucaggcaagaccaggaaguaccugccggccauuguucgggaggcaauuaagcgccgacuccgaacccugaucuuggcccccacccggguugucgccgccgagauggaggaagcccuuaagggccuucccauucgcuaccaaacgaccgcaaccaagucagaacauaccggcagagaaaucguggaccugaugugccaugcaaccuucaccaugcgccuccugagccccgugcgggucccgaacuacaaccucaucauaauggacgaagcgcacuucacggaccccgcgucgaucgccgcgcguggguacaucagcacccgugugggaaugggggaggccgccgccaucuucaugacugcuacgccgccuggcacugccgacgccuucccacaauccaacgcgcccauccaagacgaagagaaagauauacccgagcgcucuuggaacuccggcaacgaauggauuacggacuucgcggggaagacggugugguucguacccagcauaaaggcgggcaacgauauagcgaauugccuccgcaagaacgggaaaaaggugauccagcuaagccguaaaaccuucgacaccgaguaucagaagaccaagcugaacgacugggacuucgugguaacgaccgacauuagcgagaugggagccaacuucaaggccgaccgcgugaucgacccgcggcgcugucucaagccggugauccugacugacggccccgaaaggguaauccuggcggggcccaugccggugaccgcggccucggcggcccagcgccgaggccgugugggacggaauccccaaaaggagaacgaucaauacaucuucaccggccaaccccucaacaacgacgaggaccacgcccacuggacggaggccaagauguuacuggacaacauuaacacccccgaaggcaucauuccggcgcuguucgagccagaacgggagaaauccgcagcaauagacggcgaguaccggcugaagggcgaguccagaaaaaccuucguggagcugaugagacgaggggacuuacccguuuggcuggcacacaagguagccagcgaagguaucaaguauacugaucgaaaguggugcuucgacgggcagcgcaacaaccagauccucgaggagaacauggaugucgagaucuggacgaaggagggcgagaagaagaagcuacggccccgcuggcuggacgcccggaccuacucggacccgcuggcccucaaggaauucaaggacuuugcugcgggcaggaagaguaucgcgcucgaucuggucaccgaaaucgggcguguuccgucgcaccuugcccacagaacccgcaacgcccucgacaaucuggugaugcuccacacgucagagcauggcgggcgagccuaccggcaugcgguggaggagcugcccgagacgauggagacccugcuucugcugggccuaaugauccugcugacuggaggggcuaugcuguuccugaucucgggcaagggaaucggcaagacguccaucggucugauaugcguaaucgcgagcucagguaugcucuggauggccgagauuccgcugcaguggaucgccagcgcgaucgugcuggaauucuucaugauggugcuccugaucccggagccagagaagcaaagaacgccacaagauaaucaguuggccuacguugugaucgggauccucacacuggcugccaucauagcagcgaacgagaugggucugcuagaaaccaccaaacgagaccugggcauguccaaggagccggggguggucagccccaccuccuaccuggacguggaccuccacccagccucggccuggacccuguaugccguggcgaccacuguuaucaccccaaugcuccggcacaccaucgagaacucaaccgcaaacgugucguuagcagccauagccaaccaggcgguggugcugaugggccuggacaaggguuggccuauuuccaagauggaccucggggucccucuguuagcccucgggugcuauucgcaggugaauccccuuacgcugacagcagcuguccucuuacugauaacccauuaugcgaucauuggcccgggcuugcaggcgaaggccacucgcgaggcccagaagcgaacggccgccggaaucaugaagaacccgacgguugacggcauaaugaccaucgacuuggaccccgugaucuaugacagcaaguucgaaaagcagcuggggcaggucaugcuccuaguauugugcgcagugcagcuucugcugaugcgcacuagcugggcucucugcgaggcacugacauuggcuaccggccccaucacgacgcugugggaaggcucccccggaaaguucuggaacacgacaauugcugucagcauggccaauaucuucagagguucuuacuuagcgggagcgggccuggccuuuagcauuaugaaguccguagggacagguaaacggggcaccgggagucagggggagacccuuggggagaaguggaaaaagaaguuaaaccagcugagccggaaggaguucgaccucuacaagaagucaggcaucacggaaguugauaggaccgaagcgaaagaagggcugaaacguggggagaucacccaccacgccgucucccgcggcuccgcaaagcugcagugguucguugagcggaauauggugaucccugaagggcgagucauagaccucggaugugggagaggaggguggagcuacuauugcgccggccugaaaaaggucaccgaggugcguggcuacaccaagggcgggcccgggcaugaagagccuguccccauguccacuuacggcuggaacaucgugaaacuuaugagcgggaaagacguguuuuaccucccacccgagaagugcgacacgcugcugugcgacaucggcgaauccucaccgucccccaccgucgaggagucgcggacaauacgcgugcugaaaauggucgagccauggcucaaaaacaaccaguucugcaucaagguccugaaccccuacaugcccacugugaucgagcaccuggagcgccuccagcggaagcaugguggaaugcuggugcgcaacccccugucucggaacagcacgcacgagauguacuggaucaguaacggcaccgggaacaucgucgccucagugaacauggugucccgguuacugcucaaucgguuuacaaugacccaccgccggccgacgaucgagaaggacgucgaccucggcgcgggcacccgccacgugaacgcagaaccggagacgccgaauauggacgugaucggggagcggaucaagcgcaucaaggaggagcacaacagcacauggcacuaugacgacgagaacccguauaagacuugggcguaccacggcucguaugagguaaaggcuacggggagcgccagcagcaugauuaacggcguggugaagcuacugacgaagcccugggaugugguucccauggucacccagauggcgaugaccgacacaacaccauucggccagcagaggguguuuaaggagaagguugacacccgcacuccacggagcaugcccgguaccaggcgugucaugggcaucaccgccgaaugguuauggaggacccugggacgaaacaagaaaccccgacugugcacccgcgaggaauucaccaagaaggugcgaacaaaugccgccaugggcgcgguguucaccgaagagaaccaaugggacucggccaaggccgccgucgaggacgaggacuucuggaaacuuguugacagagagcgcgagcugcacaagcugggaaagugcggcagcugcguguauaacaugauggggaagcgagagaagaaacucggcgaauucggcaaggccaagggcucaagggcgauuugguacauguggcugggggcaagguaucuagaguucgaggcccucggguuuuugaacgaggaccauugguucucaagggagaacuccuacagcggcgucgagggggaaggccuacauaaacucggcuacauacugcgcgacaucagcaagauccccgggggcgccauguacgccgacgauacugcgggaugggacaccaggaucacagaggacgacuugcacaacgaagagaagaucacucagcagauggacccggaacaucgccaguuggccaacgcuaucuucaagcugacuuaccagaacaagguggugaagguucagagaccgacgccuaccggcaccguaauggacaucaucagccgaaaggaccagcggggcuccggccaagugggcaccuacggccugaauacuuucaccaacauggaggcccaauugaucaggcagauggagggcgaggggguccugucuaaggcagaccuggagaacccccaccucccggaaaaaaagaucacgcaguggcuggagacaaagggcgucgagcggcugaagcgcauggcgaucagcggagacgacugcgucgugaagcccaucgacgaucgguucgccaaugcccuccuggcccugaacgauauggguaagguacgcaaggacaucccccaguggcagccgaguaaagguuggcacgacuggcaacaagugccuuuuugcucccaccacuuccacgagcucaucaugaaggauggccggaagcuggucguaccgugcagaccucaggacgagcuuaucggacgggcucgaauaucucaaggggccggcuggucgcuccgggagaccgccugccuuggcaaggccuacgcccagauguggagccugauguauuuccaccgccgcgaucuccggcuggcgucuaaugccauuuguagcgcgguucccguucacuggguuccgaccucccgcacgaccuggagcauacaugcccaccaccaauggaugaccaccgaggauaugcuaacgguauggaaccgggucuggaucgaagacaauccuuggauggaggacaagacucccguuacgaccugggagaacgugcccuauuuagggaagcgggaagaccaauggugcggcagccugaucgggcugacuucccgggcaaccugggcgcagaacauccccaccgccauccagcaaguccgcucgcucauaggcaacgaagaguucuuggacuacaugccguccaugaagcgguuucgcaaggaggaggagagugagggggccaucugguag

SEQ ID NO: 25798 - RNA, 9873 nt, Artificial Sequence
  derived and/or modified CDS sequence (opt11) from DENV-3__FJ882576__SS-prME
acauccuuaugccucaugaugauacuacccgccgcccuggccuuucaccucacuagccgggauggcgaaccgcggaugauuguggggaagaacgagcgggguaagucacugcuguucaagacggccuccgggaucaacaugugcacgcucaucgccauggaccuuggagaaaugugugacgacacaguuacauacaaaugcccgcacaucaccgagguggaacccgaagacaucgacugcuggugcaacuuaaccucaaccugggugaccuacgguaccugcaaccaggccggcgagcaucggcgcgacaaacgguccgucgcccucgcgccucauguaggcauggggcuggacacgcgcacccagaccuggaugucugccgagggugccuggcgccaaguagaaaagguugagacgugggcccugaggcacccuggguucaccauccucgcccuguucuuagcccauuacauugggaccagccugacccagaagguaguaauauucauccugcugaugcucgucacucccucuauggccaugcggugcgugggagugggcaaccgcgacuuugucgagggccuuucgggggcuaccuggguagaugugguccuggaacauggcgggugcgugacuaccauggccaagaacaagccgacgcuugauaucgagcugcagaagacggaggccacccagcuggccacacuccgcaaauuaugcaucgagggcaagaucacgaauaucacaaccgauagccgcugccccacgcagggcgaggccguguuaccggaggaacaggaccagaacuaugugugcaagcacacauacgucgacaggggguggggcaacgggugcggccucuucgggaagggcucccuggucacgugugcgaaguuccagugccuagaacccaucgagggcaaggucguucaguacgaaaaccucaaguauacagugaucaucaccguacacacgggggaccaacaccagguaggcaacgaaacacaaggugucaccgccgaaauaacgccccaggcuagcacgaccgaggcuauauugccggaguauggcacucuggggcuggaguguucccccagaaccggccuggauuucaacgagaugauacugcucaccaugaagaacaaggccuggauggugcaccggcagugguucuucgacuuaccccugcccuggacgucuggcgccacgaccgaaaccccgacauggaaccggaaggagcuuuuagugaccuucaagaacgcgcacgcgaagaagcaggaggucgugguccugggaucucaggagggcgcuaugcacacugcccuuaccggggcgacggagauacaaaacagcggugggaccagcaucuucgccggccaccugaagugccggcugaagauggacaaacucgagcugaagggcaugagcuacgcgaugugcacuaacaccuucguucugaagaaggaggucuccgagacacagcacgggaccauacucaucaagguggaauacaagggagaggacgucccgugcaagauccccuucagcacagaggacgggcagggcaaggcccacaauggccgacugaucacagccaaucccguggugacgaagaaggaggaacccgucaacaucgaagccgagccacccuuuggggaaucaaacaucgugaucggcauaggggacaacgcuuugaagauaaacugguauaagaagggcuccagcaucggcaaaauguucgaggcaacggccaggggcgcgcgcagaauggccauccugggcgacacggcgugggacuucgggucggugggaggaguccucaacagcuuaggcaagauggugcaccagaucuucgguuccgccuacaccgcccuguucaguggaguuucgugggucaugaagaucggcaucgggguguuacugacguggaucggccugaacagcaagaacacgucaaugagcuucuccuguauugccauagggaucauaacccucuaccuuggcgccgugguccaggcggacauggguugcgucaucaacuggaagggaaaggagcuuaaauguggcagcggcaucuucgugacgaacgagguccacacauggaccgagcaauacaaauuccaggccgacucaccgaagagguuggcgacagcaaucgcuggcgcgugggagaauggagugugcgggauccgcagcaccacgcggauggagaaccugcuguggaagcaaaucgccaaugaguuaaauuacauccugugggaaaacaacaucaaacugaccgugguggugggagacaucaucggggugcucgagcaagggaagaggacccugacgccccaaccgauggaguuaaaguacucauggaagacaugggggaaagccaaaauagugaccgccgaaacccaaaauucgagcuucauaaucgacggccccaacacccccgaaugucccagcgcgucccgggccuggaacguaugggagguggaggacuaugguuucggcgucuucaccaccaacaucuggcugaagcugcgcgagguguauacccagcugugugaccaccgguugaugagcgccgccgugaaggacgagcgcgccgugcacgcagacaugggcuacuggaucgagucucagaagaacgggaguuggaaacuggagaaggccagccugaucgaggugaagacaugcaccuggccaaagucgcacacgcuuuggagcaacggcgugcuggagucagacaugauaauccccaagagccuggcugguccuauaagucagcacaauuaccggccgggcuaccacacccagacagccgggcccuggcaccucggcaagcuggagcuggacuucaacuacugcgaaggcaccacgguugugaucaccgagaacugcgggacacguggcccuagccuacggacuaccaccguuuccgggaagcugauccacgaguggugcugucgcagcugcacccugcccccucuccgguacaugggcgaggacgguuguugguaugguauggagauacgccccaucuccgagaaggaggagaacauggucaagagccugguguccgccggcagugggaaaguggauaacuucaccauggguguccugugcuuggccauccuguucgaggaggugaugcgggggaaguucgggaagaagcauaugaucgcuggggucuuuuucacguuuguccugcuccuuuccggccagauuaccuggagggacauggcccacacccuaaucaugaucggcucuaacgccucagaccgcauggguaugggcguaaccuaucuggcccugauugcgacauucaaaauccagccauuccuggcccucggcuucuucuuacgcaaauugacaagccgggagaaccuccuguuaggcgugggccucgccauggcaacuacucuacagcugccugaggacauugagcagauggcgaauggaaucgcccuuggccugauggcccuuaagcucauuacgcaguucgagaccuaucaguuguggacugcccuaaucagcuugacuugcuccaacacgaucuuuacgcuaaccgucgcuuggcggaccgcgacgcugauacuggcaggggugagccuucugccggucugccaguccagcucaaugcggaagaccgauuggcuccccaugacuguggccgccaugggagugccgcccuugccguuauucaucuucagucucaaggacacccugaaacggcgcuccuggccccugaacgaaggggucauggccgugggacucguuaguauucuggcguccucccugcuccggaacgacguccccauggccggaccccugguugccgguggccugcucaucgccugcuaugugauaacggggacaucagccgaccuuaccgucgagaaagcggcggacgugaccugggaggaggaggccgagcaaaccggcgugucccacaaccugaugaucaccgucgacgacgacgggaccaugcgaauaaaggacgacgagaccgagaacauacucaccguacugcucaagacggccuugcugaucguguccggcaucuucccauacagcaucccagcuacacuguuggucuggcauaccuggcagaaacagacgcagcggucuggcguguuaugggacgugcccagcccgccugagacgcaaaaggcggagcuugaggagggggucuaccguaucaagcagcagggcauauucgggaagacccaagugggcgugggaguccagaaggagggcguguuccacaccauguggcacgugaccaggggcgccguacuggcauacaacgggaagcgccucgagccuaacugggccagcgugaagaaggaccugauaagcuacggcgggggcuggcgacucucggcacaguggcagaagggggaggagguucaagucaucgccguggagcccgggaaaaaccccaagaauuuucaaaccaugcccggaaccuuccagaccaccacgggggagaucggcgccauagcucuagauuuuaagcccgggaccucuggcucuccuaucaucaaccgcgaaggcaagguggugggacuguacggcaacgguguggugaccaaaaacggcggauacgucuccggcauugcccagacaaaugcggagccggacggccccacgcccgaacuggaggaggaaauguucaagaagcggaaccucaccaucauggacuuacauccugggagcgguaagacgcgcaaguaucugcccgcaaucgugcgggaggccaucaagcggcgccuccgcacacugauccuggcccccacgcggguggucgcugcggaaauggaggaggcccucaagggucugccaauacgcuaccagacgaccgccaccaaguccgaacacacgggccgggagauuguggacuugaugugccaugccaccuucaccaugcgcuuacugagcccugugagagucccuaacuauaaccugauuaucauggacgaggcccauuuuacggaucccgcguccaucgccgcccgcgguuacauuagcacgcgagugggcaugggcgaggcggcggcaaucuuuaugaccgccacgccgcccgggacugcagacgccuuuccgcaguccaaugcgccgauccaggacgaggagcgcgauauccccgagcgcucguggaacucgggcaaugaguggaucacagacuuugcggggaagaccgucugguucguccccucaaucaaggccgguaacgacaucgccaacugucuccggaagaacggcaagaagguuauccagcuuucuagaaagacauuugauaccgaguaucagaagacgaaacugaacgacugggacuucguugucaccaccgacaucuccgagaugggcgccaacuucaaggcggaucgggugaucgacccgcgccgaugccucaaacccgugauccugaccgacggacccgagcgcgucauccuggccgggcccaugccggugacugccgccagugccgcccagcggcgcggccggguagggcgaaacccccagaaagagaacgaccaguacaucuucaccggccagccccugaacaaugacgaggaccacgcccacuggaccgaggcgaagaugcugcuggacaacauuaauacucccgaggggaucaucccggcccuauucgagccugagagggaaaaguccgcggcgaucgauggcgaguacagacugaagggcgagagccggaaaaccuucguagagcugaugcgccgcggggauuuacccguguggcuugcccacaaggucgccagcgaggggaucaaguacacggaucgcaaaugguguuucgauggggagcggaacaaccagaucuuagaagagaacauggacguggaaauauggaccaaagagggugagaagaaaaagcuccgcccccgguggcuggacgcgcgcaccuacuccgauccccuagcucuaaaggaguuuaaagacuucgccgcgggccgcaagagcauagcccuggaccugguaaccgagaucgggcgaguuccgucccaccucgcgcaucgcacgcggaacgcucuugacaacuuggugaugcuccacacuagcgagcacggcgggcgcgccuaccgccacgccguggaggagcuacccgaaacaauggagacccugcuccugcugggacucaugauccuguuaaccggcggggccaugcuguuccucaucuccggcaaggggaucggaaagaccucuaucgggcuaaucugugucaucgcuagcagcggcaugcucuggauggcggagaucccacugcaguggaucgccagcgcuaucgugcuagaguucuuuaugauggugcuccugauccccgaacccgagaaacagcgcacaccacaggacaaucaacucgccuaugucgugaucgggauucuuacccuggcggcgaucaucgccgccaaugagaugggccugcucgagacuaccaagagagaccugggcauguccaaggaaccggggguugucagccccacuagcuaccuagacgucgaccuccaccccgccuccgcguggacccuguacgccgucgcaaccacugugaucacccccaugcugcgacacacgaucgagaacagcacggccaaugucucccucgccgcgaucgcuaaccaggccguggucuugaugggccuggacaagggauggccgaucuccaagauggacuugggcgugccccuacuggcccucggguguuacagccaggugaauccccugacccugacagccgcgguccuccuacugaucacccacuacgcuauaauaggacccggacuccaggccaaggcaacgcgggaggcccagaagcggaccgcggccgggauuaugaagaacccgaccguggacggcauuaugacuaucgaccuggaccccgugaucuacgacuccaaguucgagaagcagcuggggcaggucaugcuccuggugcuaugcgccguucaguuacuccugaugcggacgagcugggcccucugcgaggcacugacgcuggcuaccggcccgaucaccacacugugggaagggucccccgggaaguucuggaacaccaccauugccguaagcauggccaacaucuuccgugggucauaccuggcuggggcgggacucgcguucucgauaaugaaguccgugggaaccggcaaacggggcacggggagccagggcgagacccucggggagaaguggaagaagaagcucaaccagcuaagccgcaaggaguucgaucucuauaagaaguccggcauuaccgagguggaccggaccgaggccaaagagggucuuaagcguggagaaauuacccaccacgccguaagccgaggcuccgccaagcugcagugguucguagagcgcaacauggugauuccggaggggcgggucaucgaccugggcugcggucgcgguggguggagcuacuacugcgcgggccucaagaaggugacggagguucgggguuacacuaaagggggucccgggcacgaggagcccguccccauguccaccuacggcuggaacaucgugaaguugaugagcggaaaggacguuuucuaccugccgccugaaaagugugauacccugcugugcgacauuggugaguccucaccaucccccacgguagaggagagucgcaccauccgcgugcugaagaugguggagccguggcugaagaacaaucaguucuguaucaaaguauugaaccccuacaugcccacuguuaucgaacacuuagaacggcuccagcggaagcacggcgggaugcuggugcgcaacccccugucccguaacagcacccaugagauguauuggaucucaaacggcacgggcaacauagucagcuccgugaauauggucucgcggcuccugcugaaccgcuucaccaugacccaccggcguccuacgaucgagaaggacgucgaucucggcgccggcacgcggcacguuaaugccgagccugagaccccaaacauggacgugaucggggagcgcaucaagaggaucaaggaggagcauaacucaacuuggcacuacgacgacgaaaacccauacaaaacgugggccuaucacggcagcuaugaggucaaggccacgggaagugccuccagcaugaucaacggcguggucaagcugcugaccaaaccaugggaugucgugcccaugguaacucaaauggccaugacugauacgacccccuucgggcagcagcgcguguucaaggaaaagguggacacacggacaccuagauccaugcccggcacaagacgcguuauggguauaaccgccgaguggcuuuggcggacccugggccgcaacaagaagccccgguugugcaccagagaggaguucacuaagaaagugcguaccaaugcggcgaugggcgccguguucacugaggagaaccagugggauagugccaaggccgccguagaggaugaggauuucuggaagcucguggaccgggagagggagcugcauaagcuggggaaaugcggguccuguguguacaauaugauggggaagagagagaagaagcucggcgaguucggcaaggcgaagggaagcagagccaucugguacauguggcuaggggcccgguacuuagaguuugaggcgcuaggguuucucaaugaggaucauugguucuccagagagaacagcuacuccggcguagagggggagggccugcacaagcucggcuacauuuugcgggacaucagcaagaucccaggaggggcgauguacgcggacgacaccgccgggugggacacgcgcauaacggaagacgaccuccacaacgaggagaaaauaacccagcagauggacccggagcaccgacagcucgccaacgcaaucuucaaauuaaccuaccagaacaaaguuguaaaaguccaaaggcccacgcccaccggcaccgugauggacaucauaucccggaaggaucagcgcggcagcggccaagugggaaccuacggccugaacacguuuacgaacauggaggcccagcucauccggcagauggagggagagggcguguuauccaaggcggacuuagagaauccccaccuccccgagaagaagaucacucaguggcuggagacaaaagguguagagcgcuugaagagaauggcuauaagcggggacgacugcguuguaaagccuauagacgaccguuucgccaacgccuuacuggcguuaaacgacauggguaaggugcggaaggacaucccccaguggcagcccuccaagggcuggcacgacuggcaacaaguccccuucuguagccaccacuuucacgagcugauuaugaaggacgggaggaagcugguggugcccuguagaccccaggacgagcugaucggccgcgcacggaucucgcagggagcuggcuggucguugagagagaccgcaugucuagggaaggcguacgcucagauguggucccugauguacuuucaccgucgggaccucagacuggcgagcaacgccaucugcagugccgucccgguccauugggugccgacgagccggaccaccuggagcauccacgcccaccaucaauggaugaccacggaggauaugcucacgguguggaacagagucuggauugaagacaaccccuggauggaggacaagacccccgugaccaccugggagaacgugcccuaccucgguaagcgagaagaccagugguguggcagucugauugggcuaacuagccgggcgacuugggcacagaauaucccaacagccauccagcagguccggucccucauugggaacgaggaguuucuggacuacaugcccagcaugaagcgcuuccggaaggaggaggaguccgagggggcaaucugguga

SEQ ID NO: 25799 - RNA, 9873 nt, Artificial Sequence
  derived and/or modified CDS sequence (opt11) from DENV-3__FJ850052__SS-prME
acgucgcucugccuaaugaugauacugccugccgcccuagcuuuccaucucaccagccgggacggcgagccgcggaugauuguggggaaaaacgaacggggcaaaucccugcuguucaaaaccgcuuccgguaucaacaugugcacccucaucgccauggaccugggcgagaugugcgaugauaccguuaccuauaaauguccgcacauuacugagguagagccagaagacaucgacugcuggugcaaccugaccucuacgugggugaccuacgggacgugcaaccaggcgggugaacaccggcgcgacaagcgguccguagcccucgcgccccacguaggcaugggguuggacacacgcacucaaaccuggaugagcgccgagggcgccuggcgccagguggagaagguggagacuugggcauugcgccacccggguuuuacgauccuggcgcuguuccuggcgcauuacaucggaaccuccuugacccagaagguggugaucuuuauucugcugaugcuggucacgcccucuaugaccaugcgaugcgugggugugggaaaucgugacuucgucgaaggccuguccggggccacguggguggacgugguacucgagcacggcgggugcgugacgacgauggcaaagaacaagccgacccuggacaucgagcuacagaagacggaggcaacccaacucgcgacgcugcgaaagcugugcauugagggcaagauuaccaacauuaccacugauagccggugccccacccagggugaggccacgcugccugaggaacaggaucagaauuacguauguaagcacacuuacguggaccguggguggggcaacggcugcggccucuucgggaaaggaagccuugugaccugcgccaaguuccagugccuggagccgaucgagggcaagguuguccaguacgagaaucucaaguacaccgugaucaucacggugcauaccggggaucagcaccaggucgggaacgagacccaggggguaacggccgaaaucacgccccaagcgagcacuacugaggcgauccugccggaguaugggacgcuggggcuggagugcuccccccgaacaggccuggauuucaacgagaugauccugcucaccaugaagaauaaggccuggaugguccaccgccagugguucuucgaucugcccuugcccuggaccucaggcgcuaccacagagacgcccaccuggaaccgcaaggagcuccucgugaccuucaagaacgcucacgccaagaagcaggaggugguggugcuggggucccaggagggggcuaugcauacggcgcucaccggggccacugagauccagaacaguggcggcaccuccaucuucgccggacaccugaagugcagacugaagauggacaagcucgagcugaaggggaugagcuacgcgaugugcacgaacacuuucgugcugaagaaggaggucuccgagacccagcaugggacaauccucaucaaggucgaauauaagggcgaggaugugccguguaagauccccuuuagcacggaagaugggcaggggaaggcgcacaacggccgccuaaucacagccaaccccgucguuaccaaaaaggaggaacccgugaacaucgaggccgaaccgcccuuuggugagagcaacaucgucaucggaaucggggacaacgccuugaaaaucaacugguacaaaaagggauccagcauugggaagauguucgaagcgacggcccggggagcucgccgcauggcgauccugggcgacacagccugggacuucggguccgugggcggggugcucaauucgcugggcaagaugguccaccaaaucuucgggucggcuuacaccgcgcuguucagcggcguuuccugggugaugaaaaucggcaucggcguccuccugaccuggauaggcuugaacagcaagaacaccuccaugucauuuucgugcaucgccaucggcauuaucacucucuaucuuggcgccguggugcaggccgacauggguugcguaaucaacuggaagggcaaagagcugaagugcggcucagggaucuucguuacaaacgaaguacacaccuggaccgagcaguacaaguuccaagcagacucccccaagcgccucgcaacagcgaucgccggcgcuugggagaauggggucugcggcaucaggagcacaacccggauggagaaccugcuguggaagcagauugccaacgagcucaacuacauucugugggagaauaacauaaagcugacggugguagucggggacauaaucggcgugcuggaacagggcaaacgcacgcuuacgccccagccgauggagcuaaaguacuccuggaagaccugggguaaggccaagauagugaccgccgagacacagaacaguuccuucaucauugacgggcccaauaccccagaaugccccucggugucccgggccuggaacgugugggaggucgaggacuauggguucggcguauuuaccacaaauauuuggcuuaagcuccgggagguguacacccagcugugcgaccaucgauugaugucagcggccgugaaggaugaaagagccguccaugccgacaugggguacuggaucgagagccaaaagaacggcuccuggaaacucgagaaggccagccucauagaggugaagaccugcacguggccaaagucccacacccuguggucaaacggcguacuggaguccgauaugaucauccccaagagccuggcggggcccauuucccaacauaaccaccggccgggauaucacacccagacugccgggcccuggcaccucgguaagcuggagcuggacuucaacuacugcgagggcaccaccgugguuaucaccgagaacugcgggacgagaggccccagccucaggaccaccaccgucuccggcaagcugauccacgaguggugcugcagaucuugcacucugcccccguugcgguacaugggugaggacgggugcugguacggcauggaaaucagacccaucucggagaaggaggagaacauggucaagagccuggucuccgcgggaagcgggaagguggacaacuucaccaugggcguccugugccuugccauccuguuugaggaaguuaugcgggggaaguucgguaagaagcauaugauagcaggugucuucuucaccuuuguccugcuccuguccggccagaucaccuggcgcgacauggcgcacacccugaucaugauaggcucuaacgccuccgaccggauggggauggggguuacguacuuggcccugauagcuacguucaagauucagccguuccuggcccucggguuuuuccugcgaaaacugaccuccagagagaaccucuuguugggaguaggacucgcuauggccacgacccugcagcugcccgaggauaucgagcagauggccaacgggaucgcguuagggcucauggcgcugaagcuaauuacgcaauucgagaccuaucagcuguggacggcacugauaagccugaccugcucgaacaccaucuucacgcugacgguugccuggcgaacagccaccuuaauccucgccggggugagccugcuaccggucugccaauccagcucuaugcgaaagacagauuggcuccccauggcgguugccgcgaugggcgugccgccucucccgcuguucaucuucgggcucaaggauacucugaagcgccgcaguuggccccugaacgagggagucauggcugugggccuagugucaauccucgcaagcucccuguuacggaaugacguccccauggcggguccacuuguggcaggcgguuuacuaauugccugcuacgugaucaccggcaccagcgccgauuuaaccgucgagaaggcugcggacauuacgugggaggaggaggcggagcagacaggggugucccacaaccugaugaucaccguugacgacgacggcaccaugcgaaucaaggaugacgaaaccgagaacauccucacgguccuucugaaaaccgcccuccugaucgugagcgggaucuucccguauaguauccccgcgacccugcucguguggcauaccuggcaaaaacagacccagcgaagcgggguccugugggauguccccagcccaccugagacccagaaggccgagcucgaggagggcguguaucgcaucaaacaacaagguaucuucggcaagacgcaggucggggucggggugcaaaaagaaggcguuuuccacaccauguggcaugugacgaggggggcugugcucaccuacaacgggaagcgccuggagcccaacugggccuccgucaagaaggaccuuauuucguacggggggggguggcggcuaagugcgcaauggcagaagggagaggaaguccaggucaucgccgucgagcccggcaagaaccccaagaacuuucaaaccaugcccgggaccuuccaaacgaccaccggcgagaucggugcgauagcccuggacuucaagcccgggaccucaggcaguccuaucaucaaccgcgagggaaaaguggugggccuuuacgggaacggcgucguaacuaagaacgggggcuacgugucgggcaucgcucagacuaacgcugaaccggauggaccuaccccagaacuggaagaggagauguucaaaaagcggaaccucaccauaauggaccuccauccagguuccgggaagacacgcaaguacuuaccggcaaucguccgggaggcuaucaagcgccgccuccgcacccugauacuugcccccacgcgggugguggcggcagagauggaggaggcccuuaagggccugcccauccgcuaccagaccacggcgaccaaaagcgagcacaccgggagggagauagucgacuuaaugugucaugcuaccuucacgaugcgccuccugucaccgguacgggugccgaauuauaaccugaucauuauggaugaagcgcacuuuaccgacccggccucaaucgccgcgcgcggcuauaucuccacacgggucggcaugggggaggccgccgccauauucaugaccgcgacgccgccgggcaccgccgacgccuucccccagucuaacgcccccauccaggacaaggagcgcgacauaccagaacgcuccuggaauagcgggaacgaguggauaaccgacuuugccggcaagaccgugugguucguucccuccaucaaagcgggaaacgacaucgcgaauugccuccggaagaacggcaagaaggucauccaguuaagccgcaagacguucgacaccgaguaucagaagacgaaauugaacgacugggacuucguagugaccacugacaucuccgagaugggcgcgaauuucaaggccgaccgggucaucgacccgcgcaggugccuaaagcccgugauccugaccgacggccccgagcgcgugauucuggcaggcccgaugccggucacggcggccagcgccgcccaacggcgcgggcggguugggcgcaacccccaaaaggagaacgaccaguacaucuucaccggucagccccucaauaacgacgaggaccacgcccacuggacugaggccaagaugcugcuugacaacaucaacacgcccgagggcauaauacccgcccucuuugagcccgagcgagagaagagugccgccaucgacggcgaauaccgccugaagggggaaagccgaaaaaccuucguggagcugaugcgaagaggcgaccucccaguuuggcuugcgcauaaaguggccuccgaggggauaaaguacacugacagaaaguggugcuucgacggccagcggaacaaccagauauuggaggagaacauggacguugagauauggaccaaggagggcgagaaaaagaagcuccgcccccgguggcuggacgcccgcacguacucggacccgcuggcccucaaggaguucaaggaauucgccgcagggaggaagaguaucgcccuggaccugguaacagaaauuggucgggugcccagccaccucgcccaucguacucggaacgcucuggacaaccuagucaugcuccauaccuccgagcaugggggcagagccuauaggcacgccguggaggaguugcccgagacgauggagacacugcuccugcuggggcuuaugaucuugcugaccgguggugccaugcuguuccugaucagugggaagggcaucgggaagaccucgaucggccuaaucugcgugaucgcuuccucugggaugcucuggauggccgagaucccccugcaguggaucgcgucugcgaucguucuggaguuuuuuaugaugguauuacugauccccgagccagagaagcagcgcacgccucaggacaaccagcuggccuacgucgugaucgguauacuaaccuuagccgcaaucauugccgcgaacgagaugggucuacucgagaccaccaagcgggaccuggggaugagcaaggaaccgggcguggugucccccacgagcuaccuggacgucgaccuccaccccgccuccgccuggaccuuguaugcgguggcuacaaccgugauaacgcccaugcugcgccacaccaucgagaacucaaccgccaauguaucccucgcggccaucgcaaaccaagcaguggugcugauggggcuggacaagggguggccuauuagcaagauggaucucggggucccucugcuggcacucggcugcuacucccaagucaauccccugacgcugacggccgccgugcuccugcugaucacccacuaugccauuauagggcccggccuacaagcgaaggccacacgggaggcacagaagaggaccgccgccggcaucaugaagaacccgacgguggacgguaucaugacaaucgaucuggaucccguuaucuacgacagcaaguucgaaaaacagcuggggcagguuaugcuucugguuuugugcgcagugcagcugcuucuuaugcggaccuccugggcacucugcgaggccuuaacccuggccacaggccccaucaccacccucugggagggaagccccggcaaguuuuggaacaccacgaucgcgguguccauggcgaauauuuuccgcgggagcuacuuggccggcgcugggcuggcauuuuccaucaugaaguccgucggcacgggaaagagggguaccggcagccagggggagacacucggcgagaaguggaagaagaagcugaaucagcugucacgcaaggacuucgaccucuacaagaaguccggcauaaccgaggucgaucguacggaggcgaaggagggccuuaagcggggugaaauaacccaccacgccgugucccgggggucggccaaguugcaaugguuuguggagcguaauaugguaaucccggagggccgaguuaucgaucucgggugcggccguggcggcuggucauauuacugugccggcuugaagaaggugacggaggugcggggguacaccaagggcgggccuggucacgaagagccaguccccaugagcaccuacggguggaacaucgucaaguuaauguccgggaaggacguguucuaccucccgcccgagaagugugacaccuugcugugcgauaucggcgaguccucccccagccccaccguugaggagucccgcaccaucaggguccugaagaugguagaaccguggcucaagaacaaccaguucugcaucaagguccugaaccccuacaugcccacgguaaucgagcaccuggagcggcuucaacgaaaacacgguggcauguugguacggaacccucugucccgcaacuccacccacgagauguauuggaucagcaacggcaccggaaacaucguggccucuguaaacauggugagccggcuccugcugaaucgcuuuaccaugacgcaucgccggccaaccaucgagaaggacguagaccuaggagcugggaccaggcacgucaacgccgaaccggagacccccaauauggaugugauaggcgagcgcaucaagaggaucaaagaggagcacaauuccacguggcauuaugacgacgagaacccguauaaaacuugggccuaccacgggagcuacgagguuaaagccaccggauccgcuagcuccaugaucaauggggucgugaagcugcugaccaagccuugggaugucgugccuaugguaacacagauggccaugaccgacaccacccccuucggccagcaacgugucuucaaggagaagguggacacgcggaccccgcgcaguaugcccggaacucgccgcgugauggggauuaccgccgaauggcucuggcggacgcucggccgaaacaagaagccccgccugugcacacgcgaggaguucaccaagaagguccgcacaaacgccgccaugggggcaguguucacggaggaaaaccagugggacagcgccaaggccgccguggaagacgaggauuucuggaaguuggucgaccgggagcgugagcuccauaagcugggcaagugcgggaguugcguguacaacaugauggguaagcgggaaaagaagcuaggcgaguucgggaaggcaaagggcagccgagcgaucugguacauguggcugggggcccgguaucuggaguucgaagcccucggcuuccugaaugaagaccacugguucucccgcgagaacucuuauuccgggguagagggugaaggcuugcacaaacucggguacauucucagggacauaagcaaaauccccggcggggcuauguaugccgacgacaccgcaggaugggacacgcgcauuacugaggacgaccugcauaaugaggagaagaucacgcagcagauggacccagagcaccggcagcucgcgaaugccaucuucaagcugaccuaccaaaauaagguuguaaaagugcaacgccccaccccaaccgggaccgucauggacauuaucagccggaaggaccaacgggggagcggccaggugggcacguacgggcugaauaccuucaccaauauggaggcccaacuuauccggcagauggagggggagggcgugcugucuaaagcggaucuagagaacccccaccucccggagaaaaaaaucacccagugguuagaaacgaagggcgucgagcgccugaagcggauggcaaucagcggggacgacugcguggugaagcccaucgacgaucgcuucgccaacgcucuacuagcacugaacgauaugggcaagguuagaaaggacauuccacaguggcaacccuccaaaggguggcaugacuggcagcaggucccuuucuguagccaccauuuucacgagcucaucaugaaagacggccgcaagcuggucgucccgugccggccccaagaugagcuaauagggagggccaggauaucccagggggcgggauggagccucaaggagaccgcuugccugggaaaggccuacgcacagauguggucacucauguacuuccaccggcgcgaccuccggcuggcgaguaaugccaucugcuccgccgugcccgugcacugggucccuacuagccgcaccacgugguccauucacgcccaccaccaguggaugaccaccgaggauaugcugacgguguggaaccgcguguggaucgaagacaaucccuggauggaggacaagacgcccgucacaacuugggagaacguacccuaccucgguaagcgcgaagaccaauggugcgggagccuaauuggccugacuucucgggccacuugggcgcagaacauuccuaccgcgauccagcaaguacgcucccuuaucgggaacgaggaguuccuggacuacaugccgucaaugaagcgguuccguaaagaggaggagagcgagggcgccaucugguga

SEQ ID NO: 25800 - RNA, 9873 nt, Artificial Sequence
  derived and/or modified CDS sequence (opt11) from DENV-3__FJ873812__SS-prME
acuagccugugccucaugaugauucugcccgcagcacuggcuuuccaccucacgucccgggacggggagccccggaugaucgugggaaaaaacgagcgaggcaagucacugcuguucaagacagccagugggaucaacaugugcacucuuaucgccauggaccugggcgagaugugcgacgauaccgugaccuacaagugcccucacauuacggagguggagccugaggacaucgauugcuggugcaaccugacaagcacgugggugaccuacgggacaugcaaucaggccggugagcaccggagggacaaacgauccguggcucuggccccccacgugggaaugggauuagacacacguacucaaaccuggaugagugcggaaggggccuggcgacagguggagaagguggaaacuugggcccugcgccauccaggauucaccauccuagcgcuguucuuagcccauuacauaggcacguccuugacccagaaggucgucauuuucauccuucugaugcucgucaccccgagcaugacuaugcggugcguggggguggguaacagggacuucguagagggccuaagcggagcgaccuggguggacguaguuuuggagcauggcggaugcguuacgacgauggccaagaacaagccaacccucgacaucgagcuacagaagaccgaggccacucagcuugcaacacucaggaaguugugcaucgaggggaagaucaccaacaucacaacugacucacgcugccccacgcagggcgaagccacucuaccugaggagcaggaucaaaauuacgugugcaaacacacauaugucgaccggggauggggcaaugggugugguuuguucgggaaaggcucccuagugaccugcgcgaaguuccagugccuggagcccauagaagguaaggugguccaauacgagaaucucaaguauacggugaucaucaccgugcacacgggcgaccagcaccaggucggcaaugaaacccaggggguaaccgccgagauaacgccacaggcgucaaccaccgaggcgauccugcccgaauauggcacacugggguuagagugcuccccgcguacgggacuggacuucaacgagaugauccuacucaccaugaagaacaaagcguggaugguccaccggcagugguucuucgauuuaccuuuacccuggacgaguggcgcuaccacggagacccccacuuggaaccgcaaggaguugcuagucaccuucaaaaacgcgcacgccaaaaaacaggagguugucguguuagggucccaggagggugcgaugcacacggcccucaccggcgccacugagauccagaauagcggcgggaccuccauuuuugcgggccaucuuaagugucgacuaaagauggacaagcucgaguugaagggcaugagcuaugcaaugugcacuaacacauucgugcuaaagaaggaggucuccgaaacccagcaugggaccaucuuaaucaagguggaguacaaaggcgaggacguuccaugcaagaucccuuucagcacggaagacggacagggcaaggcgcacaacggucgccugaucaccgccaacccaguugugaccaagaaggaagagcccguaaacaucgaggccgagccacccuucggggagagcaacauugucaucggcauuggggacaaugcccugaagaucaauugguauaaaaaaggcuccucaaucgggaagauguucgaggcuacugcccggggcgcgcgcagaauggcgauccuuggcgacacggccugggauuuugguucagugggggguguucugaacagccugggcaagaugguacaucagaucuucggauccgcguacaccgcauuguucagcggagugucuugggugaugaagaucggaaucggugugcuccucaccuggauagguuuaaacagcaagaacacaucgaugucuuucaguugcaucgccaucggcaucaucacguuauacuugggggccguggugcaggccgacauggggugcguaaucaacuggaagggcaaagaacugaagugcgggagcgggaucuucgugacgaacgaggugcacacauggaccgaacaguauaaauuccaggcagacuccccgaagcgccucgccacggccauagcgggcgccugggagaacggaguaugcgguauccgcagcacgacacggauggaaaaccugcuuuggaagcagaucuccaacgagcucaacuauauacugugggagaacaacaucaagcugacaguugucgucggggacaucaucggcgugcuggagcaggggaagcgaacauuaacgccccagccgauggagcugaaguacagcuggaagaccugggggaaagccaaaaucgugacggcagagacccagaauuccucguucaucaucgacgguccaaacacucccgaaugcccaucagucagccgggcauggaauguuugggaaguggaggauuacggguucggaguuuucaccaccaacaucuggcucaaacugcgugaaguguacacucagcugugcgaucaccggcucaugucggccgcgguuaaggaugagagagccguccacgccgauaugggguacuggaucgagucucagaaaaaugggaguuggaaacucgagaaggccucacuaauagaggugaagaccuguaccuggcccaaaagccacaccuugugguccaacggugugcuggagucugacaugaucaucccaaaaucccuggcugggccgauuagccagcacaaucaccggccgggguaccacacccagacugcgggccccuggcacuuaggcaagcuggagcuggauuuuaacuacugcgaggggaccacggucguaaucacagagaacugcggcacgcgcggacccucccuucggacuacaacagucucggggaagcugauccaugagugguguugucgguccugcacccuacccccgcuccgguacaugggcgaagaugggugcugguacggcauggagaucagaccgaucagugaaaaggaagagaacauggucaagucccuuguguccgcaggcuccgggaagguggacaacuucacgauggguguccucugccucgccauauuguucgaagaggugaugagagggaaguucggcaagaagcacaugaucgccgggguguuucugaccuucguacucuugcugagcggacagaucacguggcgugauauggcccacacccucaucaugaucggcagcaacgcgagcgaucggaugggcaugggcguuaccuaccuggccuuaauagccacguucaagauccagccauuucucgcauugggguucuucuuacgcaaacucaccucgcgggagaaucugcuccuuggaguuggccuggcuauggcgacaacucugcagcugcccgaggacaucgagcaaauggccaacggaaucgcgcucgggcugauggcccucaagcucaucacacaauucgagaccuaccaacuguggaccgcguuaaucucccuaaccugcucuaacacaaucuucacccugacggucgccuggcgcacagccacgcuuauccucgccgggguaucccugcucccaguaugucagagcagcagcaugcgaaagacugauugguugccuauggcggucgcagcgaugggcguccccccgcugccacuguucaucuucuccuugaaggacacucuaaagcggcguaguuggccuuuaaacgaggggguuauggccgugggccuggucuccauccucgcaucaucccugcuucggaaugaugugcccauggccggccccuugguugccggagggcuccuaaucgccuguuacgugauuacggggaccuccgcugaccuuaccgucgagaaggccgcagacaucacuugggaggaggaggccgagcagacgggggucucccauaaucucaugaucacaguagaugacgaugggaccaugcgcauuaaggaugacgagaccgagaauauccugacgguccugcucaagaccgccuuacugauugugucagggauuuuucccuacaguaucccggcuacacuucucguguggcauacuuggcagaagcagacgcagcggucuggcguccugugggaugugccguccccgccugaaacccagaaggccgagcucgaggagggggucuaucgcaucaagcagcagggaaucuucgguaagacccagguaggaguagggguccaaaaggagggcguuuuccacaccauguggcacgugacccggggcgccguguuaaccuacaauggaaaacgacuggaaccuaacugggccagugucaagaaggaccucauuucauacggcggcggcuggcggcuguccgcccaauggcagaagggggaagaaguccaggugaucgccguagagccuggcaagaaccccaagaacuuucaaaccaugccgggcaccuuccagacaacaaccggggaaauaggggccaucgcgcucgauuucaagccagggacgagcgggucccccaucauaaaccgcgaggggaaagucgugggccuauacgggaacggggucgugacgaagaacggcggguaugugagcggcaucgcacaaacuaacgccgagccugauggaccaaccccugagcuugaagaggagauguuuaagaagagaaacuuaacaaucauggaccugcaccccgguucgggcaaaacucgcaaguaccuaccggccauagucagggaggccaucaagcgcaggcugcgcacauuaauccucgcgcccaccagggugguggcggccgagauggaggaagcuuuaaaggggcuuccaauccgcuaucagaccacggccaccaagagcgagcacaccggucgggagaucgucgaucucaugugccacgccaccuuuacaaugcgccugcuaagucccgugcgggugccaaacuacaaccucaucaucauggacgaagcucacuucacugacccugccuccaucgccgcacggggguauaucuccacccggguaggcaugggcgaggcggcagcgaucuuuaugacugccacgccgccagguaccgccgacgcguucccacaaagcaacgcacccauccaggacgaggagcgcgacauaccagagcguucauggaacagcggcaaugaguggaucacggacuucgcugggaagaccgugugguucgugcccucgauuaaagcuggcaacgacauugcgaauugccuccggaagaauggcaagaaagucauccagcugagcaggaagacguuugacaccgaguaccagaaaacgaaguugaacgacugggacuucguggugaccacagacauauccgagaugggggccaacuuuaaagcugaccggguaaucgacccgcgccgguguuuaaaacccgugauacugaccgauggcccugaacgcgugaucuuggccgggccgaugccggucaccgccgcgagcgccgcccagcggcgaggccgggugggccgcaacccccagaaggagaacgaccaguacaucuucaccggucagccucugaacaacgacgaggaccaugcccacuggaccgaggccaagaugcugcuggacaauauuaacacccccgaagguaucauuccggcgcuuuucgagcccgagcgugaaaaauccgcagccaucgauggcgaauacaggcuaaagggcgagucccggaagaccuucguagaacucaugcgccgcggugaccuccccgucuggcuggcccacaagguugcuuccgaagguaucaaguacacggacaggaagugguguuucgaugggcagcguaacaaucagauccucgaggaaaauauggacguagaaaucuggaccaaggagggcgagaagaagaagcugcguccccgguggcuagaugcccgcacauacucggacccacucgcccugaaggaguuuaaagaauucgcagccggccgcaaguccaucgcgcuggaccucguaacagagaucggccgggugcccucucacuuggcccaccggacuaggaaugcccuggacaaucucguaaugcugcacaccagcgaacauggcggacgcgccuacagacaugccgucgaggagcuccccgagacgauggagacgcuccuccugcucggucucaugauacuguugacaggaggcgccaugcuguucuuaauuucaggaaaagggaucggcaagaccagcauagggcucaucugugugaucgcuucgagugguaugcuuuggauggccgaaaucccgcuacaguggauugccucggccauuguacuggaguuuuuuaugauggugcuguuaauuccugagcccgagaagcaacgcacgccccaggacaaccagcucgcguacguggucaucgggauucugacccuggccgccaucaucgcagccaacgaaauggguuuacucgagaccacuaaacgggaccugggaauguccaaggagccgggaguaguaucgcccacgagcuaccucgacgucgaccugcaccccgcauccgcauggacccuguacgcgguggccaccaccgugauaacgccaauguugcgccacaccaucgagaauagcaccgcgaacguaucucuugcagccaucgcuaaccaggccguggugcugauggggcucgacaaggguuggccgaucucuaagauggaccugggcgucccacuccucgcuuuagggugcuacucccaagugaauccccuaacacuaacggcagcgguucugcugcucauuacgcacuaugcaauaauaggacccggacugcaggccaaagcgacccgggaggcacagaaacgcaccgccgcugguauaaugaagaauccaacggucgacggcaucaugaccauagaucuggacccaguaauauacgacagcaaauucgagaagcaguuaggucaggugaugcuucuuguccuaugcgccgugcagcugcugcucaugcggaccucuugggcgcugugcgaagcccucaccuuagcaaccggccccaucacgacgcugugggagggcagucccgggaaguucuggaauaccacgauagccguguccauggcgaacaucuuccgugguagcuaccuggccggcgccggccucgccuucuccauuaugaagagcguggggaccggcaagcgcgguaccgggagccaaggggaaacccuaggagagaaguggaagaaaaagcuaaaccaacucagccgcaaggacuucgaucuguacaagaaguccggcaucaccgagguggacagaacggaagccaaggaagggcugaaacgcggcgagauaacccaucacgcgguaucacggggaucagcuaagcuccagugguucguugagcgcaacaugguuaucccggaagggcgggugaucgaccucggcugugggcgaggcggaugguccuauuacugcgccggcuugaaaaaggucaccgaggugaggggcuacaccaagggggggcccgggcacgaggaaccugugcccaugagcaccuauggauggaacaucguaaagcucauguccgguaaggacguguucuaccucccucccgaaaagugcgauacucugcugugcgacauaggagagagcucccccucgcccacuguggaggagucacguaccauccgaguacucaagaugguggagccauggcuuaaaaacaaucaguucuguaucaaggucuugaaccccuacaugccaaccgucaucgagcaccucgaacggcugcaacgaaagcacggcgggaugcugguaagaaauccucucuccagaaauucgacccaugagauguauuggaucagcaacggcaccgggaacaucguggccucaguuaacauggugagccgguuacugcucaaucgcuucaccaugacccaucggcgcccuacuaucgaaaaggacguggaccugggcgcgggcacgcggcacgucaacgcggaacccgagaccccgaauauggacguaauaggcgagcguaucaagcggauaaaggaggagcacaacuccacguggcacuacgacgaugagaauccguauaagaccugggccuaccacgguagcuacgaggugaaggccaccggguccgcuucgucuaugauuaacggggucgugaagcugcucacgaagcccugggacgucgugcccauggugacucaaauggccaugaccgacacuaccccuuucgggcagcagcgcguauucaaggagaagguggacacgcgaaccccaagauccaugccgggaacccgacgcgugaugggcaucaccgcggagugguuauggcggacccugggacguaauaagaagccgcggcucugcacgcgcgaggaguuuacgaagaaggucagaacaaacgcugcuaugggcgccguguuuacggaagagaaucagugggacagcgccaaagccgccguggaagacgaggauuucuggaaauuggucgaccgcgaacgagagcugcacaaguuagggaagugcggcucaugcguguacaacaugauggggaaacgugagaaaaagcugggugaguucggcaaagcgaaagggagccgggccauaugguacauguggcugggggcgagguaccuugaguucgaggcacuaggguuccucaacgaggaucacugguucucacgcgaaaacagcuacagugguguggagggugagggccuccacaaguuaggcuauauccuucgagacaucucaaagauccccggaggcgccauguaugccgaugacacugcggggugggacacccgcaucaccgaagaugaucuccauaacgaggagaagaucacgcagcagauggacccggagcaccggcaauuagcgaacgcgaucuucaaacuuaccuaccagaacaaagucgugaaaguacaacgccccacaccaaccgguaccgucauggacaucauaagccgaaaggaucagcgcggcucaggccagguaggcacguacggccuuaacacguuuaccaauauggaagcccaacuuauucggcagauggagggugagggggugcucuccaaagccgaccuugagaacccccacuugccagagaagaagauaacccaguggcucgagacgaagggcgucgagcgccuaaagcggauggcuaucagcggggaugacugcguggugaaaccuaucgacgauagguucgcgaacgcccugcuggcccucaacgacauggguaaggugaggaaggauauuccucaguggcagcccucgaagggcuggcaugacuggcaacaagucccguucugcucucaucacuuccacgaguugaucaugaaggacgggcgcaagcugguggucccaugccggccccaggaugagcuaaucggacgugcucggaucucgcagggggcuggcuggagucugaaggagaccgccugccugggcaaggccuacgcccaaauguggucucucauguauuuccaucgcagagaccucaggcuggccagcaacgccaucugcuccgcagugcccgugcauuggguaccgacuagccgcaccacguggagcauucacgcccaccaccaauggaugaccaccgaagacaugcucacagucuggaaccguguguggauugaggacaaucccuggauggaggacaaaacgcccgugaccaccugggaaaacgugcccuaccuggggaagcgugaagaccagugguguggaucuuuaaucggucucacuagcagagccacaugggcccagaacauaccgacagcaauccaacagguccgcucgcuaaucggcaacgaagaauuccuggacuacaugccgagcaugaagcgguuccgaaaggaggaggagucagagggugcgaucugguag

SEQ ID NO: 25801 - RNA, 9873 nt, Artificial Sequence
  derived and/or modified CDS sequence (opt11) from DENV-3__FJ873813__SS-prME
accucccugugccugaugaugauccucccagcggcccuggcuuuucaccuaacaagccgggauggcgaaccccgaaugauugugggaaagaacgagcgaggcaaaagccugcuguucaaaacugccucagguauuaacauguguacccuaaucgcaauggaccuaggcgaaaugugcgacgauacugucacauacaaguguccccacauaaccgaaguagaaccagaggauaucgacugcuggugcaaccucaccucgacauggguaacguacggcacaugcaaccaggccggcgaacaccgucgagacaagagaucggucgcgcuagcaccccacgugggcaugggguuagacacaaggacucaaacauggaugagugcggaaggcgccuggcgucagguggagaaaguagaaacaugggcccuccggcacccaggguuuaccaucuuagcacuauuccuagcacacuauauugggaccuccuuaacgcaaaaggucguaauauucauacuucuaaugcuggucacccccuccaugaccaugcgcugcguuggagucggaaaccgggacuuuguugaaggccuaucgggagccacauggguagacgucguacucgagcacggaggcugcgugacgacaauggcgaaaaauaaaccgacucuggacauagaacuucaaaaaaccgaagcgacgcagcucgccacuuugcgcaagcuaugcauagaagggaagaucacgaacauaacuacggauucgcgguguccaacacaaggggaagcgacccuacccgaagagcaggaccagaauuacgucugcaaacacaccuacguggaccgaggauggggaaacggaugcggacuuuucggcaaaggaucccucguaacgugcgccaaauuccaaugccuugagccuauagaagggaaaguagugcaacacgagaaccugaaguacaccgugauaauaacgguccacacaggagaucaacaucaaguuggcaacgagacacaggguguaacggccgaaauuacgccgcaggcaucuacaacagaggcaauacugccagaguacggcacacuaggucuggagugcagcccgcguacagggcucgacuuuaacgaaaugauccugcucacgaugaagaacaaagcguggaugguucaccgacagugguucuucgauuuaccgcuaccuuggaccagcggagcgacaacagaaacaccgacauggaaccggaaagaacuccuuguaaccuucaaaaaugcccacgcaaaaaaacaagagguggucguacugggaucccaagagggcgcgaugcauacugcacuaaccggugcgacagaaauucagaacucgggaggaaccucaaucuucgcgggacaccugaagugccgacuuaaaauggacaagcuagagcuuaagggcaugucauaugcaaugugcaccaacacauucgugcuaaagaaagaagucucugaaacacagcauggaacgaucuugauaaagguagaguacaagggggaggacgucccauguaaaauaccauucagcacagaagauggucaaggcaaagcucacaacggcagacugaucacugccaaccccguggugacuaaaaaagaagaacccgucaauauagaagcggaaccacccuucggagagucuaacaucgucaucgggaucggggacaacgcccucaaaauaaacugguacaagaaaggcagcaguaucgggaaaauguuugaggccaccgcccgcggcgcacgucggauggcaauacugggcgacacagcaugggacuucggaagcgugggaggaguccugaacucccuagguaagaugguucaccagaucuucgggagcgcuuacaccgcacuauuuucagguguaagcugggucaugaaaauagggauaggaguacuccuuaccuggauagggcugaacaguaagaacacuuccaugaguuucaguugcaucgccaucggaaucaucacacucuaccucggagcagucguccaagcggacaugggauguguaauuaacuggaaagggaaagagcucaaaugcggcuccggaauuuuugucacuaacgaaguccacacauggaccgagcaauauaaauuccaggccgacagcccaaagcgacuugccacagcgauagccggagccugggaaaacggagugugcggaauacgcaguaccacacgaauggaaaaccuacuguggaaacaaauugcaaacgaacuaaacuacauacuaugggaaaauaacaucaaacuuacagucguaguaggagacauaauaggggugcucgaacaagggaaacguaccuuaacgccgcagccaauggaacuuaaauacuccuggaagaccuggggaaaagccaaaaucguaaccgcagaaacccaaaacaguagcuuuauaauugauggacccaacacacccgaaugccccucuguuagcagagcguggaacgugugggaaguagaggauuacggguucggcgucuucacaacgaauaucuggcuaaagcuccgggaagucuacacucaauuaugcgaccaccggcugauguccgccgcugugaaagacgaacgagcaguucacgcggacaugggcuacuggaucgaaucgcaaaagaacggcagcuggaaacucgaaaaagcgagcuuaaucgaaguaaaaacaugcacguggccaaagucacacacccucuggaguaacgguguacuugaaucagacaugaucaucccaaagaguuuagcgggacccaucucgcaacacaaccaccgcccgggcuaccacacacagacugcuggucccuggcaucuggggaagcucgagcuggacuucaacuauugcgaagguacaacggucgucauaaccgaaaacugcggaacaaggggcccaagucucagaaccacaaccgugagcggaaaacuaauacaugaauggugcugucgaaguugcacgcucccuccccugcgcuauaugggcgaagacgggugcugguacggaauggagauccgacccauaagcgagaaagaggaaaauaugguuaaaagucucgucagcgcaggauccggaaaggucgacaauuucacuaugggcgugcuaugccucgccauacuguucgaagagguaaugcgggggaaauucggcaagaagcauaugauagcugggguuuuuuuuacuuuuguacugcugcuaucugggcagauuacauggcgcgacauggcucacacacugauaaugauagggagcaacgcaagugaucgaauggguauggggguaaccuaucucgccuuaauugcaacguuuaaaauucaaccguuccuggcucuuggauucuuccuacgaaagcucacgucacgcgagaaccuacuccugggcguaggccuagcaauggcgacgacgcuccaacuccccgaggacauagagcaaauggccaacggaauugcucuuggacuaauggcccucaaguuaauuacccaauuugagacguaccagcuuuggaccgccuugaucucauugacuugcuccaauacaauauucacucugacaguagccuggcguacugcgacacucauucuagcaggagucagucuguuaccagucugccaaucaaguuccaugcgaaagacggauuggcuccccauggccguagcagcuaugggaguaccaccacucccgcuuuuuaucuucagccuaaaagacacccucaagagacgaucauggccauuaaaugagggaguaauggcaguugggcuggugagcauucuagcaagcagccugcugcggaacgacguacccauggcuggaccgcuggucgccggggggcuacucauagcgugcuacgucauaacaggaacgucagcggaucuaaccgucgagaaagcagcggacauaacaugggaagaagaggcggaacaaaccgguguaagccacaaccuaaugaucacuguggaugacgacggcacuaugaggaucaaagaugacgagaccgaaaacauacugacugugcuucuaaaaaccgcacuacuaaucgucagcgggaucuucccauacaguaucccggccacacuucuaguuuggcacaccuggcagaaacagacacagcgguccggaguccucugggauguuccuagcccgccggagacgcagaaagcggaacuugaggagggaguguaccgcauuaagcagcaggggaucuucggaaaaacacaagugggcguagggguacaaaaagagggcgucuuucauaccauguggcacguuaccagaggagccguacuaacuuauaacgguaaacgucuagaacccaacugggccagcgucaaaaaggaccucauaucguacggcggaggguggagacuuucagcucaauggcaaaagggggaggaaguccagguaauagcagucgagccgggcaagaauccuaagaacuuccaaacgaugccuggcacauuucagaccacaacaggcgaaauuggcgcuauagcgcuggauuucaaaccgggaaccagcgggaguccaaucaucaaccgggaggggaaagucgugggcuuguacgguaacggagugguaaccaaaaacggcggauacgucagcggcauagcacaaaccaacgcagaaccagacgggccgaccccggaacuagaagaggaaauguucaaaaagagaaaucucacuauaauggaccuccacccgggaucaggaaaaacccguaaguacuuaccagccauaguacgcgaggcgaucaagcguagacuacguacacuaauucucgcgcccacaagggucguggcagccgaaauggaagaggcgcugaaaggccuccccauccgauaccaaaccacagccaccaagucugaacacacaggccgagaaauaguagaccuuaugugucaugcgaccuuuacgaugcgccuacuaagcccaguccggguucccaacuauaaccuaauaaucauggacgaggcccacuucacagauccggcaaguaucgcugcacgcggguauauaagcaccagaguuggcaugggugaggcggcggcgauauuuaugacagcaaccccaccagguaccgcagaugcguuuccccaaagcaacgccccgauacaggacgaggaacgugacauccccgaacgcagcuggaacagcggcaacgaguggauaacugacuucgcgggaaagaccgucugguucgugccaagcauaaaggcugggaaugacauagccaauugucuaaggaagaacgggaagaaggucauacagcugucacgaaagaccuucgacaccgaauaccaaaagacuaagcuaaacgacugggacuucgugguaacuacagauauaucagagaugggggccaacuucaaagcggaccgcgucauagacccacgccgaugccugaaaccaguaauccucacagauggacccgagcgaguaauacuagcaggcccaaugccagucacagcagcguccgcggcgcaacggcgcgggcgcgugggccgaaacccacaaaaagaaaacgaucaauauauauucaccggucaaccacuaaauaaugacgaagaucacgcccacuggaccgaagcaaagaugcuccuagacaacauaaacaccccugaaggcaucaucccagcccuauucgaaccugaacgagagaaaagcgcugccauagacggggaguaucguuuaaaaggugaaagucgcaagaccuucgucgaacuaaugcgacggggagaucuccccguguggcucgcacacaaaguugcauccgaagggaucaaauauacagaccgcaaauggugcuuugaugggcaaagaaauaaucaaaucuuagaggaaaacauggacguagagauauggacaaaagagggagaaaagaagaagcuucgaccgcgcuggcuugaugcgagaacauacagcgaccccuuagcucucaaagaguucaaggaguucgcagccggcagaaagucaaucgcacuagaccuaguaaccgagauaggacgaguaccgagccaccucgcgcaucgcacgcguaacgcauuagauaaccucguaaugcuucacacaucggagcauggcggccgagcguaccggcacgcgguggaagaacuuccggaaacaauggaaacacugcugcuccugggacugaugauuuugcucacaggaggcgcuaugcucuuccugaucuccggaaaggggauaggaaagaccucaauaggacuaauuugugugauagccucaucuggcaugcuauggauggcagaaaucccccuacaauggauagccagcgcgauuguauuagaauucuuuaugaugguacugcugauaccagaacccgaaaagcagcgaacaccgcaagacaaucagcucgccuauguagucaucgggauucuaaccuuagccgcaauaauugcagccaaugaaaugggacuccuagagacgacaaaacgagaccuaggaaugagcaaggagccgggaguugucucaccgaccagcuacuuagacgucgaucuccacccagccagugcauggacucuauacgcagucgcaaccacaguaauaacgccaaugcucaggcacacuauagagaacagcaccgcaaaugucagccucgccgcuauagccaaucaggcagugguccuaaugggccuagacaaaggguggcccaucucaaagauggaucucggagucccccuccucgcacuuggcugcuauucccaagugaauccacuaacacugacagccgcaguccucuuacuaaucacccacuacgcaauuauaggaccuggacuccaagccaaagcgacgagagaggcgcaaaagcggacagcagcagguauaaugaaaaaccccacggucgacggcauaaugacaauagaccuggauccaguaauauacgauuccaaguuugagaagcaacuggggcaagugaugcuauuaguacuuugcgcggugcaauuacugcugaugcgcacgagcugggcacucugcgaagcccuuacacuggccaccggucccauaacaacguuaugggaagggucgccugggaaauucuggaauacgacgauagccguaucgauggccaacauauuccgcggaagcuaccucgcaggcgcgggccuggccuucuccauaaugaagucagugggaaccggcaaacgcggaaccggaagccaaggagaaacacucggggaaaaauggaagaaaaaacugaaccagcucagccggaaggacuucgaucuguacaaaaagagcggcaucacagaaguagauagaaccgaggcuaaggaagggcucaagaggggagaaauaacucaccacgccgucagccgcgguuccgccaaauugcaaugguucgucgaacggaacauggugauacccgagggacguguaauagaccuggggugcggccgaggaggcuggucauacuacugcgcggguuuaaagaaagucaccgaaguacguggauauaccaaggguggaccgggacacgaggagccgguuccgaugagcacguacggauggaacaucguaaagcugaugucaggaaaagacguauucuaccuccccccagagaaaugcgauacauuacuaugcgauaucggagaaucuucccccucgccaacuguagaggagucaaggaccauucguguccuaaagaugguggagccauggcuuaaaaacaaccaauuuugcauuaaaguauuaaacccauacaugccgacgguaaucgagcaccuagaacgacuacaacgaaaacacggcggaaugcucgugcgauacccacuaucgaggaauucaacacacgagauguacuggaucaguaacgguacagggaacauaguugcaagcgugaacaugguuucacgacugcuccucaaccgguucacaaugacacaccggagacccaccauagagaaagacgucgacuuaggagcgggcacgaggcacguaaacgccgaaccggaaaccccaaauauggacgugauaggggaacggauaaaacgaaucaaggaagagcacaacucaacauggcauuaugacgacgaaaaccccuacaaaacaugggcguaccacggcagcuacgaggucaaggcgacgggcucagccucgucuaugaucaauggcgucguaaaguuacuuacaaaaccaugggacguagugccgaugguaacucagauggcaaugacagacacgacuccuuucgggcaacaacgcguauucaaggaaaaggucgauacacgaacacccagauccaugccagggacgcggagggugaugggcaucacagccgaauggcucuggcggacccugggccguaacaagaagccgaggcucuguacacgggaggaauucacgaaaaaaguaagaaccaaugcugcgaugggggccguauucacggaagagaaccagugggauagcgcuaaggcggccgucgaagacgaagacuucuggaaguuagucgacagggagcgcgagcuacauaaacuagggaaaugcggaagcugcgucuacaacaugaugggaaagcgagagaagaagcucggagaguucggaaaagcaaagggauccagagccauaugguacauguggcugggggcaagguaucucgaguucgaggcccuagguuuccuaaacgaggaccacugguucucccgcgagaacucauacucuggaguagagggcgagggucuacacaaacugggauacauccuacgggacauauccaagauaccuggcggggcaauguacgcugaugacacagcugggugggacacaaggaucacagaggacgaucuucacaacgaggagaaaauaacucaacaaauggaccccgagcaucggcaguuagccaaugcaauauucaagcucacguaccaaaacaaggugguaaaaguccagcggccuacccccacagggacgguaauggacauuaucucacgcaaagaccaacgcggcuccggacaaguagggacuuaugggcugaauacguuuacaaauauggaagcacaacuuauacgccagauggaaggcgagggcguccuauccaaagccgacuuagagaacccgcaccuaccggaaaagaagauuacacaguggcuugaaacaaaaggagucgaaagacuaaaacgaauggcaauaucgggggacgauugcguaguuaagccuauagacgaccgguucgcuaacgcccuccuggcauugaacgacauggggaaagugcggaaagacauaccacaauggcaaccaucuaaaggguggcacgacuggcagcaggugcccuucugcagccaccacuuccacgagcuaaucaugaaggacggucgcaaacucgucguaccaugucgcccccaggacgagcucauaggacgagcgcgcauuucacaaggggcggguuggagccugaaggagacagcaugccucggaaaggcauacgcacaaauguggucacucauguacuuccacagaagggaucuacgauuagcgucaaacgcaaucugcucggcaguucccguucauugggugccgaccucacgcacaacauggucgauacacgcacaucaccaauggaugaccacugaggauaugcucacgguauggaacaggguguggauagaagacaacccguggauggaagacaagacccccgucacgacgugggagaauguaccauacuuaggcaaacgagaggaucaauggugcgggucacucauaggccugaccucacgagcuacgugggcacaaaacauuccuaccgcaauccaacaaguccggucgcuaaucgggaacgaggaauuuuuagacuacaugccuuccaugaagcgauucaggaaagaagaggagagcgaaggcgcaauaugguga

SEQ ID NO: 25802 - RNA, 9873 nt, Artificial Sequence
  derived and/or modified CDS sequence (opt11) from DENV-3__FJ850048__SS-prME
accagccucugccucaugaugauccugcccgccgcgcuggccuuccauuuaaccagccgagacggggagccccggaugaucguugggaagaacgagcgaggcaagucgcugcuguucaagacugcauccgggaucaacaugugcacucucaucgcgauggaccucggggagaugugcgacgacaccguuaccuauaagugcccccacaucaccgaaguggagcccgaggacaucgacugcuggugcaaccugaccagcaccuggguaacguauggaacgugcaaccaggccggcgagcaccggcgcgacaagcgguccguggcccucgcgccacacguggggaugggacuggacacccgcacccagaccuggaugagcgcggagggcgccuggcgccagguggagaagguggagacuugggcccugcggcacccgggauucaccauucucgcguuauucuuggcacauuacaucggcaccucgcucacccagaagguagugaucuucauccugcugaugcucguaacgccuaguaugacaaugcggugcguaggggugggaaaccgcgacuucgucgaaggccuguccggcgccaccuggguggacgugguccuggagcacggcgggugcgugaccacgauggccaagaacaagcccacccucgacaucgaacugcagaagaccgaggccacccagcuugcgacgcuccggaagcugugcaucgagggcaagaucaccaacauuaccaccgacagcagaugccccacucaaggcgaggccacccugccggaggagcaggaucagaacuacguaugcaagcacaccuacgucgacagaggguggggcaacggguguggccucuuugggaagggcucccugguaacgugcgccaaguuccagugccuggagcccaucgagggcaaggugguccaguacgagaaccucaaguacacggugaucauuaccgugcauaccggagaucagcaccaagucggcaacgagacccagggggugacggcugagaucacgccucaggcgagcaccacggaagcgauucugcccgaguacggcacucuggggcucgagugcuccccgcgaacgggucuggacuucaaugagaugaucuuacuaaccaugaagaauaaggccuggaugguccaccggcagugguucuucgaccugccccugcccuggacgagcggcgcaaccacggagaccccgaccuggaaucguaaggagcucuuagugaccuucaagaacgcccacgccaagaagcaggaggugguaguauuggggucccaggaaggcgcgaugcacacggcccuuaccggggccaccgagauccagaacucaggcgggacguccauuuucgcaggccaccugaaaugccgucugaagauggacaaacuugagcugaagggcaugagcuacgccaugugcacgaacacuuuugugcugaaaaaggaggucuccgagacacagcacgggaccauccucauaaaggucgaguauaagggcgaggaugugccaugcaagauccccuucagcacggaagacgggcagggcaaggcgcacaacggacgccugaucaccgccaacccagucgugaccaagaaggaggagcccgugaacaucgaggccgagccgcccuucggggagagcaauaucgucauugguaucggcgacaaugcccugaagaucaacugguacaagaagggcuccucaauugggaagauguucgaggcgaccgcgcggggcgcucgacggauggccauccugggcgacacggccugggacuucggguccgugggcgggguccucaacagccugggcaagaugguccaucagauuuucggguccgcguacaccgcacuguuuagcggcguguccugggugaugaagaucggcaucggggugcuccuaacauggaucggccugaacaguaagaacaccuccaugagcuucucguguaucgccauagguauaaucacgcucuaccuuggcgccgugguacaagccgacauggggugcgucauuaacuggaagggcaaggaacugaagugcggcagcggcaucuucgugaccaacgaagugcacaccuggaccgagcaguacaaguuccaagcggacucccccaagcgccucgccacggcuaucgccggcgcuugggagaauggggucuguggcauccgaagcaccacccggauggagaaccugcuguggaagcagaucgcuaacgagcucaacuacaucuugugggagaacaacaucaagcucaccgugguuguuggggacauuaucggcgugcucgagcagggcaaacggacgcugacgccccagccgauggagcugaaauacucauggaagaccugggggaaggcuaaaaucgucaccgccgagacgcagaacagcuccuucauaaucgacggccccaacacgcccgagugccccagcgucucccgagcauggaacgugugggagguggaggacuacggguuuggcgucuucacgacuaacaucuggcucaagcugcgcgagguguacacccaguuaugcgaccaccguuugaugagcgcggccgugaaggaugagcgcgccguccacgccgacaugggcuacuggaucgagagccagaagaacggauccuggaagcuggagaaggccagcuugauugaagugaagacgugcacauggccgaagucgcacacccucuggagcaacggcgugcuggaguccgacaugaucaucccuaagagcuuggcggggccgaucucccagcauaaccaccggccgggcuaucacacccagacggccggccccuggcaucucggcaagcuagaguuagacuucaacuauugcgaaggcacaaccgucgugaucaccgagaacugugggacgcgcggccccagccuccggaccacaaccguguccgggaaacugauccacgagugguguugucgcagcugcacgcuacccccgcuccguuacaugggcgaggacgguugcugguacggcauggaaauccgccccaucuccgagaaggaggaaaacaugguaaagagccugguguccgccggcagcgggaaggucgacaacuucaccaugggcguccucugccucgccauccuuuuugaggaggucaugcgggggaaguuuggcaagaagcacaugaucgccgggguguucuucacuuucguccugcuccugagcggccagauaaccuggcgcgacauggcgcacacacugaucaugaucggcagcaaugcuuccgauaggauggggaugggcguuacguacuuggcccugauugccaccuucaagauccaaccuuuccuggcccucggguuuuuccugcgcaagcugaccaguagggagaaccuacugcugggcgugggcuuggcuauggccacaacacugcagcugccagaggacaucgagcagauggcuaacggcaucgcucuuggccugauggcgcugaaacuuauaacccaguucgagaccuaccagcuguggacggcacugaucagccugaccuguuccaacaccaucuucacccuaacggucgccuggagaacugcuacccugauccucgccgggguuagccuacugccggucugucaguccucauccaugaggaaaaccgacuggcuccccauggcgguagccgcgaugggcgugccgccccuaccguuauucaucuucagccugaaggacacgcugaagcgccguuccuggccccugaacgagggggucauggccgugggccucgugagcauccuagcauccagccugcuccggaaugacguucccauggcggggccccugguugccgggggccuccucaucgcaugcuacgugaucaccgggaccuccgccgaccugaccgucgagaaagccgcggacaucacuugggaggaggaagcugagcagacaggcgugagccacaaccuaaugaucaccgucgacgacgaugggaccaugcgcaucaaagacgaugagacggagaacaucuuaacgguccugcugaagaccgcccuccugauuguguccgguauauucccguacagcauccccgccacacugcucguguggcauaccuggcagaaacaaacgcagcgguccggcguccugugggacgugcccagcccgccagagacccagaaagccgagcuagaggaggggguguaucgcaucaagcagcagggcaucuuugggaagacccaagucggaguuggggugcagaaggaaggcgucuuccacaccauguggcaugugaccagaggggcggugcucacauauaacgguaagcgcuuggagccaaauugggcguccgucaagaaggaccugaucucauacggcgggggcuggaggcugucagcacaguggcagaaaggggaggagguccaggugauagccguggagcccggcaagaaccccaaaaauuuccagaccaugcccggcaccuuccagacgaccaccggggagauuggcgcgaucgcccuggacuuuaagccugggaccaguggcagucccauuaucaaccgcgaaggaaagguggugggccuguacggcaacgggguggugacgaagaacggcggguacgugucaggcaucgcccagaccaacgccgagccggacggcccaaccccagagcuggaggaggagauguucaagaaaaggaaccucaccaucauggaccugcaccccgggagcggaaagacgcgcaaguaccugccggcuaucguccgggaggcaaucaagcgucggcuccgcacccugauucuggcuccuacacgggugguggccgcagagauggaggaggccuuaaagggguugcccauccguuaccagaccacggcgaccaaguccgagcacaccggccgggagauaguugacuuaaugugccacgccaccuucacgaugcgccuccugagccccgugcgggugccgaacuauaaccugauaauuauggacgaggcccacuucaccgacccggccucgauugccgcgcgcggguacauaagcacccgggucggcaugggcgaggccgccgcaaucuucaugacagcaacgccaccaggaacugcagacgccuucccgcagagcaaugcccccauccaggacgaggaacgcgacauacccgagcgcagcuggaacuccggcaacgaguggaucaccgauuucgccgggaagaccgugugguucgugcccagcaucaaggccggcaacgauaucgccaacugccuccggaagaacggaaagaaggucauucagcugucccgcaagacguuugacaccgaguaccagaagacuaagcugaaugauugggacuucgucgugaccacggacaucagcgaaaugggcgcuaacuucaaggcggaccgggucaucgacccgcgccgguguuugaagccgguuaucuuaaccgacggacccgagcgcgugauacuggccggucccaugccggucaccgcggccuccgccgcccagcgacgcggccgggugggucgcaauccucagaaggagaacgaucaauacaucuuuaccggccagccccucaacaacgacgaggaccacgcucacuggaccgaggcgaaaaugcugcuggacaacaucaacacucccgaggggauaaucccagcccucuuugagccggagagagagaaguccgccgcaaucgauggcgaguacagguuaaagggggagucccggaagacguucguggaguugaugcgccgcggggaccuuccggucuggcuagcgcacaagguggccagcgagggcauuaaguacaccgaccgcaaguggugcuucgacgggcagcggaauaaccaaauccuggaggagaacauggacgucgagaucuggaccaaggagggcgagaaaaagaagcuccgaccccgguggcucgacgccagaacguacagugacccgcuggcacucaaggaguuuaaggaguuugccgcgggccgcaagagcaucgcccuggaucuggugaccgagaucgggcgggugccaucccaccucgcccacaggacccggaacgccuuggacaaccuugugaugcuccacaccagcgagcacggcgggcgcgccuaccggcacgcgguggaagaacugcccgagacgauggagacucuguuguuacuggggcucaugauccuauugaccggaggggccaugcuguucuuaaucucaggcaaggggaucggcaagacauccaucggucugauaugcgugauugccagcucaggcauguuguggauggcugaaauccccuugcaguggaucgccagcgcaauuguccuggaguuuuucaugaugguucuccugauuccagagcccgagaagcagcguacaccccaggacaaccagcucgccuacgugguaaucgggauccucacgcuggccgccaucaucgccgcgaacgagaugggccugcucgagaccaccaagcgggaccucggcauguccaaagaaccggggguggucagccccacguccuaucuggacgucgaccuccacccagcgagcgccuggacccuguacgccguggcgaccaccgugaucacgcccauguuacgccacaccauagagaacuccaccgccaaugucagccuagccgccaucgcuaaccaagccguggugcugaugggccuggauaagggauggccgaucuccaaaauggaccucggggucccccugcuggcauuaggaugcuacagccaggugaacccucugacgcugacugccgccgugcuccugcugaucacccacuacgcaaucaucggcccgggccuccaggcgaaggccacccgggaggcccagaagcgcacggcugccgggaucaugaagaacccgaccguagacgggaucaugaccauugaccuggacccagugaucuaugacuccaaguucgaaaagcaguugggccaggugaugcuccugguccuaugcgcggugcaguugcugcugaugcggaccagcugggcccucugcgaggcccucacacuggccacagggccuaucaccacccucugggagggcuccccagggaaguucuggaacaccacgaucgcggugagcauggcgaacaucuuccgcggcagcuaccuggccggggccggucuggccuucucaauaaugaaauccguggggacuggaaagcgggguacugggagccaaggugagacccuuggagagaaguggaagaagaagcugaaccagcuaucccgcaaagauuuugaccuauacaagaagagugggaucacagaggucgaccggacggaggcgaaggagggucuuaagcgcggcgagaucacccaccacgcuguaagccggggcuccgcuaagcugcaaugguucgucgaacgcaacaugguuauaccggagggccgggugaucgaccucggcugcggacgcgguggguggagcuacuacugcgccggacugaagaaggucacggaggugcggggcuacaccaagggcgggcccgggcacgaggaacccgugcccauguccacguacggauggaacaucgucaagcugaugagcgggaaggacguguucuaccucccgcccgagaagugugacacccuguugugcgacaucggcgaguccagucccucacccaccguugaggaaagccgcaccauccgcguccugaagaugguggagccguggcucaagaacaaucaguucugcaucaaggugcugaaccccuacaugcccaccgucaucgaacaccuggagcgguuacagcgaaagcacggcgggaugcuugugcggaacccccugucacggaauagcacccacgagauguauuggaucagcaauggcaccgggaacaucguggcaagcgucaacaugguguccagacucuuacugaaccgcuucaccaugacucaccgcaggccgaccaucgagaaggacguggaccucggcgcgggcacccggcacgugaaugccgaacccgagaccccaaacauggauguuauaggcgaacgcauuaagcgcaucaaggaggagcauaauucgacguggcauuacgacgacgagaauccguacaagaccugggccuaccacggcuccuacgaagugaaggccaccgggagcgccuccagcaugaucaacgggguagugaaacuucugaccaagcccugggaugucgugcccauggugacgcagauggcgaugaccgacacgacgcccuuugggcaacagcgggucuucaaggaaaaagucgacacccggacuccacgcagcaugcccggcacccggcgcgugaugggcaucacagccgaauggcucuggcguacgcucgggcgcaacaagaaaccccggcuguguacccgcgaagaguucacuaagaaggucaggacaaacgccgccaugggcgcgguguucacggaggagaaccagugggacuccgccaaagccgccguggaggaugaggacuucuggaagcucgucgacagagagcgcgagcuucacaaguuagggaaauguggcucgugcguguacaacaugauggggaagcgggagaagaaguuaggcgaguucggcaaagcaaaaggaucgagggcuaucugguacauguggcucggugcccgguauuuggaguucgaggccuugggguuccucaacgaggaccacugguucucacgcgaaaauuccuacagcggcguggagggggaaggcuuacacaagcucggcuacauuuugcgggauaucuccaagauccccgggggcgccauguacgccgaugacaccgcggggugggacacaaggaucaccgaggaugaccugcacaaugaagagaagaucacacagcagauggaccccgagcaccggcagcucgcuaacgccaucuuuaagcugaccuaccagaacaagguagugaagguacagcgccccacgcccaccggcacagucauggacauaaucagccggaaggaccagcgaggauccggccaagugggcacguacgggcugaacacauucaccaacauggaagcccagcuuauccggcagauggagggggagggggugcugagcaaggccgaccuagagaacccccaccucccggagaagaaaaucacccaguggcuggaaacgaaaggggucgagcgccugaagcggauggcgauauccggcgacgauuguguggugaaaccgaucgaugaucgcuucgcaaaugcccuccuggcccuuaacgacauggggaagguccggaaagacaucccacaguggcagcccagcaagggcuggcacgauuggcagcagguccccuuuugcucccaccacuuccacgagcucaucaugaaggacggucgcaagcuggucguucccugccggccccaggacgaguuaaucggccgcgcccggauaagccaaggggcgggcuggucccucaaggagaccgccugcuuaggcaaggccuaugcgcagauguggucccugauguauuuccaccgccgcgaccuccguuuggcguccaacgcaaucuguucggccguacccgugcacuggguaccgacgucccgaaccacguggagcauccacgcccaccaccaguggaugaccaccgaggacaugcuaaccgucuggaaccguguuuggaucgaggacaacccguggauggaggacaaaacgcccgucaccaccugggagaacgugcccuaccuugggaaacgcgaagaccaguggugcggcagccugaucgggcuuaccucccgggcgacgugggcgcagaacauccccaccgccauccagcaggucagaagccucaucggcaacgaggaguuccuggacuacaugcccuccaugaaacgguuucgcaaggaggaagagagcgaaggugccaucugguga

SEQ ID NO: 25803 - RNA, 9873 nt, Artificial Sequence
  derived and/or modified CDS sequence (opt11) from DENV-3__FJ850049__SS-prME
acuagccucugccucaugaugaucuuacccgccgcccuggcguuucaucucaccagccgcgacggugagccccggaugaucguggggaagaacgagcggggcaagagccugcuauucaagaccgcaucugguauaaacaugugcacccugauugcaauggaccugggcgagaugugugacgacacugugacguacaaguguccccacaucacagagguggagcccgaggacaucgacuguuggugcaaccucaccagcaccugggugacauacgggacgugcaaccaggccggcgagcaucggcgcgacaagcgguccgucgcccucgcuccccacguuggcauggggcucgacacccgcacccagacuuggaugagcgccgagggugcuuggcgccagguggagaagguagagacgugggcccugcgucaccccggguucaccauccucgcguuauuccuggcacacuacaucggcaccucccuaacacagaagguagugaucuucauccugcugaugcucgucacuccaagcaugaccaugcguugcgugggggucggaaaucgcgacuucguugagggucuguccggggccacgugggucgacgugguccuugagcacggcggguguguaaccacgauggccaaaaauaagccuacccucgacaucgagcuccagaagaccgaagcaacccagcuggcuacgcuccggaagcugugcauagaggggaagaucacuaacauuaccacagacucccgcugccccacgcaaggcgaggcuacccugccggaggagcaggaucagaacuacgugugcaagcauaccuacguagaccggggguggggcaacgguuguggucucuucgggaagggcucccuggucaccugcgcgaaguuccaaugucuggagcccaucgagggcaagguuguccaacacgagaaccucaaguacacggugaucaucaccgugcacacaggggaccaacaucaggucggcaacgagacccagggggucacggccgagauaacgccccaagccagcaccaccgaggcgauccugcccgaauacggcacccuggggcucgaguguucaccgcgcacgggccucgacuucaacgagaugauccugcuuaccaugaagaacaaggccuggaugguccaccgacagugguuuuuugaucugccccuccccuggaccucuggcgccaccacggagacccccaccuggaacagaaaggagcuccucgugacauucaaaaaugcccacgcaaagaagcaggaggugguggugcuagggucccaggagggugccaugcauacugcucuaaccggagccaccgagauccagaacagcggcgggaccuccaucuucgccggccaccugaagugccgacuaaagauggacaaacucgagcugaaggguaugagcuacgccaugugcacuaacaccuucguucugaagaaggagguauccgaaacccagcacgggacaauccucaucaaggucgaguacaagggcgaggacgugccgugcaaaaucccauucagcacugaagacgggcaaggcaaggcccacaacggacgccugaucaccgcgaaccccguugucaccaaaaaggaggagcccgugaacauagaggccgaaccgccuuuuggugagagcaacaucgucaucggcauuggggacaaugcccugaagaucaacugguacaagaagggcucuaguaucgggaagauguucgaggcgaccgcccggggcgcccgccggauggccauucugggcgacacggccugggacuucgguuccgucggcgggguccucaacaguuuagggaaaaugguacaucaaaucuuuggguccgccuacaccgcacuguucagcggcguuagcugggugaugaaaaucgguauuggcguccuccucaccuggaucggccugaacucaaagaauaccaguauguccuucaguugcaucgccauagggaucaucacccucuaccugggcgccguugugcaggccgacauggggugcguaaucaacuggaagggcaaggagcugaagugcggcagcgggaucuucgugaccaaugaggugcacaccuggaccgagcaguacaaauuccaggcggacucccccaagcgccucgcgacggccaucgcuggcgcgugggaaaacggaguuugcggcauccguagcacuacgcggauggagaaccugcuguggaagcagaucgcgaacgagcucaacuacauccugugggaaaacaauaucaagcugaccguaguggucggcgacaucaucggcguucucgaacagggaaagaggacucugacaccgcaaccgauggagcugaaguacuccuggaagaccugggggaaggccaagaucgugaccgccgagacgcagaacagcuccuucauuaucgacggccccaacacccccgaaugccccagcgucagccgggccuggaaugugugggagguggaggacuacgguuucggcgucuucaccacgaauaucuggcucaagcugagagaaguguacacucagcugugcgaccaccggcucaugagcgcggcaguuaaggacgagcgcgccguccacgcggauaugggcuacuggaucgagagccaaaagaacggguccuggaagcuggaaaaagccagccugaucgaggugaaaacgugcaccuggccaaagucccacacccucugguccaacgguguguuagaguccgacaugauaauccccaagagcuuagcggggcccaucucccagcauaaccaccggccgggcuaccauacccaaacggcaggcccguggcaccucggcaaguuagagcuggacuucaauuacugcgagggcacuacagucgugaucaccgagaacugcgggacccggggucccagccuaagaacgaccacuguguccgguaaacugauccacgaguggugcugccgcagcuguacgcugcccccguugcgcuacaugggggaagacgggugcugguauggcauggagauccgucccaucuccgagaaggaggagaacauggucaagagccuggucuccgccgggagcgggaagguggacaauuucaccaugggaguccugugccuugccauccuauuugaggagguaaugcgggggaaauuugggaagaagcacaugaucgccggugucuucuucaccuucguccugcuccugagcgggcagaucaccuggcgcgacauggcucacacucugaucaugauuggcagcaacgcguccgacaggauggggaugggcgugacguaccucgcccugaucgccacuuucaagauucagcccuuucuggccuuaggauuuuucuuacguaagcuaaccagcagagagaacuugcugcugggcguagggcucgcgauggccacgacccugcagcugcccgaagacaucgagcagauggcuaacggcaucgcccucggacugauggcccugaagcucaucacucaguucgagaccuaccaguuauggaccgcccugaucagccugacuuguuccaacaccaucuucacccugacggucgccuggcgcaccgccacccucauccuugccggggugucguugcugcccaugugccaguccagcagcaugcggaagaccgauuggcuccccauggcgguggccgcgaugggcguaccaccacucccguuauucaucuucucccugaaggauacucugaaacgccgcuccuggccgcugaacgaaggcgucauggcagucggccucgugucuauccuggccagcagccugcucagaaaugaugugccgauggcgggcccccuggucgcugggggcuuacucaucgcaugcuacgugaucaccgguacguccgccgaccugaccguggagaaggcugcgaacaucacgugggaggaggaagcugagcagacuggcguaucucacaaccuuaugauaaccguugaugacgaugggaccaugcgcaucaaagaugacgagaccgaaaacauccucacgguacugcuaaagaccgcccucuuaauugucuccggaauuuucccguacagcauccccgccacccugcucguguggcacaccuggcagaaacagacucagcgguccggcgugcugugggacguccccagcccacccgagacccagaaagccgagcuagaagaagggguguaccgcaucaagcagcagggcauuuucgggaagacccagguaggcgucggcgugcagaaggagggagucuuccacaccauguggcaugugacucggggcgcggugcugaccuacaacgggaagcgccuggagcccaacugggccucggucaagaaagaucugauaagcuauggagguggcuggcggcucuccgcacaguggcaaaagggggaggagguccaagugaucgccguugagccgggcaagaaccccaagaacuuccagacgaugccagguaccuuccagacuacuacuggggaaauuggcgcgaucgcccuggacuucaagcccgggaccagcggcagccccaucaucaaucgcgagggaaaggucgucggguuauacggcaacgggguggucacaaagaacggcgguuacguguccgguaucgcccaaaccaacgccgaaccugauggccccacccccgagcuggaagaggagauguucaaaaagcgaaaucucacgaucauggaccugcaccccgggucuggaaagacucguaaguaccugccggccaucgugcgggaggcgaucaagaggcggcuccgcacccugaucuuagccccgacccgaguaguggccgccgaaauggaggaagcccucaaggggcugcccauccgcuaucagaccacggcgaccaaaucugagcacacuggacgggagaucguggaccugaugugccacgccaccuucacgaugcgccuucugagccccguccgggugccgaacuacaaccugauuaucauggacgaggcgcacuuuacagaccccgccaguauugccgcgcgcggguauaucagcacccggguggguaugggugaggccgccgcuaucuucaugaccgcuacgccacccgguacugccgacgcguucccacaguccaacgcccccauucaggaugaggagcgugacauccccgagcgcaguuggaacucagguaaugaguggaucacugacuucgccgggaagaccgucugguucguacccucaauaaaggcgggcaacgacauugccaacugccuccggaagaacgggaagaagguaauccagcuaucccgcaagacguucgacaccgaguaucagaagaccaaguuaaaugacugggacuuugucgugaccacggauaucagugagaugggagccaacuucaaagccgaccgugugaucgacccucgccggugucucaagccggucauccucacggauggccccgagcgcgucauccuggccgggcccaugccggugaccgcagcauccgccgcacagcgacgcggccgggucggucgcaacccgcaaaaggagaacgaccaguauaucuucaccggccagccuuugaacaacgacgaggaccacgcccacuggaccgaggccaagauguuacuagacaacauaaauacgcccgaggggaucaucccggcgcucuucgagcccgagcgagagaaguccgcagccaucgacggcgaauaccgccugaagggcgagucccggaagacuuucguggagcugaugaggaggggcgaccucccuguguggcuugcgcacaagguagccagcgaggggaucaaauacaccgaccgcaaguggugcuucgacgggcagcguaacaaccagauccucgaggagaacauggacgucgagaucuggaccaaggagggcgagaagaaaaagcuacgcccgcgguggcuagacgcccgcacguacucugauccgcuggcgcucaaggaguucaaggaguucgcugccggccgcaagucuaucgcucuggaucuuguuaccgaaaucgggcgggugcccucccaucuggcacaccgcacccggaacgcccuggacaaccugguuaugcuacacaccagcgagcacggggggcgcgccuaccggcacgcgguugaagagcuccccgagacuauggagacccuucuccugcugggccucaugauccugcugacggggggcgcuaugcuguuucugaucagcggcaaggggauugguaagacguccaucgggcugaucugugugaucgccuccuccggcaugcucuggauggccgagauaccgcugcaguggaucgccuccgccauuguccuggaguuuuucaugaugguccugcugauuccggagccagaaaaacagcgcacgccccaggacaaucagcuggccuacgugguuaucggcauccucacccuggcagccauaauagcagcgaacgagaugggccuauuggagacaaccaagcgggaccugggaaugucaaaggagccgggggucgugucccccacuucuuaccucgauguagaccuccacccugccagugccuggacccuguacgccgucgcgaccaccguuaucacccccaugcuacgccauaccaucgagaacucaaccgcaaacgugagccucgcagccaucgccaaccaggcggucgugcugauggggcuggacaagggguggccgaucuccaagauggaccucggugucccgcugcuggccuuggggugcuacucgcaggucaacccacugacccuaacggccgccgugcuauugcugaucacgcacuacgccauuaucggccccggccuccaggcgaaggcaacccgggaggcccagaagcgcacugccgccggaauuaugaagaacccgaccguggacgguauuaugaccaucgaccuggaccccgucauuuacgacuccaaguucgagaaacagcuuggccaggugauguugcugguguuaugcgcggugcagcuccugcugaugcggaccagcugggcgcucugcgaggcccuuacccuggcgaccggccccauaaccacccucugggaaggcucccccggcaaguuuuggaacaccacgaucgcgguguccauggccaacaucuuucgcggcuccuaccuggcaggggccggccuggcuuuuagcaucaugaaauccguugggaccgggaagcgcggaacuggaucacagggcgagacccuuggggagaaguggaagaagaagcuuaaucagcugagcaggaaagauuucgaccucuauaagaaguccggaaucacagaagucgaccgaacggaggcgaaggagggccugaagcgcggcgagaucacgcaccacgccgucucgcguggcuccgcaaagcugcagugguucgucgaacgcaacauggugauaccggaggggcgggugaucgaccucggcugcgggcgcggcggguggagcuacuacugcgccggccugaagaaagugaccgagguccgggguuauaccaaaggcgggccggggcaugaggagcccgugcccauguccacuuacggcuggaacaucgugaagcucaugagcgggaaggaugucuucuaccucccucccgaaaagugcgacacccugcugugugacauuggggagucaagccccucccccaccguggaggaaagccgcaccauccguguguuaaagauggucgagcccugguuaaaaaacaaccaguucuguaucaaagugcugaaccccuacaugccgacggugaucgaacaccuggaacggcuccagcgcaagcacgguggaauguugguuagaaacccucucucccgcaacagcacccacgagauguauuggaucuccaacggcaccgggaacauagucgccagcgucaacaugguuucccggcuccugcugaaccgcuucacgaugacucaccggcgcccgaccaucgagaaagacguggaccucggagcgggcacccggcacgugaacgccgagcccgagaccccgaacauggacgucaucggagagcgcauaaaaagaauaaaggaggagcacaauaguacauggcacuacgaugacgaaaauccguacaagaccugggccuaucacggcuccuacgagguaaaggccaccgggagcgccuccagcaugaucaacggcguggucaaguuacuaaccaaaccuugggacguggugccaauggugacccagauggcuaugaccgacaccacgcccuucggucagcagagaguguucaaggagaagguagacacgcggaccccgcgcagcaugcccggcacuaggagggugauggggaucaccgccgaguggcucuggcggaccuuggggcgcaacaaaaagccccggcugugcacccgggaagaauuuaccaagaagguacgcacgaacgccgcaaugggcgcggucuucacggaggagaaccagugggacuccgcuaaggccgcgguggaagacgaggauuucuggaagcucguggaccgcgagcgcgaacugcacaagcuggggaagugcggcagcugcgucuauaacaugauggggaagcgggagaagaaguugggcgaguucgguaaggccaaggggucucgcgccaucugguacauguggcugggugcccgguauuuagaguucgaggcccucggauuccugaacgaggaccacugguucagccgggaaaacucuuacagcgggguggagggggaggggcugcacaagcuggguuacauacuccgggacaucucuaagauccccgggggcgcuauguaugccgacgacaccgccgggugggacacccgcauaaccgaggacgaccugcauaaugaggagaagauaacccaacagauggacccugagcaccggcagcucgcuaaugcgaucuucaagcugaccuaccaaaacaaaguggucaaggugcaacgccccacccccaccggcacggugauggauaucaucagccguaaggaccaacgcggcuccggucaggucggcacauacggccugaacacauucaccaacauggaggcccaacucaucagacagauggagggagaggggguguugagcaaggccgaccuagagaacccccaccucccggaaaagaagauaacccaguggcuggagacgaagggcguggaacgcuuaaagcggauggcgaucuccggcgacgauugcgucgugaagccuaucgaugaucguuucgcgaacgcccuccuggcccugaaugacauggguaagguucgcaaggacaucccccaguggcagcccagcaagggcuggcaugauuggcagcagguaccguuuugcucccaccacuuccaugaguugaucaugaaggacgggcgcaagcuaguggugccgugccggccgcaggacgagcugaucggccgcgcccggauuucucagggggcggguuggucccucaaggagaccgccugccugggcaaggccuacgcccaaauguggagccugauguauuuccaccgccgcgaucuccggcuggcgucuaacgccaucuguagcgcgguuccugugcauuggguaccgaccucccgcaccacguggagcauacacgcucaccaucaauggaugacgacggaggacaugcuaaccgucuggaaucggguguggaucgaggacaauccuuggauggaggacaaaacgcccgugaccaccugggagaacgugcccuaccuugggaagcgugaggaccaguggugcggcagccugauagggcugaccucccgggcaacgugggcgcagaacaucccgaccgccauccagcagguccgcagccucauuggcaacgaggaguuccuggauuacaugccauccaugaagcgguuucgcaaggaagaggaguccgagggggccaucugguag

SEQ ID NO: 25804 - RNA, 9873 nt, Artificial Sequence
  derived and/or modified CDS sequence (opt11) from DENV-3__FJ898476__SS-prME
accucgcucugccucaugaugauccugcccgcagcccuggcuuuucaccucaccagccgggacggcgagccccggaugaucguggggaaaaacgagcggggcaaaucucugcuuuucaagaccgccuccgggaucaacaugugcacucucaucgccauggaccuuggcgagaugugcgacgacaccgugaccuacaagugcccccacauaaccgagguggagccggaggacaucgacugcuggugcaaucugaccagcaccugggugacauacgggacgugcaaccaggccggcgagcacaggcgcgacaagcgguccguggcucuagcgccccacguaggcauggggcuggacacccgcacacagaccuggaugagcgcggaaggcgccuggcggcaaguagagaagguagagacgugggcccuccgccacccgggcuucaccauccucgcgcuguuccuggcucacuacaucgguaccucccucacccaaaagguggugaucuuuauccugcugaugcucgucacgcccagcaugacaaugcggugcgugggggugggcaaccgcgacuucgucgagggccuguccggggccacauggguagacgugguccuggagcacggcgggugcguaaccacgauggccaagaacaagcccacccuugacaucgagcuccagaaaaccgaggccacccagcucgcgacgcuccggaagcugugcaucgagggcaagauuaccaauaucaccaccgacagccgcugucccacgcaaggcgaggccacccugcccgaggagcaggaucagaauuacgucugcaaacacacguacguugaccggggguggggcaaugguugcggccucuucgggaagggcucccuggugaccugcgccaaguuccagugccuggagccuaucgagggcaaggugguacaguaugagaaccuuaaguacacggucaucaucaccguucacaccggggaucaacaccaggucggcaacgagacgcagggggugacugccgagauaacgccccaggccagcaccaccgaagcgauccugccagaguacggcacccuggggcucgagugcucaccgcgcacgggccuggacuucaacgaaaugauccuacucacuaugaagaacaaggcguggauggugcaucggcagugguucuucgaccugccccugcccuggaccagcggagcgaccacggagaccccaaccuggaaccgaaaggagcuucuggugaccuucaagaacgcccacgcuaagaagcaggagguggucguauuggggucccaggagggagcgaugcacacggcccucacuggggccaccgagauccagaacagcggcgggaccuccaucuucgccggucaccugaagugucggcugaaaauggauaagcuagagcucaagggcaugagcuacgccaugugcacgaacacauucgucuuaaagaaggaggucuccgagacgcagcacggcacgauccucaucaagguggaauacaagggugaggacgugccgugcaaaauccccuucaguacagaggacgggcaagggaaagcgcacaacggccgccugaucacagccaaccccgucgugaccaagaaggaggagcccguaaacauugaggcagagccgcccuucggggaaagcaacaucgucaucggcaucggggacaacgcccugaagaucaacugguacaagaaggguucaagcauagggaagauguucgaggcgacagccaggggcgcccggcggauggcuauccugggugacacggccugggacuucgggucagugggcggagugcucaacagccugggcaaaaugguccaucagaucuucggaucggcauacaccgcccuguucagcgguguguccugggugaugaagaucgguauugggguccuucugaccuggaucggacugaacagcaagaauaccagcaugagcuucuccugcaucgcgauagggaucaucacgcucuaccugggcgccguggugcaggccgacauggggugcguaaucaacuggaagggcaaggagcugaagugugggagcgggaucuucgugaccaacgaagugcacaccuggaccgaacaguacaaguuccaggcggacuccccaaaacgccuugccaccgccaucgccggagcuugggagaacggaguaugcggcauacgcucgacaacucggauggagaaccuccuguggaagcagauugccaacgagcuuaacuacaucuuaugggagaacaacaucaagcugaccgucguggucggggacaucauuggcguguuggagcagggcaagaggacgcugacgccacaaccgauggaacugaaauacucauggaagaccugggggaaggccaagaucgugaccgcugagacucaaaacagcucguucaucaucgacggaccuaacacgccagaaugcccuuccgucucccgggcuuggaacgugugggagguggaggacuacgguuucgggguauucacaacaaacaucugguuaaagcugcgcgagguguacacccaguuaugcgaccaccgccucaugagcgcggccgugaaggacgagcgcgccguacacgccgacauggguuacuggaucgagagccagaagaacggguccuggaagcuggagaaggccagccugauugaagugaagacgugcacauggccaaagucccauacacucuggagcaacggcguccuggaguccgacaugaucauccccaagucucuggcggggcccauaagucagcacaaccaucgacccggcuaccacacccagacggcugggcccuggcaccucggaaagcuggaacuggauuucaacuacugcgaaggcaccaccgucgugaucaccgagaacugcgggaccagaggucccagcuuacgaaccaccaccguguccgggaagcugauccacgaguggugcugccgcagcugcacgcugcccccucuccgguacaugggggaggacgguugcugguacggcauggagauccgccccaucuccgagaaggaggagaauauggucaaaagccugguguccgccggcagugguaagguugacaacuucaccaugggcguccugugccucgcaauccuuuucgaggaggugaugcgggggaaguucggcaagaagcauaugaucgccgggguguucuucaccuucguucuguugcuguccggccagaucaccuggcgcgacauggcgcacacgcugaucaugaucggcagcaacgccuccgaccggaugggcaugggagucaccuaccucgcccugaucgccaccuucaaaauacagccauuccuggcccuggguuuuuuccugcgcaagcuaacuagccgagagaaccuccugcugggagugggccucgcgauggccacgaccuuacagcugcccgaggacauugagcagauggccaacgggaucgcccucgggcucauggcguugaagcucaucacccaauucgagaccuaccagcuguggacggcccugaucagccugaccugcuccaacaccaucuucacccugacggucgccuggcggaccgccacccugauccucgcaggggugagcuugcuaccggucugccaguccagcuccaugcggaagaccgacuggcuccccauggccguggccgccaugggcgugccgccccucccgcuguucaucuucgggcucaaggacacgcugaagcgucggaguuggccccugaacgagggcguaauggccgugggccucguuucaauacuggccucuuccuuauugcggaacgacgucccaauggcggggcccuuaguggccggcggccuucucauagccugcuacgugaucaccggcaccucagccgaccugaccguugagaaggccgcggacaucacgugggaggaggaggccgagcagaccggggugucgcacaaccugaugaucacaguagacgacgacggcaccaugcgcaucaaagaugacgagaccgagaacauccucacgguccuguuaaagaccgcccuccugauugucagcggcaucuucccguacuccauccccgccacccugcucguguggcauaccuggcagaaacagacacagcggagcgggguacugugggaugugcccagcccucccgagacccagaaggccgagcuggaagagggcguguaccgcaucaagcagcaggggaucuucggcaagacacaggucggggugggcguccagaaggagggugucuuccacacuauguggcaugugacccgcggggcggugcucacauacaacggcaagcgcuuggagcccaauugggccucggucaagaaggaccugauauccuacgggggcggauggcggcuuagcgcccaguggcagaagggggaggagguccaggugaucgccgucgagcccggaaagaaccccaagaacuuccagaccaugccagggacauuucaaacgacuacuggcgagaucggagcgaucgcccuggacuucaagcccggcaccuccggcagcccuauaaucaaccgcgaggggaagguugugggccuguacggaaacggugucguuacgaagaacgggggcuacgugagcggcauagcccagacgaacgccgagcccgacggccccaccccugagcuagaggaggagauguucaagaagagaaaccucaccaucauggaccugcacccgggauccggcaaaacucgcaaguaucuaccggccaucguacgggaggcgaucaaacgccggcuacgcacccugaucuuagcucccacgcgggugguggccgccgagauggaggaggcccucaaaggacuccccauccgcuaccaaaccacggccaccaaguccgagcacaccgggcgggaaaucgucgaccugaugugccacgccaccuuuacgaugcgccuccucagccccgugaggguucccaacuacaacuuaauuaucauggacgaggcccauuuuaccgacccugccagcaucgccgcgcgcggguacaucuccacgagagucggaaugggggaggccgcagccaucuucaugaccgcaaccccgcccggaaccgccgacgccuucccgcaguccaacgcgcccauccaggacgaggagagggacauccccgagcgcucauggaacagugggaacgaguggaucaccgauuucgccggcaagaccgugugguucgugcccucuaucaaggcggggaacgacaucgccaacugcuugcggaagaacggcaagaaggucauccagcugucccgcaagacguucgacacggaguaccagaagaccaagcuuaacgacugggacuucgucgugaccacggacauuuccgagaugggcgccaacuucaaggcugaccggguuaucgacccgcgccggugccucaagccggugaucuugaccgauggaccggagcgagucauccuggcaggaccaaugccggucaccgcggccagcgccgcccagagacgcgggcgcgugggacgcaacccccagaaggagaacgaccaguacaucuucaccggacagccccucaauaacgacgaggaccacgcccacuggacagaggcgaagaugcugcuggacaacaucaacacgcccgagggcaucaucccggcccuuuuugaacccgaacgggagaaguccgcugccauagacggugaauacagacugaagggggagagccggaagacuuucguggagcugaugcgccggggggaccuccccgucuggcuggcgcacaagguggccucugaggggaucaaguacaccgaccgcaagugguguuucgacggccaacggaacaaccagauccuggaggagaacauggacgucgaaaucuggaccaaagaaggcgagaagaagaaguuaaggccccgguggcuggacgcccgcacguacagcgacccguuagcccucaaggaguucaaggaauucgccgcagggcgcaaguccaucgcccuggaccuugugaccgagauuggccgggugcccagccaccucgcccauagaacccggaacgcccuugacaaccugguuaugcugcacaccagugagcacgggggacgugcuuaccggcacgcggucgaggagcugcccgaaaccauggagacccugcuccugcucggccucaugauccugcuaaccggaggcgccaugcuguuccugauaagcgggaagggcaucgggaagaccagcaucggccugaucugcgugaucgccucgagcgggaugcuauggauggcagagauaccgcugcaguggaucgccuccgcgaucguacuggaguucuucaugauggugcuacuuaucccagagcccgagaaacagcgcacgccccaggacaaucagcuggcuuacguagucaucggcaucuugacccuugcggccaucaucgcagcgaaugagaugggccugcucgagacgaccaaacgggaucuggggaugagcaaagagccgggcgugguuuccccaaccagcuaccuggaugucgaccuucauccagccuccgcuuggacccuguacgcaguggcaaccaccgugaucacgcccaugcugagacacaccaucgagaacagcaccgccaacgucagccuggccgccauagccaaccaggcggugguacugaugggacuggacaagggcuggccgaucagcaagauggaccuagguguuccccugcuagcccucggcugcuacucucaggugaaccccuugacacugacagcagcaguguuacugcugaucacccacuacgccaucaucggccccgggcuccaggcgaaggccacccgggaggcccagaaacgaaccgccgccggcauaaugaagaacccgacagucgaugggaucaugaccaucgaccuggaccccgugauauacgacagcaaguuugagaagcagcugggccaggugaugcuccuggucuuaugcgcugugcaacuccuuuugaugcgaaccuccugggcccucugcgaggcccugacccuggccacgggccccaucaccacccucugggaggggagccccggcaaguucuggaacaccacgaucgcuguguccauggcgaacaucuuccgggggagcuaccuggcuggcgccgggcuggccuucuccauuaugaaaucugucggcacuggcaagcgggggacggguucccagggggagacccucggcgagaaauggaagaagaagcugaaccagcugagccgcaaggacuucgacuuguacaagaagucggggauuaccgagguagaccguacggaggccaaggagggccuaaagcgaggcgagaucacccaccaugccgugucccgggggagugccaagcugcagugguucguugagcgcaauauggugaucccggaaggccgggucaucgaccucggcugcggccgcgggggauggucguacuacugcgcaggccugaaaaaggucaccgagguucggggguacacuaagggcgggcccggccacgaggagcccgugcccaugagcaccuacgguuggaacauugucaagcugauguccggcaaggacguuuucuaccucccgcccgaaaagugcgauacccuacugugcgacauuggagaaagcucgcccagccccaccguggaggagucccgcaccauccgcgugcugaagaugguggagcccugguuaaaaaacaaccaauucuguaucaaggugcugaaccccuacaugcccacugucaucgagcaccuugaacggcugcagcguaaacacgggggcaugcugguacguaacccccugagccgaaacuccacccacgagauguauuggaucagcaacgggaccggcaacaucguggccagugucaacaugguuagccggcuccugcucaaccgcuucacaaugacgcaccggcgcccgacaaucgagaaggacguggaucucggggcugggacgcgacacgucaacgcagagccggagacccccaacauggacgugaucggcgagcgcaucaaaaggauaaaggaggagcacaauuccaccuggcacuacgacgacgagaaccccuacaagacgugggccuaccacgggagcuacgaagugaaagccaccggcuccgccaguuccaugaucaacggggucgugaagcugcugacuaaacccugggaugucgugccgauggugacgcaaauggcaaugaccgacaccacgccguucggccagcagcgcgucuucaaggagaagguggacacccggaccccgcgcagcaugcccggcacccggcgcguuauggggaucaccgcugaguggcuguggcggacgcugggcaggaacaagaagccccgguuaugcacccgcgaggaguucaccaagaaggucaggaccaacgccgcaaugggugcgguguucacggaggagaaccagugggacagcgcuaaggccgccguggaggacgaggacuucuggaagcucgucgaccgggagcgcgaauugcacaagcuuggcaagugcggaucauguguguacaauaugaugggcaagcgggaaaaaaagcucggcgaguucgggaaggccaagggcagccgcgcgaucugguacaugugguuaggggccagauaccuggaguucgaggcccucggguucuugaacgaggaucauugguucucgcgcgagaacucguacuccgggguggagggcgagggcuugcacaagcucggguacauccugcgugacauaucuaagauucccggcggggccauguacgccgacgacacagcaggcugggacacccgcaucacugaggacgaucugcacaaugaggagaagaucacccagcagauggacccggaacaccggcaacucgccaacgcuauuuuuaagcuuaccuaccagaacaaggucgucaagguucagagacccaccccgaccggcacuguuauggacaucaucucccggaaagaccagcgcgggagcggucagguggggacguauggccugaacacuuucacgaacauggaggcccagcucauucgacaaauggagggggagggagugcuuuccaaggccgaccuggagaacccccaccucccggagaagaagauuacccaguggcuggagacgaagggugucgagaggcugaagagaauggcgaucagcggggacgacugcguggugaaacccauugacgacagauucgccaacgcccuccuggcgcugaaugacaugggaaagguccggaaggacaucccucaguggcagcccuccaagggguggcacgacuggcagcaggucccauucugcagccaucacuuccacgagcucaucaugaaggacggccgcaagcuggugguccccugccggccucaggacgagcugauagggcgcgcccggauuucccagggcgcgggcuggagcuuaaaggagaccgccugccuggggaaggccuacgcccagauguggucccugauguacuuccaucgccgcgaccuucggcuggcgagcaacgccaucuguuccgccguacccgugcacugggucccaaccagccgcaccacguggagcauccacgcccaccaccaguggaugaccaccgaggacaugcugaccgucuggaaccgcguguggaucgaggacaaccccuggauggaagacaagacccccgucaccacaugggagaaugugcccuaccucggcaagcgugaagaccaguggugcgggagccugaucggacugaccagccgggccacgugggcgcagaacauaccgacggccauucagcagguccggucccucaucggaaacgaggaguuccuggacuacaugcccucuaugaagcgguuccgcaaggaagaagaguccgagggcgccaucugguga

SEQ ID NO: 25805 - RNA, 9873 nt, Artificial Sequence
  derived and/or modified CDS sequence (opt11) from DENV-3__FJ898475__SS-prME
accagccucugccucaugaugauacuucccgcugcccuagcauuccaucuaacuaguagagacggugagccgcggaugaucguagggaagaacgagcggggcaagagccugcuguucaagaccgccuccgggaucaacaugugcacccucaucgccauggauuuaggggagaugugcgacgacacgguaaccuauaagugcccccauaucaccgaaguagaaccugaggacaucgauugcuggugcaaucugaccagcaccugggugaccuacgggacguguaaccaggccggcgagcaccggagagauaagcggucaguggcacucgcgccgcacguaggcauggggcuggacacgcgcacccagaccuggaugagcgccgaaggcgccuggcgccaagucgagaagguggagacuugggcucugagacauccgggguucacuauuuuagcgcuguuccuggcucauuacauaggaaccucauugacccagaagguugugaucuucauccuccugaugcuggucacacccucaaugacgaugcggugcgugggaguggggaaccgcgauuucgucgaagggcuauccggcgccacuuggguggacguagugcuggagcauggcggaugugucaccacaauggccaagaacaagccgacccucgauaucgagcugcagaagaccgaggcuacccagcuagcgacgcuacguaaacugugcauugagggcaagaucacuaauaucacgaccgauagccgaugcccaacgcaaggagaggccacacugccagaggaacaggaccagaacuacgucuguaagcacacauacgucgaccgcggaugggggaaugggugcggccuauucgggaaggggucguuagugacaugcgcgaaguuccagugucucgaaccgaucgaaggcaaggugguucaguacgagaaucucaaauacacggugauaauuaccguucacacaggagaccagcaccaggucggcaacgagacucaaggggucacugccgagaucacuccccaagccagcaccacugaggcgauccuaccagaguacggaaccuugggucucgaauguuccccgcgcacgggccucgacuuuaacgaaaugauucuucugacaaugaagaacaaggccuggaugguccaccggcagugguuuuucgaccugccucugccguggacaagcggcgccacuacggagacaccaacauggaaccgcaaggaguuacuggugacguucaaaaacgcccacgccaagaagcaggaagugguuguauuaggcagccaggaaggcgcgaugcacacugcccucaccggggccaccgagauccagaauagcggugggacuuccauuuuugcuggccaccugaagugccgguuaaagauggacaaguuagagcucaaggggaugagcuacgccaugugcaccaacaccuucguguugaagaaggaggucuccgaaacucagcacgggacgauauuaaucaagguggaguacaagggcgaggauguuccguguaagaucccauucagcacggaggacggccagggcaaagcgcacaauggucggcugaucaccgccaaccccgucguuaccaagaaggaggagccagugaauaucgaagccgagccacccuucggggagagcaacauugugaucggcaucggcgacaacgcuuuaaagauaaacugguacaagaagggguccagcaucgggaaaauguuugaggcgaccgcacggggcgcucgacggauggccauccugggcgacacggcgugggacuuugggagcguggguggcguccucaacagccugggcaagaugguccaccaaaucuucggauccgcguacaccgcccuauucucaggcguaucuugggugaugaaaaucggcauugggguccuacugaccuggaucggcuugaacagcaagaacaccuccaugucguucaguugcaucgcuaucgggauaaucacucucuaucugggugcugugguucaggcagauauggggugcgucaucaacuggaaaggcaaagagcugaagugcggcucggggaucuucgugaccaacgaaguacacaccuggaccgagcaauacaaauuccaggcggacucccccaagcgacucgccacugcaaucgccggcgcaugggaaaacggggugugcggcauccggucaaccacgcgaauggagaaccuccuguggaagcaaaucgccaacgaacucaauuacauacucugggagaacaauaucaaacuaaccgugguggucggugacaucaucggcguacuagagcagggcaagcgaacguuaaccccucagccaauggagcugaaguacagcuggaaaacuuggggcaaggccaaaauagugacugcggaaacgcagaacagcuccuuuauaauagacgggcccaacacccccgagugcccuagcguaucucgggccuggaacgugugggagguggaggauuauggguucggcgucuucaccaccaacaucuggcucaagcugagagagguauauacucaacugugcgaccaucggcucaugagugcggcugugaaggacgagcgcgccguacaugccgauaugggcuauuggaucgagagucagaaaaacgggucauggaaacuggagaaggcuagccugauagaggugaaaacgugcacguggcccaagucucacacccucuggucuaauggcgugcuugaguccgacaugaucauccccaagagccuggccgggcccauuucccagcacaaccaccgaccggguuaccauacucagacggcugggcccuggcaccucggcaagcuugaguuagacuuuaacuacugcgagggaaccaccguugucaucacugagaacugcgggacccguggccccagccuccggaccaccaccgugagcgggaaguugauacacgaauggugcugcagguccugcacccugcccccgcuccgguacaugggcgaggacggcugcugguacggcauggagauccggcccaucuccgaaaaagaagaaaacauggugaagucgcuuguguccgcugguagcggaaagguagacaacuucaccaugggcguacugugccucgcgauccuguucgaggaggugaugcgggggaaguucggaaagaagcacaugaucgccgggguguuccugaccuuuguccuccugcugucggggcagaucaccuggcgcgauauggcgcacacgcucaucaugaucggcagcaacgcgucugacagaauggggaugggcgucaccuacuuggcccucaucgcuaccuucaagauccagcccuuccucgcgcuuggcuucuuccugcggaagcugaccagccgggaaaaccugcuacucgguguggggcuggcaauggcgaccacccugcagcuccccgaggacaucgagcaaauggccaacggaaucgcccugggccugauggcacuaaagcugauaacucaguucgaaaccuaccaacuguggacggcacucaucagucugaccugcucgaacaccaucuucacccugaccguagccuggagaaccgcgacccucauccuggcuggggugagucuacucccggugugccagucgucuucaaugcggaagaccgacuggcugccgauggcuguagccgccaugggagugccgccccugccccuguucaucuuuagccucaaggacacgcugaagcgucguucuuggccccucaacgaagggguuauggccguaggccugguuagcauccuggccuccagccuccugcggaacgacguccccauggcugggccccuaguggcggggggucuauuaaucgccugcuacguaauuacuggaacauccgccgaucugacggucgagaaggccgcggacaucacgugggaagaggaagcggagcagaccggcguuagccacaaccuaaugaucacuguagacgacgacggcacuaugcgcauaaaggacgaugagaccgaaaauauccugacgguccugcucaagacagccuugcugaucgugucaggaaucuucccguacucuauccccgccacccuccugguguggcauacguggcagaaacagacgcagcggagcggcguacugugggauguucccagcccgcccgagacccagaaagccgagcucgaagaaggagucuaccggaucaaacaacagggaaucuuugggaaaacccaagucggcguggggguccaaaaagagggcgucuuccauacaauguggcacgugacgcggggggcggugcucacuuacaacgguaaacggcuagagcccaacugggccuccguuaagaaggauuuaauuucguacggggggggcuggagacucagcgcgcaauggcagaagggagaggagguccaagugauugcggucgagcccgggaagaaccccaagaacuuucagaccaugcccgguacauuccagacaaccaccggggaaaucggugcgauagcccuggacuucaaaccagguaccucaggaucccccaucaucaaccgcgagggaaaaguuguggggcuuuauggcaacgggguugugacaaagaacgggggcuacgugucagggaucgcucagaccaacgcggaacccgauggccccacccccgagcucgaggaggagauguucaaaaagcggaaccuuacaaucauggaccugcauccugggagcgguaagacgcguaaauacuuaccggcgauuguccgugaggcgaucaagcgccggcugcguaccuugauccucgcuccaacccgcguggucgcagcugagauggaggaggcccugaagggccucccuauccgcuaucagaccacggcgaccaaguccgaacacaccggacgggagaucgucgacuugaugugccacgccaccuucacgaugcgcuuacugagccccguccgggugccgaacuacaaccugaucaucauggacgaagcccacuuuacggacccggcgucgaucgcagcgcgaggguauaucuccacccgggucggcaugggagaggccgcggccaucuucaugaccgcgacgccuccagggaccgcggacgccuucccacagucuaacgcccccauccaggacgaggaacgcgacauccccgaacggagcuggaacaguggcaacgaguggauaacggacuucgccgggaagacaguaugguucgugcccucgauuaaggcgggcaacgacauugccaacugccugcggaagaacgggaaaaaggucauucagcugucccguaagacguuugacacugaguaccaaaagacaaagcuaaacgacugggauuucguggugaccacggacaucucagaaaugggcgcuaacuucaaggccgaccgggucaucgauccgagacggugucucaaaccagucauucugaccgacgguccggagagagugauccuagccggccccaugccugucacggccgccuccgccgcucagcggcgcgggcgggugggccgcaauccccagaaggagaacgaccaguauauuuucaccggucaaccgcugaacaacgaugaggaccaugcacacuggaccgaggcgaagaugcugcucgauaacaucaauacgccugaaggaaucaucccggccuuguuugagccagagcgggagaaguccgccgcgauugauggcgaguaccgguugaagggcgaaucccggaagaccuucguggagcucaugcgccgcggggaccugcccgucuggcuggcucacaagguagccagcgagggcaucaaguacacagaccgaaaguggugcuucgaugggcagcggaacaaccagauccucgaggagaauauggacgucgaaaucuggacaaaggagggcgaaaagaagaagcugcggccccguuggcuugacgcccggacguauucagauccucucgcccugaaggaauucaaggaguucgccgcgggccgcaagagcaucgcgcuggaccucgucacugagaucgggcgggugccuagccaucuggcucaucgcacgcggaacgcccuggacaaccuugucaugcugcacaccagcgagcacggugggcgcgcguacagacacgcgguugaagagcugcccgaaacgauggaaacacuccugcugcuaggccuuaugauccugcuuaccgggggugcaauguuauuccugaucagcggcaaggguauuggaaagaccuccaucggccucaucugcguuaucgcguccuccggcauguuguggauggcugagaucccgcugcaguggaucgcauccgcaaucgucuuggaguucuuuaugauggucuuacugaucccugagcccgaaaagcagcguacgccgcaggacaaccaguuagccuacgugguaauugggauccuuacgcuggccgccauuaucgcugcgaacgagaugggccuacuggagacgaccaaaagagaccuugguauguccaaggaacccggggugguuagcccuacguccuauuuagacgucgaccugcacccugcgucagcauggacccuauacgcgguugcuaccacugugaucacgccgauguuacggcacaccauugagaauucgaccgccaacguuucucuagccgccaucgcaaaccaggcgguggugcugaugggguuggacaaaggguggccgaucucgaagauggacuugggagucccucuguuagcuuuggggugcuauagccagguuaacccccuaacccucacggccgccguacuccuucucaucacccacuaugccauuaucggacccggucugcaagcuaaggcgacccgggaggcgcagaaacgcaccgcagccggcauaaugaagaacccgacggucgacggcaucaugacuauagauuuagaccccgugaucuacgauuccaaguucgagaagcagcugggccaagugaugcuguuaguccuuugugcggugcaacugcugcucaugaggaccagcugggccuuaugcgaggcgcugacccucgccaccggucccauuaccacccugugggagggaucccccgggaaguucuggaacacgacaaucgcugucucuauggcgaacaucuuccgcggguccuaucuagccggugcaggccuggccuucuccaucaugaaguccgucgggaccggcaaaagaggcacggggagucaaggcgagaccuugggugagaaguggaagaagaaacugaaccaacucagccguaaggacuuugaucuguacaagaaauccgguaucacugagguggaccggacggaagccaaagagggccucaagcgcggggagauuacccaccacgccgugagccggggcuccgcaaaacuccagugguucgucgagcgcaacauggugaucccagaggggcggguaauugaccuggggugcgggcggggaggguggagcuauuauugcgcagggcugaagaaggucaccgaggugcgcggcuacaccaagggcgggccaggucacgaggagccugugccaaugucaacguacggcuggaauaucgucaaacuaaugagcgggaaggacguuuucuaccugccgcccgagaaaugugacaccuuacugugugauaucggcgaguccucucccuccccgaccguugaggagagcagaacuauccgcguauuaaagaugguggagccgugguugaagaauaaucaauucuguaucaagguauuaaauccauacaugccaacggugaucgagcaccucgagagguuacagcgcaaacauggagggaugcugguacggaauccccucucacggaacagcacacacgagauguacuggaucuccaacggcaccggcaacauaguugccucuguaaauaugguuucccgucuguugcucaaccgcuucacgaugacccaccggagaccaaccauugagaaggacguagaccugggagcgggcacccggcacgucaacgcggagcccgagacgcccaacauggaugugaucggggagcguaucaaacggauuaaagaggagcacaacagcacguggcacuacgacgacgagaauccguacaagacaugggcguaccacggcaguuacgaagucaaagcgacagggagcgccuccucuaugaucaacggcgucgugaaacugcuaaccaagcccugggacguugugcccauggugacccaaauggcgaugacggacaccaccccguucgggcaacaacgagucuucaaggagaagguggacacgagaacaccgcguucuaugcccggcacccggcgcgugaugggcauuaccgcagaguggcuguggcggacacuggggcguaacaagaagccgcgucugugcacacgcgaggaguucaccaaaaaggugcgaaccaacgccgccaugggcgcaguguuuacggaggagaaucaaugggauuccgccaaggccgcaguggaggaugaagacuucuggaaauuaguagaccgggaaagagagcugcacaaguuggggaagugcggcagcugcguguauaauaugauggguaaacgggagaaaaagcugggcgaguuuggcaaggcaaaagggagucgugcuauuugguauauguggcuuggagcccgguaccucgaguucgaggccuugggguuccugaaugaggaccacugguuuucgcgcgagaacagcuacucuggaguugagggagaggggcuccacaagcuaggcuacauucugcgcgauaucuccaagauacccgggggugccauguacgcagaugacacggcggguugggacacgcgcauaaccgaagacgaccuccacaacgaagagaagaucacgcagcagauggacccggaacaucggcagcuagccaacgccaucuucaagcucaccuaccagaacaaggucgugaaaguacagcgacccaccccuaccggcacuguuauggacaucaucucucggaaagaccaacggggguccggccaggucggaacguacggccugaacacauucacuaacauggaggcccaacucauccgacagauggagggagagggggugcuguccaaggcagaccucgagaacccucaucucccagagaagaagaucacccagugguuagagacgaagggggucgagagacuuaagcgaauggcaauauccggcgacgauugcguugucaagcccaucgacgaccgcuucgcuaacgcccugcuggcccucaacgacaugggcaagguacggaaggauaucccccaguggcagccuucgaaaggauggcacgacuggcagcaaguacccuucugcucccaccauuuccaugagcuaaucaugaaagacggacgcaaacuggugguccccugcagaccccaggaugagcucaucggcagagcgagaauaucucagggggcgggcuggucccugaaagaaacggcgugccucgguaaggcuuacgcucaaauguggagccucauguauuuccaccgccgggacuuacgccucgcguccaaugccaucugcagcgcaguuccaguccauugggucccuaccucucguacgacguggucuauccacgcucaccaucaguggaugaccaccgaagacaugcugaccguguggaaucgcguguggauagaagacaaccccuggauggaagacaagacgccgguuacuacaugggagaacgugcccuaccuggggaaacgcgaagaccaguggugcgguucccugaucgggcucacaucgcgcgccacgugggcgcaaaacaucccuaccgcuauccagcagguccgcucucugaucggcaaugaagaguuccuggacuacaugcccuccaugaaacgcuuccgcaaggaagaggagagcgaaggggccaucugguag

SEQ ID NO: 25806 - RNA, 9873 nt, Artificial Sequence
  derived and/or modified CDS sequence (opt11) from DENV-3__GQ199861__SS-prME
acaucucugugccucaugaugauccugccggccgcccuggcguuucaccuuacaucacgggacggugaaccccggaugaucgucgggaagaacgagcguggcaagagccuguuauuuaaaacggccagcggcaucaauaugugcacccucauugcaauggaccugggcgagaugugcgacgauaccgugacuuauaagugcccccacaucacugagguggagccggaggacaucgacugcuggugcaaccuaaccaguacaugggugaccuacgggacgugcaaccaggccggcgagcacaggcgugacaaacgguccgucgcccucgcuccccauguaggcaugggucuggacacccgcacccaaacauggaugagcgcagagggcgcauggcgccaagucgaaaagguagagacgugggcccugagacacccgggguuuaccauccucgcgcuauuccucgcccacuauaucggcaccuccuuaacccaaaagguggugaucuucauccuccuaaugcuggugacgcccagcaugacuaugcggugcgugggggugggcaaccgugacuucgucgagggccuguccggggccaccuggguugacguggucuuggaacacggagggugcgucaccacgauggccaaaaacaagcccacccucgauaucgagcuccagaagaccgaggccacccagcuggcaacgcuccgcaagcugugcaucgagggcaagauaaccaacaucacuaccgacaguagaugcccuacgcagggugaagccacccugccggaggagcaggaccagaauuauguguguaagcauacauacgucgaccgcggcugggggaaugggugcggccucuucgggaaaggcucccuuguaaccugcgccaaguuucagugccuggagccgauugaaggcaaggucguccagcaugagaaccucaaguacacggucauaaucacgguucacaccggcgaccaacaccaggucggcaaugaaacccagggcgugacggccgagaucacgccucaggcaagcaccacugaggcaauccugcccgaguacgggacccuaggguuggaaugcucuccgaggacaggucuagacuucaacgaaaugauccugcuuacuaugaagaacaaggcguggaugguacaccggcagugguucuucgaccugccucugcccuggaccagcggcgccacuaccgagacccccacuuggaaccgcaaggaacuccuggugacguuuaaaaacgcccacgccaagaagcaggagguggucgugcuggggagucaagagggcgcgaugcacacagcgcuaaccggggccaccgagauccagaacagcggcgggaccucgauauucgcgggacaccucaaaugccgacugaagauggacaaacucgagcugaagggcaugucuuacgcuaugugcacgaacaccuucgugcucaagaaggaaguuuccgagacccagcauggcaccauccucaucaaaguggaguacaagggugaggacgucccgugcaagaucccguucaguacggaggauggccaaggcaaggcucacaacggcagacugaucaccgccaaccccgugguaacuaagaaggaagaacccgucaauauugaggcggaaccgcccuucggggagagcaacaucgucaucgguaucggggacaacgcccuuaaaauuaacugguacaagaagggcaguagcauugggaaaauguucgaggcgaccgcccggggagcccgccggauggcuauccugggcgacacggccugggauuuuggcuccguggguggggugcucaacagccuggggaagaugguacaccaaauauuuggguccgccuacaccgcccuguucagcggaguguccugggugaugaagaucggcaucgggguccuccugacauggauuggucugaacagcaagaacaccagcaugagcuuuuccuguaucgccauagggaucaucacgcucuaucugggcgcaguugugcaggccgauaugggcugcguaaucaacuggaagggcaaggagcugaaaugcggcagcgggaucuucgugaccaacgaggugcacaccuggaccgagcaguacaaguuccaggcggacucccccaagagacuugcuacggcgaucgccggcgcgugggagaacggugucugcggcauucgcagcacaacucggauggagaaccugcuguggaaacagauagcuaacgaacucaacuacauccugugggagaacaacaucaaacuuaccgugguggucggggauaucaucggcgugcuugaacagggcaagaggacgcuuacgccacaaccgauggaguugaaguacagcuggaagacuugggggaaagccaagaucgugacagccgagacgcagaacaguucguucaucaucgacggacccaacacacccgagugccccagcgucucccgggccuggaacguaugggagguggaagacuacggcuucggcguauuuaccacgaauauauggcucaaacugcgcgagguauauacucagcugugcgaucaccgguuaaugagcgcggccgucaaagacgagcgggccgugcacgccgacaugggguacuggauagagagccaaaagaacggguccuggaaacuggaaaaggccagcuugauagaggugaagacuugcacauggccgaaaucccacacccucuggucgaacggcguuuuagaguccgacaugaucauccccaagagucuagcggggccgaucucccagcauaaccaccgaccgggcuaccacacccaaacagccggacccuggcaucucgguaagcuggagcuggauuucaacuacugcgagggcacgaccgucgugaucaccgagaauugcgggacacgcgggccaagccuccggaccacgacagugagugggaaacuuauccaugaguggugcugcagauccugcacguugccaccccuucgguauaugggugaagacgggugcugguacggcauggaaauuagacccaucucagagaaggaggagaacauggucaagagcuuaguauccgccggaagcgggaaaguggacaacuucaccaugggcgucuuaugucuggccauccuguuugaggaagugaugaggggcaaguucggcaagaagcacaugaucgcggguguguucuucacuuucguccuacuucugucgggccagaucaccuggcgcgacauggcgcacacgcucaucaugaucggcagcaacgcaucagaccggauggggaugggcgucacuuaucuggccuugauagccaccuucaagauacagcccuuccuggcucucggguuuuucuuacgcaaacucacuucgcgugagaaucuccugcuuggcgugggacuugcaauggccacaacgcugcaguuacccgaggauaucgagcagauggcaaacggaauagcccucggccugauggcucugaaacuuaucacccaauuugagaccuaccaacuguggaccgcccugaucucucugaccugcucuaauaccaucuucacauugacgguagcauggcgcacggcgacccugauccuugccgguguaucacuccucccgaugugccaaucgagcucaaugcggaagaccgacuggcucccaauggcggucgccgcgaugggagugccgcccuuaccuuuguucaucuucagccucaaggauacgcugaagcgccgcuccuggccccugaacgagggggugauggcgguuggcuuggugagcauucuggccuccagcuuacuccgaaacgacgugcccauggcgggcccgcuaguggccgggggucugcuuaucgccuguuacgugauaaccgggaccuccgccgaucugacgguggagaaggcggcggacauaacgugggaggaagaggccgagcagaccggggucagccauaaccugaugaucaccguggacgacgacggcacgaugcguaucaaggacgacgagaccgagaacauccuaacaguacugcugaagaccgcccuucugaucgucucgggcauuuucccguacaguauccccgcuacacuacuuguguggcacaccuggcagaaacaaacgcagagguccggcgugcugugggacguccccagcccgccggagacccagaaggccgagcuggaggaggggguguacaggaucaagcagcagggaaucuucgggaagacacaggucggagucggggugcagaaggagggcguguuccauacgauguggcaugucacacggggcgcgguucucacguacaacgggaagcgccuagagccgaauugggccaaugugaaaaaggaucugaucuccuauggcgggggcuggcggcucagcgcccaguggcagaagggggaagagguccaggucaucgcgguagagcccggcaaaaauccuaagaacuuucagaccaugccgggcacguuccagaccaccacuggggagaucggugcuaucgcgcucgacuuuaagccggggacauccggcagcccgaucaucaacagggagggcaaagucgugggguuguacggcaacgggguagucaccaagaauggaggguacgugucgggcauugcccagacuaacgccgagccggauggccccacuccagaacuggaggaggaaauguucaagaagcggaaccucacuaucauggaucuacaucccgggucaggcaaaacgcgaaaauaccucccggccaucgugagggaggcuaucaagcgccgguuaagaaccuuaauccucgcgcccacccgggugguggcugcagagauggaggaagcacucaaagggcugcccauccguuaccaaacaacggcgaccaagagcgaacacaccggacgagaaauaguggaccuuaugugucacgcaacuuucacaaugcgccugcugucccccguccggguaccgaacuacaaccugaucauuauggaugaagcccacuucaccgaccccgccagcauagccgcccgcgguuacauauccacacgcgugggcaugggcgaggcagccgccauauucaugaccgcgaccccgcccgggaccgccgacgccuucccgcaaaguaacgcgcccauccaggacgaagaacgggacauacccgagcgcagcuggaacaguggaaacgaguggaucacggacuucgcaggcaagaccgugugguucgugcccucuauuaaggcggggaacgacaucgcgaacugccuccguaagaauggaaagaaggugauccaacugagccgcaagacguucgacacggaguaccaaaagacgaagcugaaugacugggacuucgucgugaccacugacauaucggagaugggcgccaacuucaaagcggaccgggugaucgauccgcgccgaugccucaagcccgucauccugaccgacggucccgaacgcguuauucuggccggacccaugccggugacggccgccucugccgcccagcggaggggccgggucgggagaaacccucagaaagagaacgaccaauauaucuuuaccggccagccccucaacaaugacgaggaccacgcccacuggaccgaggcaaagaugcugcucgauaacaucaacacuccugagggaaucaucccugcacucuucgagcccgagcgggagaaguccgccgccaucgauggcgaguaccgccucaaaggcgaaucccggaagaccuucguggagcugaugagacguggggaccuccccguuuggcuggcgcauaaggucgccucugaaggaaucaaguacacagaccgcaagugguguuuugacggacagagaaacaaccagauccuggaggagaacauggacguggagauuuggaccaaggagggugagaagaagaagcuccgcccccgguggcuggacgcacgaacauacagcgacccgcuggcccugaaggaguucaaggaguucgccgcaggaagaaagaguaucgcacuggaccuggugacggagaucgggcguguacccagccaccucgcccacagaacaagaaaugcccuggacaaccuggugaugcuccacacguccgagcauggugggcgagccuaccggcacgcggucgaggagcugcccgagaccauggaaaccuuacuccuguuaggacucaugauucugcuaaccgggggcgccaugcuguucuugauuagcggcaagggcauaggcaagacuagcauuggucucaucugcguuauugcuuccuccggaauguuauggauggcggagaucccgcuccaguggaucgccucggcuaucguguuagaguucuucaugaugguccugcugaucccggaacccgagaagcagaggacgccgcaggacaaccaauuggccuauguggugauugggauacucacgcuagccgccaucauagccgcgaacgagaugggccugcucgaaaccaccaagcgggaccuggguaugagcaaggaaccgggggucgugucccccacgagcuaccuggauguggaccugcauccugcuuccgcguggacgcuguaugccgucgcaacgaccgugauaacgcccaugcugagacauaccaucgagaacagcacugccaacgugucccucgcggccaucgccaaccaggcggugguucugaugggccuggacaaaggguggccgauuucuaaaauggaccucggaguuccauuacuggcccucgggugcuacucacaggugaacccucugacguugaccgccgccgugcuccugcugaucacccacuacgccaucaucgggccuggccugcaggcgaaagccacccgggaggcacagaagagaacagccgccgggauuaugaagaacccaacgguggacggcaucaugaccauugaccuagaccccgugaucuaugacagcaaguuugagaagcagcugggccaggugaugcuauugguguugugcgcgguccagcuccuguuaaugcggacuagcugggcucuaugcgaggcccuuacccuggccacgggucccaucaccacccucugggagggcagccccgggaaguucuggaacaccaccaucgcagucuccauggcgaauaucuuucgcggcagcuaccuggccggggcaggccuagcguucuccaucaugaagucgguggggaccggcaaacggggcaccgggucccagggcgagacccucggggaaaaguggaagaagaagcugaaccaguuaagccgcaaagacuucgaccucuauaagaaguccgggauaacugagguugaccgcacggaagcgaaggagggcuugaagcgcggcgagaucacccaccacgccgugagucggggcagcgccaaguugcagugguuuguagagcgcaauaugguaaucccggagggacggguuaucgacuuaggcugcgggcgcggcgguuggucguauuacugcgccggacugaaaaaggugacugaggugcgaggcuauaccaagggcggacccgggcaugaggaaccgguuccuaugucuaccuacggcuggaacaucgugaaacugauguccgggaaagauguauuuuaucugccgcccgaaaagugugacacccugcugugcgacaucggcgagagcuccccauccccaacgguggaggagucgcgcaccauacgcguucuuaagauggucgagccguggcuaaagaauaaccaguucugcaucaagguuuuaaaucccuauaugcccaccgugaucgaacaucuggagaggcuacagcggaagcacggcggcaugcucguccgcaacccucugucacggaacuccacgcacgagauguacuggauuuccaauggcaccgggaauaucguggccuccgugaauauggucagccgccucuugcugaaccgcuuuaccaugacacacaggcgcccgacuauugagaaggacguagaccucggcgcgggcacacggcaugucaaugcugagccagagaccccaaacauggacgucaucggggagcgcaucaagcguauuaaggaggagcauaacuccacuuggcacuacgacgaugaaaacccguacaagaccugggcuuaccacggguccuacgaggucaaagccaccgguuccgcaagcuccaugaucaacggcguggucaaguugcugaccaagcccugggacgugguccccaugguaacgcagauggcgaugaccgacaccacaccuuucggccaacagcgcguuuucaaggagaaaguugacacgcgaacgccgcgguccaugcccgguacccggcguguaaugggcaucacggcugaguggcuuuggcgcacguuggggcgcaacaagaaaccccgguugugcacucgcgaggaguucaccaagaaagugcgcacuaaugccgccaugggagcaguguucacggaggagaaucaaugggacucagccaaggcugccguggaggaugaggacuucuggaaacucguggacagagagcgugagcugcacaagcuggggaaaugcggcucaugugucuacaacaugauggggaagcgagagaagaaacuuggcgaguucggcaaggcuaaggggagccgagccaucugguacauguggcugggcgcccgauaccuagaguucgaagcguugggguuccugaacgaggaccauugguuuagccgcgaaaacuccuacuccggcguggaaggggagggccuccacaaacuuggauacauccugcgggauaucagcaaaauccccgguggcgccauguacgcugacgacaccgcggggugggacacccgcauuacugaggaugaccugcacaacgaggagaaaauaacgcagcagauggacccugaacaccggcagcucgcgaacgcgauuuucaagcucaccuaccagaacaagguugucaagguccagcgcccaacccccacaggaaccguuauggacaucauauccaggaaggaccagcgcggcagcgggcaggucggaacauacgggcuuaacaccuucaccaacauggaggcccagcucauccggcagauggaaggcgaaggggugcuguccaaagccgaucuggagaacccgcacuugcccgagaagaagaucacccaguggcuggagacgaagggcguggaacgccugaagcggauggcgaucagcggugaugauugcgucgugaagcccaucgacgaccgcuuugcaaaugcucuauuagcccugaaugacauggggaaagucaggaaagacaucccccaguggcagcccuccaagggcuggcaugauuggcagcaagugccguuuugcagccaccacuuccaugagcucauaaugaaggacggccgcaagcugguggucccuugccgaccccaagacgagcuaaucgggcgcgcucggaucucccagggggcgggcuggagccugaaagaaacggccugcuugggcaaggccuacgcucagauguggucccugauguacuuccaccgccgcgaccuccgacuggcaagcaaugccaucugcucagcggucccagugcacugggugccgacuagccgcacuacuuggaguauccaugcucaucaccaauggaugaccaccgaggacaugcugacggucuggaacaggguguggaucgaggacaaccccuggauggaggauaagacccccguuaccaccugggagaaugucccguaccucgggaagcgcgaggaccaguggugcggaucgcugaucggucuuacgagccgggccacgugggcucagaacauaccgaccgccauucagcagguaaggagucucauaggcaacgaggaguuucuggacuacaugcccagcaugaaaagauuccggaaggaggaggaguccgagggggccauuugguaa

SEQ ID NO: 25807 - RNA, 9873 nt, Artificial Sequence
  derived and/or modified CDS sequence (opt11) from DENV-3__GQ199862__SS-prME
accagccuuugccucaugaugauauuacccgcggccuuagcguuccaccuuaccucaagggacggggagccgcguaugaucguggguaagaacgagagggggaagagccugcuguucaagaccgccucggggaucaacaugugcacccucaucgcaauggacuugggagagaugugcgacgacaccgugaccuacaagugcccccacaucaccgaaguggagccugaagauaucgacugcugguguaaccugaccagcaccugggugaccuacgguacgugcaaccaggccggcgaacacaggcgcgacaaacgaucgguggcccucgcgccccacgugggcaugggucuggauacccgcacccagacauggaugagcgccgaaggcgccuggcgccagguggagaagguagagacgugggcccugcgccacccgggguuuaccauccucgcguuauuccuggcccauuacaucggcaccucccucacccagaaaguggugaucuuuauccugcuaauguuggucacacccaguaugaccaugcggugcgugggggugggcaaucgcgauuucgucgagggccuguccggcgcaacguggguggacgugguccuggagcauggcggcugcgugacgacgauggccaagaacaagccuacccucgacaucgagcugcaaaagaccgaggccacccaacuggcgacgcuacggaaacugugcaucgaaggaaagaucaccaacaucaccaccgacagccgcugcccaacgcagggcgaggccacccugccagaggagcaggaccaaaacuacgugugcaagcacaccuacgucgaccgggguuggggcaacggguguggcuuguucggcaaaggcucccuggugaccugcgccaaguuccagugucuggagcccaucgagggcaaggugguccaguacgaaaaccucaaguacacggugaucaucaccgugcauaccggggaccagcaccaggucggcaacgaaacccagggaguaaccgccgagaucacuccgcaggccagcaccaccgaagccauccugcccgaguacggcacccugggacucgagugcuccccucgcacaggccuggacuuuaacgagaugauucugcuuaccaugaagaacaaggccuggaugguccaccggcagugguucuucgaucugcccuuacccuggaccucuggcgcuaccacggagacacccaccuggaaccgcaaggagcuccuggugaccuucaagaacgcccacgcgaagaagcaggagguugucguacuggggagccaggagggcgcgaugcacacagcccugaccggggccaccgagauccaaaacagcggcgggaccuccaucuucgccggccaccugaagugccgucugaaaauggacaagcuagagcuaaaggguaugucauacgccaugugcacgaauaccuucguguugaagaaagaggucuccgagacccagcacgggaccauccucaucaagguggaguacaagggcgaagacgucccgugcaaaauccccuucagcacggaagacgggcagggcaaggcgcacaacggcagacugauaaccgccaaccccgucgugaccaagaaagaggagcccgugaacaucgaggccgagccgccguucggggagucgaauaucgucaucggcaucggugauaacgcccugaagaucaacugguacaagaagggcuccagcaucgguaagauguucgaggcgaccgcccggggcgcccgccggauggccauccugggcgacaccgccugggacuucgggucuguggggggggugcucaacucacugggcaaaaugguccaccagaucuucggguccgcguacaccgcucucuuuagcgguguguccugggugaugaaaaucggcaucggugugcuccucaccuggaucggcuugaacucuaagaauaccuccaugagcuucaguuguaucgccaucgggaucaucacgcucuaucucggcgcggucguccaggccgacauggggugcgucaucaacuggaagggcaaagagcugaaguguggcagcgggauuuuugugaccaacgaaguucacaccuggaccgagcaguacaaguuccaagcggacuccccgaagagauuggccacggccaucgccggcgccugggaaaacgguguaugcggcauccgcagcaccacccggauggagaaccugcucuggaagcagaucgcuaacgagcucaacuacaucuuaugggagaacaacauuaaacugaccgugguggucggggacaucaucggcguccucgagcaggguaagcgcacgcugacgccccagccgauggagcugaaauacuccuggaaaaccugggggaaggcaaagaucgugaccgccgaaacgcagaacagcuccuucaucaucgacggcccuaacacccccgaaugucccagcgucucgagagcguggaacguaugggagguggaagacuacggguucggcgucuucacuaccaacaucuggcucaagcugcgugagguguacacccagcugugcgaccaucggcucaugagcgcggccgugaaggacgagcgcgccguccacgcugacaugggcuacuggaucgagagccaaaagaacggguccuggaagcuggagaaggccucucuaaucgaggugaagacgugcaccuggccgaagucccacacucucuggucgaacggcgugcuggaguccgacaugaucauacccaagagccuggcggggcccauuagccagcauaaccaccggccgggcuaccacacccaaacggccgggcccuggcaccucggcaagcuggaacuggacuucaacuauugugagggcaccaccgucgugaucaccgagaacugcgggacacgcggccccagucuuaggacaaccacuguguccggaaagcuuauacacgaguggugcugccgcagcugcacucugcccccgcuccgguacaugggcgaggaugggugcugguacgguauggagauccgccccaucuccgagaaagaggagaacauggucaaaagccugguauccgccggcagcgggaaaguggacaacuucaccaugggcgugcugugccucgcaauacuuuucgaggaggugaugcgagggaaauucggcaagaagcacaugaucgcugggguguucuucaccuucgugcugcuccuguccggccaaauuaccuggcgcgauauggcgcacacgcugaucaugaucggcagcaaugccuccgaccggauggggaugggggugacguaccucgcccugaucgcaacauucaagauccagcccuuccuggccuugggguucuucuugcgcaagcugaccagcagggagaaccuccugcugggcgucggacucgcgauggccacgacucugcagcugcccgaagauaucgagcagauggccaacggcauagcacucggccugauggcccugaagcucauuacgcaauucgagaccuaccaguuauggacggcccugauaagccugaccugcuccaacaccauauucaccuuaacggucgccuggcgcaccgccacacucauccucgccggggugagcuugcugccggucugucaauccucguccaugcggaagacugauuggcuccccauggcgguggccgccaugggcgucccgcccuugccgcuguucaucuucucucucaaagacaccuuaaagagacgguccuggccccugaacgagggggucauggcgguaggacucgugagcauccucgcguccucacugcucaggaacgauguccccauggccggaccccuaguggccgguggccugcucaucgccugcuacgugaucaccgggaccuccgcagaccugacugucgagaaggccgcggacaucacgugggaggaggaggcagagcagaccggggugucucacaaccugaugaucaccgucgacgacgacgguaccaugcgcauuaaggacgaugagaccgagaacauccuaacgguccugcucaagaccgcccuccugaucguuagcggcauuuuuccauacagcaucccggccacccugcucguauggcacaccuggcagaaacagacgcagcggucaggcguccugugggacgugccuagcccgcccgaaacccagaaagcagagcuggaggaagggguguacaggaucaagcagcagggcauccucgggaagacccaggugggcgugggagugcagaaggagggcguuuuccacacaauguggcacgugacgaggggcgccgugcugacuuacaacgggaagcggcuggagccuaacugggccuccgucaagaaagaccuaaucucguacggcgggggcuggcgguuauccgcccaauggcagaaaggggaggagguccagguaaucgccguggagcccggaaagaaccccaaaaacuuccagaccaugcccggcaccuuccagacgacgaccggggagauaggcgcgaucgcucuugauuuuaagcccgggacgagcggcagccccaucauuaaccgcgaggguaaggugguggggcuguacggaaacgggguggugacgaagaacggcggcuacgugagcggcaucgcccagaccaacgccgagccggacggaccuacccccgagcucgaggaggagauguucaaaaaacggaaccugaccaucauggaccuacacccagggagcggcaagacgcgcaaguaccucccggccaucguccgggaggcuaucaagcgccggcugcgcacacugauccuggccccuacgcgggugguagccgcugagauggaggaggcccugaaggggcuuccgauccgcuaccagaccacggcgacuaagagcgagcacaccggccgggagaucgucgaccucaugugccaugcuaccuucacgaugcgauuauuaucacccgugcgaguaccgaacuauaaccuaaucaucauggacgaggcccacuucaccgacccagccaguaucgccgcgcgcggguacauaagcacccgggucgggaugggcgaggccgcggccaucuucaugacugcgacccccccugggaccgcggacgcuuucccgcaguccaacgccccgauccaggacgaggagagggacauccccgagcgcucauggaacuccgggaaugaguggaucacggacuucgcggggaagacagugugguucguccccucaaucaaggcaggcaacgacaucgccaacugccugcggaagaacggcaagaaggucauccagcucagcaggaaaacauucgauacugaauaccagaagaccaagcuuaacgacugggacuucgucguaacgaccgacauaagcgaaaugggcgcgaauuucaaagcggaucggguaaucgacccgaggcgcugccugaagcccgugauccuaaccgacggcccugaaagggugauccucgccgggcccaugccggucaccgcugccucagccgcccagcggcgcggccgcguggggagaaacccccagaaagaaaacgaccaguacauauucaccggccagccccugaacaacgacgaggaccacgcacacuggaccgaggccaagaugcugcucgacaacaucaacacgccagaggggauaauucccgcccuauucgagcccgaacgcgagaaguccgccgccaucgauggcgaguaccgucugaagggcgagucccggaaaaccuuuguggaacucaugcgccgcggggaccugcccgucuggcuggcgcauaagguggccuccgagggcaucaaguauaccgaccgcaaguggugcuucgacggacagcggaacaaucagauccucgaggagaauauggacgucgagaucuggacaaaggagggggagaagaaaaaguugcgcccgcgauggcuggacgcccggacguacagcgacccguuagcccugaaggaguucaaggaauucgcugcggggcgcaagagcaucgcccuggaccucgugaccgagauugggagggugcccucccaccuggcucaccgcacacggaacgcccuggacaaucucgucaugcugcacaccagcgagcauggaggucgcgccuaccgccacgcuguggaggagcugccggagacgauggagacccuccugcuacucggccugaugauccugcucaccgggggcgcaaugcuguuuuugauaagcggcaagggaaucggcaagaccuccauagggcugaucugcgugaucgccagcuccggcaugcuauggauggccgaaaucccgcugcaguggaucgccagcgcgaucguacuugaauucuucaugauggugcuacugauaccugaaccugagaagcagcgcacaccccaggacaaccaguuggccuacguggucaucgggauccuuacccuagcagccauaaucgcggcgaacgagaugggacuccuggagacuacgaagcgggacuuaggcaugucgaaggagccgggggugguuucacccacgagcuaccucgacgucgaccugcaccccgccucggcuuggacccuguacgccguggcgaccaccgugaucacgcccaugcuacgccacaccaucgagaacuccacggccaacgucagccuggccgccaucgccaaccaggcgguggugcugaugggccucgacaagggguggcccauuuccaagauggaccugggcgucccccucuuggcucuggggugcuacucgcaggugaacccccugacccuuaccgcggcugugcugcugcucaucacgcacuaugccaucaucggccccggccuccaggcgaaggccacucgagaggcucagaaacgcaccgccgccggcaucaugaaaaacccgacuguugacggcauaaugacgaucgaccuggaccccgugaucuacgacuccaaauucgagaagcaguuagggcaggugaugcugcugguccucugugcggugcagcugcugcucaugagaaccagcugggcacugugcgaggccuugacgcucgcgacgggccccgugaccacccucugggagggcucccccgggaaguucuggaacaccacgaucgcggucagcauggccaauauauucagagguuccuaccuggccggagccggccucgccuucagcaucaugaagagcgucgggaccgggaagcggggcaccgggucccagggcgagacauuaggggagaaguggaagaagaaguuaaaccaauuaagccgcaaggacuucgaccuguacaagaagagcggcaucaccgaaguggacaggacggaggcgaaggaggggcugaagcgcggcgagaucacacaccaugcggucucccggggcucggccaagcuccagugguucgucgagcgcaauauggugaucccggagggacgggucaucgaucugggcugcgggcgcggcggguggucguacuacugcgccggccugaagaaagugaccgagguacggggcuacacaaagggcgggcccggccacgaggagcccgugcccauguccacguacggcuggaauaucgugaagcuaaugagcgggaaggacguguucuaccugccacccgagaaaugcgacacacuucugugcgacaucggcgaauccagccccucccccacagucgaggagagccgcaccaucagagugcucaagauggucgagccguggcugaagaacaaccaauucugcaucaaggucuugaaucccuauaugcccaccgugaucgagcaucucgagcggcugcaacgcaagcacggugggaugcucgugcggaauccccuaucccgcaacagcacccacgagauguauuggaucuccaacggcacuggcaacaucgucgccagcguuaacauggugucacggcugcugcucaaccgcuucaccaugacgcaccggcgcccuaccaucgaaaaggacgucgaccugggcgcggguacccgacauguaaacgcggaacccgagacccccaacauggacgugaucggggagcgcaucaagcguaucaaggaggagcacaauucuacguggcacuaugacgacgagaacccguacaagaccugggccuaucacggcuccuacgaggucaaggccaccgggagcgccuccucaaugaucaauggcgugguaaagcugcucaccaagcccugggacguggugcccauggucacccagauggcaaugaccgacaccacccccuucggacaacagcgcguguucaaggaaaaaguggacacacggaccccgcgcagcaugcccggcaccaggcgcguaaugggcaucaccgccgaguggcuguggcguacgcugggaagaaacaagaaaccccgguuaugcacccgcgaagaauucacaaagaagguccgcaccaacgccgccaugggcgcgguuuucacggaggagaaccagugggacagugccaaggccgccgucgaggacgaggacuucuggaagcuaguggaccgggagagggagcugcacaagcucgggaagugcggcaguugcguguacaacaugauggggaagcgggagaagaagcugggcgaguucggcaaggccaaggggucgcgcgcgaucugguacauguggcugggggcccgguaccuagaguucgaggcccugggguuccugaacgaggaucacugguucagccgcgaaaacuccuauuccggggucgagggggagggccuccacaagcugggcuacauccuccgcgacaucucaaaaauacccggcggcgccauguacgccgacgauaccgcggggugggacacccguauaaccgaggacgaccuccacaacgaggaaaagauaacgcagcagauggacccagagcaccggcagcucgccaacgccaucuucaagcugacguaccaaaacaaggugguaaagguccagcgccccacccccaccggcacuguuauggauaucaucagccggaaggaccagcggggcagcgggcagguggguacguacgggcucaacaccuucaccaauauggaggcccagcugauacggcaaauggaaggcgaggguguccugagcaaggccgaccucgaaaacccccaccucccugagaagaagaucacucaguggcuggaaacgaagggaguggagcgccugaaacggauggcaaucuccggagacgacugcguggucaagcccaucgacgaccgguucgccaacgcccugcuggcccucaaugacauggggaaggugcggaaggauauuccgcaguggcagcccagcaagggcuggcacgacuggcagcaggucccguucugcucccaucacuuucacgagcugaucaugaaggacgggcgcaagcugguugugcccugucggccccaggacgagcucaucggucgugcccggaucagccaaggggcgggcuggucccugaaggagaccgccugccucggcaaagccuacgcccagauguggagccucauguacuuccaccgccgcgaccugcgucuagccucgaacgcuauaugcagcgcggugcccguccauugggugcccaccucccgcaccacguggagcauccacgcacaccaccaguggaugaccacagaggacauguuaacggucuggaaccgcgucuggaucgaggacaaccccuggauggaggacaaaacgccggugaccaccugggagaacgugcccuaccuggggaagcgcgaggaccaguggugcggcagccugaucggacuuaccucccgggcgacgugggcgcagaacaucccgaccgccauacaacagguccgcagccugauuggcaacgaggaguuccuggacuacaugcccuccaugaagcgguuucgcaaggaggaggagagcgagggggccauuugguaa

SEQ ID NO: 25808 - RNA, 9873 nt, Artificial Sequence
  derived and/or modified CDS sequence (opt11) from DENV-3__GQ199863__SS-prME
acuucacucugucugaugaugauccuccccgcggcguuagcguuccaucucaccagccgggauggcgagccccggaugaucguggggaaaaacgaacgcggcaaaagccugcucuuuaagacagcuuccgggauaaacaugugcacacucauugccauggaccugggcgagaugugugacgacaccgugaccuacaagugcccccacaucaccgaaguagagccagaggacaucgacugcugguguaaccucaccagcacuugggucacguaugggaccuguaaucaggcgggcgagcaccggcgcgacaagcgcuccguggcccucgcaccccacgugggcaugggauuagacacgcgaacccagaccuggaugagcgcggagggcgccuggcgccaagucgaaaagguagagacgugggcccugcgccacccggguuucaccauccuagcccuguuucuggcccacuacauaggcaccagucuaacccagaagguggugaucuucauccugcugaugcuagucacgcccagcaugaccaugaggugcguaggggugggcaaucgcgacuucguggagggccuguccggagccacgugggucgauguuguccuggagcacggagguugcgugacgacgauggccaaaaacaagcccacccucgauaucgaauuacagaaaaccgaggcgacccagcucgccacucugcggaaacugugcaucgaggggaagauaaccaacaucacaacagacagccgcugucccacgcagggcgaggccacucugccugaagagcaggaccagaacuacgugugcaagcacaccuacgucgaccguggcuggggcaacggaugcggccucuucgggaagggaucccugguaaccugcgccaaguuccagugucuggagcccaucgagggcaaggucguccaguacgagaaucuuaaauacaccgugaucaucacugugcacaccggggaccagcaucaggucggaaacgagacgcagggggugacggccgagaucacgccccaagccucgaccaccgaggucauuuuacccgaguacggcacacuggggcucgagugcuccccgcguaccggccuggacuucaacgagaugauccuucucaccaugaagaauaaggcauggaugguacaccggcagugguucuuugacuuaccccuacccuggaccucaggggccacgacggagacccccaccuggaaccgaaaggagcucuuagugaccuucaagaaugcccacgccaagaagcaggaggucguggugcuggggucccaggagggcgcuaugcacacggcgcuaaccggugccaccgaaauccagaacucaggcgggaccucuaucuucgcuggucaccuaaagugccgguuaaagauggauaaacucgaacuaaagggcaugucuuacgccaugugcacgaacaccuucguccucaagaaggaaguuagcgaaacccagcaugggaccauccucauuaaggucgaguacaagggugaagacgucccgugcaagauccccuucagcacggaagacgggcagggaaaggcccauaaugggcgccugaucaccgcgaacccuguggugacaaagaaggaggagcccgugaacauagaggccgagccacccuuuggggagagcaacaucguuaucggcaucggggauaacgcccugaagaucaacugguacaagaaaggcaguucgaucgggaagauguucgaggccaccgcgcggggcgcucgacggauggccauccugggcgacacggcuugggacuucgggucaguaggugguguccucaacagccugggcaagauggugcaccagaucuuuggauccgccuacaccgcccuguucucgggcguguccugggucaugaagaucggcaucgggguuuugcuuacauggauuggccugaacagcaagaauacgaguaugagcuucuccuguaucgccaucggcaucauuacuuuguaccucggcgccgugguccaggcagauauggggugcgugauuaacuggaagggaaaggaguuaaaaugcgggagcgggaucuucgugaccaacgagguacauaccuggaccgaacaguacaaguuccaggccgacagucccaagcgccucgcgacggccaucgccggcgcgugggagaacggcgugugcgggauccgcucgacaacccgaauggaaaaccuguuguggaagcagaucgcaaacgagcucaacuacauccuaugggaaaacaacaucaaacugacuguugucgugggggacaucauaggcguucuugagcagggaaaaaggacgcugacaccgcagccgauggagcuaaaauacucguggaaaaccuggggcaaggcgaagaucgucaccgcagagacgcagaacagcuccuucaucaucgacggccccaacacccccgagugccccagcguaucccgugccuggaaugugugggaggucgaagacuacggguucggaguguucaccaccaacaucuggcucaagcugcgcgagguguacacgcagcugugcgaccaucggcuuaugucggccgcggucaaggacgagcgcgcaguccacgccgacaugggcuacuggaucgagagccagaagaacgggaguuggaagcuggagaaggcaagccugauagaggugaagacguguaccuggccaaaaucccacacgcucuggagcaacggcguguuagagucagacaugauuauccccaagagccuggccgggcccauaagucagcacaaccaccggccgggcuaucacacccagaccgcggggccauggcaucucggcaagcuugaacuagacuucaacuacugcgagggcaccacgguggugauaacagagaacugcgggacgcgcggaccgagccuccggacaacuaccgucuccgggaagcugauccaugaauggugcugccgcaguugcacgcugcccccgcuccgguacaugggcgaggacgggugcugguacgggauggagauccggcccaucuccgagaaggaggagaauauggucaagagccucguguccgccggcucagggaaggucgacaacuucaccaugggcguucuaugccuagccauccuguucgaagaaguuaugcgggggaaguucggcaagaagcacaugaucgcaggugucuucuucaccuucguguuacugcucuccggccagaucaccuggcgcgacauggcccacacgcugaucaugaucgguagcaacgcauccgaccggaugggcaugggcgugacuuaccucgcucucauagccaccuucaagauccagccauuccuggcccucggguucuuucugcgcaaguuaacuagcagggagaaucuccuccugggcgucggccucgcuauggcgacgacuuuacagcuuccagaagacaucgaacaaauggccaacgggaucgcccugggcuuaauggccuuaaagcucaucacgcaguucgagacuuaccaacuguggacggcccugauaagccuaaccugcuccaacaccaucuucacccugacaguagcuuggcgcacagccacccugauccucgccgguguaagccugcugccggugugccaguccagcuccaugcggaaaacggacuggcucccuauggccguggcggccaugggcgugccgccccuuccgcuguuuaucuucagucucaaggacacgcuuaagcgacguuccuggccccuuaacgaggggguuauggccgucggccucgucucaauucuggccucaagccugcuccggaaugaugugccuauggccggcccccugguggccggcgggcugcucauugcaugcuaugucauaaccgggacuuccgccgaucuaacaguggagaaagcugccgacaucacuugggaggaagaggcggagcagacgggggugagccacaacuugaugaucaccgucgacgacgacgggacaaugcgcauuaaggacgacgagaccgagaacauccuaacgguucuucugaagacugcccuccugaucguguccggaauuuuccccuauagcauccccgccacccugcucgucuggcacaccuggcagaagcagacccagcggucaggcgugcuaugggacguuccguccccgccggagacccagaaggcggaacuggaggaggggguauacagaaucaagcagcagggcauauuugggaaaacccagguaggcguugggguccagaaggagggcguguuucacaccauguggcacgugaccaggggcgccguccucacauacaacgggaagagacuggagcccaauugggcguccgugaagaaggaucugaucagcuacggcgggggcuggcgauuauccgcccaauggcagaagggggaggagguucaggucaucgccguagagcccggcaagaaccccaagaacuuccagaccaugcccggcaccuuccagacgaccacgggggagaucggcgccaucgcucuggauuucaagccuggaaccagcggcagcccgaucaucaaccgcgagggcaaagucguagggcuguacggcaacggcguggugaccaagaacggaggguacgucuccggcaucgcacaaacgaacgccgagccggacggcccgacccccgaguuggaggaggagauguucaaaaagaggaaccucacaauuauggacuuacaccccggaagcgguaaaacgcgcaaguaccugcccgccaucgugcgggaggccaucaagcgcagacuccgcacccugauccuagcgcccacucgcguggucgcagcugagauggaggaagcgcucaaggggcuccccaucagauaccagacuacggccaccaaguccgagcacacuggccgggagaucguggacuuaaugugccacgcgaccuucacgaugcgccuccuuagccccgugcgggucccgaacuacaaccuuaucaucauggaugaggcccacuucaccgaccccgccuccauagccgcgcgaggguacauaagcacucgggucggcaugggcgaggcagccgccaucuucaugaccgccaccccgcccgggaccgcggaugcguucccacaauccaacgcgcccauacaggaugaggagagagacauacccgagagaagcuggaauuccggcaacgaguggauuacugacuuugccgggaagacagugugguucguccccagcaucaaggcgggcaacgacaucgcuaacugccuccggaagaacgggaagaagguuauccaacugagcagaaagacguucgauaccgaguaccagaagaccaaguugaaugacugggacuucgucgucaccacagacaucagcgagaugggugccaacuucaaggccgacagagugaucgauccgcgccggugccucaaaccaguaauccugacagacggccccgagcgcguaauccuggccggucccaugccagugaccgcugcguccgccgcccagcggcgcggucgggugggcagaaacccacagaaggagaacgaccaguacauauuuaccggccagccccucaacaacgacgaggaccacgcccacuggaccgaggccaagaugcuguuagauaacauuaacacucccgaggggaucaucccugcccuuuuugagcccgagcgggagaaguccgccgccaucgacggcgaguacaggcuaaagggcgaaucccggaagaccuuuguugagcuaaugcgccgcggggaucucccgguguggcuggcgcacaaagucgcgagcgagggcaucaaguacacagaccgcaaguggugcuucgacgggcagagaaacaaccagauccuggaggagaauauggacguugagaucuggaccaaggagggagagaaaaagaaacuucgcccccgguggcuggacgcgcgcaucuacucagacccguuggcgcuaaaggaguucaaggaauucgccgcuggccgcaagucgaucgcucuggaucuggugacugagauagggcggguccccucccaccuggcccaucguacgcgcaacgcccuggauaaucuggucaugcuccacaccagcgagcacggcgggcgcgccuaccggcacgccguggaagaguugcccgaaaccauggagacgcugcuccugcuggggcugaugauccugcucaccggaggcgcgaugcuguuccuaaucagcggcaaagggaucggcaagacauccaucgggcugaucugcguaaucgccagcuccggcaugcucuggauggcggagauaccgcugcaguggauugcaagcgccauuguccuggaauucuucaugauggugcuccugaucccggaacccgaaaagcagcgcacgccacaggacaaccagcuggccuacgucgugaucgggauucucaccuuagcugccaucaucgcggccaaugaaaugggccugcucgagacgaccaagagggaccuggggauguccaaggaaccugguguggucagccccaccuccuaccuggacguggaucuucaccccgcgagcgccuggacgcuguacgccguggccacuaccgucaucacucccaugcugcgccacacgaucgagaacuccacugcgaacgugucucucgccgccaucgccaaccaagcagucguccugaugggucuggacaagggguggccuauuuccaagauggaccucggcgugccguuacuggcucuagggugcuacagccaggugaacccccugacccuaaccgccgccguacuacugcugauaacgcacuaugcaauaauaggccccggccugcaggccaaggcgaccagagaagcucagaaacgaaccgccgccgggaucaugaagaacccgacaguggauggcaucaugacgauagaucuggacccagugaucuacgacuccaaguucgagaagcagcuggggcaggucaugcuccuuguucugugcgccgugcaacugcuguugaugcgaacgagcugggcucucugugaagcacugaccuuggcaaccggcccaauaacgacccugugggagggcucccccgggaaguucuggaacaccacgaucgcugugagcauggcgaacauauuccgcggaucguaccuggcgggggccggacuggcuuucagcauuaugaaguccguggggacuggcaagcgggggaccgggucccaaggcgagacccucggggagaaguggaagaagaaguuaaaccagcuaagccgcaaggacuucgaccuguacaagaaauccggcaucacggagguggaccguacugaggccaaggaggggcuaaagcgcggugagaucacgcaucacgcggugagcaggggcucugccaagcuucagugguucguggaacgcaacauggugaucccggaggggcgggucaucgacuugggcugcggccgugguggguggagcuacuacugcgccgggcugaagaaagugaccgaggugagaggguacaccaagggcggucccgggcaugaagaacccguccccauguccaccuauggcuggaauaucgugaagcugaugagcgggaaggacguauucuaccucccccccgagaagugcgauacccuacugugugacauuggcgaauccagcccgucccccaccgucgaggagucccgcacgauccgcgugcugaagaugguggagccguggcucaagaacaaucaauucugcaucaaaguccugaacccuuacaugcccacagugaucgaacaccuggaaagauugcagaggaagcacggagggaugcugguacggaaccccuugucacgcaacagcacgcacgagauguacuggauaucaaauggcaccgggaacaucgucgccucagugaacauggugucccggcuccugcugaaccgcuucacuaugacccaccggcgcccuacgauugagaaggacguagaccucggcgccggcacccggcacgugaaugcggagcccgagacgcccaauauggacguaaucggggagcgcaucaaaagaaucaaggaagagcacaauucaaccuggcacuacgaugaugaaaacccguacaagaccugggccuaccacggcuccuacgaagucaaggccacaggcagcgccuccucgaugaucaacggaguggucaagcugcugacaaagccaugggacguggugcccauggucacccagauggcaaugacggacacaacccccuuugggcagcagcgcgucuucaaggagaagguggacacccggacgccccggagcaugccugggacccggcgcgucauggggaucaccgcggaguggcuuuggcggacccuggggcggaacaagaagccacgacugugcacgcgcgaggaguucacaaagaaggugcguaccaacgccgccaugggcgccguuuucacagaggagaaccaaugggauuccgcgaaggccgcuguagaagacgaggacuucuggaagcucguggaccgggagcgagaacuucauaagcuggggaaguguggcagcuguguguauaacaugauggggaagcgggaaaagaaacucggcgaauucgggaaggccaaaggguccagggcgaucugguacauguggcugggagcacgguaccucgaguucgaggcucucggguuccugaaugaagaccauugguucagucgagaaaacucauauagcggcguagagggggagggccugcacaagcugggcuacaucuugcgggacaucuccaagauucccgggggugccauguacgccgaugacacggccggaugggauacccguaucaccgaggacgaccugcacaacgaggagaagaucacccagcagauggacccagagcaccggcagcucgcuaacgccauuuucaagcuuacguaccagaacaagguagugaagguccagcgcccuacccccaccgggaccguuauggacaucaucagccggaaggaccaacgcggcuccggccaggugggcaccuaugggcugaacacguucaccaacauggaggcucagcucaucagacaaauggagggggaaggaguccuguccaaggccgaucuggagaauccccaccucccggagaagaagaucacccaguggcuugaaaccaagggcguggagcgccucaagcggauggcaaucucuggcgacgauuguguggucaaaccaaucgacgacagauuugccaacgcgcuccuggcccuaaacgauauggggaaagugcguaaggacauuccccaguggcagcccagcaagggcuggcacgacuggcagcagguuccguucugcucgcaccauuuccacgagcuuaucaugaaggacggucguaagcuggucgugcccugccggccccaggacgagcugaucggccgcgcccggauuagccagggugccggguggucccucaaggagacggcaugcuuaggcaaagccuaugcccagauguggucccugauguauuuccaucgccgcgaccuccggcuggcguccaacgcuaucugcagcgccgugcccguccacugggugccgaccucccgcaccaccuggagcauccacgcccaccaccaguggaugacgacagaggauaugcugaccguauggaaccgggucuggaucgaggacaaccccuggauggaggacaagacgcccgugacgaccugggagaacgugcccuaucucgggaagcgcgaggaccaguggugcggaagccugaucgggcugaccucccgggccacgugggcacagaacauuccaacggcuauccagcaaguccgcuccuuaaucggcaacgaggaguuucuggacuacaugcccucaaugaaacgguucagaaaggaggaggagagcgagggggccauaugguga

SEQ ID NO: 25809 - RNA, 9873 nt, Artificial Sequence
  derived and/or modified CDS sequence (opt11) from DENV-3__GQ199864__SS-prME
acgagccucugccuaaugaugauacugcccgcagcucuggccuuucaccucaccagccgggauggggagccuaggaugaucgucgggaagaacgaaagaggcaagucccugcuauucaagaccgccuccgggaucaacaugugcacccucaucgccauggaucugggggagaugugcgacgacaccgucaccuacaagugcccccacaucaccgagguagagcccgaggacauugauugcuggugcaaccugaccucgaccugggugaccuacgggacguguaaccaggccggcgagcaccggcgcgacaagcgguccguagcccucgcuccccacgugggcaugggucugaacacccgcacgcagaccuggaugagcgccgagggcgccuggcgccagguggaaaagguggaaacaugggcccugcgccacccuggguucaccauucucgcgcuguuccuggcgcauuacaucgggaccucccucacccagaaggugguaaucuucauccugcugaugcuuguuacccccagcaugaccaugagaugcgugggggucggcaaccgggauuucgucgaggggcuguccggggcuaccuggguggaugugguccuggagcacggaggguguguuacuacgauggccaagaauaaacccacacucgacaucgaacuccagaagaccgaggccacucagcuggcaacgcugcggaagcugugcaucgaggguaagauaaccaacaucaccaccgacucgcgaugcccaacgcagggcgaagccacccugcccgaggagcaggaccagaacuacgugugcaagcacacauacgucgaccggggguggggcaacggguguggucucuuugggaaaggcaguuuagugaccugcgccaaguuccaaugccuggaaccgaucgagggcaagguaguccagcacgaaaaccucaaguacacugucaucaucaccgugcacacaggggaccagcaccaagugggcaacgagacccagggggugacggccgagaucacgccccaggccucaaccaccgaagcuauacugccggaguacggcacucuggggcucgaguguucgccgcgcacgggccuggauuuuaaugagaugauacuacucacaaugaagaauaaggcauggaugguucacagacagugguucuucgaccugccccugcccuggacaucuggggccaccacggagacccccaccuggaaccgcaaggaacuccuggugaccuucaagaacgcacacgccaagaaacaggaggucgucguguuggguucccaagagggugcgaugcauacggcccucaccggggcgaccgagauccagaacagcggugggacuuccaucuucgcaggccaccugaagugccgucugaagauggacaaguuggagcuaaaggguaugagcuaugcaaugugcacgaacacauuugugcucaagaaggaaguauccgagacacaacacgggacuauccucaucaagguggaguacaagggcgaggacguaccgugcaagaucccauuuucaacggaggacgggcaagguaaagcccacaacggccgccugaucaccgcgaacccgguuguaacgaagaaggaggaacccgugaacaucgaggccgaaccgcccuuuggggaaagcaacaucgucaucggcauaggggauaaugccuuaaagauuaacugguacaaaaagggcuccucgauaggcaagauguuugaggcuaccgcccgcggggcacggcggauggccaucuuaggcgacacagcgugggauuuuggguccgugggcggcgugcucaacucccucggcaagaugguccaucagaucuucggauccgcguauacugccuuauucagcggcguuuccugggugaugaagaucggcaucgggguacuccugaccuggaucggccugaacuccaagaacacauccaugagcuucuccugcaucgcgauagggauaaucacguuauaccugggcgccgugguccaggccgacauggggugcgucaucaacuggaaaggcaaagagcugaagugcggcuccgggaucuucgucaccaacgaggugcacaccuggacugagcaguacaaguuucaagccgacucgccaaagcgacucgccaccgccaucgccggggcgugggagaauggggucugcggcauccgcucgaccacgcggauggagaaccuauuguggaagcaaaucgcgaacgagcucaauuacauccugugggagaacaauaucaagcugaccgugguggucggggauaucaucggcguccucgagcaggguaaacgcacgcugacaccccagccgauggagcuuaaauacagcuggaagacaugggggaaggccaagaucguaaccgccgagacgcagaacagcagcuucauaaucgacggcccaaauacccccgagugcccuagcgucucccgggcauggaacgucugggagguggaagacuacggguuuggcgucuucaccaccaacaucuggcucaagcugcgcgagguguacacccagcugugcgaccaucgguuaaugagcgcggccgugaaggacgagcgcgccguccaugcagacaugggcuacuggaucgagagccaaaagaacggcuccuggaaguuagaaaaggcuagccucaucgagguaaagacgugcaccuggccgaagucccauacccucuggagcaacggggucuuagaguccgacaugaucauccccaagagccuggccgggcccaucucccaacauaaccaccggccgggcuaccacacccagacggccgggccguggcaccucgggaagcuggagcucgacuucaacuauugugaaggcacaacgguagugaucaccgagaauugcgggacgcgcgggcccagccuccggaccacuacgguuucgggaaaacugauacacgaguggugcugccguucuugcacgcugcccccgcuccgguacaugggcgaagacgggugcugguacggcauggagauccgccccaucuccgagaaggaggaaaacauggucaagagccugguguccgccgggucagggaaaguagacaauuucacgaucggcgugcuaugccuggccauccuguucgaggaggugaugagaggcaaguucgguaagaagcacaugauugccgggguguucuucaccuucguccuucuccuguccggccagaucaccuggcgcgacauggcacauaccuuaaucaugaucggaagcaaugccucagaccgcauggggaugggcguaaccuaccucgcgcugaucgcuacuuucaagauccagcccuuucuggcccucggguucuuccuacgcaaguugacuagccgggagaaccugcugcugggcgugggcuuggcgauggccacgacccugcaacugcccgaggacaucgaacagauggcuaacggaaucgcccucggccugauggcccugaaacuuauuacgcaguucgagaccuaccagcuguggacggcacuuaucucacugaccugcuccaacacgaucuucacgcugacugucgccuggcgcacagccacgcugauucucgcaggaguaucgcuguuaccugucugccagaguagcucaaugaggaagaccgacuggcuccccauggcgguggcagccaugggaguucccccgcucccgcuguucaucuucagccucaaggacacguuaaagaggcguuccuggccccugaacgagggggucauggccgucggccucguaagcauuuuagcgagcagccugcuaaggaacgacguccccauggcaggccccuugguggccgguggcuuauuaauagcaugcuauguuauuaccgggacguccgccgaccugacagucgagaaagccgcggacauaacuugggaggaggaggccgaacagacgggcgugucgcacaaccugaugauaaccgucgaugaugacggcacgaugcgcaucaaggacgacgaaaccgagaauauccucacgguccugcugaaaaccgccuuacuaauaguguccggcaucuucccguacagcaucccggccacccuucuaguguggcacacauggcagaagcagacgcagaggucuggcgugcugugggacgugcccagucccccugagacccagaaggccgagcuugaggaagggguguaucgcaucaaacagcaggggaucuucgggaaaacccaggugggcgugggugugcaaaaggagggggucuuccauacaauguggcacguuacgagaggggcggugcucaccuauaacggcaagcgccuggagccaaacugggccuccgugaaaaaggaccugaucagcuacggaggaggguggcggcucagcgcccaauggcagaaaggggaagaggugcagguuaucgcaguagagccuggcaaaaaccccaaaaacuuucagaccaugccugggaccuuucaaacgacaacaggggaaaucggggcgauugccuuggacuucaagcccgggacaucuggcagccccaucauuaaccgcgagggcaaagugguaggucuguacgguaauggggucguaacaaagaauggaggguacguuuccggaaucgcccaaacgaacgccgagccggacgggccaacgcccgagcuggaggaggagauguucaaaaagcggaaucucacaaucauggaucuccauccggggagcggaaagacgcgcaaguaccugccggcaaucguucgggaggcgauaaagagacggcuccgcacccugauccuugcucccacacggguaguugcagccgagauggaagaagccuuaaaggggcugcccauccgcuaucagaccacggcuaccaaguccgaacacacaggccgcgagaucguggaccugaugugccacgcuaccuucacaaugcggcuccugucacccguacgggugccgaacuacaaccugaucaucauggacgaggcgcauuucaccgauccugccuccaucgccgcgcgcggguacaucucaacccgggucggcaugggcgaggccgccgccaucuucaugacagcgacaccgcccgguaccgccgaugccuucccacagucuaacgcgcccauccaggacgaggaacgcgacauccccgagcgcagcuggaacagcggcaacgaguggaucacugauuucgccgggaagacgguaugguucguucccagcaucaaggcuggcaacgacauagccaauugucuccggaagaacggaaagaaggucauccaguugucccgcaagacuuucgacacugaguaccagaagaccaaguuaaacgacugggacuucgucguuacaacggacauuucggagaugggcgcaaacuucaaggccgaccgggucauagauccgaggcggugccucaagcccgugauccugaccgacggcccagagcgcguuauccuggccgggcccaugccggugaccgcggccuccgcagcccagcggcgcggccgggugggucgcaacccccagaaagagaacgaccaguacauuuucacaggccagccccugaauaacgacgaggaccacgcccacuggacugaggcuaagauguuacuggauaacauaaacacucccgaggggaucauaccggcccucuucgagcccgagcgggagaaguccgcggccaucgacggugaguaccgacugaagggcgagucccggaagaccuucguggagcugaugcggcgcggggaucucccagucuggcuggcucacaagguugccucggagggcaucaaauacaccgaccgcaaguggugcuucgacgggcaacgaaacaaccaaauccuggaggaaaacauggacgucgagauauggacaaaagaaggcgagaagaagaaacuucgcccucgguggcucgacgccaggacguacuccgacccccucgcccucaaagaguucaaagaguucgccgcgggcagaaaaagcaucgcccuagaccuggugaccgagauagggcgggugccaucacaccucgcccaccgcacccgcaacgccuuagauaaccuggugaugcugcauacaagcgagcacggcgggcgcgccuaccgacacgcuguagaagaauugcccgaaacgauggagacccugcuacugcugggccucaugauccugcugacagggggcgccaugcuguuccugaucagcggcaagggaaucggaaagaccuccaucgggcucauuugcguaaucgcuagcuccgguaugcucuggauggccgagaucccgcugcaguggaucgccagcgcgaucguccuagaguuuuucaugaugguacuccugauccccgagcccgagaagcagcgcacaccccaggauaaccaacucgcuuacguggucauugggauucucaccuuggccgccaucaucgccgcaaacgagaugggccuacucgaaaccaccaagcgggaucuggguaugucaaaggagccgggggugguaagcccaacguccuaccuggacgucgaucuccacccagccagugcguggacacuguaugcaguagccaccacagucauuacacccaugcugagacacaccauugagaacuccaccgccaacgucagccucgcggcgauugccaaccaggcgguaguacugaugggccuggauaagggguggccuaucucuaagauggaccucggcguuccccuccuggcccucgggugcuacagccagguuaauccucuaacccucacggcugccguacuccugcugaucacccacuacgccaucaucggcccuggacuucaggcgaaggcuacccgggaggcacagaagcguacggccgccggaaucaugaagaaucccacagucgaugguaucaugaccaucgaccuugaccccgugaucuacgacuccaaguucgagaagcagcucggacaggugaugcuccugguucucugcgcgguccagcuccugcugaugcggaccucgugggcccucugcgaggcccugacacuggcuacgggccccauuaccacccucugggagggauccccggggaaguucuggaacacaacgauugcagugaguauggccaacauauuccgaggcuccuaccuagccggcgccggccuagccuucucaaucaugaaguccgucggcaccggcaagcgcggcaccgggagccagggcgagacccucggggagaaguggaagaagaagcugaaucaguugagccgaaaggacuucgaucuauacaagaaauccggcaucaccgaggucgaccggacggaagcgaaggaggggcugaagcgcggcgagauuacccaccacgccgugagcagaggcagcgccaagcugcagugguucguugagcgcaauauggugaucccggaagggcgggugaucgaccucggcugcgggcgcgggggauggagcuacuacugcgccggccugaaaaaggucacggaggugcggggcuacacaaagggcgggcccggccacgaggaacccgugcccauguccacguacggcuggaacaucgucaagcuaaugagugguaaagauguguuuuaccucccucccgagaagugcgacacccuacuaugugacaucggagaaucaucucccucucccaccguggaggagagccgcaccauccgcguccuaaagaugguugagcccuggcucaagaacaaccaguucugcaucaagguacugaaccccuauaugcccacggugauagagcaccuagagcggcuccaacgcaagcacggcgggaugcuggugcggaauccccugucgcgcaacagcacccacgagauguacuggaucuccaacggcaccggcaacaucgucgccagugugaacauggugucccggcuccugcugaacagguuuacaaugacgcaccgcagacccacgaucgaaaaggauguugaccucggcgcgggcacccgacacguaaaugccgaacccgagacccccaacauggacgugauuggggagcgcauuaaacggaucaaggaggagcacaacagcacauggcacuacgacgacgagaacccguacaaaacuugggccuaccacggcuccuacgaggugaaggccaccgggagcgccuccagcaugaucaacggcgucguuaagcugcugacaaagccuugggacgucgugccgauggugacgcagauggcgaugaccgauacgacgcccuucgggcagcagcgcgucuuuaaggaaaaagucgacacgcguaccccgcgcagcaugcccggcacccggcgggugaugggcaucaccgccgaauggcuguggcgaacguuggggcgcaacaaaaagccccggcuguguacccgcgaggaguuuaccaagaaaguccgcaccaaugccgccaugggcgcgguguuuaccgaggaaaaccagugggacuccgccaaggcagccguggaagaugaggacuuuuggaagcucguugaccgggagcgcgagcugcauaaguuaggaaaguguggcagcuguguuuacaacaugauggggaaacgggagaagaagcucggcgaguucgguaaggccaagggaucccgcgcgaucugguacauguggcugggcgcacgguaccuggaguucgaggcccucggauuccugaacgaggaccacugguucagccgcgagaacucauacagcggcguggagggggagggccugcacaagcucggcuauauucugcgggacaucucuaagauucccggaggcgccauguacgccgacgacaccgcggggugggauacgcgcauuacggaggacgaucugcauaacgaggagaaaaucacgcagcagauggacccggagcacagacagcucgccaacgccaucuucaaguuaaccuaccagaacaaggugguuaagguccaacgcccuacucccaccggcacugucauggacauaauaagccgaaaggaucagcgcggcucaggccaggugggcacguaugggcugaacaccuuuacgaacauggaggcccagcuuauccgacaaauggagggcgaaggggugcugagcaaagccgaccuggagaauccccaucucccggagaagaagauaacccaguggcuugagaccaagggcguggagcgacugaagcggauggccaucuccggcgacgacugcguggucaagcccaucgacgaccgcuuugcuaacgcccucuuagcccugaacgacaugggaaaggucagaaaggacaucccccaguggcagccaagcaagggcuggcacgauuggcaacaggucccguucugcagucaucacuuucacgagcucaucaugaaggacgggcguaaguuaguggucccguguagaccccaggacgagcugaucggccgagcccggauuucacagggggcgggcuggucccucaaggagaccgccugccucggcaaggcguacgcccagauguggagccuuauguacuuccaccggcgcgaucuccggcuggcguccaacgccaucugcagcgcagugccagugcauuggguuccgacuucgcgcacaacguggucaauccacgcccaucaccaguggaugaccaccgaggacaugcugaccguauggaaccgggucuggaucgaggacaaucccuggauggaggacaagacgcccgucaccaccugggagaacgugccuuaccucggaaagagagaggaccaguggugcggcagccugaucggacugacuucccgagccacgugggcgcaaaacauuccgaccgccauacaacaggugagaagccucaucggcaacgaggaguuccuggauuacaugcccucuaugaagcgauuccguaaggaggaggagucggaaggggcuauuugguga

SEQ ID NO: 25810 - RNA, 9873 nt, Artificial Sequence
  derived and/or modified CDS sequence (opt11) from DENV-3__GQ199865__SS-prME
accucccucugccucaugaugauccugcccgccgcccuggcguuccaucucaccagccgcgacggugaaccccggaugaucguggggaagaacgagcgggggaagagccuacuguucaagaccgccucggggauaaacaugugcacccucaucgccauggaucugggcgagaugugugacgacaccgugaccuauaagugcccccacauaaccgagguggagcccgaggacaucgacugcuggugcaaccucaccagcaccuggguuaccuacgggacgugcaaccaggccggcgagcaucggcgcgacaagcgauccgucgcucucgcgccccacgugggcauggggcuggacacccgcacccagaccuggaugagcgccgaaggcgcuuggcgccaaguggaaaaagucgagacgugggcucuucgccacccgggcuucaccauccucgcucuguuccuggcacacuacaucggcaccagccuuacccagaaggucgugauauucauccugcugaugcucgucacgcccagcaugacaaugcggugcgugggggugggcaaucgcgacuucgucgagggccugucaggggcgaccuggguagaugugguauuggagcacggcgggugcguaaccaccauggccaagaacaagcccacccucgacaucgagcuccagaagacugaggccacccagcucgcgacgcuccgcaagcugugcaucgaagggaagauaaccaacaucaccaccgauagccgcugccccacgcagggcgaggcgacccugccggaggagcaggaucagaacuacgugugcaagcauaccuacgucgaccgaggcuggggcaacggcugcggccuuuuugggaagggcucccucgugacuugugccaaauuucagugccuagagcccauagagggaaaagugguccagcacgaaaaccucaaguacacggugaucaucaccguucacaccggagaccagcaccaggucggcaacgagacccaggggguaacggcagagauuacgccccaagccagcacuaccgaggcgaucuugccugaguaugggacccuggggcucgagugcuccccgcgcacgggccuggacuucaacgagaugauccugcucaccaugaaaaacaaagccuggaugguucaccggcagugguucuucgaucugccccugcccuggaccagcggcgcaaccacggaaacaccaaccuggaaccgcaaggaguugcuugugaccuuuaagaacgcgcacgcaaagaagcaggagguggucgugcuggggucccaagagggcgcgaugcacacggcccucaccggggccaccgagauacagaacagcggcggaacuucuaucuuugccggccaucugaagugcaggcugaagauggacaagcuagaacugaagggaaugagcuacgcaauguguacaaacaccuuuguacugaagaaggaggucuccgagacccagcacgggaccauucugaucaagguggaguacaagggcgaagacgugccgugcaagauccccuucagcacggaggacggucagggcaaggcgcauaacgguagacugaucaccgccaaucccguuguuacuaagaaggaggaaccggugaacaucgaagccgagccgcccuucggggaguccaacaucgucaucggcaucggggacaacgcccugaagaucaacugguacaagaagggcuccagcaucgggaagauguucgaggcgaccgcccggggcgcccgccggauggccauccugggagauacggccugggacuucgggucggugggcggggugcucaacagccugggcaagaugguacaccagaucuuuggguccgcguacaccgcucuguucagcgggguauccugggugaugaagaucggcaucgggguccuccugacuuggaucggcuuaaacagcaagaacaccuccaugagcuucuccugcaucgccaucgggaucaucacccucuaccugggcgcuguggugcaggccgacaugggaugcgucaucaacuggaagggcaaggagcugaagugcggcagcgguaucuucguaaccaaugagguccacaccuggaccgagcaguacaaguuccaggcggacucccccaaacgccuagccacggccaucgccggcgccugggagaacggugucugcggcauccgcagcaccacccggauggagaaccuucuuuggaagcagaucgcgaaugagcucaacuacauccucugggaaaacaacaucaagcugaccgugguggucggggacaucaucggcgugcucgaacagggcaagcgcacgcugacuccccagccgauggagcugaaguacuccuggaagaccugggggaaggccaaaaucgugacggcggagacgcagaacucauccuucauaaucgacggcccgaauaccccugaaugucccagcgucucccgggcguggaacgugugggagguggaggacuacggguucggcgucuucaccaccaauaucuggcucaagcugagagaaguguauacccaguugugcgaccaccggcucaugagugcggccguuaaggacgaacgcgccguccaugccgacaugggcuacuggaucgagagccaaaaaaacggcuccuggaagcuggagaaggccagccugauugaagucaaaacgugcaccuggccgaagucccacacccucuggagcaacggcgugcuagagagcgauaugaucaucccuaaaucccuggcgggcccaauaucccaacacaaccaccggccgggcuaccacacccagacggccgggcccuggcaccuuggcaagcuggagcuggacuucaacuauugcgagggcaccaccgucguaaucaccgaaaauugcgggacgaggggcccgagccugcggaccacgacggugucagggaagcugauccacgaguggugcugccgcagcugcacgcugccuccgcuccgguacaugggcgaggacgggugcugguacggcauggagauccgccccaucagcgagaaggaggagaacaugguaaaaagccugguauccgccggcucggggaagguggacaacuucacuauggggguccucugccucgccauccuguucgaggaggugaugcguggaaaguucggaaagaagcacaugaucgccgggguguucuucaccuucguccugcuccuguccggccagaucaccuggagagacauggcgcauacgcugaucaugaucggcagcaacgccuccgaucggauggggaugggcgugaccuaccuagcccugaucgcgaccuucaagauccagcccuuccuggcccucggguucuuccuacgcaagcugaccagccgggagaacuugcugcugggcgucggccucgcgauggccacgacccugcagcugcccgaggacaucgagcagauggccaacggcaucgcacucggccugauggcgcugaagcucaucacccaguucgaaaccuaccagcuguggacggccuugaucagccugaccugcuccaacaccauauucacccuaacggucgccuggcgcaccgccaccuuaaucuuagccggggugagccugcugccgaugugccaguccucauccaugcggaagaccgacuggcuccccauggcggucgccgccaugggcgugccuccccucccgcuguucaucuucucgcuuaaagacacgcugaagcgccgcuccuggccccugaacgagggugugauggccgucggccucgugagcauccuggcuuccagccugcuucggaacgacgugcccauggcgggcccccuggucgccgggggauuacucaucgcguguuacgugaucaccgggaccuccgcagaucugacuguggagaaggccgcggacauuacguggggugaggaggccgaacaaaccggggucagccacaugcugaugaucaccguggaggaugacggcaccaugcgcauaaaggacgacgagaccgagaacauccuaacggugcugcugaagaccgcccuccugaucgucucgggcauuuucccuuacagcauccccgccacccugcucguguggcacaccuggcaaaagcagacgcaacgguccgggguguugugggacguucccucaccgcccgagacccagaaggccgagcuggaggaggguguguaucgcaucaaacagcagggaauuuucggcaagacccagguuggcguuggcgugcagaaggagggcguguuucacacgauguggcaugucacgcgcggggcagugcucaccuacaacggcaaacgccuggagcccaauugggccuccgucaagaaggaccugaucagcuaugggggcggguggcgccucucggcccaguggcagaagggcgaagagguccaggugaucgccguggagcccggcaagaaccccaagaacuuccagaccaugcccgggaccuuucagacgacuaccggcgagaucggggcgaucgccuuagacuuuaagcccggcaccagugguucgccuaucauuaaccgcgaggggaaggucguuggccuauaugggaacggcguggucaccaaaaacggggguuacguauccggcauagcccagacgaaugccgagccggacggacccaccccagaguuggaggaggagauguucaagaagcggaaccuuaccauuauggaucuacacccgggcagcgggaaaacgcgcaaguaccugccugcuauagugcgggaggcgaucaaacgccggcuccgcacccugauccuagcccccacccgggucguggccgcugagauggaggaagcccucaagggcuuaccaauccgcuaccagaccacagcgaccaaguccgagcacaccgggcgggagaucguggaccucaugugccacgccacuuucacgaugcgucuguugucacccguccggguuccgaacuacaaccucauuaucauggacgaggcccacuuuaccgaccccgccuccaucgccgcaagaggguauaucagcacgcgggugggcaugggggaggccgcugccaucuucaugacugcgacaccgcccggcaccgccgacgcauucccgcaguccaacgcccccauucaagaugaagagcgcgacauccccgagcgaucauggaacuccgggaacgaguggaucaccgacuuugccgguaagaccgucugguucgucccuagcauaaaggcugggaacgauaucgccaauugccucaggaagaacggcaagaagguaauacagcuguccagaaagacguucgacaccgaguaucagaagaccaagcugaacgacugggacuucgucgugacgacggacaucucugagaugggcgccaacuucaaagccgaccggguaaucgacccccgccggugccucaagcccgugaucuugaccgacgggcccgagcgcgugauccuggccggccccaugccggugaccgcggcuuccgccgcccagaggcgcgggcgggucggccgcaauccccagaaggagaacgaucaauacaucuucaccggccagcccuuaaacaacgacgaggaucacgcccacuggaccgaagcaaaaaugcugcuggauaauaucaacacgcccgaggggaucaucccagccuuauucgagcccgagcgggaaaaguccgcagccaucgauggcgaguaucgccugaagggugaaagccggaagaccuucgucgagcucaugcggcggggcgacuugcccguguggcucgcgcacaaagucgcaagcgaggggauaaaguauacagaccgcaaguggugcuucgacgggcagcggaacaaccagauccuggaggagaacauggacguggagaucuggaccaaggagggcgagaagaagaaguuacgcccccgguggcuggacgcccgaacguacuccgacccgcuggcacucaaggaguucaaggaguucgccgcugggcgcaagagcauagcccuggaccuggucacggaaaucggccggguucccucccaccuggcccaucgcacccggaacgcccuggacaaccuggugauguuacacaccagcgaacacggggggcgcgcuuaccgccacgcgguggaggaguuaccagaaacgauggagacccuccuccugcugggguuaaugaucuuacugaccggcggcgcuaugcuguuucugaucagcgggaagggcaucgggaagacaaguaucggccugaucugcgugaucgccagcucugggaugcucuggauggccgagauuccgcugcaauggaucgccuccgcgaucgugcuggaauucuuuaugaugguccuccugauccccgagcccgagaagcaacggacuccgcaggacaaccagcuggccuacguggugauuggcauccucaccuuggccgccaucaucgccgcgaacgagauggggcugcucgaaaccaccaagagagaccuggggauguccaaggagccgggcgucguaagccccacauccuauuuggacguggaccuccaccccgccagcgcguggacccuguacgccguugcgacgaccgugauuacgcccaugcugcgacacaccaucgagaacuccacagccaacgugagccucgccgccauagccaaccaggcagucgugcugauggggcuggacaagggcuggccgaucuccaagauggaccucggggugccccugcuggcgcucggcugcuacucccaggucaaccccuuaacccugacggccgccguccucuuacucauuacccacuaugccaucaucggccccggguuacaggcgaaggccacccgggaggcacagaagcgcaccgccgccggcaucaugaagaacccgacuguggacgggaucaugaccaucgaccuggaccccgucauuuacgacuccaaguucgagaagcaacugggccaggugauguuacuggugcugugcgcgguccagcuccuccugaugcggaccagcugggcacuaugcgaggcccugacccuggccacgggcccaaucaccacccucugggaggggucccccggcaaguucuggaacaccacaaucgccgugucuauggcaaacauauuucgcggguccuaccuggccggcgccgggcuggcuuucagcauuaugaaguccgugggcaccggcaagcgggguacagggagccagggggagacccuaggagagaaguggaaaaagaagcuaaaccaacugagcagaaaggacuuugaccucuauaagaaguccgguaucacugaggucgaccggacggaggcuaaggagggacugaagcgcggcgagaucacccaccacgccgugagucgggguuccgcuaagcugcagugguucguggaacgcaauauggucaucccggagggccggguaauugaucucgggugcgggcgggggggguggagcuacuacugcgccggccuaaagaagguuaccgagguccggggcuacaccaagggcgggcccggccacgaggagcccgugcccaugucaacguacggguggaacaucgugaagcugaugagcggaaaagacgucuucuaucucccgcccgagaaaugcgacacccugcugugcgacaucggcgaguccagccccagccccacaguugaggagagccgaaccauccgcgugcugaagauggucgagccguggcucaagaacaaccaguucugcaucaaggugcugaaccccuacaugcccacggugauugagcaccuggagcggcuacaacgcaagcacgggggcaugcugguccggaauccacugucccgcaacucuacccacgagauguauuggaucuccaacgggaccgggaacauaguagccagcguaaacauggucagccggcuccugcugaacagauucaccaugacgcacagacguccgacaaucgagaaagauguggaccucggggcggggacccggcacguuaaugccgagcccgagacccccaacauggacgucaucggcgagcgcaucaaacggaucaaagaggagcacaacucaaccuggcacuacgacgacgagaacccguacaagaccugggcauaucacggguccuacgaggucaaagccaccggcagcgccaguagcaugaucaacgggguggucaagcugcugacaaagcccugggacgucgugcccauggugacgcaaauggcgaugaccgacaccaccccuuucggccagcagcgcguguucaaggagaaaguggacacacggaccccgcgcagcaugcccgggacccggcgcgugauggggaucaccgccgaguggcucuggcggacacuaggccgcaacaaaaagccaaggcugugcacuagggaagaguucaccaagaagguccgcaccaacgcagccaugggggcggucuucacggaggagaaccaaugggauuccgccaaggccgccguggaggacgaggacuucuggaaguuagucgaccgggaaagggaguuacacaaauuggguaagugcgggagcugcgucuacaacaugaugggcaaacgggagaagaaguugggcgaguuuggaaaagccaagggcagccgcgcgaucugguauauguggcugggggcccgguaccuggaguucgaagcccucggcuuccuaaacgaagaucauugguucagccgcgagaacucguacagcgggguugaaggagaaggcuuacacaaacucggguauauucugcgagacaucucgaagauucccggcggggccauguacgcggacgacaccgcgggcugggacacccgaauaaccgaggacgaccugcacaacgaggagaagaucacgcagcagauggacccggagcaccggcaguuagccaaugccaucuucaaacucaccuaccaaaacaaggucgucaaggugcagcgccccaccccaaccggcaccgugauggauaucaucagucggaaggaccagcgcggguccggccagguggguacguacggccugaacaccuucacuaacauggaggcccagcugaucaggcaaauggagggggagggcguccuaagcaaggccgaucuggagaacccccaucucccggagaagaagauaacccaguggcuggaaacgaagggcguagagcgccugaagcggauggccaucuccggggacgacugcgucgugaaacccaucgacgaccguuucgcuaacgccuuacuggcccugaaugacaugggcaaaguccggaaggacaucccccaguggcagccaagcaagggguggcacgauuggcaacaagucccguucugcucacaucacuuccacgagcucaucaugaaggacggccgcaagcugguggugcccugcagaccccaggacgaacugauagggcgugcucggaucucacaaggcgcgggcuggucccuuaaggagaccgcaugccuugguaaagccuacgcccagauguggagccugauguacuuccaccgccgcgaccuacggcuggcguccaacgccaucugcagcgccgucccggugcacuggguaccgaccucccgcaccacauggucgauccacgcccaccaccaauggaugaccaccgaggacaugcuuaccgucuggaaccggguguggaucgaggacaaccccuggauggaggacaagacgcccgugacgacuugggagaauguacccuacuuagguaaacgcgaagaccaguggugugggagcuugaucggucugaccagccgggccacgugggcgcagaacaucccgaccgccauacagcaagugcgcagccucaucgggaacgaggaguuccuagauuacaugccuuccaugaagcgauuccguaaggaggaggagagcgagggugccaucugguga

SEQ ID NO: 25811 - RNA, 9873 nt, Artificial Sequence
  derived and/or modified CDS sequence (opt11) from DENV-3__GQ199870__SS-prME
accagccucugccucaugaugauccugcccgccgcccucgcguuccaccucaccagccgggacggagagccccggaugauuguggggaagaacgagcgcggcaaaagccugcuguucaagaccgccuccgggaucaacaugugcacacucaucgcgauggaccuuggcgagaugugugacgacaccgugaccuacaaguguccccacaucaccgagguggagcccgaggacaucgacugcuggugcaaccugaccuccaccugggugaccuacgggaccugcaaucaggccggagagcaccggcgcgacaagcgcuccguggcccucgcgccccacgugggcauggggcuggacacccgcacccaaaccuggaugagcgccgagggcgccuggcgccagguggagaaaguagagacgugggcccugcgccacccgggguucaccauccuggcgcuguuccuggcccacuacaucgguaccuccuugacccagaagguggugaucuucauacugcugaugcucgucacgcccagcaugaccaugcggugugucggggugggcaaccgagacuucguggagggacuguccggggccaccuggguggacguuguccuggagcacggcgggugcgugacgacaauggccaagaacaagcccacccucgacaucgaacugcagaagaccgaggccacccagcuggcgacucuucguaagcugugcaucgagggcaagaucaccaauaucaccaccgacagccgcugccccacucagggagaggccacccugccggaggaacaggaccagaacuacguuugcaagcacaccuacgucgaccggggguggggcaacgggugcggccucuuuggcaagggcucccuggugaccugcgccaaguuccagugccuggagcccauugagggcaagguuguucaguacgagaaccuaaaguacacggugaucaucaccgugcacaccggcgaucaacaccaggucggcaacgagacccaaggggugacggccgagaucacgccccaggcgagcaccaccgaggcgauacugcccgaguacggcacccuggggcucgagugcuccccgcgcacgggccuggacuucaacgagaugaucuuacucaccaugaaaaacaaggccuggaugguccaccggcagugguucuuugaccugcccuugccuuggaccagcggcgccaccacggagacccccaccuggaaccgcaaagaguuacuggugaccuucaagaaugcacacgccaagaagcaggagguggucgugcuggggucccaggagggcgcgaugcauacagcccucaccggggccaccgaaauccagaacagcggcgguaccuccaucuucgccggccaccuaaagugccggcugaagauggacaagcuugaacucaagggcaugucauacgccaugugcacgaacaccuucguguuaaagaaggaggucuccgagacccagcacgguaccauccuuauaaagguggaguauaagggugaggacgugccgugcaagaucccuuucucaacggaggacgggcaggguaaggcgcacaacggcagacugauaacugcgaaccccgucguuacgaagaaggaggagcccguuaauaucgaggccgagccgcccuucggggaaagcaacaucgucaucggcaucggagacaacgcccugaagauuaacugguacaaaaagggcaguagcaucgggaagauguucgaggcaaccgcccguggcgcccgccggauggccauacugggcgacacggccugggacuucggguccgugggcggugugcucaauucucugggcaagaugguccaccagaucuucgguucugcguauaccgcccuguucucgggcgucuccugggugaugaagaucggaauugggguccuccuuacauggauaggccugaacagcaagaacaccaguaugagcuucuccugcaucgccaucggcaucaucacccucuaccugggcgccgugguacaggccgauauggggugcgucauuaacuggaagggcaaggagcugaagugcggaagcgggaucuucguaaccaaugaggugcacaccuggaccgaacaguacaaauuucaggcggacucccccaagagauuagccacggccaucgccggagccugggagaacggggucugcggcauccgcagcaccaccaggauggagaaccugcuguggaagcagaucgcgaacgagcucaacuauaucuugugggagaacaacaucaagcugaccguaguggucggggacaucaucggcgugcucgagcagggcaagcgcacacuuacgccccagccgauggagcugaaguacuccuggaagaccugggggaaagccaagaucgugaccgccgagacacagaacagcuccuucaucaucgacggcccuaacacccccgagugccccagugucucccgggccuggaacguaugggagguggaggacuacggguuuggugucuucaccaccaacaucuggcucaagcugcgcgaggucuacacccagcugugugaccaccggcucaugagcgcggccgugaaggaugagcgcgccguccaugccgacaugggcuacuggaucgagagccagaagaacggguccuggaagcuggaaaaggccagccugaucgaggugaagacaugcacguggccgaagucacacaccuuauggagcaacggcgugcuggaguccgacaugaucauccccaagagccuggcagggcccaucucccagcacaaccaccggccgggguaccacacccagacggccgggcccuggcacuuaggcaaacuggagcuggacuucaacuacugugagggaacaaccguagugaucaccgagaacugcgggacaagaggccccagccuccggaccacgaccguguccgggaagcugauccacgaguggugcugccgcagcugcacgcuucccccgcuccgguacaugggcgaagacggcugcugguacggcauggagauucgcccuauaagugagaaggaggagaacauggucaaaagcuuagugagugcgggcagcgggaagguggacaacuucacuaugggcgugcuaugccuugccauccuguucgaggagguaaugcgugggaaguucggcaagaagcacaugaucgccgggguguucuucaccuucguccugcuccuaucuggccagaucaccuggcgcgacauggcgcacacgcugaucaugaucggcagcaacgccuccgaccggauggggaugggcgugacuuaccucgcccuuaucgccaccuucaagauccagcccuuccuggcguuaggguucuucuuaagaaaacugaccucgcgggaaaaccuccugcugggcgugggccucgcgauggccacgacucugcagcugcccgaagacaucgaacagauggccaacgggaucgcccuuggccugauggcgcugaaguuaaucacccaguuugagacguaccaacuguggacagcccugaucucucugaccugcuccaauaccaucuucacccugacggucgccuggcgcaccgccacacugauccucgccggggugagccugcugccggucugccagucuagcaguaugaggaagaccgacuggcuccccauggcaguggcggcgaugggcgugccaccccucccgcuguucauauucgggcucaaggacacgcucaagcgccgcaguuggccccugaacgagggcgucauggccgugggccucguguccauccuugccucaucccugcuccggaacgacguccccauggcagggccccugguugccggcgggcugcucaucgcaugcuacgugauaaccggcaccagugccgaccugacugucgagaaggccgcugacaucacuugggaggaggaggccgagcagaccggggugucccacaaccuaaugaucaccguggacgacgacggcaccaugcgcaucaaggaugacgaaaccgagaacauccuuacgguccugcugaaaaccgcccuucugaucgugagcggcaucuucccguacuccauacccgccacccugcucguguggcacacauggcagaagcagacgcagcggagcgggguccugugggacgugcccagcccgccggagacccagaaggccgagcuggaggagggcguuuaccgcaucaagcagcaggggauauucggcaagacccaggucggggugggcguucaaaaggagggggucuuccacaccauguggcacgugacgcgcggggccgugcucacguauaacgggaagcgccuggagcccaacugggccagcguuaagaaggaccugaucuccuacgggggcggauggcggcucagcgcccaguggcaaaagggcgaggagguccaggugauugccguggagcccggcaagaaccccaagaacuuccagacaaugcccgggaccuuucagacgaccaccggagaaaucggcgcgauugcccuggacuucaagcccggcaccaguggcagucccaucauuaaccgcgaggggaagguggugggccuguacgguaacggugucgugaccaagaacggcggcuacgugagcggcaucgcccaaaccaacgccgagccggaugggcccacccccgaacuggaggaggagauguucaagaagaggaaccucaccaucauggaccugcacccuggcuccgggaagacgcgcaaguaccugccagccaucguucgggaagcgauaaagcgccggcuccgcacccugauccuggcacccacccgggugguggccgccgaaauggaggaggcucucaaggggcugcccauccgcuaccaaaccacggcgaccaagagugagcacaccgggcgggagaucgucgaucugaugugccacgccaccuucacgaugcgccuucuaucccccgugcgcgugccgaacuacaaccugauaaucauggacgaggcccacuucacggaccccgccucaaucgccgcgcgcggcuacaucuccacccgggucggcaugggggaggccgccgccaucuuuaugaccgcgacgccgcccgggaccgccgacgccuuuccucagagcaacgcccccauccaggaugaggagcgcgacauccccgaacgcuccuggaacagcggaaaugaguggaucacggauuuugccggcaagaccgugugguucgugcccuccaucaaggcggguaacgacaucgccaacugccuacggaagaacgggaagaaggucauccagcugagccgcaagacguucgacaccgaguaccaaaagaccaagcugaacgacugggacuucguggugaccacggacaucuccgagaugggcgccaacuucaaagccgaccggguuauagacccccgccgcugccucaagccagugauccucaccgacgggcccgagcgcgugauccuggccggccccaugccggucaccgcggccagcgccgcucagcggcgagggcggguggggcgcaacccccagaaggaaaacgaccaguacaucuucaccgggcagccccucaacaacgacgaggaccacgcccacuggaccgaggcuaagaugcuacuggacaauaucaauacucccgaggguaucaucccggcccuauucgagcccgagcgggaaaaguccgccgccaucgacggcgaguacaggcugaagggggagagucggaagaccuucguggagcugaugcgccgaggcgaccuccccguguggcuggcgcacaagguggccuccgaggggaucaaguacaccgaccgcaaguggugcuucgacggccagcggaacaaccaaauacuggaagagaacauggacgucgaaaucuggaccaaggagggcgagaagaagaagcuccgcccccgguggcuggacgcccgcacguacuccgacccgcuggcccucaaggaauucaaagaguucgccgcggggcgcaaguccaucgcccuggaccuggugaccgagaucggcagagugcccucgcaccucgcucaccgcacucggaacgcuuuggauaaccuggucaugcuucacaccuccgagcacgggggccgggccuaccgucacgcgguggaggaacuacccgagacgauggagacccugcuccugcuugggcucaugauccugcugacgggcggagccauguuauuccugaucucagggaagggcaucggaaagaccagcaucggcuugaucugcgugauugcguccagcgggaugcucuggauggccgagaucccgcugcaauggauugccuccgcgauuguccuugaguucuucaugauggugcuccugauccccgagcccgaaaagcagcgcacgccccaggacaaccagcucgccuauguggucaucggcauccucacccuugccgccaucauagccgcgaacgagaugggcuuauuagagaccacuaagcgagacuuagggaugagcaaggagccgggugucgugucccccacgagcuaccuggaugucgaccuccacccggccuccgccuggacccuguaugccguggcaaccaccgugaucacgcccaugcuccgacacacuaucgagaauuccaccgcaaacgucucccucgccgccauagccaaccaggcgguggugcugaugggguuggacaagggauggcccaucagcaagauggaccucgggguccccuugcuggcccucggcugcuacucccaggugaacccccugacccugacggccgccgugcuacuccugaucacacacuacgccaucauaggccccgggcuccaggccaaggccacccgggaagcccagaagcgcaccgcugcugggaucaugaagaacccgacggucgacgggaucaugaccaucgaccuggaccccgugaucuacgacagcaaguucgagaagcaguugggccaggugaugcuccugguccugugcgcagugcaacuccugcugaugcggacgaguugggcccugugcgaggcccugacccuagccacgggaccaaucaccacccucugggaggggagccccggcaaguucuggaacacuacgaucgcgguguccauggccaacaucuuccgcgggucuuaccuggcuggcgccgggcuggcguucuccaucaugaaauccgucggcaccggcaagcgggggacgggcucccagggggaaacccucggcgagaaguggaagaagaagcugaaccagcugucccgcaaggacuucgacuuguacaagaaguccgggaucaccgagguagaccggacggaggcgaaggagggccugaagaggggcgaaaucacccaccacgccguguccagagguagcgccaaacugcagugguucgucgagcgcaacauggugaucccggagggccgggugaucgaccucgggugcggccgcgggggcugguccuacuacugcgccggccugaagaaggucaccgaggugagaggguacaccaagggcgggcccggccacgaggagcccguccccaugagcacguacggguggaacaucgucaagcugauguccgggaaggacguguuuuacuuaccucccgagaagugcgacacucugcugugcgacaucggugagagcucccccagccccacaguggaggaguccagaaccauccgcguccugaagaugguggaaccguggcuaaagaacaaccaguucugcaucaaggugcugaaccccuauaugccuacggucaucgaacaccuggagcgauuacagcgcaagcacgggggcaugcuggugcggaacccccugagccgcaacuccacccacgagaugucuuggaucuccaacgggaccggcaacaucguggccagcgucaacauggugagucggcucuuacugaaccguaguaccaugacgcaccggagaccgaccaucgaaaaggacguggaccucggcgcggggccucgccacgucaacgccgacccggagccgcccaacauggacgugaucggcgagcggaucaagcgaguaaaggaggagcauaacaguaccuggcacuacgacgacgagaauccuuacaagaccugggcuuaccaugggagcuacgaggugaaggccacaggcuccgccagcagcaugauaaaugggguugucaagcugcugaccaagccgugggacguugugccuauggugccccagauggcaaugaccgacaccacgccguucggccagcagcgcguauucaaggagaagguggacacacggaccccccgguccaucccgggcacccggcgcgucauggggauaacggcugaguggcucuggcggacccugggacggaacaagaagccacggcugugcacccgcgaggaauucaccaagaaggugcgcacgaacgccgcaaugggggcgguguucaccgaggagaaccagugggacagcgccaaggccgccgucgaggacgaggacuuuuggaagcucguggaccgggagcgcgaacuccauaagcugggcaaaugcggguccugcguguacaacaugaugggcaagcgggagaagaagcucggcgaguucgggaaagccaagggcucucgcgccaucugguacauguggcugggggcccgguaucuggaguucgaggcccucggguuccugaacgaggaccacugguucucccgcgagaacagcuacuccggugucgagggcgagggccuacacaagcucggguacauccugcgggacaucuccaagauccccggcggggccauguacgcugaugacaccgcgggcugggacacccgcauaacggaggaugaccugcacaacgaggagaagaucacacagcagauggaccccgagcaccggcagcucgcaaaugccaucuucaagcugacauaccagaacaagguggugaagguccagcgcccuacaccgacgggcaccgugauggacaucauaucccgcaaagaccagcgcgggucuggccagguggggacuuacggccugaacaccuucacuaauauggaggcccaguuaauccggcagauggagggggagggcguccuguccaaggcggaccuggagaacccccauuuacccgagaagaagaucacgcaguggcuggagaccaagggcguggagcgccugaagcggauggcgaucagcggggaugacuguguggucaagccaaucgaugaccgcuucgccaaugcccuccuggcccugaacgauauggggaaggugcguaaggacauuccucaguggcagccauccaagggguggcacgacuggcagcagguccccuucugcagccaccacuuccacgagcucaucaugaaggacggccgcaagcugguagugccgugccggccccaggacgagcugaucggacgcgcccggaucucccagggcgcgggcuggagccucaaagagacagccugccuggggaaggccuaugcccagauguggucccugauguacuuccaccgccgcgauuugcggcuagccucuaaugccaucugcuccgccgugcccguccacuggguuccaaccagccgcaccacuuggagcauccacgcccaccaccaguggaugaccaccgaggacaugcugaccguguggaaccggguguggauagaggacaauccguggauggaggacaagaccccugugaccacgugggagaacgugcccuaccucggcaaacgcgaggaucaguggugugggucccuaaucggacugacgagcagggccaccugggcgcagaacauuccgaccgccauccagcagguccgcucccucaucgggaacgaagaguuccuggacuacaugcccagcaugaagcgguuccgcaaggaggaggaguccgagggggcgaucugguga

SEQ ID NO: 25812 - RNA, 9873 nt, Artificial Sequence
  derived and/or modified CDS sequence (opt11) from DENV-3__JF937630__SS-prME
accagccugugcuugaugaugauccugcccgccgcccuagcguuucaccucaccagccgggacggggagccccggaugaucgugggaaagaacgaacggggcaagagcuugcuguucaagaccgccuccgggaucaacaugugcacucucaucgccauggaccugggugaaaugugcgacgauacugugaccuacaaaugcccacacaucaccgagguggagcccgaggacaucgauugcuggugcaaccugaccagcaccugggugaccuacgggaccugcaaccaggccggagaacaccggcgcgacaagcggucuguggcuuuagcgccccacguggguauggggcuggauaccagaacgcagaccuggaugagcgcagagggcgcguggcgucaaguggagaagguugagacgugggcucugaggcacccaggguuuaccaucuuagcgcuguuccuggcccacuacaucggcaccucccuuacccagaagguggugauauucauccuccuaaugcuggucacgccgagcaugacuaugcgaugcguaggggucggcaaccgcgacuucguggagggucuguccggggccacguggguggacgugguccuagagcacggcgggugcgugaccacgauggccaagaacaagcccacucuggacauugaauuacagaagaccgaggccacccagcuagcgacgcuccggaagcuguguaucgagggcaagaucaccaauauaaccacugacagccgcuguccaacucagggcgaggcaacccugccggaggagcaggaccagaacuauguguguaaacauaccuacguugaccgggguugggggaacgggugcggccucuucgggaagggcucccugguuaccugugccaaauuccaaugccuggaaccuaucgagggcaaggugguccaguacgagaaccucaaauacacggugaucauuaccgugcacaccggggaccagcaccagguaggaaaugagacucagggggugacggccgagaucacgccccaggccucuaccaccgaggcgauccugcccgaauacggcacacucgggcuugagugcuccccgaggacgggccuggauuucaaugagaugauccugcucaccaugaagaacaaggccuggaugguacaccggcagugguuuuucgacuuacccuugcccuggacaagcggugccaccacggagaccccuacauggaaccguaaggagcuacuggugaccuucaagaaugcccacgccaagaagcaggagguggucgugcuagggagucaggagggcgcgaugcacacggcccucaccggggcuacggagauucagaacucuggcgggaccuccaucuucgccgggcaucugaagugucgacugaaaauggauaagcucgaguugaagggaaugagcuacgccauguguacgaacgcauucgugcugaagaaggaagucagugagacccagcacgggaccauccuuaucaagguggaguacaagggcgaggacgugccgugcaaaauccccuucagcaccgaggacgggcaggguaaggcccacaacggccgccugaucacggcuaacccagucgucaccaagaaggaggagccuguuaacaucgaagccgagccgcccuucggggaaagcaacaucgucauuggcauaggggacaacgcucugaagaucaacugguauaagaaaggcuccucuauugggaaaauguucgaggccaccgcgcggggcgcccgccggauggccauccugggagacacggcgugggacuucggguccguggggggcguuuugaacagccugggcaagaugguccaccagaucuucggguccgccuacacggcccuuuuuagcggcguguccugggugaugaagaucggcaucggcguccuccugacauggauagggcugaacagcaagaacaccuccaugagcuucucaugcauagccaucgggaucaucacccucuaccugggcgccguggugcaagcugacauggggugcgucaucaacuggaaggggaaggaacugaagugcggcagcgguaucuucgugacgaacgaggugcacaccuggacggagcaguacaaguuucaagcagacucccccaaaagacuugccaccgccaucgcgggcgcuugggagaacggugucugcggcauccgaucgacaacacggauggagaaccuucuguggaagcagaucgccaaugagcuaaauuauaucuugugggagaacaacaucaagcugaccgugguggucggggacaucaucggcgugcucgagcagggcaagagaacacucacaccccagccgauggagcugaaauacuccuggaagaccuggggcaaggccaaaaucgugaccgcagagacccagaauagcucauuuaucaucgacggcccgaacacacccgagugcccgagcgugucacgggcguggaacgugugggagguggaggacuacggguucggaguguucaccaccaacaucuggcugaaguugcgcgaaguguacacccagcucugcgaccacaggcuaaugagcgccgcgguuaaggacgagcgugccguccacgccgacaugggcuacuggaucgagagccagaagaacgguuccuggaaacuggagaaggcgagccugaucgaggugaaaacaugcacguggccgaagucccauacccucuggagcaacggcguccuggaauccgacaugauuauccccaagagccuggcaggucccaucucccaacacaaucaccggcccgguuaccacacccagaccgccggccccuggcaucucggcaagcuggagcuugauuuuaauuacugcgagggcacgaccgucgugaucacggaaaacugugggacgcgcggccccaguuuacggaccacuaccguguccgggaagcugauccacgaguggugcugccgcagcugcacucugcccccgcuccgguacaugggcgaggaugggugcugguacggcauggagauacgccccauuuccgagaaggaggagaacauggucaagagcuugguguccgcgggcagcgggaaaguggacaauuucacaaugggcguucugugccucgccauacuguucgaagaggugaugcgggggaaauucgguaagaagcauaugaucgcggggguguucuucaccuucguacugcuccuaucgggccagauuaccuggagggauauggcgcacacccugaucaugaucggcucgaacgcaucagaccggauggguaugggcgugacauaucuugccuugauagcgaccuucaagauucagccuuuccuggcgcucgguuucuuccugcgaaagcugacaagccgggagaaccucuuacucggcgugggccuagccauggccaccacucuacagcugcccgaggacaucgagcagauggccaacgggauagcacugggccugauggccuugaagcucauaacccaauucgagaccuaccaacuguggacugccuugaucagccucacgugcagcaacaccaucuucacacugaccgucgccuggcgcacagccacucugauccuagcgggggugagccugcugccggucugccaguccagcuccaugcggaaaaccgacugguuacccauggcuguugccgcgaugggugugccgccccucccgcuuuuuaucuuuagcuuaaaggauacucucaagcgacgguccuggccacugaaugagggggucauggccguaggccucguuagcauccuggcguccucccugcuccggaacgacguacccauggccggcccccugguggccgggggacuacuaauugcuuguuacguuaucaccgggaccuccgcggaccugaccgucgagaaggcggcagacauaaccugggaggaggaagcggagcagacgggaguaagccacaaucuaaugaucacaguggacgaugaugggacaaugcgcauuaaggacgacgagaccgagaacaucuugacugugcuguugaagacggcccuccugauugugaguggaauuuucccguauucuaucccagccaccuugcucguguggcacacguggcagaagcagacccagcguuccggcguguuaugggacgugccgagcccacccgagacacagaaagcggagcuggaggagggggucuaccgcaucaagcagcagggcauuuucgggaaaacacaagucggggugggggugcaaaaggaaggcguuuuccacaccauguggcacgugaccagaggcgcugugcucacguacaacgguaagaggcuggagccgaacugggccuccgucaagaaggaccugaucagcuacggcgguggcuggcgucucuccgcccaguggcagaagggggaggaggugcaagucaucgcugucgaacccggcaagaaccccaagaacuuccagacuaugcccgggaccuuccagaccacgaccggggagaucggcgccaucgcccuggacuuuaagcccgggaccucaggaucaccaaucauaaaucgcgagggcaaaguugucggucuguacggcaacggagucguaaccaaaaauggcggguacguuucgggcauagcgcagacgaacgccgagccggaugguccuacccccgaguuagaggaggagauguucaagaagagaaauuuaaccaucauggaccugcaucccggaagcggcaagacccguaaguaccugccggcgaucguucgcgaggccaucaagaggcggcuccgcacucugauauuagcccccacccggguaguggccgccgagauggaggaagcgcucaaggggcuucccauccgcuaccagaccaccgccacgaaauccgaacacacaggccgggagaucgucgaccugaugugccacgccacuuucaccaugcgccuacugagucccgugcgggugccgaacuacaaccugauaaucauggaugaggcccacuucacggacccagccuccauagcggcccgcggguacaucaguacccgggucggcaugggcgaggccgccgcgaucuucaugaccgccacgccgccagggacggcagacgccuucccucaaaguaacgcgcccauccaggacgaggagagggauauccccgagcgcuccuggaacuccggcaacgaguggaucaccgauuucgcgggaaagaccgugugguucgugcccagcaucaaggccgggaacgauauugccaacugccuacggaagaacgguaagaaggucauccagcugucccgcaagaccuucgacacggaguaccaaaagacaaagcuuaacgacugggacuucgucguaaccaccgacaucuccgaaaugggcgccaacuucaaagccgaccgggucaucgacccgcgccggugccucaagcccgugauccucacggacggccccgagcgagugauccuggcggggcccaugccggucaccgccgcuuccgccgcacagcggcgaggccgggucggccgcaacccccaaaaggagaacgaccaguacaucuucaccgggcagcccuuaaacaacgacgaggaucacgcgcacuggaccgaggccaagaugcugcuggacaacaucaacacccccgagggaaucaucccggcccucuucgagcccgaacgggagaaguccgcugcgaucgacggcgaguauaggcugaagggcgaaucccggaaaacguuugucgagcugaugcgccgcggggaucuccccgucuggcuugcccauaagguggcuagcgagggcaucaaguacaccgaccgcaaguggugcuucgacggccaaagaaacaaccagauucuggaggagaacauggacgucgagaucuggacaaaggagggcgagaagaagaagcugaggccccgguggcuggaugcucgcaccuauucugauccgcuggcccugaaggaguucaaggaauuugcggcagggcgaaaaagcaucgcccuggaccuggugacggagaucgggcgggugcccucccacuuagcccaucgcacccggaacgcccuggacaaccuggucaugcuccacaccagcgaacacgguggucgcgcguaucggcacgccgucgaggaacugcccgagaccauggagacgcugcuccuacugggacucaugaucuuacugaccggcggcgcuaugcuguuccugaucucuggcaaggggaucgguaaaacauccaucggccuaaucugcgugaucgccucgagcggcaugcucuggauggcagagaucccgcuacaguggauagcgagugccaucguccuggaguucuuuaugauggugcuccugauccccgagcccgagaagcagcgaacgccgcaggauaaccagcuggccuacguugucaucgggauccucacguuagcagcgaucauugcggccaacgagaugggcuuacucgagaccaccaagcgggaccuagguauguccaaggagccaggugugguuagccccaccuccuacuuagacgucgaccuccacccggccagcgccuggacgcuauaugcggucgccaccaccgugaucacccccaugcuacgccauacgaucgagaauuccacugcaaacgucagcuuagccgcuaucgcgaaucaggccguaguacugaugggucuggacaagggguggccgauuuccaagauggaucucggcguaccccugcuggcgcucgggugcuauagccaggugaauccgcugacccugacggccgccgugcuccuauuaaucacgcacuacgcgaucaucgggccgggccuucaggccaaggcgacacgggaagcgcagaagcgcaccgccgcgggaauuaugaaaaacccgaccgucgacgggauuaugacgaucgaccuggaccccgugaucuaugacuccaaguucgagaagcagcucggucaggugaugcucuuggugcugugcgcugugcagcuccuguuaaugcggacgagcugggcccucugcgaggcccucacccuggcgaccggcccaaucacgacccucugggaaggcagccccgggaaguucuggaauaccaccaucgccgugucuauggccaacaucuuccggggcuccuaccuugccggggccggacuggcguuuucuaucaugaaauccgucgggacggguaaacgggguaccgggagccagggcgagacccucggggagaaguggaagaagaaacugaaccaacugagccgcaaggacuucgaccucuacaagaaguccggaaucacagagguagaccgcaccgaggccaaggaggggcugaagcgcggcgaaauuacgcaccaugccgugagccggggcuccgcgaagcugcagugguucgucgagcgcaacauggugaucccugaggggcgggugaucgaccuaggcugcgggcgcgggggauggagcuacuacugcgccggccugaagaaggucaccgaggugcggggcuacaccaaaggcgggccggggcaugaggaacccgugcccauguccaccuacggcuggaacauugucaaacugaugagcgggaaagacguguucuaccugccgcccgagaaaugugacacguugcugugcgacaucggagaguccagucccagucccacgguggaggagucacggacuauccgcguuuuaaaaaugguggagccuuggcucaagaacaaccaguuuugcaucaaggugcugaacccauacaugcccaccgucaucgagcaccuggagcgacuccagcgcaagcacggcgggauguuagugcggaacccgcugucccgcaacagcacgcacgagauguacuggaucuccaacggcaccggcaacauaguggcguccgucaauauggugucccgucucuuacugaaccgcuucaccaugacucaccggcggccgacgaucgagaaggacguagauuugggcgccgguacccggcacgucaacgccgagcccgagacacccaacauggacguaaucggugagcgcaucaagcgcaucaaggaggagcacaacagcacguggcacuacgaugacgagaacccguacaaaacgugggccuaccacggcuccuacgaagucaaggccacggggagcgcuuccucgaugaucaacggagucgugaagcugcugacaaagccuugggacguugugcccauggugacccagauggccaugacggacaccacccccuucggccagcaacgcgucuucaaggagaagguggacacccggaccccgcgcagcaugcccggaacccgucgcgugaugggcauaaccgccgaguggcucuggcguacucuggggcgcaacaagaaaccccggcugugcacgcgcgaggaguucaccaagaagguaagaaccaacgccgcgaugggcgcaguguucaccgaggagaaccagugggauuccgccaaggccgccgucgaggacgaggacuucuggaaacucguggaccgagagcgagagcugcauaagcuggggaaguguggcagcugcguguacaacaugauggggaagcgggagaagaagcucggcgaguuuggcaaggcaaaggggagcagggcuaucugguacauguggcugggcgcgcgcuaccuugaguucgaggcguugggguuccucaacgaggaccacugguucagccgcgagaauucuuacucgggcgucgagggggaaggccugcacaaguugggcuauauccugcgggacaucaguaagauccccgggggagccauguacgcagacgacacggcggggugggacaccagaaucaccgaggaugacuugcacaacgaggaaaagaucacccagcaaauggacccggagcaccggcaacucgccaacgcaaucuucaagcuaacguaucaaaacaaggucgugaagguccaacgccccacccccaccggcaccgucauggacauaaucagccggaaagaucagcggggcuccggccagguaggcaccuacggauugaacacuuucaccaacauggaggcgcagcucauccggcagauggaaggcgaaggugugcucagcaaggcggaccuggagaacccacaccugccagagaagaagaucacccaguggcuggagaccaagggcgucgagcgccugaagcggauggccauuuccggugacgauugcguggugaaaccuaucgacgaccgguucgccaacgcccuccuggcccugaacgacauggggaaagucagaaaagacaucccccaguggcagcccucaaagggcuggcacgacuggcagcagguaccguucugcucccaccacuuucacgaguuaaucaugaaggacgggcgaaagcugguggugcccugucgaccgcaggacgagcugaucggcagagcgcggaucagccagggagccggcuggucccuuaaggagacggccugccugggcaaggccuacgcccaaauguggagccugauguacuuucacagacgagaccuccgccuggcauccaacgccaucugcuccgcuguccccgugcacugggucccgaccagcaggacaacauggucuauccacgcccaccaccaguggaugacaacugaggacaugcugaccgucuggaaccgugucuggauugaggacaacccuuggauggaggacaagacccccguuacgaccugggagaauguccccuaucugggcaagcgagaggaccaguggugcggcucucuaaucggauuaaccucgcgggcgaccugggcacagaacauuccgacggccauccaacagguccgcucauugaucggaaaugaagaguucuuagacuacaugcccuccaugaagagguuccgcaaggaggaggagagcgagggagccauaugguga

SEQ ID NO: 25813 - RNA, 9873 nt, Artificial Sequence
  derived and/or modified CDS sequence (opt11) from DENV-3__JN000936__SS-prME
accagcuugugccucaugaugauccugccggccgcccuggcguuccacuuaaccagccgagacggagagccccggaugaucguggggaagaacgagcgcggcaagagccugcuguucaagaccgccuccgggaucaacaugugcacccucaucgcaauggaccucggggagaugugcgacgauacggugaccuacaagugcccccacaucacagagguggagccggaggacaucgacugcuggugcaaccucaccucgaccugggugaccuacgggacgugcaaccaggccggcgagcaccggcgcgauaagcgguccguggcccuugccccccacguggguauggguuuggacacccgcacccagaccuggaugagcgcugagggcgccuggcgccagguggaaaagguggagaccugggcccugcgucacccgggguucaccaucuuagcgcuguuccuggcgcacuacaucgggaccucacucacccagaagguugugaucuucauccugcugaugcucgucacgcccagcaugaccaugcggugcgugggggugggcaaccgugacuuugucgagggccuguccggggccaccuggguggacgugguccuggagcacggcgggugcgugaccacgauggcuaagaacaagcccacccucgacaucgaacugcagaagaccgaagccacccagcuggcgacguugcggaaacugugcaucgagggcaagaucaccaacaucaccaccgacagccgcugccccacgcagggcgaggccacccugccggaggagcaggaccaaaacuacgugugcaaacacaccuauguagaccggggguggggcaacgggugcggccuauucgggaagggcucccuggugaccugcgccaaguuucaaugccuugagcccaucgagggcaaggugguccaguacgagaaccucaaguacacagugaucaucaccgugcacaccggggaccagcaccaggucgggaacgagacccagggugugacggccgaaaucacgccccaggccagcaccaccgaggccauccugcccgaguacggcacgcuggggcucgagugcuccccgcgcacgggccuugacuucaacgagaugauacugcucaccaugaagaauaaggccuggaugguccaccggcagugguucuuugaccugccccugccuuggacgagcggcgccaccacggagacccccaccuggaaccgcaaggagcuccuggugaccuucaagaacgcgcacgccaagaagcaagagguggucgugcugggcagccaggagggcgcgaugcacacggcccucaccggggcuaccgagauccagaacagcggcgggaccuccauuuucgccggccaucuuaagugccggcugaagauggacaagcuugagcugaagggcaugagcuacgccaugugcacgaacaccuucgugcugaagaaggaggucuccgaaacccagcacgggacgauccuuaucaagguggaguacaagggcgaggacgugccgugcaagauacccuucagcacugaagaugggcagggcaaggcgcauaacggccgccugaucacagccaacccagucgugaccaaaaaggaggagcccgugaacaucgaggcggagccgcccuucggggagagcaacaucgucaucggcauaggggacaacgcucugaagaucaacugguacaagaagggcuccagcaucgggaagauguuugaggccaccgcccggggcgcccggcgcauggcaauccugggcgacacggccugggacuuuggguccgugggcgggguucugaacagccugggcaagaugguccaccagaucuucggauccgcguacaccgcccuauucagcgggguguccugggugaugaaaauaggcaucgggguucugcugacauggaucggccugaacagcaagaacaccuccaugagcuucuccugcauugccaucggcaucaucacgcucuaccugggcgccguggugcaggccgacauggggugcgucaucaauuggaagggcaaagaacugaagugcggcagcgggaucuucgugacaaacgaggugcacaccuggaccgagcaguacaaguuccaggcggacuccccaaagcgccucgccacggccaucgccggcgccugggaaaacggggucuguggcauccgauccaccacacggauggagaaucuccuguggaaacagaucgcgaacgagcucaacuacauccuuugggagaacaacaucaagcugaccgugguggucggagacaucauuggcgugcucgagcaaggcaagcgcacucuuacuccccagccgauggagcugaaguacuccuggaagaccugggggaaggccaagaucgugacugccgaaacgcagaacagcuccuuuaucaucgacggccccaacacccccgagugccccagcgucucccgggccuggaacgugugggagguggaggacuacggguucggcgucuuuacaaccaacauauggcucaagcugcgcgagguguacacucagcuaugugaccaucgguuaaugagcgcggccguaaaggacgaacgugccguccacgccgacaugggcuauuggaucgagagccagaagaacggguccuggaaguuagagaaggccagccugaucgaggugaagacgugcaccuggccgaaaagccacaccuuguggagcaacggcguguuagaguccgacaugaucauccccaagagccuggcggggcccaucucccagcacaaucaccggcccggcuaccacacccagacggccggacccuggcaccucggcaagcuggagcuggacuucaacuauugcgagggcaccaccguugugaucaccgagaacugcgggacgaggggccccagccuccggaccaccaccguguccgggaagcugauccacgaguggugcugccgcagcugcacgcugccuccgcuccgauacaugggcgaggacgggugcugguauggaauggagauccgccccauauccgagaaagaagagaacauggucaagagccuggugagcgccggcagcgggaagguugacaauuucaccaugggcguccugugucucgcgauccuguucgaggaggugaugagagggaaauucggaaagaagcauaugauugcaggggugguguucaccuucgugcugcuccugucaggccaaauuaccuggcgggacauggcucacacgcugaucaugaucggcagcaacgccuccgaccggauggguaugggcgugaccuacuuagcccugaucgccaccuucaaaauccagcccuuucuggcccuaggauucuuccugcgaaaguuaaccagccgggagaaucuccugcugggcgucggccucgcgauggccacgacccugcagcugcccgaagacaucgagcagauggccaacgggaucgccuuaggucugauggcacugaagcucauaacucaguucgagaucuaccagcuguggacagcccugaucucgcucacgugcuccaacaccaucuucacccugaccguagccuggcgcacggccacccugauccucgccggggucucgcugcugcccaugugccaaagcagcuccaugcggaagaccgacuggcuccccauggcgguggccgccaugggcgugccgccccucccgcuguucaucuucagccucaaggauacccucaagcgacgguccuggccccugaaugagggggugauggccgugggccucgugagcauccuggccuccucgcugcuccggaacgacguccccauggccggcccccugguggccgggggccugcucaucgcauguuacgugaucaccgggaccuccgcugaccugaccgucgagaaggccgcggacaucacaugggaggaggaggccgagcagacgggcgugagucacaaccugaugaucaccguggacgaugacgggaccaugcgcauaaaggacgacgagaccgagaacauccuaaccguccugcugaagacggcccuccucaucguguccgggaucuucccguacuccauccccgcuacccugcucguguggcacaccuggcagaagcaaacccagcgcuccgggguccugugggacgugcccagcccacccgagacgcagaaggccgagcuggaggaggguguguaccgcaucaagcaacagggaaucuucgggaagacccaggucggcgugggggugcagaaggagggcgucuuccacaccauguggcacgugacccggggagcggugcucacguacaacgggaagcgccuggagcccaauugggccuccgucaagaaggaccugaucagcuacggcgggggcuggcggcucuccgcucaguggcagaagggggaggagguccaagucaucgccgucgagcccggcaagaaucccaagaacuuccagacgaugcccggcaccuuccagaccaccacgggggagauaggugccaucgcccuggacuucaagcccgggaccucuggcucccccaucauuaaccgggagggcaaggugguggggcuauacggcaacggggucgugaccaagaacggcggguacguauccggcaucgcccagacgaacgccgagccggacggacccacccccgagcuggaggaggagauguucaaaaagcggaaccucaccaucauggacuuacaccccggguccggcaaaacacgcaaguaccugccggccaucguccgugaggcgauuaagcgccggcuccgcacgcugauccuggccccgacccgggugguggccgccgagauggaggaagcccucaaggggcugcccauccgcuaucagaccaccgcgacgaaguccgaacacaccggccgggagaucgucgaccugaugugccacgccacuuucacaaugcgccuccugagccccgugcgggugccuaauuacaaccugaucaucauggacgaggcccacuucacggaccccgcgucuaucgccgcgcgaggguacaucagcacccgugucggcaugggcgaggccgccgcgaucuuuaugaccgcgaccccacccggaacggccgaugcauucccgcagucuaacgcccccauccaggacgaggagcgcgacauccccgagcgcagcuggaacagcggcaacgaauggaucaccgacuucgccgggaagacggugugguucgugcccagcaucaaagcgggcaacgacaucgccaacugccucaggaagaacgggaagaagguuauccagcucucccgcaaaaccuucgacacggaguaccagaagaccaagcugaacgacugggacuucguggugaccaccgacaucagcgagaugggcgccaacuucaaggccgacaggguuaucgacccgcgucggugccuaaagcccguaauccugacggacggccccgagcgcgugauccuggcggggcccaugccggucaccgccgccucggccgcccagcgacgcggccgggucgggcgcaacccccagaaggagaaugaccaguacaucuucaccggccagcccuugaacaacgaugaggaccacgcccacuggacugaggccaaaauguuacuggacaacauaaauacccccgaggggauaaucccagcccucuucgagcccgaaagagagaaguccgcugccaucgacggcgaguaccgccugaagggcgagucccggaagacguucguugaguugaugcgccgcggggaccuccccgucuggcuggcacacaagguggccagcgagggcaucaaguacaccgaccgcaaguggugcuucgacgggcagcggaacaaccagauccuggaggagaacauggacgucgagaucuggaccaaggagggcgagaagaagaaguuacggccccguuggcuggaugcccgcaccuacuccgauccucuggcccucaaggaauucaaggaauucgcggcgggccgcaaguccaucgcccucgaccuggugacugagaucggccgggugcccucccacuuagcgcaccguaccagaaacgcccuggacaaccuggucaugcuccacaccagcgagcacggggggcgcgccuaccggcacgcugucgaagagcugcccgagaccauggagacgcugcuccugcugggccucaugauccugcugaccgggggcgcgaugcuguucuuaaucucgggcaaggggauuggcaagaccuccaucggguuaaucugcgucaucaccagcuccgggaugcucuggauggccgagaucccgcugcaguggaucgccagcgcaaucguccuggaguucuucaugaugguccuccugauacccgagccugagaagcagcgcacgccccaggacaaccagcuggcguacguggucaucgggauccucacucuggccgccaucaucgccgccaacgagaugggucugcucgagaccacuaagagggaccugggcauguccaaggagccgggcgucgugagccccacguccuacuuagacgucgaccugcaccccgcgagcgccuggaccuuguacgccguggcuaccacggugaucacgcccaugcugagacacaccaucgaaaacuccaccgcgaacgucagccucgccgccaucgccaaccaggccguggugcugaugggccuggauaaagguuggccgauuuccaagauggaccucggcguccccuugcuggcgcugggauguuacagccaggugaacccccugacccugacggccgcgguccuccugcucaucacccacuacgccaucaucggccccggccuccaggccaaggcgacccgugaggcccagaagcgcacagccgccgggaucaugaaaaacccgacggucgacgggaucaugaccaucgaucuggacccggugaucuacgacuccaaguucgagaagcagcuuggccaggugaugcuccugguccugugcgccgugcagcuccuccugaugcggaccagcugggcgcucugcgaggcccugacucuggccacgggacccaucaccacccucugggaaggcucccccgggaaguucuggaacaccacaauagccgugagcauggcgaacaucuucagaggauccuaccuugccggggcgggcuuagccuucagcaucaugaaguccgucgggacgggcaagcgggguacggggagccaaggcgagacccuuggggagaaguggaagaagaaguugaaccagcugagcaggaaggacuucgaucucuacaagaagucaggaauuaccgagguggacaggacggaggccaaggaggggcugaagcgcggcgaaaucacccaccacgcgguaucacggggcuccgccaagcugcagugguuugucgagcgcaacauggugaucccggagggucgggugaucgaccucggcugcgggcguggcggguggagcuacuauugcgccggccugaagaaggucacugaggugcggggcuacaccaagggcgggcccggucacgaggaaccugugcccauguccacguacggcuggaacaucgucaagcugaugagcgggaaggacguguuuuaucucccgcccgagaagugcgacaccuuacugugcgacauuggcgaguccagccccagcccaaccguggaggagagccgcaccauccgcguccugaagaugguggagccauggcucaagaacaaccaguuuugcaucaaggugcugaaccccuauaugcccacggucaucgagcaucuggaacgucuccagcgcaagcacggcgggaugcucgugcggaacccccugucccgcaacagcacgcacgaaauguacuggaucucuaauggcaccgggaacaucguggccagcguaaacaugguaucgcggcuacuucucaaccgcuucaccaugacgcaccggcgcccgaccaucgagaaggacguggaccucggcgccgggacccggcacgucaacgcggagcccgagacccccaauauggacgugauuggggagcgcaucaagcggaucaaggaggagcacaacagcacguggcacuacgacgacgagaacccguauaaaaccugggcuuaucacggaagcuacgagguaaaggccaccgggagcgccuccaguaugauaaacggcgucgugaagcugcugaccaagcccugggacgucgugccuauggugacgcagauggccaugaccgacacaacccccuucgggcagcagcgcgucuucaaagagaagguggacacgcggacgccgcggagcaugcccggcacccgucgcgugaugggcaucaccgcggaguggcucuggcggacucuugggcgcaacaaaaagccccggcugugcacccgcgaggaguucaccaagaagguccgcaccaacgccgccaugggcgcaguguucacggaggagaaccagugggacuccgcgaaggccgccguggaggacgaggacuucuggaagcuagucgacagagagcgagagcugcacaagcuggggaaaugcggcucuugcguguacaacaugauggggaagcgggaaaagaaacucggcgaguucggcaaggccaaggggucccgcgccaucugguacauguggcugggcgcgcgguaccucgaguucgaggcccucggguuccugaacgaggaccacugguucagccgcgagaacaguuacagcggaguggagggggaaggccugcacaagcucggcuacauauuacgggacauuaguaagauccccgggggcgccauguacgcugacgacaccgccgggugggacacccgaaucacugaggacgaccugcauaacgaggagaagauuacgcagcagauggacccggagcaccggcagcuagccaacgcuaucuucaagcugaccuaccagaacaaggucguuaaggugcagcgccccacccccaccggcaccgucauggacaucaucagccggaaggaccagcgcggguccggucaggugggcacguacgggcugaacacguucaccaacauggaggcccagcuuauccgccagauggaaggcgagggggugcugagcaaggcagaccuggaaaacccccaccuccccgagaagaagaucacccaauggcuggagacgaagggcgucgagcgccuuaagcggauggccaucucaggcgacgacugcguggugaagcccaucgacgaccgcuucgcgaacgcccucuuagcccugaacgacaugggcaagguccggaaggauaucccgcaguggcagcccagcaagggcuggcacgacuggcagcagguaccguucugcucccaccacuuccaugagcucaucaugaaggacgggcgcaagcugguggucccaugccggccccaggacgaguuaaucggcagagcccggauaagccagggggccggcuggucccucaaggagacugcuugccugggcaaggccuacgcccagauguggagccugauguacuuccaccgccgcgaccuucgacuggcauccaacgcgaucuguagcgcugugcccgugcauuggguccccaccucccgcaccacguggagcauccacgcccaccaccaguggaugaccaccgacgacaugcuuaccguguggaaccguguguggaucgaggauaaccccuggauggaggacaagacgcccgucaccaccugggagaacgugcccuaccucgggaagcgcgaggaccaguggugcggcucacugaucgggcugaccucccgggccacaugggcccagaacaucccgaccgcgauucagcagguccgcagccucaucggcaacgaggaguuucuggacuacaugcccucuaugaagcgguuccgcaaggaggaggagagcgagggugccaucugguga

SEQ ID NO: 25814 - RNA, 9873 nt, Artificial Sequence
  derived and/or modified CDS sequence (opt11) from DENV-3__HQ541796__SS-prME
accagcuuaugccucaugaugaucuuacccgcggcccucgcuuuccaucucacuucgcgagacggcgagccgcggaugaucguggggaagaaugaacgcggcaaaagccugcuguucaaaaccgccucugggaucaacauguguacccucauagccauggaccugggcgagaugugugacgacacugugaccuacaaaugcccgcacauaaccgaagucgagcccgaagacauugacugcuggugcaaucugaccucgaccuggguuaccuacgggacgugcaaccaggccggcgagcaccggcgcgacaagcgaaguguggcccuugcgccccacguaggcauggggcucgacacccgcacacagacguggaugagugccgagggggccuggcgacaggucgagaagguggaaaccugggcccugcgucacccgggguuuaccauucucgcacucuucuuggcccacuacaucggcaccucccucacccagaaggucgugaucuucauccugcugaugcucgucacccccagcaugaccaugcgguguguuggagucgguaaccgcgacuucgucgagggucugaguggcgcgaccuggguggaugugguccucgagcacgguggaugcgugacuacgauggcuaagaacaagcccacccucgacaucgaacugcaaaagaccgaggcuacgcaacuggcgacgcuucggaagcugugcaucgaaggaaagauaaccaacauaaccaccgacucucggugucccacgcaaggggaggcaacauugccggaggagcaggaccagaacuacguaugcaagcacacauacguggaccggggguggggcaacggguguggccucuuugguaagggguccuuagugaccugcgccaaguuccagugccucgagccuaucgagggcaaggugguccaauacgagaaccucaaauauaccgugaucaucacaguacauaccggggaucagcaccagguaggaaacgaaacucagggaguaacggccgagauaacgccccaggccagcacgacagaggcgauccugcccgaguauggcacccuggggcuggagugcuccccgcgaacgggucuggacuucaacgagaugauccuguugaccaugaagaacaaggcuuggaugguccaucggcagugguucuucgacuuaccgcugccguggaccagcggcgccaccaccgaaacccccaccuggaaccgaaaggaacucuuggugacuuucaagaacgcccacgccaagaagcaggagguggucguccuggguucgcaagagggcgccaugcacacugcccucaccggggccaccgaaauccaaaacucgggcggaaccucgaucuucgccggucacuuaaagugccggcugaagauggacaagcucgagcugaagggcaugagcuaugccaugugcacgaacaccuuuguccugaagaaggaggucuccgagacccagcacgggaccaucuuaaucaagguugaguacaagggcgaggaugugccguguaagauccccuucagcacagaggacgggcaaggcaaggcgcacaacggcaggcuuauaacagccaaccccgucguuaccaagaaagaggagcccgugaacaucgaggcagagccacccuucggggagaguaacaccgugaucggcauuggggauaacgcucuuaaaauuaacugguauaaaaagggaucuagcauagggaagauguuugaggcgacggcccggggcgcccgccggauggccauccugggcgacaccgccugggacuucggguccgugggcgggguccugaacagucugggcaagaugguccaccagaucuuuggguccgcuuauaccgcgcuuuucagcggcgucuccuggguuaugaagauaggcauagggguucuucugaccuggaucggccugaacucgaagaacacguccaugagcuuuaguugcauagccaucgggaucaucaccuuguacuuaggggcugugguacaggccgacaugggcugcgucauaaacuggaagggcaaggagcugaagugcggguccggaauuuuugugaccaacgaggugcauaccuggacggagcaguacaaguuccaggcggacucccccaagcgccuggcgaccgcaaucgccggugcaugggaaaacggcgucuguggcauccgcagcaccacccggauggagaaucugcuguggaagcagauagcgaaugagcucaacuacauauugugggagaacaauauuaagcugacggugguggucggggacaucaucggcguacuugagcagggcaagcgcacgcugacgccccagccgauggagcugaaguacuccuggaaaacgugggggaaagccaagaucguaacggccgagacccagaacucuuccuuuaucaucgacggccccaacacccccgagugccccagcgucucccgugccuggaaugugugggagguggaggacuauggguucggcguauucaccaccaacaucuggcucaagcugcgcgagguguauacgcagcugugcgaccaccgccucaugucugcagccgugaaggaugaacgagccguacacgcagacaugggcuacuggauagagucacagaagaacggaaguuggaagcuggagaaggccagccugaucgaagugaagaccugcaccuggccgaagucccauacucuauggucuaacggcgugcucgaguccgacaugauaauaccaaagagucuggcggggccaaucucucaacacaaccacagaccaggcuaucacacgcagaccgccgggccguggcaucucggcaagcuggagcuggacuuuaacuacugugaaggcacgaccgucguaaucaccgaaaacugcgggacccgcggucccucgcuccggacaaccacugugucagggaaacugauccacgaguggugcugccguagcugcacuuugccgccgcuccgguacaugggcgaggacggcuguugguacggcauggaaauccgccccaucuccgagaaggaagaaaacauggugaaaagccugguguccgccgguagcgggaaaguggacaacuucacuaugggcgugcuuugccucgccauccuguucgaggaggugaugcgaggaaaguucggcaagaaacauaugaucgcggggguguucuucaccuucgucuuguuacugucuggccagauaacguggcgcgacauggcgcacacucugaucaugaucggauccaacgccuccgaucggauggggaugggcgugaccuaccucgcucugaucgccaccuuuaagauucagccuuuccuggcccucggcuucuuucugcgcaagcugacaagcagggagaaccuacuguuaggcguggggcucgcgauggccacgacucugcaacugccagaagacaucgagcaaauggccaacgggaucgcccucgguuuaauggcguuaaaacucaucacucaguucgagacguaucagcuuuggaccgccuuaauaagccugacuugcagcaacaccauauucacgcugacugucgccuggcgcaccgcuacccugauccuagccggggugagccugcugccggucugucagucgagcuccaugcggaagacagacugguuaccaauggcaguagcagcaaugggagugccgccccucccguuauucaucuucgggcucaaggacacucucaaacgccgcucuuggccuuuaaacgagggcgucauggccgucggccucguguccauauuggcuagcucacuguugcggaacgauguccccauggcggggccccugguggcaggcgggcugcucauugccuguuacgugaucacgggcaccuccgccgauuugacggucgagaaagccgcggauaucaccugggaggaggaggccgagcagaccggggugucucauaaccugaugaucacaguggacgacgacgguaccaugcgcaucaaggacgacgagacggaaaacauucuaaccgucuuguugaaaaccgcacuccugaucgucucgggcaucuucccguacuccauaccagcgacccugcucguuuggcacacguggcagaaacagacgcaacggagcggggucuugugggacguaccgagcccucccgagacucaaaaggcggagcuggaagagggcguguaucggaucaagcagcaggggaucuucggaaagacccagguuggggugggcgugcagaaggagggcgucuuccacacgauguggcaugugacccgcggcgcugugcuuaccuacaacgguaagcgccuggagccgaauugggccagcgucaagaaagaccuaauuuccuacgggggcggguggcgguugucugcccaguggcagaagggcgaggagguacaggugaucgccguggagcccggcaagaaucccaagaacuuccagacaaugccaggcacguuccaaacuaccaccggugaaaucggggcgaucgcguuggacuucaagcccgguacgagcgguagccccaucaucaaccgcgagggaaaggugguuggcuuguacggcaauggcguugugacgaagaacggcggcuacgucagcgguaucgcacagaccaacgccgagccugacggaccaacacccgagcuggaggaagagauguucaagaaaagaaaccuaacgaucauggacuugcaccccggcucagggaagacccgcaaguaccugccggcaaucguccgggaggcgauuaagcgccgcuugcgcacccugauccuugcccccacucggguaguggccgcagagauggaagaagcgcucaagggccugccaauccgguaucaaacgaccgcgaccaagagcgagcacaccgggcgugagaucgucgaccugaugugccacgccacuuucaccaugcgccuccuguccccggugcguguaccgaacuauaaucucaucaucauggacgaggcacacuuuacagaccccgccagcaucgccgcgcgugguuacaucuccacccgggucgguaugggcgaagcugcugccaucuucaugacggccacgccacccggcaccgccgaugcuuucccgcagagcaacgccccaauacaagacgaggaacgcgacaucccagagcgcucuuggaacagcgggaaugaauggaucaccgacuuugcugguaaaacgguuugguucguucccuccauaaaagcgggaaacgacaucgccaacugucuucggaagaacggcaaaaaggucauccagcugucucgcaagaccuuugauaccgaauaccagaagaccaagcugaaugacugggacuuuguggugacgaccgacaucuccgagaugggcgcaaacuuuaaggcagacagaguaaucgacccccgucgcugucucaaaccggucauccucaccgacgggcccgagcgcgugauccuggccggaccuaugccggucacugcggcuucugccgcucaacggcgcgggagggucggucgcaacccgcaaaaggagaacgaucaguacaucuucacagggcagccgcucaauaacgacgaagaucacgcccacuggaccgaggcgaagauguuacuggacaacaucaacacaccagaggggaucauaccggcccucuucgagccagagcgggaaaaguccgccgccauugauggcgaguacagacugaaaggggagucacggaagaccuucguggaacuaaugcgccggggcgaccucaccgucuggcuggcccauaaaguggccuccgaggggaucaaguauacggaucgcaaauggugcuucgacggccagagaaacaaccagauccuggaggagaacauggaugucgagaucuggaccaaggagggcgagaagaagaagcuccgcccccgguggcucgacgcgcgcaccuacagcgacccccuggcccucaaagaguucaaggaguucgccgcuggucgcaagucaaucgcccuggaccuggugacggagauaggcagggucccgagccaccucgcccaucgcacgcggaaugcccuagacaaccuagucaugcuccacaccuccgagcacggaggccgcgccuacaggcacgcgguggaggaguuacccgagaccauggaaaccuugcuacuguuggggcucaugaucuugcuuacagggggugccaugcuuuuccugaucucugguaaaggaaucgggaagaccaguauaggauuaauuugcgucaucgcauccagcgggaugcuauggauggccgagauucccuuacaauggaucgcuuccgcgauagugcucgaguucuucaugaugguacuccugaucccggagccugaaaagcaacgcacuccacaggacaaccagcuggcguacguugucaucggcauccucacucuggcagcgaucauagcggcgaaugagaugggccuguuagagacaaccaaacgggacuugggcaugucgaaagaacccggaguggucucccccacgucguaucuggaugucgaccuccauccugccucagccuggacgcuguacgccguggcgacgaccguaaucaccccaaugcugcgucacaccauugagaacucaacugccaacgucaguuuagccgcgauugccaaccaggcgguggucuuaauggguuuagacaaaggcuggcccaucagcaaaauggaccucggggucccgcugcucgcccuaggcugcuacucccaggugaacccccuaacacugaccgcugccguccuucugcugauaacccacuaugccaucaucggucccgggcuucaggcgaaggcgacccgggaagcccagaaacgaaccgcagccggcaucaugaagaaccccacagucgacgggaucaugaccaucgaucuggacccggugaucuacgacagcaaguucgagaaacaacugggccaaguaauguuguugguacugugugcggugcaacuccuccuaaugcggacguccugggcccucugugaggcccucacccuggcgaccgggcccauuaccacgcucugggaggggagcccuggcaaauucuggaacaccacaaucgcgguguccauggccaacaucuuucgcgguucguacuuggccggcgccggucuggccuuuagcaucaugaaguccgucggaacgggcaagcgggggaccggcucacagggcgagacucucggcgagaaauggaagaagaaacugaaccagcuuagccgcaaggacuucgaucucuacaagaaguccgggauaaccgaaguggaccggaccgaggcuaaagagggccugaagcguggcgagauaacccaccacgccgugucccgggggagcgcuaagcuccagugguucgucgagcggaacauggugaucccagagggucgggucauagacuugggguguggucgcgggggcuggucuuacuauugugcaggccugaaaaaggucacggaggugcguggguauaccaagggcgggccuggccaugaggaaccgguccccaugagcaccuacgguuggaacaucguaaagcuaauguccggcaaggauguguucuaccucccgccggagaagugcgauacccugcuaugcgacaucggcgaaaguuccccaucuccaacgguagaggagucacgcacgauaaggguccugaagaugguggagccaugguugaagaauaaccaguucugcauaaagguccugaaccccuacaugcccaccgucaucgagcaccuggaacggcuccaacgcaaacacgggggcaugcugguacggaaucccuuaucgcgcaacuccacccaugagauguacuggaucucuaacgggacagggaacauagucgcauccgucaacaugguuagcaggcuccuguugaaccgcuucaccaugacccaucgucgccccacaauugagaaggacguggaccuuggcgcggggacacggcacguaaacgcggagccggaaacgcccaacauggacgugaucggcgagcgcauuaagcggaucaaagaggaacacaacucaacguggcacuacgacgacgaaaacccauacaagaccugggccuaccacggcagcuaugaagugaaggccacgggcucugcuucauccaugaucaacggggucgugaagcuccucaccaagccaugggacguugugcccauggugacccaaauggcgaugacagacacaacgcccuucggccagcagcgcgucuuuaaggagaagguagauacccggacgccgcgaagcaugccuggcacgaggcgcgugauggggaucacagccgaguggcucuggcggacccugggucguaauaagaaaccuagacuguguacccgcgaggaauuuacgaagaagguacgcacgaacgcggccaugggagcgguauucaccgaggagaaucagugggauucagccaaggccgccguggaggacgaggacuucuggaaacuggucgaucgggagcgcgagcugcauaagcuggguaagugcggguccugcguguacaauaugaugggcaaacgggagaagaaacucggugaguucgggaaggcgaagggcagccgcgcgauuugguauauguggcugggggcccgguacuuagaguucgaggcacuaggguuccucaacgaggaccacugguucucccgagaaaacucuuacuccgggguggaaggcgagggacugcacaaacucggguauauccugagagacaucagcaaaauccccggcggggcuauguacgccgacgacaccgcgggcugggauacacgcauuacagaggaugaccugcacaacgaggagaaaaucacccaacaaauggaccccgagcaccgucagcucgccaacgcgaucuucaagcugaccuaccagaauaaggucgugaaggugcagcgcccuacucccacggguaccguuauggacaucaucucgcggaaggaccagcgagguagcggccagguggggaccuauggacugaacaccuucacuaacauggaggcucagcucauucggcagauggagggggaggguguucugucgaaggccgaccucgagaacccccaccuacccgagaagaaaaucacacaguggcuggagacuaaagggguggaacgccugaagcgaauggcgauuagcggggaugacugcguagugaagccaaucgacgaccgcuucgccaaugcccucuuagcccugaaugacaugggcaaggugaggaaggacaucccucaauggcagcccuccaaggguuggcacgacuggcagcagguccccuuuugcagucaucauuuccacgaguuaauuaugaaggacggccgcaagcugguaguaccaugucguccccaggacgagcucaucgguagagcccguauuucccagggcgcgggcuggagccucaaggagacggccugccucgggaaggccuaugcucagauguggucccugauguacuuccaccgccgagaccuccggcuagccagcaacgccauuuguuccgccgugcccgugcacuggguuccaacaagccguacgaccugguccauccaugcccaccaccaguggaugaccacggaggauaugcugaccguguggaaccggguguggaucgaggacaacccguggauggaggacaagacccccgucaccacgugggagaacgugcccuaccucggcaagcgcgaagaccaguggugcgggucuuugaucggccugacaucucgggcaaccugggcgcaaaacauccccaccgccauacagcagguccgcucccuaauagguaacgaggaguuucuggacuacaugccgagcaugaagcguuuccgcaaagaggaagagagcgaaggcgccauaugguga

SEQ ID NO: 25815 - RNA, 9873 nt, Artificial Sequence
  derived and/or modified CDS sequence (opt11) from DENV-3__HQ166034__SS-prME
acuagccuaugccuuaugaugauccugcccgcugcccuggccuuccaccucaccagccgugauggggagccuaggaugaucguggggaagaacgagcgggggaagagucugcuguuuaagaccgcguccgggaucaacaugugcacgcucauugccauggaccugggggagaugugcgaugacaccgucacuuacaaaugcccccacauaacggaggucgagccggaggacaucgacuguuggugcaacuuaacaagcaccuggguuacguacggaaccuguaaccaagccggcgagcaccgacgcgacaagcgguccguggcccucgcuccccacgucggcaugggcuuggacacccgcacccagaccuggaugagugccgaaggcgccuggaggcaagucgagaaggucgagaccugggccuugcgccauccgggguucacaauacuugccuuguuccuggcgcacuacaucgggaccucccucacccagaagguugugauauuuauccugcugaugcucgucacgcccagcaugaccaugcggugcgugggggugggaaacagggacuucgucgaaggccugucaggagccaccuggguggacguggucuuagagcauggcgggugcgugaccacgauggcuaaaaacaaacccacccuggacauagaacugcaaaagaccgaggccacucaauuggcgacacuccggaagcuauguaucgaggggaaaaucaccaacaucacaaccgacagcagaugccccacgcagggcgaggcgacccugccggaggaacaggaucaaaauuacgugugcaagcacacauacguugaccguggguggggcaacgguuguggccucuucgggaagggcucgcuaguuacgugugcaaaguuucaaugccuggaacccauagagggcaagguaguccagcaugaaaaccucaaguacacugugaucaucaccgugcacaccggggaucagcaucaggucggcaacgagacgcaaggggugaccgccgaaauaacaccucaggcuucgaccaccgaagcaauccugcccgaguacgguacucucgggcucgaguguucgccucgaaccggccuggacuuuaaugaaaugaucuuacucaccaugaagaacaaggccuggaugguccaccggcaaugguucuucgaucugccccugccguggaccucgggcgccaccacggaaacccccacguggaaccguaaggaguugcuggugaccuucaagaaugcccaugccaagaagcaagaaguagucgugcuggggucccaagagggcgcgaugcacacggccuugaccggugccaccgagauccagaacucuggcgggaccagcaucuuugccgggcaccuuaaaugucggcugaagauggacaaacuggagcugaagggcaugagcuacgccauguguacgaauaccuucguucuuaagaaggaggucagugagacucagcaugggaccaucuuaauaaagguggaguacaagggagaggacgugcccugcaagauccccuuuagcacggaagauggacagggcaaggcgcacaacgggcgccugauuaccgcgaaucccguaguuaccaagaaggaggagcccgugaacaucgaggccgagccacccuucggcgagagcaacaucgucaucggcauaggcgacaacgcccugaagauaaacugguacaagaaaggcuccagcaucgggaagauguucgaggccaccgcucggggcgcccgucggauggccauccugggugacacggccugggacuucggauccgugggcggggugcugaacagucugggcaaaaugguccaucagaucuucggguccgcguacacugcgcuguucagcggcgugagcugggucaugaaaaucggaaucggggugcuccugaccuggaucggauuaaacagcaaaaacaccuccaugagcuucuccugcaucgccauugggaucaucacgcucuaccucggcgccgugguucaagccgacauggggugugucauaaacuggaagggaaaagaacugaagugcggcucggggaucuucgugaccaaugagguacacacauggaccgagcaguacaaguuccaagcagacucccccaagcgauuggccacggccaucgccggcgccugggagaacgguguuuguggcauccgcagcacuacuagaauggagaaucugcuguggaagcaaaucgcaaacgagcuuaacuacauucugugggagaauaacaucaaacugacugugguggucggggacaucaucggcgugcucgagcaggggaagcgcacccugacgccccagccgauggagcugaaguacucauggaagaccugggggaaggccaaaaucguuaccgccgaaacacagaacaguuccuuuaucaucgauggucccaacacccccgagugccccagcgucucgagagcuuggaacgugugggagguugaggauuacggguucggcguauucacaaccaauaucuggcucaagcugcgagagguguacacucagcugugcgaccauagacucaugucagcggccgugaaggacgagcgcgccguacacgccgacaugggcuacuggaucgagagccagaagaacggcuccuggaaacuugaaaaagccagucugaucgaggugaagacguguaccuggccgaagucccacacccucuggagcaacggagugcuggaguccgacaugaucauucccaaaucacuugcgggcccuauuucccaacacaaccaucggccgggcuaccauacgcagacggccggccccuggcaucucggcaaguuagagcuggacuuuaacuacugugagggaaccacaguggugaucaccgagaacugugggacgcgcggccccucccuccgcacgacuaccguauccggcaagcugauccacgaguggugcugcagaagcuguacgcugcccccacuccgguacaugggagaggacgggugcugguacggcauggagauucgcccgaucuccgagaaagaagagaauauggugaaaagccuuguguccgccggcagcggaaaaguggacaacuucaccaugggcguucugugccucgcuauccuuuucgaggaggugaugcgggguaaauucgguaaaaagcauaugaucgcaggaguguucuucaccuuugucuuacuccuaucaggccagauuaccuggcgcgauauggcgcacacgcuaauaaugaucggcagcaacgccuccgaccggauggggaugggcgugacuuaucucgcccugaucgccacguuuaaaauccagccguucuuggcgcucggcuucuuccugagaaagcugaccagccgggagaacuuauugcuggggguggggcucgcgauggccaccacgcugcagcugcccgaggacaucgagcagauggcaaacgggaucgcacuuggccugauggcgcugaaauugaucacucaguuugagauauaccaacuguggaccgcgcugauuagucucacuuguucaaacaccauauucacccugacaguagccuggcgcacggccacccugauacucgcuggagugagccuguuacccaugugccagaguuccaguaugcgcaagaccgauuggcuccccauggcggucgccgccaugggcgugccgccccucccucuguucaucuucucgcucaaagacacccugaaacgccgcuccuggccucugaacgagggggugauggcugucggcuuggucagcauccuggccuccagccugcuccggaacgacguucccauggcaggcccccucguugccgggggccuguugaucgccugcuacgugaucacggggacauccgccgaccugacaguggagaaagcggcggacaucaccugggaggaggaagcagaacagacgggcgucagccacaaccugaugauuacggucgacgacgauggcacgaugaggaucaaagacgacgagaccgagaauauccucaccgugcugcuuaagacagcgcuacugauugucuccgguauauucccguacagcauuccagccacccugcucguguggcacaccuggcagaagcagacccagcgcucuggcgugcuuugggacguccccuccccgcccgagacgcagaaagccgagcuggaggaaggggucuaccgcaucaagcagcaggguaucuucgggaagacccaggugggagucggggugcagaaggagggcguguuucacaccauguggcaugucacgcgcggugcggugcucacguauaacgggaagcgcuuggagccuaacugggccuccguaaagaaggaucugauuagcuacggcgguggguggcgacucagugcccaguggcaaaaaggggaggagguccaggucaucgcgguggagccuggcaagaaccccaagaacuuucagaccaugccaggcaccuuccagaccacgacuggagagaucggcgcuaucgcccuggacuuuaagcccgggaccaguggcagcccaauaauuaaccgggagggcaaagucguggggcuguacggcaacggaguggucacaaagaacggcggauacguguccggcaucgcucaaacaaacgccgagcccgacggucccaccccagagcuggaggaggagauguucaaaaagagaaaccucaccaucauggaccugcacccugggagcggaaagacccgaaaguaucugccggccauuguucgggaggcgaucaaaagaagacuccgcacucugauccuggcacccacccguguuguugccgccgagauggaggaggcauugaaagggcuaccgauacgauaucaaaccaccgcuacgaaguccgagcacacaggccgggagaucguggacuuaaugugccaugccacguucacuaugaggcuccuaagccccgugcggguccccaacuacaaccugaucauaauggacgaggcccacuuuacugaccccgcuuccaucgcagcgcgaggauacaucucaacccguguaggcaugggcgaggccgcagcaaucuucaugaccgcgacgccgcccggcacggccgacgccuuuccccaguccaacgcgcccauccaagacgaggagcgcgacaucccugagcgcaguuggaacuccggcaacgaguggaucaccgauuucgccggaaagacagucugguucgugcccucgaucaaggcgggcaaugacaucgccaacugucucaggaaaaacgggaaaaagguaauucagcugucccgcaagaccuucgacacagaguaucagaaaaccaagcugaaugacugggacuucguggugaccacugacauuagcgaaaugggagcaaacuucaaggccgacagggugaucgacccgcgccggugccugaagcccguuauacugacggacggcccggagagggugauccuagccgggccaaugccgguaacggcugccuccgcggcgcagcggcgcggccgagucgggcgcaacccgcagaaagagaaugaccaguacaucuucaccggccagccccucaauaacgacgaggaccacgcccacuggaccgaggcgaagaugcuucuugacaacaucaacaccccggaggggauaaucccggcguuauuugaacccgaacgggagaagucugccgccauugauggagaguaccggcugaaaggagagucccggaagaccuucguggagcugaugcgccgcggggaccucccggucuggcucgcccacaagguugccagcgagggaaucaaguacacugacagaaaguggugcuucgacgggcagcguaacaaccagauccuggaggagaauauggacgucgagaucuggaccaaggagggcgagaaaaagaagcuaagaccacgcuggcuggacgcccgcaccuacucagacccgcuggcccucaaggaguucaaggaguuugccgcgggucgcaagaguaucgcccuggaccuggucacggagaucgggcggguaccuucccaccuggcucaccggacccggaacgcccuggacaacuuggugauguuacacacgagcgaacacggugggcgcgccuaccggcaugcggucgaggagcuaccggagaccauggagacguuauuguuauuaggacucaugauucuauuaaccggaggggccauguuguuccugaucuccgguaaggggaucggaaaaaccaguaucgggcugauuugugucaucgccucuucuggcaugcucuggauggcugagaucccgcugcaauggaucgccagcgcgaucguacuggaguucuucaugaugguccuccucauccccgaacccgaaaaacaacguacgccccaggacaaucaguuagccuacguggugaucgggauccucacacuagcagcaaucaucgcagccaacgagaugggccuauuggagaccacgaagcgcgacuuaggcaugucaaaggagcccggggucgugucgcccacauccuaccuggacguagaccuccauccugccucugccuggacgcuguacgccgucgcgaccacggugauaacaccuaugcugaggcauaccaucgaaaauuccacggcuaacgugagcuuggcagccaucgccaaccaagcuguagugcugaugggucuggacaagggauggccgauuuccaagauggaccucggcgucccccugcuggcucucgggugcuacagccaggucaauccccugacgcugaccgccgcaguucuccugcuuauuacgcacuacgccaucauaggccccgggcuacaagcgaaggccacacgggaggcccagaaacggaccgccgccgggauuaugaaaaacccgacuguggacggcaucaugaccauagaucuggaccccguaaucuaugacuccaaguucgaaaagcagcugggacaggugaugcuccucgugcugugcguugugcagcuccuguuaaugcggaccagcugggcgcucugcgaggcccucacccuggccaccggccccauuacgacccucugggagggcucccccgggaaguucuggaacaccacaaucgccguuagcauggcgaacauuuuccgcggguccuaccuggccggugccggccuggcguucagcaucaugaagagugucgggacgggaaagcggggcaccggcagccagggcgagacauuaggcgagaaguggaagaagaaacugaaccagcucagucgcaaagacuucgacuuauacaagaaguccggcaucaccgaggucgaccggacagaggccaaggaaggccugaagcgcggcgagaucacacaccacgcggugagccggggcuccgccaagcugcaaugguuugucgagcgcaacauggugauucccgaggggagagugauagaccucggaugugggcgcggcgguuggagcuacuacugcgccggcuugaagaagguuaccgaagugcgagguuacacgaaaggcggacccgggcacgaggagcccgugccgauguccacguacggauggaauaucgucaaacuuaugagcgguaaggacguguucuaccucccgcccgagaagugcgacacgcugcugugugacauaggugagucuagcccaucccccaccguggaagagagccgcacuauccgcguucuuaaaaugguggagccuuggcuuaagaacaaccaguucuguauaaagguacugaacccuuacaugcccaccgucaucgagcaucuggagcgacuccagcgcaaacacggagggaugcuggugagaaacccccugucccggaauaguacgcacgagauguacuggaucagcaacggcaccgggaacauaguggccucagugaacauggugucccggcuccuccugaaucgcuucaccaugacucaccgacgcccgacgaucgagaaggacguggaucucggugcgggaacaagacacguuaacgcggagcccgaaaccccaaacauggacgugaucggggagcgcaucaagcgaauuaaggaggagcacaacuccaccuggcauuaugacgaugagaacccguacaagacgugggccuaccauggcaguuaugagguaaaggccaccgggagcgcuuccagcaugaucaacggcgucgucaaacuguugaccaaaccuugggacgucguccccauggugacucaaauggccaugacugacaccacccccuuuggucagcagcgcgucuucaaggagaagguggacacuagaacgccgcgcaguaugcccggcaccaggcgcguaaugggaaucacagcagaguggcucuggcgcacucuggggagaaacaagaagccucgucugugcacgcgggaggaguucaccaagaaggugcgcaccaacgccgccaugggcgcgguguucaccgaggagaaccaaugggacuccgcgaaggcggccgucgaggacgaggacuucuggaaguuaguugaccgcgagcgcgaacugcauaagcugggaaagugcggcagcugcguguacaauaugaugggcaagcgggagaagaagcucggcgaguucggcaaagccaaagguucccgcgccaucugguacauguggcugggugcacgguacuuggaguucgaggcccuuggguuccuaaacgaggaccacugguucagccgcgaaaauuccuacucaggcguggaaggggagggccugcacaagcuagguuacauauuacgggacaucaguaagauuccaggggccgccauguacgccgacgacacggcgggcugggauaccagaaucacggaagacgaccuucacaacgaggagaagauuacccagcagauggacccggagcaccgacaacucgccaaugccauuuuuaaauugacauaucagaacaaagucgugaaggugcagaggcccacccccaccgguaccguuauggacauaaucagcaggaaggaucaacgcggcuccggccagguggggacguacggccuaaacaccuucaccaacauggaggcccagcucauccgccaaauggaaggggagggugugcuguccaaggccgacuuagagaacccccacuuaccagagaagaaaaucacccaauggcuugagacuaaggggguggaacgacugaagaggauggcuaucuccggcgaugacugcguggugaagccgauagacgaucgcuuugccaacgcccuguuagcccugaaugacauggggaagguucggaaggauauuccccaauggcagcccagcaagggguggcacgacuggcagcaggucccguucuguucccaccacuuccacgaacucaucaugaaggauggccgcaagcuggugguuccgugccggccccaagacgagcugaucgggcgcgcgcggaucucccaaggcgcgggguggucccucaaggagacggccugcuuaggcaaagccuacgcccaaauguggagccugauguacuuccaccgccgcgaccuucgguuggcgucgaacgccaucugcagcgccgugccggugcacugggugcccaccucccggaccaccugguccauccacgcacaucaccaguggaugaccaccgaggauauguugaccguuuggaacaggguguggaucgaggacaauccauggauggaggacaagacucccguaacgacaugggaaaacgugccguauuuaggaaagcgcgaggaccaguggugcggaagccucauuggccugaccagucgggccacuugggcgcagaacauuccgacggccauccaacaaguucgcagccucauugggaacgaggaguuccuagauuacaugcccucuaugaagcgguuccgcaaagaggaggaguccgagggagcuauaugguga

SEQ ID NO: 25816 - RNA, 9873 nt, Artificial Sequence
  derived and/or modified CDS sequence (opt11) from DENV-3__HM756274__SS-prME
accagcuugugccucaugaugauccugcccgccgcucuggccuuccaucucaccagcagggacggggagccccguaugaucguggggaagaacgagcggggcaagagcuuacuguucaagaccgcuagugggaucaacauguguacccucaucgccauggaccugggggagaugugcgacgacaccgugaccuacaagugcccccacauaacagagguggagcccgaggacaucgacugcuggugcaaccuuaccaguaccugggugaccuacgggacaugcaaccaggcgggagagcaccggagggacaaacgguccguggcccuggcuccccacguuggcauggggcuugacacccggacucagaccuggaugagcgcggagggcgccuggcgccaaguggagaagguggaaacgugggcccuccgccauccaggguucaccauccucgcgcuguuccuggcccacuauaucgguaccucccuaacucaaaaaguggugaucuucauccuguugaugcucguuacgcccagcaugaccaugcggugcgugggggugggcaaccgcgacuucguugagggccugagcggggcaaccuggguggacguuguccuggagcacggcgggugugugacuacgauggccaagaacaagcccacccucgacaucgagcugcagaagacagaggccacucagcuugcgacguuacggaagcuguguaucgaggggaagauuaccaacaucaccaccgacagccgcugccccacgcaaggcgaggccacccugccggaggagcaagaccagaacuacguuuguaagcauaccuacgucgaccggggauggggcaaugggugcggccuuuucgggaagggcucauuagugaccugcgccaaguuccaaugccuggagcccaucgagggcaaggugguacaguacgagaaccucaaguacacggugaucaucacagugcacacuggugaccagcaccaggucgguaacgaaacccaaggcgugacggccgagaucacgccccaggccagcacuacagaggcgauccugcccgaguacggcacccugggauuagagugcucaccccgcacggggcuugacuucaacgaaaugauccugcucacgaugaagaacaaggccuggaugguccaccggcagugguucuucgaccugccccuaccguggaccuccggcgccacgaccgagacccccacguggaaccgcaaagagcuguuggugaccuucaagaacgcucacgccaagaagcaggagguggucguacuggggucccaggagggagcgaugcacaccgcccucaccggggcuaccgaaauccaaaacagcggcgggaccuccauauucgccggccaucugaagugucgguuaaagauggacaagcucgagcugaagggaaugaguuacgccaugugcacuaaugcguucguacugaaaaaggaaguaagcgagacccaacacgggacuauccuaaucaaaguggaguacaagggcgaagacgugccaugcaaaauucccuucagcaccgaggacggacagggcaaagcgcacaacggucggcuuaucacggccaacccagucgugaccaagaaggaggagcccgugaacaucgaggccgaaccgcccuucggggaguccaauaucgucaucggcaucggagacaaugcguuaaaaaucaacugguacaagaagggcuccucgauagggaagauguuugaggcuacagcccguggcgcccggcggauggcgauccugggcgacaccgccugggacuuuggauccguaggcggcguacuaaauucacuuggcaagaugguccaccagauuuucggguccgccuacacggcccuguuuaguggcgucuccugggugaugaaaaucggcaucgggguccucuugaccuggaucggccugaacagcaagaacaccuccaugagcuucuccugcaucgccauugggaucaucacucucuaucugggcgccgucgugcaggcugacauggggugcgucaucaacuggaagggcaaggagcugaagugcgguucggggauauuugugacgaacgaggugcacaccuggaccgagcaguacaaguuucaggccgacucccccaagcgccuugccaccgccaucgccggagcgugggagaauggugucugcggcauacgcaguacaacgcggauggagaaccugcuguggaagcagaucgccaacgagcucaacuauauacugugggagaacaacaucaaacugaccgugguggugggggacauaaucggcgugcucgaacagggcaagcgcacccugacgccccagccgauggaacucaaguauuccuggaagaccuggggaaaggccaagaucgugaccgccgagacacagaacagcuccuucaucauugacggccccaauacgcccgagugccccuccgucagccgcgcguggaacgucugggaaguugaggacuauggguucggcgucuucacgacaaacauuugguugaagcugcgcgagguauacacccagcugugcgaccaccgcuugaugucagccgcaguuaaggacgaacgcgccguccacgcagacaugggcuacuggauugagagccagaagaauggguccuggaagcuagaaaaggcgagccugaucgaggugaaaaccugcaccuggccgaaaagccacaccuuauggucgaauggcguccuggagucugacaugaucauccccaagagccuggccgggccaaucucgcagcacaaccaccggccgggcuaccacacccagacagccggcccuuggcacuuaggcaagcuggagcuggacuucaacuauugugagggaaccaccguagugauuacggaaaacugcgggacccgcggccccagccucagaacgaccaccgucucagggaaacugauccacgaguggugcugccgcagcuguacacuacccccauugcgguacaugggcgaggacggcugcugguauggcauggaaauacggcccaucucugagaaggaggaaaauauggucaagucgcugguguccgccgggucggggaagguggacaacuuuacgaugggugugcugugccucgcaauccuuuucgaggaggugaugcgggggaaauucggcaagaagcauaugaucgcggguguguucuucaccuucgucuugcuccugaguggccagauuacuuggcgugacauggcccacacacugaucaugauaggaagcaacgcuuccgaccggauggggaugggcgugacguauuuggcacucaucgcuaccuucaagauacagcccuuucuggcguuaggauucuuccugcgcaagcugacgagccgagagaaucuccugcugggcgugggccucgcaauggcaaccacgcugcagcugcccgaggacaucgagcaaauggccaacggaaucgcucuggguuugauggcacugaagcucaucacccaguucgagacauaccaacuguggacugcucuuauuagccucacuugcuccaacaccauuuuuacccugaccguggccuggcgcacggccacccuuauccucgcgggcgugagccugcugccgguuugucaguccagcaguaugcggaagaccgauuggcuccccauggccguggccgcaaugggcgugccgccccucccauuauucaucuucggucucaaagacacccugaaacguagaaguuggccccugaacgagggcgucauggccgugggccucguauccauccuggcgagcucccugcuccggaacgacguccccauggccgggcccuuaguggcaggagggcugcucauagccugcuacgugaucacggggacuagcgccgaccugaccgucgagaaggcggcagacaucaccugggaggaggaggcggagcagacgggggugagccauaaccugaugaucaccguagacgaugacggcacaaugcgcaucaaggacgacgagaccgagaacaucuuaacgguccugcugaagacggcccuccugaucgugagcggcaucuucccuuacuccaucccagccacccugcucguguggcacaccuggcagaagcagacccagcgcagcgggguacugugggacguaccaagcccgcccgagacacagaaggcggagcuagaagagggcguuuaccgcaucaaacagcaggguaucuucggcaagacccaggugggggugggcgugcagaaggagggaguauuccacaccauguggcaugucaccagaggggccgugcucacacacaauggcaagcgccuugagcccaacugggccagugucaagaaggaccugaucuccuacgggggcggguggcggcucagcgcccaguggcagaagggcgaggaggugcagguuaucgcggucgagcccgggaagaaucccaaaaacuuccagaccaugcccgggacauuccagaccacgaccggagagauuggggccaucgcccuggacuucaagcccggcaccucgggcagcccgaucaucaaccgcgagggaaagguggugggccuauauggcaacggcgucgugaccaagaauggggguuacguaagcggcaucgcccagacgaacgccgagccggacgggccuacccccgagcuggaggaggagauguucaagaagcguaaccucaccaucauggaccugcaccccggcuccggcaagacccgcaaguaccugccggcgaucguccgcgaggccauuaaacgccggcuccgcacucugaucuuggcccccacccgcguuguagcagccgagauggaagaagcacucaagggccugcccauccgcuaccaaaccacagccaccaaguccgagcauaccgggcgggagaucgucgaccuaaugugccacgcuacauucacgaugcgucucuuguccccugugcgggugccaaauuauaaccugaucauaauggaugaagcccauuuuacggaccccgccagcaucgcggcccgcggguacaucuccaccagagucggcaugggugaggccgccgcgauuuuuaugacugccacgccgcccggaacggccgacgccuuuccgcaaucaaacgcccccauccaggacgaggagcgagauauccccgaacgcuccuggaacucagggaacgaguggaucacggacuucgcuggaaagaccgugugguucgugcccuccaucaaggccggaaacgacaucgccaacugccuucguaagaacgguaagaaggucauccaacugagccgcaagaccuucgacacggaguaucagaagacgaaacugaacgacugggacuucguggugaccacugacauuuccgagaugggcgccaacuucaaggcggaccgcgucaucgauccgcgucggugccucaaacccguuaucuuaacggacggccccgagcgcgugauccuggcgggacccaugccggucaccgcagccagcgccgcacagcggcgcggccgggugggccgcaacccccagaaggagaacgaccaauacaucuucaccggccagccccucaacaacgacgaagaccacgcgcacuggaccgaggcuaagaugcugcuggauaauaucaacacucccgaggguaucaucccggcccucuucgaacccgagcgggaaaagagcgccgcgauugacggcgaguaccgccugaagggggagagccgaaagacguucguggagcugaugcgcagaggggaucuccccgucugguuagcgcacaaaguggcuuccgagggcaucaaguacaccgaccggaaauggugcuucgacggccagaggaacaaccaaaucuuggaggagaacauggacguggagaucuggaccaaggaaggcgaaaagaagaagcuccgcccgagguggcucgacgcccgcaccuacagcgacccgcuggcccucaaagaguuuaaggaguucgcggccggccgcaaauccauugcccuggaccuggugacggagaucggccgcguacccagccacuuggcccacagaacccguaaugcccuggacaaucuggugaugcuccauacguccgaacacgggggccgcgcguaccggcacgccguggaggagcugcccgagacgauggagacgcugcuacugcuggggcucaugauccugcugaccggcggagccaugcuguuccugaucagcggaaaaggcaucgguaaaaccagcaucggacugaucugcgugaucgcuuccagugggaugcucuggauggccgagaucccguugcaguggaucgcguccgccauaguccuugaguucuucaugauggugcugcugauccccgaacccgagaagcagcgcacuccccaggacaaccagcuggccuacgucgucauaggcauauuaacgcuggccgcuauaaucgcggccaacgagaugggccugcucgagaccaccaagcgggaccugggaaugagcaaagagccuggcguggugucccccacaucuuaccuggacguugaucuccacccagccuccgccuggacgcuguacgcgguagcgacgaccgugaucacucccaugcugcgccacaccaucgagaacagcaccgccaacguauccuuagcugccauugcuaaccaagccgugguacuaaugggacuggacaagggcuggccgaucagcaagauggaccucggggucccacugcuggcccucggcugcuacagucaggugaacccccuaacacugacggccgcagugcuccugcugaucacgcacuacgcgaucaucggcccugggcugcaggcgaaagccacccgggaggcucagaagcggaccgccgcagguaucaugaagaacccaaccgucgacgggaucaugaccaucgaccuugauccagugaucuacgacagcaaguuugaaaagcagcugggccaggugaugcugcugguccugugugccgugcaauuauugcugaugcggaccuccugggcccucugcgaggcacugacguuggcgaccggcccaauaacgacgcucugggaggggagccccgggaaguucuggaacaccaccaucgccguguccauggccaacaucuuccgcgggagcuaccuggcuggcgccggguuggcguucuccauaaugaaguccgucggcacuggcaagcgggguacaggcucccagggcgagacccucggggaaaaguggaagaagaaacugaaccagcuuucccggaaggauuucgaccucuacaagaaguccgggauuaccgagguggaucgcaccgaggccaaagaaggccugaaacggggcgagaucacgcaucaugccgugucccgaggaagcgcaaagcugcagugguucguggagcgcaacauggugaucccggagggccgggugaucgaucucgggugcggccgcgguggcugguccuacuacugugcaggucuaaagaaggucaccgaggugcgggguuacaccaagggcgggcccggccacgaggagccugucccuaugagcacguacggguggaacaucgucaaacugauguccgguaaggacguguucuaccucccuccugagaagugcgacacgcuccugugugacauaggcgagucuuccccaagccccaccguggaggagucccgaaccauccgcguccuaaaaaugguggagccguggcucaaaaauaaccaguuuugcauuaagguguuaaaccccuacaugcccaccgucaucgagcaccuugagcggcuccagcggaagcacggcggcauguugguacggaacccccugagccgcaacuccacgcacgagauguacuggaucagcaacgggaccggcaacaucguugcuuccgucaacaugguuagccgucuacuccucaaucgcuuuaccaugacccaccggagaccgacgaucgaaaaggacgucgaucucggcgcugggacccgccacguuaacgccgagcccgagacacccaacauggacgugaucggcgagcgcaucaagcggaucaaggaagaacacaacuccaccuggcacuacgacgacgagaacccguacaagacgugggccuaccacgggagcuacgaggugaaagccaccggcuccgcgagcuccaugaucaacggggucgugaaacugcuuacuaagcccugggacguugugccgauggugacccagauggccaugacggauacgacccccuucggccagcagcgaguuuucaaggagaaaguggacaccagaaccccgcgcaguaugcccggcacccggcgcguaauggggauuacggcagaguggcucuggcgcacccugggcaggaacaaaaagccacggcugugcacccgcgaggaguuuaccaagaagguacguacgaaugccgcgaugggggccguguucacggaggagaaccagugggacagcgccaaggcugccguggaagacgaggacuucuggaagcucgucgaccgggagagggagcugcauaagcucggcaagugcggguccugcguguacaacaugauggguaaacgggagaagaaguugggggaauuugguaaggcgaaaggcagccgcgccauaugguauauguggcugggugcgcgguaccucgaguucgaggcccucgguuucuugaacgaggaucacugguucucccgagagaauagcuacuccgggguggaaggagagggccugcauaaacucggguauauccugcgcgacaucucgaagauccccggcggggcaauguacgcggacgacacggccggcugggacacccgcaucacggaggacgaccuucauaacgaggagaagauaacccagcagauggacccggagcaccggcaacucgccaacgcgauauucaagcugacguaccagaauaagguagugaaggugcaacgccccaccccaaccggcaccguaauggacauuaucucccggaaagaccaacgcgggagcggucaaguggggacguacggccugaacacuuucaccaauauggaggcccagcuaauccggcaaauggagggcgagggagugcuguccaaggcggaccuggagaacccccaucugccugagaagaagaucacgcaguggcuggagaccaagggcgucgagcgccugaagagaauggcuauaucgggcgaugacugcguggugaagccaauugacgaccgauucgcuaacgcacuucuugcacugaacgacaugggcaaggugcggaaggacauuccccaauggcagccguccaagggguggcacgauuggcagcaggucccguuuugcagccaccacuuccacgagcucauaaugaaggacggccgcaaguuaguggucccgugucggccccaggacgagcugaucgggcgcgcgcggauaucccaaggcgcgggcuggucacucaaagagacugcgugucuggggaaggccuacgcccagauguggucucugauguauuuccacaggcgcgaccugcgguuggccagcaaugccaucugcagugcggugcccguacacugggucccgacaagccggacuaccuggucuauccacgcccaccaccaguggaugaccacugaggacaugcugaccguguggaaccgggucuggaucgaggacaaccccuggauggaggauaagacacccgucacgaccugggagaacgugcccuaccuaggcaagcgcgaggaccaguggugugggagccugauaggccugacuagccgggcgacuugggcgcagaacaucccgacugccauacaacagguccguucccucaucggaaacgaggaguuccuggacuacaugccuaguaugaagcgguuccgcaaggaggaagaguccgagggcgccaucugguga

SEQ ID NO: 25817 - RNA, 9873 nt, Artificial Sequence
  derived and/or modified CDS sequence (opt11) from DENV-3__HM756275__SS-prME
accucccuaugccugaugaugauccuaccugcagcccuagccuuccacuugacgucucgggacggagaaccucggaugauagucggcaaaaacgaaaggggaaaaucccugcuauucaaaacagccaguggcauaaacauguguacacuaauugccauggaccucggagaaaugugugacgacacugucacguacaaauguccucacauaacagaaguggaacccgaagacauagacuguuggugcaacuugacaaguacgugggucacauacggaacauguaaccaagccggagaacaccgacgagacaaacgauccguagcacuggcgccacacguaggcaugggccuggauacacgaacacaaaccuggaugucggccgagggugcauggcgacaagucgaaaaagucgaaaccugggcacugcgccacccaggcuucaccaucuuagcuuuguuucucgcgcacuacaucggcacaucacuuacccaaaaagucguaaucuucauccucuuaaugcuugugacaccaucaaugacaaugagaugcguaggagucgguaaccgcgauuuuguagagggacuuucaggggcaacguggguggacgucgugcuugaacacgguggguguguaacaacaauggccaaaaacaaaccaacgcucgacaucgaacuucagaaaacugaagccacacaacucgcaacguuaaggaaauugugcaucgaagguaaaaucaccaauauaaccaccgacuccaggugcccgacucagggagaggccacucuccccgaagaacaagaucaaaauuacguuugcaaacacacauauguagauagggguuggggaaacggcuguggacuguucggcaaaggaucccuagucacuugugccaaauuccaaugcuuggaaccgauagagggaaaaguuguccaacacgagaaccuaaaauacaccguaauaaucacaguccacacaggggaucagcaccagguggggaacgaaacgcagggggucacugcagagauaaccccacaagcgucuaccaccgaagccauauuaccagaguacgguacacucggcuuggaaugcagcccccggaccggccucgacuucaacgaaaugauccugcuuaccaugaaaaacaaggcuuggaugguccaccgucagugguucuucgaccugccgcucccauggacaagcggagccaccacggaaacaccgacauggaaucgcaaagaacuacuugucaccuuuaaaaacgcccaugcuaagaaacaagagguuguaguucuaggaagucaggaaggcgcaaugcacacggcgcuuaccggcgcaacugaaauucagaacagcggagggacgucgaucuucgccgggcaccuaaaaugcagacuaaaaauggacaagcucgaacucaaggggaugagcuacgcgaugugcacaaauaccuucguacucaagaaagaggucuccgaaacacaacacggaacgauauugaucaagguggaguacaagggagaagacguucccugcaaaauccccuucucuaccgaagacggccagggaaaggcgcauaacggacggcuaauuaccgccaauccgguggucaccaagaaagaggagccggucaacauagaggcugagcccccuuucggagaaucaaacauagucauaggcaucggcgauaacgcacuuaaaauuaacugguacaagaaaggguccuccaucgggaaaauguucgaagcaacggcgcgaggcgcccgccgcauggcaauauuaggcgauacagcaugggacuucggcagcgucgguggcguucuaaacucccuaggaaaaaugguccaccaaauuuuuggcucugccuacacugcacucuucagcggcguaagcugggugaugaaaauaggaaucgguguucuacugacguggaucggccugaacagcaagaauaccuccaugagcuucagcugcaucgcgaucggaaucaucacgcucuacuuaggugcagucguccaagccgacaugggaugcgugaucaacuggaaaggaaaagaacucaagugcgggucuggcaucuucgucaccaaugagguccacaccuggaccgaacaauacaaauuccaggcagauuccccaaagcggcucgcaacagcaaucgccggggcaugggagaacgggguauguggcaucaggagcacuacacggauggaaaaucuacucuggaaacaaaucgcgaacgaacucaauuauauacucugggaaaauaacauaaaguuaacggucguagugggugauauaauaggcguccucgaacagggaaaacgcacccuuacaccccaaccgauggaacucaaauacucguggaagaccuggggcaaggcaaaaaucgucacagcggaaacccaaaacagcagcuucauaaucgauggcccuaauacccccgaaugcccaagcgugagccgcgcguggaacgugugggaaguggaagacuauggauucggcgucuuuacaacaaacauauggcuaaagcuccgggaggucuacacgcagcugugcgaucaccgguuaaugucagccgccguaaaagaugagcgagccguccaugcagauaugggguacuggaucgaaucccagaaaaaugguagcuggaaacuagagaaggcauccuuaaucgaggucaaaacuugcaccuggcccaaaagccacacccuauggucaaaugguguccucgagucagauaugaucauuccgaaaaguuuagcagggccuaucucacaacauaaccacaggcccggguaucauacacaaacggccggaccuuggcaccuagggaagcuagagcucgacuuuaacuacugugaaggaacaacggucguaauuaccgaaaacugcggaacacgagguccuucccugcggacaacgacuguauccggaaagcugauacaugaauggugcugccgauccugcacccuaccuccccugcgauacaugggagaagacggaugcugguacgguauggaaauacgucccaucagcgaaaaggaagaaaacauggucaaaucccucgucucggccggaagcggaaaaguagauaauuucacgaugggaguccugugccucgcaauacuauucgaggagguaaugcggggaaaauucgggaagaaacacaugauugccggggucuucuucacauucguucuacuacugagcgggcagaucaccuggagggacauggcacacacccuaauaaugaucgggaguaacgcgucggauagaaugggcaugggggucacguacuuagcgcuaaucgcgacauucaaaauccagcccuuccuagcgcuaggcuucuuuuugagaaagcucacaucgcgagagaaccuacuccucggagucgggcucgcaauggcgacgacucuucaacuuccggaagacaucgaacaaauggccaacggaauagccuugggacucauggcccuuaaacuaauaacccaauucgagaucuaccaacuauggacagcccuaauaagccucaccuguaguaacacuaucuuuacccuaacuguggcauggcgcaccgcgacacuuauacuagcgggugugucacucuugccaaugugccaguccucguccaugagaaagacagauuggcucccaauggcggucgcugcgaugggggucccuccacuuccgcuguucauuuucagccugaaagacacgcuuaaaagaaggagcuggccacugaacgaaggugugauggccgugggacucguuagcauccucgcuucgagccuacuaagaaacgacguacccauggcgggcccauuaguggccggcggccuacuuaucgcauguuaugucauaaccggaacaagcgcagaccugacaguagaaaaagcggcagauauuacuugggaagaggaagcggagcagacgggcguaagucauaaccucaugauaaccguagacgacgacggaaccaugcggauaaaggacgacgagaccgagaauauacuaacaguccuacugaaaacggcacuccuaaucgucagcggaauauuccccuacucaauacccgccacacuucuggucuggcacacguggcagaaacagacgcagaggucaggcguccuaugggacgucccuuccccacccgagacccagaaggcggagcuagaggagggcgucuaccgcauaaaacaacaggguauuuucggaaagacacaagucgggguuggcguacaaaaagagggcgucuuucauacuauguggcaugugacccgcggcgcuguacuaacuuacaacggaaagcgucucgagccgaacugggcgucuguaaagaaagaccucaucucauacggggguggauggcgacuguccgcgcaauggcaaaaaggugaagaaguccaggucauugccguagaacccgggaaaaacccuaaaaacuuucagacgaugccaggaaccuuucaaacgacgaccggugaaaucggagcgauagcacuugauuucaaaccaggaacaucaggaucgcccauaaucaaccgugaagggaaaguggucggccuguacggcaauggcgucgucaccaaaaacggaggcuacguaagcgguauagcacaaacgaacgcugagccugauggaccaaccccagagcucgaggaagaaauguucaagaaaaggaaccuaacgauaauggauuuacacccaggcagcggcaagacacgaaaguaccugccugcgaucguccgugaagccauaaagcggcgacuucgcacgcuaauucucgcuccgacgagagugguggccgcagaaauggaagaagcacuaaaaggccugccaauuagauaccaaacuaccgccacuaagagcgaacauaccggacgcgaaauuguagaccugaugugccacgcuaccuucacgaugcgacuccugagucccgugcggguaccuaacuauaaucuaauaauaauggaugaagcccacuuuacagaccccgccaguauagccgcgagaggguacauaucgacccgggucggcaugggggaagcagccgccaucuucaugacagccacgccaccaggaacggccgacgccuucccccaaagcaacgcaccaauacaggaugaggagcgagauauaccggagcgcuccuggaacucgggcaacgaguggaucacagacuucgcgggaaaaacggugugguucguucccagcauaaaagccggcaacgauauagcuaauugccuacgaaagaacggcaaaaagguuauacagcucagccggaaaaccuuugacacagaguaccagaagaccaaacucaacgauugggacuucguagugaccaccgacaucucagagaugggcgcaaacuucaaagcagacagggucaucgauccccgaaggugccuaaaaccagucauacuuacagaugguccagagcgggugauacuagccgggcccaugcccguaaccgcugcaucugcagcccaaagacggggucgcguuggccgcaacccacagaaggaaaacgaucaguacaucuucacgggccaaccccucaacaacgacgaggaccaugcacacuggacagaagccaagaugcugcuagauaacauaaacaccccagaaggaauaauacccgcucuguucgaaccagagcgcgagaagucggccgcaauugacggcgaauaccgguuaaaaggggaaagccgaaagaccuuuguagagcuaaugcguagaggggaccuacccgucuggcucgcacacaaaguugcaagcgaaggaauaaaauacaccgacagaaaguggugcuucgacggccaaaggaacaaccaaauacuugaagaaaauauggacguggaaauauggacaaaagagggcgagaagaagaaacugcguccccgauggcuggacgcacggaccuauagcgacccgcucgcccugaaagaguucaaagaauuugcagcgggaaggaaaagcaucgcccucgaccugguaacggaaauuggacgcguucccagccaucucgcacaccgcacccggaacgcccuagacaaccucguaaugcuacacacaagcgaacacgggggaagggcguaccgucaugccguagaagaacuuccggaaacgauggagacgcuguuauugcucgggcuaaugauacuacuuaccgguggagcgauguuauucuuaauuuccggaaagggaauaggcaaaaccagcauaggauuaauaugcgucauugcauccaguggcaugcuuuggauggcugagaucccacuacaguggaucgccagugccaucguacucgaauuuuucaugauggugcugcugauacccgaaccagaaaaacagcguacaccacaagauaaucaauuagcauacguaguuauagguauccuaacacucgcggcaaucaucgcagcgaacgaaaugggguuauuggaaacgacgaaacgugacuuggggauguccaaagaaccgggagucguaucucccacaucuuaccucgacguagaccugcaucccgcuucagcguggacccuauacgcggucgcaacaacggucauuacgccaaugcuccgucacaccaucgagaacagcacagcaaacgucucccuagcagcaaucgccaaccaagcuguggugcugaugggcuuggacaaaggauggccaauaaguaaaauggaccuaggggucccgcugcucgcacuuggaugcuauagccaaguaaauccccuaacacugaccgcugccguccugcuacuaaucacccacuacgccauuauagggcccggccuacaagcgaaggcaacgcgcgaggcgcaaaagcggacggcggcugggaucaugaagaauccuaccgucgauggaauaaugaccaucgaccucgauccaguuauuuacgauuccaaauuugaaaagcaacucggacaaguaauguuacucguacucugcgucguucagcuacuacucaugcgcaccucgugggcacugugcgaagccuugacucuggcgaccgggcccauaacaacacugugggaaggcucacccggaaaauucuggaacacgaccaucgcugucagcauggccaauauauuccgaggcuccuaucuagcgggggcagggcuagcguucuccauuaugaagucaguggguacggggaaaagaggaacggggagccaaggggaaacccuuggagagaaauggaagaagaaacuaaaccagcuaucgcgcaaagacuucgaucuguacaaaaagucaggcaucacugagguggaccgcaccgaagcgaaagaaggauugaaaagaggggaaaucacacaccaugcaguaucaagaggcucagccaaacugcagugguucguugagaggaacaugguaauccccgaagggcgagucauugaucucggcuguggaagaggagggugguccuacuacugugccggacucaagaaaguaacagaaguacgaggcuacacgaaaggcggcccuggacacgaggaaccgguaccaaugagcaccuacggcuggaauauugucaaacuuauguccggaaaagacguauucuaccugccaccagaaaaaugcgacacauugcuaugcgacauuggagaaagcucgccguccccuacugucgaagaaucacguacgauacgaguauuaaaaaugguggaaccauggcuuaagaauaaccaguucuguauaaagguacugaacccauauaugccaaccguaaucgagcaccucgagcggcugcaacgcaagcacggcgggaugcucgugcgaaacccgcuaagccgcaacaguacgcacgaaauguacuggaucagcaacggaaccgggaacaucguggcuuccguuaacaugguaucgcgccugcuauuaaaccgcuucaccaugacccacaggagaccaaccaucgaaaaagacgucgaccuaggggccggaacccgacacgugaacgccgaacccgagacacccaauauggacgucauaggggagcgaauaaaacgaauaaaggaagaacauaacagcacauggcauuacgacgaugagaaccccuacaaaaccugggcguaccacggcagcuacgaagucaaagccaccggauccgcuucaagcaugauuaacggagugguuaagcucuuaaccaaaccaugggacguggucccaaugguaacacaaauggccaugacagacaccacaccguucggccaacagcgagucuuuaaagaaaagguagauacacgcaccccgagguccaugcccggcacccgacgugugaugggcaucacagccgaauggcuauggagaacgcucggcaggaauaagaaaccgaggcuaugcacacgcgaggaguuuacgaagaaagugagaacaaacgcagcuaugggcgccguauucacagaggaaaaccaaugggacuccgcgaaagcugcgguagaggacgaagauuuuuggaaauuaguagaccgagaacgggaguugcacaaacuagguaagugcgggagcugcguuuacaauaugaugggcaaacgagagaagaaacugggcgaguucggaaaagccaaagguagucgcgcaaucugguauauguggcuaggggcaagauaccuggaguuugaggcacuaggcuuucucaacgaagaucacugguucagcagagaaaauagcuauuccgguguggaaggagaaggccuacacaaacucggauacauccuacgagacauuagcaaaauaccagguggugcaauguacgcagacgacaccgcgggaugggauacccgcauaacggaagacgaucuucacaaugaggagaaaaucacccaacaaauggacccagaacaccgacaacuggcaaacgcaauauucaaacuaacauaccagaacaaggugguuaaagugcagcgucccacccccacggggacagucauggacauaauuucucgcaaagaucaacgaggauccgggcagguagguacauacggacucaacacguuuaccaauauggaggcacaacuaauccgucagauggagggggaggguguucuauccaaagcagaccuagaaaacccacaccuuccagagaagaaaauaacgcaguggcuagaaacaaaggggguagaaagacuuaaacggauggcaaucucuggagacgacugcguagugaaacccauugaugaccgguuugccaacgcguuacucgcucuaaaugacaugggcaagguacguaaagacaucccacaauggcaaccaagcaaaggcuggcacgauuggcagcaagugccauucuguucccaucacuuccacgagcuaaucaugaaagacggucgcaaacucgucguacccugucgaccccaagacgaauuaaucgggagagcccgaaucucgcagggcgcaggauggucccuuaaggaaaccgcgugucugggaaaagccuacgcacaaauguggucgcucauguauuuccaucgucgagaucugaggcuagcgucgaacgcaauauguucagcgguuccgguacacugggucccgacuagccgcacgacuuggucaauacacgcgcaucaccaauggaugacaacggaggacaugcugacaguauggaaccggguguggaucgaagacaauccauggauggaagacaagacgcccgucacuacuugggaaaauguccccuaucugggaaagagggaggaucaguggugcggcucacucauuggacuaaccucgcgggcuaccugggcacagaauauccccacagccauacaacagguccgaucccuaauuggaaacgaggaguuccuggacuauaugccguccaugaagcgcuuccgcaaggaagaagagucagaaggggcuauaugguga

SEQ ID NO: 25818 - RNA, 9873 nt, Artificial Sequence
  derived and/or modified CDS sequence (opt11) from DENV-3__JF937632__SS-prME
acaagucucugccucaugaugauccucccagccgcccuggcguuccaccucaccagcagggacggcgagccgagaaugaucgucgggaagaacgagagagguaagagucugcuguuuaagacggccagcggcaucaacauguguacuuugaucgcgauggaccugggcgagaugugcgacgacaccgugaccuacaaguguccccacaucaccgagguggaacccgaggacaucgauugcuggugcaaccugaccagcaccugggugacguacggaacuugcaaccaggccggcgagcaccggcgugacaaacgcuccguggcccuggccccccacgugggcaugggacuggacaccaggacucagacauggaugagcgccgaaggggcguggcgacagguggaaaagguggaaacgugggcccugcgucaccccggguucaccaucuuagcguuauuccuagcgcacuacaucggcacguccuuaacccaaaaggugguuauauucauucuucugaugcucgucacgcccagcaugacgaugcggugcgugggggugggcaaccgcgacuucgucgaaggccuguccggggccaccuggguggacguaguccuggagcacggcggguguguaaccacgauggccaagaacaagccaaccuuggauaucgaacugcagaagacggaagcuacccagcuggcgacgcuccggaagcuuugcaucgaggggaagaucacuaacauuacgacugacagccgcugccccacgcagggcgaggcgacucucccggaggaacaggaucagaacuacguauguaagcauacguacgucgaucgggguuggggaaacgggugcggccucuucgguaagggcucccucgugacaugcgccaaauuucagugccuggaaccuauagaggguaagguuguccaguacgaaaaccucaaguacacagugaucaucacggugcacaccggugaccagcaccaggugggcaacgaaacgcaaggugucacagcggagauaacgccccaagcuucaacaacagaggcgauccugccugaguaugguacacuggggcucgagugcuccccgcgcacgggucuagacuucaacgagaugauccugcucaccaugaagaacaaggccuggaugguccaccggcagugguucuuugaccugccccuuccguggacgagcggcgcgaccacggagaccccgaccuggaaccgaaaggaacuccugguaaccuucaagaaugcccacgcgaagaagcaggagguugucguguuagggucacaagagggcgcgaugcacacugcguuaaccggggccaccgagauccagaacagcggagggaccuccaucuuugcaggccacuugaagugcaggcugaagauggacaagcucgagcuaaaaggcaugucauacgcgaugugcacuaauacauucgugcuaaagaaggagguguccgagacccagcacgggaccaucuuaauaaaaguggaguacaaaggcgaggacgugccauguaagauccccuucucaacugaagacgggcaagggaaggcgcauaacggccgccuuaucacggccaaccccguugucaccaagaaggaggagccggugaauauagaggcugagccgccguucggugagagcaacaucgucaucggcaucggggacaacgcccugaagaucaacugguacaagaagggauccagcaucgggaagauguucgaggcgaccgcccggggcgcacgcaggauggcuauccugggcgacacggccugggacuucggcuccgugggcgggguccucaauuccuugggcaagaugguacaccagaucuucggcagugcguauacugcccuguucagcggcgugagcugggugaugaagauaggcauugggguauugcugaccuggaucggccucaacagcaagaacaccuccaugagcuucuccugcaucgccaucgguaucaucaccuuguaucugggagcagucgugcaagccgacauggggugcgugaucaacuggaaagggaaggagcugaaguguggaagcggaaucuuugugaccaacgaggugcacacguggaccgaacaguacaaguuccaggcagacucuccuaagcgacucgccacggcgauugccggcgcaugggagaacggggucuguggcauccgaagcaccaccaggauggagaaccugcuguggaagcagaucgcgaacgaguugaacuacauucuuugggagaauaacaucaagcugacuguaguugucggugacaucaucggcguccucgaacagggcaagcgcacgcucacgccgcagccuauggagcugaaauacuccuggaagaccugggggaaggccaaaauaguaacggcggagacgcagaacucuuccuucaucaucgacgggcccaacacccccgagugccccagcgucucccgugcguggaaugucugggagguggaggauuauggguucggcguauucacaaccaacauuuggcucaagcugcgcgagguguacacccaauuaugcgaccaccgccucaugagcgcggcugugaaggacgagcgcgccguucacgcagacaugggauauuggaucgagucucagaaaaacggguccuggaagcuggagaaggcaucacucauugaggugaagacuuguaccuggccgaagucccacacccuuuggagcaaugggguguuggaguccgacaugaucauccccaaaagcuuagccgggcccaucucccagcacaaccaucggccgggcuaccacacucagaccgccgggcccuggcacuugggcaagcuggagcuggacuuuaacuacugugaggggaccacgguagugaucaccgagaacugcgggacgcguggccccagccuccguacaacgacaguuucugggaagcugauccacgaguggugcugccguuccugcacccugcccccgcuccgauauaucggugaggauggcugcugguacggcauggaaauccgcccuauauccgaaaaggaagaaaauaugguaaagagccucguguccgcaggcagcgggaagguagacaauuucaccaugggcguucugugcuuagccauccuguucgaagaggugaugcgcgggaaguucgggaaaaagcacaugauagcgggggucuucuuuaccuucgugcuacucuuauccggccagaucaccuggcgcgauauggcgcacacucugauuaugaucggaagcaacgccagcgacagaauggggaugggcgugaccuauuuggcccugaucgccaccuuuaagauccagcccuuucucgcccucggcuuuuuucugcgcaagcugacgagccgggagaauuuacuacugggcguggguuuagcgauggccacgacacugcagcugcccgaggauaucgaacaaauggccaacgggaucgcccuaggccugauggcccuuaaauuaaucacucaauuugaaaccuaccaacuguggacggcccugauaucucugaccuguuccaacaccaucuucacgcugacggucgccuggcgaacggccacacucauucucgccggggugagccugcuaccugucugccagaguucgucaaugcggaaaaccgacuggcuaccaauggcgguagccgccaugggcguacccccccucccccuguucauauucagucucaaggacacccugaagcgccgguccuggccccugaacgagggggucauggccgugggccucgugagcauccuggccuccagccugcuccguaaugacgucccaauggccggcccccugguggcagggggucuucucaucgccugcuacguaauuaccggcaccuccgcggaccugacggucgagcgcgccgcggacauuacgugggaagaggaggccgaacagacaggaguaagccacaaccugaugaucaccguggacgacgauggcaccaugcggaucaaggacgaugagacggagaacauccugacgguuuugcugaagaccgccuuacugaucgugucaggcauauucccguacagcauccccgcgacccugcugguguggcacacguggcaaaaacagacccagcgaagcgguguccugugggacgugccuagcccgcccgagacccagaaggccgaacuggaggaagggguuuaucggauuaagcagcagggcaucuucgggaagacccaggucggcguggguguccagaaggagggcgucuuccacacgauguggcacgugacgagaggcgcagugcucaccuacaacgggaagcggcuggaacccaacugggcguccguaaaaaaggaucugaucagcuacggcgggggcuggcggcucucagcgcaguggcagaaaggggaggagguccaggugaucgccgucgaacccggcaaaaaucccaagaacuuccagaccaugcccggcacguuccagaccacaaccggggagaucggcgcgaucgcccuggacuuuaaacccggaaccagcggcagucccauaaucaaucgggagggaaagguggugggguuguacgggaacggggucgugacgaagaacggcggguacguguccggcauugcccagaccaacgccgagcccgauggacccacccccgaacuggaggaggagauguucaagaagcgcaaccugaccaucauggaccugcaccccggaagcggcaaaacccguaaguaccugccugcuauaguacgcgaggcgaucaagcggagauuacggacucuuauucuggccccgacccgcgugguggccgccgagauggaggaggcccuaaaggggcugccuauucgcuaccagacaacugcgacuaagucggaacauaccggccgcgagaucguugaccucaugugucacgccacguucacgaugcgccuccuaagccccgugcgcgucccaaacuacaaccucauuaucauggacgaggcccacuucacagaucccgccuccaucgccgcgcggggauacaucaguacaagagucggcaugggcgaggcggccgccaucuucaugaccgcgacgccgccugggacggccgacgccuucccgcaauccaacgcacccauccaggacgaggagagggacauccccgagcggagcuggaacuccggcaaugaguggaucaccgauuuugccgggaagaccgugugguucgugcccagcaucaaggcgggcaaugauaucgccaauugccuccgcaaaaacgggaagaaggucauccagcugucucggaagacguuugacacggaguaccagaagaccaagcuuaacgacugggacuuuguggugacaacagauaucagcgagaugggcgcgaacuuuaaggccgaccgggucaucgauccgcggcgcugccucaaacccgucauccugaccgauggccccgagcgcguaauccuggccggacccaugccggucacggcggccuccgccgcccaacgccggggccgagugggccggaacccccagaaggagaacgaucaauauaucuucaccggccagccccucaacaacgaugaggaccacgcccacuggaccgaggcgaagaugcuguuggacaacauuaacacaccagaggggaucauucccgcccuauucgagcccgagagagagaaguccgccgcgaucgacggcgaauaccgccugaaaggcgaaucccgcaagacguucguugagcucaugcggagaggggaucucccaguuugguuagcgcacaagguagccagcgagggcauuaaguacaccgaccggaaguggugcuucgacgggcaacgcaacaaccagauccuugaggagaacauggauguggagaucuggacuaaggagggcgaaaaaaaaaagcuccguccccgauggcuggacgcccggacuuacuccgacccgcuggcccugaaggaauucaaggaguucgccgcuggccgcaagucgauagcccuggaccuggugaccgagauuggccgcgugcccucccaccuagcccaccggacccgcaacgccuuagacaaucuggugaugcugcacacauccgagcacggcgggagggccuaccgucaugcaguugaagaacugcccgagacgauggagacccugcugcugcugggccucaugauucugcugacaggcggcgccaugcuguuccugauuucuggcaaagggaucgggaagaccuccaucggccuaaucugcgugaucgccagcaguggcaugcucuggauggccgagaucccgcuacaguggaucgccagcgcgaucguccuggaguuuuuuaugauggugcucuuaauucccgagcccgagaagcaacguacgccccaggacaaccagcucgcauacguggucauuggcauucucaccuuggccgccaucaucgcugcgaacgagaugggccuacucgagacuaccaagcgcgacuuggggaugucgaaggaaccggguguggugagcccaacgucauaccuggaugucgacuugcaccccgccuccgcguggaccuuauacgccguagccaccaccgugaucacgcccaugcugcgacacacgaucgagaacuccaccgccaaugucagccucgccgcaauagcgaaccaggcaguggugcugaugggucucgauaagggcuggccuaucuccaagauggaccugggcguuccccugcuggcccucgggugcuacagccaggugaacccacugacccuuacagccgcgguacuccuacugauaacacauuaugccaucauuggccccggccuccaggcgaaggccacacgcgaagcccagaagcggaccgccgccgggauuaugaagaacccgacggucgauggcaucaugaccauugaccuggacccuguaauuuaugauuccaaguucgagaagcagcugggccaggugaugcuccugguucuuugugcagugcaauugcugcuuaugcgcaccagcugggcccuaugcgaggccuugacccuggccacggguccaaucaccaccuuaugggagggaucccccgggaaauucuggaauaccacgauagcggugucuauggccaacaucuuccggggguccuaucuagccggggccggccuggccuucagcaucaugaagaguguagggaccggcaagagaggcaccggcccucagggggagaccuugggggagaaguggaagaagaaguugaaccagcugucucggaaagacuucgacuuauacaagaagucagguauuacggagguggaucggacggaggcgaaggaggggcugaagcggggcgagaucacacaccaugcggugucccgcgguagugccaagcuucagugguucgucgagcgaaacauggugauaccggaggggagggugaucgaucucggcugcgggcgaggcgggugguccuacuacugcgccggccugaagaaggucacugagguacgcggcuacaccaagggcgggcccgggcacgaagaacccgugccgaugagcacguauggguggaauaucgucaaacugaugucagggaaggacgucuucuaccugccucccgagaagugcgacacccugcugugcgacaucggcgaauccuccccuagcccgaccguggaagagucacgcaccauuagagucuuaaagaugguagagcccuggcugaagaauaaccaguucugcaucaaagugcugaaccccuacaugcccacgguaaucgagcaccuggagcggcuccagaggaaacacggcgggaugcuggucagaaauccgcuaagcagaaauucgacacacgagauguacuggaucagcaacggcaccgggaauaucguggcauccgugaacauggugagccgccuccuucugaauagguuuaccaugacgcaccgcaggcccacaaucgagaaggacguggaccucggcgcgggcacccgccacgucaacgcggagccugagacgccgaacauggacgucaucggggaaaggauaaaacgcaucaaggaggaacacaauucaacuuggcacuacgacgacgagaaccccuacaagaccugggccuaccacggcagcuaugaggugaaggcaacaggauccgccagcucuaugaucaauggcgucgugaagcuucugaccaagcccugggacgugguuccuauggugacgcaaauggcgaugacggacacuaccccguucgggcagcagcgggucuucaaagaaaagguggacacgcgaacuccccgcagcaugcccggcacuagacggguuauggguaucacggccgaguggcucuggcguacgcugggucggaacaagaagccccgccugugcacccgcgaagaguucacaaagaagguccggaccaacgccgccaugggugcgguguucacugaggagaaccagugggacagcgcuaaagccgcgguagaggacgaggacuucuggaagcuggucgaccgcgagcgggaguugcauaagcuggggaagugcggguccugugucuacaauaugauggguaagagagagaagaagcucggagaguuugggaaggccaaggggagccgagcgaucugguacauguggcugggugcccgcuaucuggaauucgaggccuugggguuccucaacgaggaccauugguucucgagagaaaacagcuacuccgguguggagggggagggccugcaccgccucgguuacauacugcgggacaucagcaagaucccaggcggugcgauguacgccgacgauaccgcaggaugggacacccgcauuaccgaggacgacuugcauaacgaagagaaaaucacgcagcagauggacccagaacacagacagcucgccaaugcaaucuucaagcuaacguaccagaauaaggucgugaagguacagcgcccgacacccaccgggaccguuauggauaucaucucccggaaagaucagagaggcuccggucaagucggcacguaugggcugaacacuuucaccaacauggaggcccagcucauccgccaaauggagggagaaggggugcugagcaaagccgaccucgagaacccgcaccuacccgagaagaagauaacccaguggcuggagaccaaggguguggaacgucugaagcggauggcgaucagcggcgacgauugcgucgugaagcccauugacgaccgcuucgcuaacgcguugcuagcccuaaaugacaugggcaagguucggaaggacaucccucaguggcagcccaguaagggcuggcaugacuggcagcaagucccuuucuguagccaucacuuucaugagcucaucaugaaagacgggcgcaagcuggugguccccugccguccccaggacgagcugaucggccgcgcgcgcaucucacagggggcaggcuggucccucaaggaaacggccugccuggguaaagccuaugcccagauguggucgcugauguacuuccaccggcgcgaccuccgccuggcguccaacgccaucuguuccgcugugccagugcacugggucccuacaucgcgcaccacgugguccauccaugcccaccaccaauggaugaccacggaggauauguugacgguguggaaccggguuuggaucgaagacaaccccuggauggaggacaagacgcccgucaccaccugggaaaacgugccguaccucgggaagcgcgaggaccaauggugcggcucccuuaucggguugacaagccgggccacgugggcgcagaacaucccuaccgcgauccagcaaguccgcucucugaucggcaaugaggaguuccuugacuacaugcccucaaugaaacgcuuccgaaaggaagaagaguccgagggagccauuugguga

SEQ ID NO: 25819 - RNA, 9873 nt, Artificial Sequence
  derived and/or modified CDS sequence (opt11) from DENV-3__HM756281__SS-prME
accagccucugccucaugaugauacuacccgccgcccuagcguuucaccucaccagccgggacggggagccccggaugaucguggggaagaacgagcgcggcaagagccucuuauucaagacagccuccgggaucaauaugugcacccugauagcaauggaccugggugagaugugugacgauacgguaaccuacaagugcccucacaucaccgagguggaacccgaggacauugacuguuggugcaaccugaccagcaccuggguuaccuacgggacguguaaccaagcuggcgagcacaggagagacaagcguuccguggcucuggcgccccacgugggaaugggacuugacacccgcacgcagaccuggaugagcgcagagggcgccuggcggcaggucgagaaggucgagacgugggccuuacgccacccuggguucaccauacucgcgcuguuccuggcgcacuacaucgggacauccuuaacccaaaaggugguuaucuucauccugcugaugcucgucacucccucuaugaccaugcggugcgugggggugggcaacagagacuucgucgaaggccuguccggggccaccuggguggacgugguccuggagcacggcggaugcgucaccacaauggccaagaauaagcccacccucgacauugaacugcagaagacggaggccacccagcuagcuacguuacggaagcugugcauagaaggcaagauuaccaauaucaccacggacagcagaugccccacccagggggaggcaacccugccggaggagcaggaucagaacuacgugugcaagcacaccuacgucgaucggggcuggggaaacgggugcgggcucuucgguaagggcucccuggugaccugcgccaaguuucagugucuggagcccaucgagggcaaggugguccaguaugagaaccucaaguacacugugauuaucaccgugcacacaggggaccagcaccagguaggcaaugagacacaaggggugacggccgaaaucaccccccaggcuagcaccaccgaggcgauacugcccgaguauggcacccuagggcucgagugcucaccgcgcacggggcuugauuucaacgagaugauccuccucaccaugaagaacaaggcuuggaugguccaccggcagugguucuucgaccugccccugccuuggaccagcggagcgacaacggaaacccccaccuggaaccgcaaggaacuccuugugaccuucaaaaaugcccacgcgaagaaacaggagguggucgugcuggggucccaggagggcgccaugcacacagcccucaccggggcgaccgaaauacagaacaguggcggaaccuccaucuucgccggccaccugaagugucggcugaagauggacaagcuagaacugaagggcaugagcuacgccaugugcacgaauaccuucgugcugaagaaggaggucucugagacccagcaugguaccauauuaaucaaaguggaguacaagggcgaggacgugccgugcaagaucccguuuagcacggaggacgggcagggcaaagcucacaacgggcguuugaucaccgcgaaccccgucguuaccaaaaaggaggagcccgugaacauugaggccgagccgcccuucggggagucuaacaucgugauuggcauuggggacaaugcucugaagaucaauugguacaaaaagggcuccagcaucgggaagauguucgaagcgaccgcgcggggcgcccgccggauggccauucugggagacacagccugggacuucggauccgugggggggguacucaacagccugggcaagaugguccaccagaucuucggcucagcuuacaccgcccuguucagcggagugagcugggucaugaaaaucggcauuggaguccucuugaccuggauuggccugaacuccaagaacaccuccaugagcuucagcugcauagcgaucgggaucaucacgcucuaucugggagcgguuguucaggcggauauggggugcgucgugaacuggaagggcaaggaacugaagugcggcagcgggaucuuugugaccaacgagguccauacauggacagagcaauacaaguuucaggccgacucgcccaagagacucgccacggcuaucgccggcgccugggagaacggggugugcggcauccggagcaccacccggauggaaaaccuguuauggaagcagaucgccaacgagcucaacuacauccugugggagaacaauaucaagcucaccguugucgugggggacaucaucggaguccucgagcaaggcaagaggacccugacuccccaaccgaaagagcugaaguacaguuggaagacauggggcaaggccaagaucgucaccgcugaaacgcagaauagcagcuuuauuaucgacggacccaacacgcccgagugccccagcguaucccgggccuggaacgugugggaggucgaggacuacggguucggcgucuucaccaccaacauauggcuuaagcugcgugaagucuacacccaacugugcgaccaccggcucaugagcgcggccgucaaggacgaacgcgcuguccacgccgacaugggcuacuggauagagagccagaaaaacgggucuuggaagcuggagaaggcuucgcugauugaggugaaaacgugcacauggccgaagucccacacccuauggagcaacggcguccuggaguccgacaugaucauccccaagucacuggcggggcccaucagccaacacaaccaccggccgggcuaccacacgcagacugcagguccguggcacuuggggaagcuggaacuagauuucaacuauugcgagggaacuaccgugguaaucacagaaaacugugggacgagaggccccagccuccggacuaccaccgucuccgggaaacugauccacgaguggugcugccgcagcuguacucuuccaccccuacgguacaugggcgaggacggaugcugguacgggauggagauucgccccaucuccgagaaggaggagaacauggucaaaagccuggucuccgccggcagcgguaagguggacaauuucaccaugggcguucugugccuggcgauucuguucgaggagguuaugcgggggaaguucggaaagaagcauaugaucgccggggucuucuuuaccuuuguguuacuccugagcggucagaucaccuggcgcgacauggcgcacacacuuaucaugaucgggagcaacgccagcgacagaauggggaugggcgugacauaccucgcucugaucgccaccuucaagauccagccguuccuggcccuuggguucuuucugcgcaagcugacaagccgcgagaaucuccugcugggcgucggccucgcuauggcaacgacccugcagcugcccgaggacaucgaacaaauggccaacgggaucgcgcucggccugauggcgcuuaaacuaaucacccaguucgagaccuaccagcuuuggaccgcccucaucagccugaccugcuccaauaccaucuucacacuuacgguagccuggcgcaccgcuaccuuaauccucgccggagucagccugcugccggugugccaauccagcuccaugaggaagaccgacuggcuccccauggcgguggcggccaugggcgugccgccccuuccgcuguuuaucuuuagccuuaaggauacgcugaagcggcgcuccuggccccuaaacgaggggguaauggccgugggccuggucagcauccucgccaguagccugcuccggaacgacgugcccauggcgggcccccuggucgcaggcggguuguuaaucgccugcuacgucaucaccgggacguccgccgaccugaccguggagaaggcggcggacaucacgugggaggaggaggccgagcagaccggggucagccacaaccugaugaucaccguggacgacgaugggaccaugcgcauaaaggacgacgaaaccgaaaacauacucacggugcugcugaagacagcccuccugauaguguccggcaucuucccguacucgauucccgcaaccuugcucgucuggcacacauggcagaagcaaacgcagcggagugguguacuaugggacguccccagcccgcccgaaacccagaaagcugagcucgaggaggggguauaccgcauaaagcagcaggggaucuucggcaagacccaggugggcguaggaguccagaaggagggcgucuuccacacgauguggcacgugacgcggggcgcgguccucaccuauaacgggaagaggcuggagcccaacugggccuccgucaagaaagaccugaucagcuauggagggggcuggcggcucuccgcccaauggcagaagggggaagaggugcaggucauagccguggagccaggcaagaaucccaagaacuuccagaccaugcccggcaccuuccagaccaccaccggggagauuggcgcgaucgccuuggacuuuaagccugggacaucaggcagccccaucaucaaccgcgaaggcaaaguggucgggcuuuacggaaacggcgucguuacuaagaacggcgguuacgucagugguaucgcgcaaaccaacgcagagccggacggccccacacccgaacuggaggaagagauguucaagaagcguaacuuaacuaucauggacuugcaccccgggagcggcaagacacguaaguauuugccggccauugugcgggaagcaaucaagcgccggcuccgcacccuaauccuggcccccacccggguggucgcugcggagauggaggaggcccucaagggccugccaauccguuaccaaacgacugcgaccaaguccgaacauaccgggcgagagaucgucgaccuaaugugccacgcgaccuucacaaugcgccuccugagccccgugcgggucccgaauuauaaucugaucaucauggacgaggcucacuucaccgacccagccuccaucgccgcacgcggguacaucagcacacgggugggcaugggagaggccgccgcuaucuucaugacagccacgccucccgguaccgccgacgccuucccgcaauccaacgccccuauccaggacgaagagcgcgacauccccgagcgcagcuggaauuccgguaacgaguggaucaccgacuucgccgggaagaccgucugguucguccccagcauaaaggcuggcaacgacaucgcaaauugccuacgcaaaaacgggaagaaagugauacagcugucccgaaagacguucgacaccgaguaccaaaagaccaagcugaaugacugggacuucguggucaccacagacaucagcgagaugggcgccaacuucaaagccgaccgggugaucgacccgcgccggugccucaagcccgugauccugacggacggccccgaacgcgucauucucgccgggcccaugccagucaccgcggccuccgccgcccaacggcguggccggguggggcgcaacccacagaaggagaacgaccaauacaucuucacuggccagccccucaacaacgacgaggaccacgcccacuggacugaagcgaagaugcugcuggacaauaucaacacgcccgaggggaucaucccggcccucuucgaacccgagcgggagaagucagcugccaucgauggugaguaccgccuaaagggcgagucccggaagacuuucgucgaguuaaugcgucgcggggaccuccccguguggcuggcgcacaaggucgcuucugaggguaucaaauacaccgaccgcaaaugguguuucgacgggcagcguaacaaccagauccuggaagagaacauggacguggagaucuggacuaaggagggagagaagaagaagcuccgcccacgauggcuggacgcccgcacguacuccgauccgcuggcccugaaagaguuuaaggaguucgccgcgggccgcaagagcaucgcucuggaccuggugaccgagaucgggcgggucccuucccaccucgcccaccgaacucguaacgcccuggauaaccuggugaugcuccacaccagcgagcacggcggccgcgccuaccggcaugcggucgaagaauugcccgagacaauggaaacccugcugcuucugggccuaaugauccugcugaccgguggggccauguuguuccugaucagcggcaaggggaucggcaagacuuccaucgggcugaucugcguuauugccucguccggaaugcucuggauggccgagaucccccugcaguggaucgccuccgcuauuguccuggaguucuucaugauggugcuccuaaucccagagcccgagaagcagcggacgccccaggacaaccaacuggccuacgucgugaucggcauccuaacccuggccgccaucaucgccgcgaacgaaaugggccuucucgagaccaccaaacgggaccuggguauguccaaggagccgggagucgugagccccacguccuaccucgacguggaccuccaccccgcaagcgccuggacacuguacgcgguggcuaccaccgucaucaccccaaugcuacgccacaccaucgagaacagcaccgccaacgugucacucgcggcgaucgcgaaccaggcggugguacuuauggggcuggacaaaggguggccgaucuccaagauggaccucggcgucccucuguuggccuuagggugcuacucacagguuaacccccugaccuuaacagccgcaguccuccugcuuaucacccauuacgcuaucaucggccccggccuacaggcaaaggcgaccagggaggcccagaagcgcaccgccgccgggauaaugaagaauccgacuguggacggcauaaugaccaucgaccuggaccccguaaucuacgauuccaaguucgagaagcagcugggacaagucaugcucuuagugcugugugcgguccagcuccugcuaaugcggaccagcugggcccucugcgaggcccugacauuggccaccggcccaaucacgacgcucugggagggcucccccggcaaguucuggaauacuacgaucgcggucagcauggccaacaucuuucguggcuccuaccuggccggggccggccuggccuucucgaucaugaaguccguagggacuggcaaacggggcacagggagccagggagagacucuuggggaaaaguggaagaagaagcuaaaccaauuguccaggaaggacuucgaccuuuacaagaaaucuggcaucaccgagguggaccggacggaggcgaaggaggggcugaaacggggcgagauaacccaccacgccgucagcaggggguccgcuaagcugcagugguucguggagcgcaacauggugaucccggagggacgugucaucgaccucggcugcgggagaggaggguggagcuacuauugcgccggucugaagaaggugaccgaggugcguggcuauaccaagggcgggccgggccacgaggaacccguucccauguccacguacggcuggaacaucgugaaacuaaugagcgggaaggacguguuuuaccucccacccgagaaaugcgacacccuacugugcgacaucggcgaguccagccccucccccacagucgaggagagccgcaccauccgcgugcugaagaugguggagccguggcucaagaacaaccaauucugcaucaagguccugaaucccuacaugcccacgguaaucgagcaccuggagagacuccagcgcaagcacggcggcaugcuggugcguaacccccugucccgcaacuccacccacgaaauguacuggaucucgaacggaacuggaaacauugucgccagcgugaacaugguuagccggcuccugcugaaccgcuucaccaugacgcaucgucgccccaccaucgagaaggacgucgaccucggcgcgggcacccgucacgucaaugccgagccagagacccccaacauggacgugaucggcgaacgcaucaagcggaucaaggaggagcacaacucaaccuggcacuacgacgacgagaacccguacaagaccugggccuaccacggcucuuacgaagucaaggccaccgggagcgccuccagcaugauuaacggcguggucaaauugcucaccaagcccugggacguggugccuauggucacgcagauggcgaugacggacacaacccccuuugggcagcagcgcguuuuccgggagaaaguggauacaaggaccccgcgcagcaugcccggcacgcgucgggugaugggaauaaccgccgaguggcucuggcgcacgcugggccggaacaagaaaccccgccugugcacccgcgaggaguucaccaagaagguuagaaccaacgcugcuaugggagcgguguucacggaagaaaaccagugggacagcgccaaggcugcugucgaagaugaggacuucuggaaguugguggaucgcgagcgggagcugcacaagcuggggaagugcggcagcugcguguacaacaugauggggaagcgcgagaagaaguuaggcgaauucggcaaggccaaagggucccgggccaucugguacaugugguugggugcccgcuaccuggaguucgaggcccucggguuucuuaacgaagaccacugguuuagccgagagaacagcuacagcggcguagagggggagggccuucacaagcucgguuacauccugcgcgacaucucuaaaaucccggggggcgcuauguacgccgacgauaccgcggguugggacacccggaucaccgaggaugaccugcacaaugaggagaaaauaacacagcaaauggaccccgagcaccgucaauuagcaaacgccaucuuuaaguuaacuuaccaaaacaagguggugaagguccagagacccacccccaccggcaccgugauggacauaauuucacgcaaggaccagcggggcuccggccagguagguaccuacgggcucaauaccuucaccaacauggaggcucaacucauccgacagauggagggcgagggcguccugagcaaggccgaccuggagaacccccaccucccggagaagaagauaacccaguggcucgaaacgaagggcguggagagacuuaagcgcauggcgauuuccggggacgacugcguggucaagcccauagacgaucgguucgccaacgcccugcuugcacugaacgauauggggaagguaaggaaggacaucccccaauggcagcccucuaagggcuggcacgacuggcaacaggucccguuuugcucccaucacuuccacgaacucaucaugaaagacggccguaagcuggucgugccgugccggccccaggacgagcugauuggccgagcccgcaucucccagggggcgggcuggagucucaaggaaacggccugccugggcaaggccuacgcgcagauguggagccugauguacuuucaccgccgggaccugcgccuggccuccaacgccaucugcagcgccgugcccguccacugggugccgacaucccggaccacguggucuauccaugcgcaccaccaguggaugacgaccgaggacauguugaccguguggaaccgagucuggaucgaagacaacccuuggauggaggacaagacaccggugacuaccugggagaaugugcccuaccucgggaagagggaggaccaguggugcggaucccugauagggcuuacaagccgugccacgugggcgcagaacaucccgaccgccauccagcagguccggagccucauugguaaugaggaauuccuggacuacaugcccuccaugaaacgauuccggaaggaggaggagucagagggggccaucugguga

SEQ ID NO: 25820 - RNA, 9873 nt, Artificial Sequence
  derived and/or modified CDS sequence (opt11) from DENV-3__JF937643__SS-prME
accagcuugugucuaaugaugauccuccccgcagcucucgcguuccaccucaccagccgggacggcgagccccgcaugaucgugggcaaaaacgaacgcggaaaaucucugcuguucaagaccgcuuccgggaucaacaugugcacccugaucgccauggacuuaggcgaaaugugcgacgauaccgugacuuauaaguguccacauaucaccgagguagaacccgaggacaucgauugcuggugcaaucugaccuccacuuggguaacauacgguaccugcaaccaggccggagagcaccgccgcgacaagcgguccguggcgcuugcgccucacgugggcaugggacucgauacccgcacucaaacguggaugagcgcggaaggagccuggcgccagguugagaaggucgagacgugggcccugcgccacccgggauucaccauccucgcguuauucuuagcccacuacaucggcaccagucucacccagaaggugguaaucuuuauucuccugaugcucgucaccccaucaaugaccaugcgguguguggggguggguaacagagacuucgucgagggccuuuccggggccaccuggguggacgugguccuggagcaugggggaugugugacuaccauggcaaagaacaagcccacccucgacauugagcugcagaaaacggaggccacucagcuggcaacgcuucggaagcugugcaucgaggguaagauaacuaacaucaccaccgacuccaggugccccacucagggcgaggccacccugccagaggagcaagaccagaauuacgugugcaagcacaccuacguugaccggggguggggcaacggguguggguuauucgguaaggggucucucgugacaugcgccaaguuccaaugucucgagcccaucgagggcaagguaguccaauacgagaaucucaaguacacggugaucaucaccgugcacaccggugaccagcaccagguugggaacgagacccagggcgugacggcugagaucacaccccaagcgagcaccacugaggcgauacuccccgaguacgguacucuggggcucgagugcucuccgcgcacgggucuugauuucaacgagaugauccuucucaccaugaaaaacaaggcuuggaugguccaucgacagugguucuucgaccugcccuuacccuggaccagcggcgcaacuaccgagacacccaccuggaacagaaaggagcuccuggucaccuucaagaacgcgcacgcgaagaagcaggagguggucguccuagggucccaggagggcgcgaugcacacugccuuaaccggggcgacagaaauccagaacagcggcgggaccuccaucuucgcgggacaucugaagugcagacugaagauggauaaacuagagcuuaaaggcaugucuuacgcuaugugcacgaacaccuuugugcugaagaaagaggucuccgagacccagcacgggacaaucuuaaucaaaguugaguacaaaggcgaggacguaccgugcaagauccccuucagcacggaggacggccagggcaaggcgcacaacggccgccugauuacugccaaccccgucguuaccaagaaagaggagccgguaaacaucgaagccgaaccucccuucggggagagcaauaucguaaucgguaucggggacaacgcccugaaaaucaauugguacaagaagggauccuccaucgggaagauguucgaagcuaccgcccggggcgccagacguauggccauccugggcgacaccgccugggauuuuggcuccgugggcggggugcucaacagccuggggaagaugguccaccagaucuucgggucagcguacaccgcucuguucaguggcguguccugggugaugaagauaggaaucgggguccuccugacauggauaggacugaacucgaagaauacguccaugaguuucuccuguauagccauugggauaaucacgcucuaccugggcgcaguggugcaggcggauauggggugcgucaucaacuggaagggcaaggaguugaagugcgggucugggaucuucgugaccaacgagguacacacuuggaccgagcaguacaaguuccaggccgacucccccaaacgcuuggcgacggccauugcgggcgccugggagaacggaguaugcggaauccgcagcaccacgcggauggagaaucugcuguggaaacagaucgcgaacgagcucaacuacaucuuaugggaaaacaacaucaagcucacgguugugguuggggacaucauuggcguacucgagcagggcaagcgcacucuuacaccccagccuauggaauuaaaguacuccuggaagacaugggguaaggcuaagaucgugaccgcugagacacagaacagcuccuucauuaucgacggccccaauacgcccgagugccccuccgucucccgggccuggaacgugugggagguggaagacuacggguuuggcguguucaccaccaauaucuggcugaagcugcgggaaguguauacgcagcugugcgaccaccggcuaaugucagcugccgugaaggacgagaaggccguccacgccgacaugggcuacuggaucgagagccagaagaacgguuccuggaaacuggaaaaggcaucgcugaucgaagugaagacaugcaccuggccgaagucccacacucucuggaguaacggcgugcuggaaucugacaugaucaucccaaaaagccuggcggggccgaucucccagcauaaccaccgccccgguuaccacacccaaacagcagggccauggcauuuagguaagcuggagcuggauuucaacuacugugaggguacgacuguagugaucaccgagaacugcgggacccggggccccagccuccguaccaccaccguguccggaaagcuaauccacgaguggugcugccggagcugcacccugccgccccuccguuacaugggcgaggacgguuguugguacggcauggagauccggccgaucuccgagaaggaggagaacaugguuaagagcuuagucucggccggaagcgggaaggucgacaacuucaccaugggggucuuaugccucgccauccucuucgaggaggucaugcgcggcaaauucggcaagaaacacaugaucgccgggguguucuucacauucguccuucuacugucgggccagauaaccuggcgggacauggcccacacccuuaucaugauaggaagcaacgcuucagaucgcauggguaugggcguaaccuaccucgcccugaucgccaccuucaagauucagcccuucuuggcucuggguuucuucuuaagaaaacugacuucucgugagaaccuucuccuuggaguggggcucgcuauggccacgaccuuacagcugcccgaggacaucgagcagauggcgaacgggaucgcccucgggcugauggcgcugaaacuuauagcccaguuugagaccuaccaguuguggaccgccuugaucagccuaacgugcuccaauaccaucuucacgcugaccgucgcuuggcggacggccacucugaucuuagcggguguaucucugcugccagucugccaauccuccuccaugcgcaagacagacuggcucccgauggcuguugccgcgaugggcgugccgccucucccucuguucaucuucagccucaaggacacucucaagcggcgcuccuggccccugaacgaaggugucauggcuguggggcucguuagcauucuggcguccucucugcuccgcaacgacguccccauggcuggcccucugguggcugguggccuguugaucgccugcuacgugaucaccggcaccagcgcagaccugaccgucgagaaggcggccgacaucaccugggaggaggaggcugagcagacgggcgugagccacaaucuaaugaucgcaguggaugacgacgggacgaugcggauuaaggacgacgagaccgagaacauccuuaccguccugcugaagaccgcccuccugaucgugagcggaaucuucccuuacucgauccccgccacgcuacucgucuggcacaccuggcagaaacagacccaacgcuccggcgugcugugggacgugcccagcccgcccgaaacgcagaaggccgagcuggaagagggggucuacaggaucaagcagcagggcauuuuugggaagacgcaggucggaguaggggugcagaaagaagggguauuccauacuauguggcacgugaccaggggcgccgugcucaccuauaacgggaaacgccuugagcccaacugggccuccgucaaaaaggaccugaucucauauggcggcggcuggcgcuuaagugcgcaguggcaaaaaggggaagaaguccaggugaucgccguagagccuggcaaaaacccuaagaacuuccagacaaugcccggaaccuuccaaacuacgacgggggagaucggcgcuaucgcauuagauuucaagcccgggaccucgggauccccuaucaucaaccgagagggcaaagugguggggcuuuacggcaacggggucgucacgaagaacggcggguaugugagcgggaucgcgcagaccaacgcggaacccgacggacccacgcccgaauuagaggaagaaauguucaagaagcgcaaccucaccaucauggaccugcaucccggaagcggcaagacccgaaaauaccuaccggcaauuguacgcgaggccauaaagcggcgccugcggaccuugaucuuagcccccacgcgggugguggccgccgagauggaggaggcccuaaaggggcugccgauccgauaccagaccaccgcaaccaaaucugaacacacgggccgcgaaaucgucgaccuaaugugccaugccacuuuuaccaugcgccuccugagccccgugcgcgugccgaacuacaaccugaucaucauggaugaggcccacuuuacagacccugcgucuauagcugcccgggguuacaucagcacgcgugucggcaugggagaggcugcggcaaucuucaugaccgccacgccacccgggacugcugacgccuucccacagucuaacgcgcccauccaggaugaggagcgggacauaccagagcguagcuggaacagcggaaaugaguggauaaccgacuuugccgggaaaaccgucugguucgugccgagcauaaaagccgggaacgacauugcgaacugccugcgcaagaacgggaagaagguaauacaguugagucgaaagaccuucgacacggaauaccagaagaccaagcucaaugacugggauuucguggugacuaccgacauuucugagaugggcgccaacuucaaggcagacagaguuauugacccgcgacggugccucaaaccgguuauccugacggacggcccagagcgggucauucuggccggucccaugccgguuaccgccgccagcgcugcgcagcggcggggccgcgugggccggaacccccagaaggagaaugaccaguacauuuucacugggcagccccucaauaacgacgaagaucacgcccauuggacagaggcaaagaugcuacucgacaacauaaauaccccagaaggaaucaucccggccuuauucgagccagagcgcgagaaaagcgcggcaauagauggcgaauaccguuuaaagggcgaaucccgcaagaccuucguggaguugaugcggcgcggugaccuccccguauggcuggcucacaaaguggccuccgaaggcauaaaauacacagaccggaagugguguuucgacgggcagcguaacaaccaaauccuggaggagaacauggacguggaaaucuggaccaaagagggggagaagaagaaacugcgucccagauggcucgaugcccgcaccuacuccgauccucuggcucucaaagaguucaaggaguucgcagcgggacggaaaagcauagcucuggaccugguuaccgagaucggacgugugccuagccaucucgcacaccggacgcgcaacgcgcuggacaaccuggugaugcuccacacaagugagcacggagggcgggccuaccgccacgccguggaggaacugcccgaaacaauggagacacuguuacugcuaggccucaugaucuuacucacaggcggugccaugcuuuuccugaucagcgggaaagggaucgggaaaaccuccaucgggcugauaugugugaucgccuccucaggaaugcucuggauggcggaaaucccucuucaguggaucgcgucugccaucgucuuggaguucuuuaugauggugcuccugaucccagagcccgaaaaacagcggacgccccaggacaaccaguuagcguauguggucaucgggauccuuacccuggccgcgguaauugcggcgaacgagaugggccuguuggagacgaccaaacgcgaccucggcauguccaaagagccggggguggucucacccaccuccuaccuggacguagaucuccaccccgccucagcguggacccuguacgccguagccacgaccgugaucacccccaugcugcggcacaccaucgaaaacuccacggcgaacgucucacuggccgccaucgccaaucaggccgucguacugaugggccuggacaagggguggccgaucagcaaaauggaccucggcgugccccugcuugcacucggguguuacucgcagguuaacccccucaccuuaaccgccgccguccuccugcucauaacccacuacgccaucaucggaccagggcuccaagcgaaggccacgcgggaggcccagaagcgaaccgcugcagggaucaugaagaacccgaccguggacgggaucaugacaaucgauuuggaccccguaauuuacgacuccaaauucgagaagcagcuggggcaggucaugcuccucgugcugugugcuguccaacuccugcuuaugcgcacgagcugggcccuaugcgaggcucucacccuggccaccgggcccauuaccacgcucugggaggggucccccgggaaguucuggaacaccaccaucgccgucuccauggccaacaucuuccggggcucauaccuggccggcgccggccuugcuuucagcaucaugaaguccguagggacgggaaaacggggcacugguagccagggcgagacccucggggagaaguggaagaagaaacugaaccaacugagccggaaggauuucgaucucuauaagaagucgggcauuaccgagguugaccgaacggaggccaaagaggggcugaagcguggcgagaucacccaucacgccguaucacgcggcagugcaaagcugcagugguucguggagagaaacaugguuaucccggaggggcgcgucaucgaccucggcuguggucggggcggcuggucguacuacugcgccggccuaaagaagguaacagaaguuaggggguacacaaaaggcgggccagggcacgaggaaccgguucccaugagcaccuacggauggaauauuguuaaacugaugagcggcaaggacguguucuaccucccgcccgagaaaugcgacacccuccugugcgacaucggggaguccagccccuccccuacgguagaggagagcaggacuaucaggguccugaagauggucgagccguggcucaagaauaaccaguucugcauuaaaguccucaacccuuauaugcccacugugaucgagcaccucgagcgccuccagcggaagcaugguggaaugcuggugcgcaauccgcugucccggaauagcacccaugagauguacuggauauccaacggcacggggaacaucguggccagcguuaacauggugucccgccuccugcuaaaccgguucaccaugacccaccgccggccgacaauugagaaagacgucgaccuuggcgccggcacgcggcacgugaacgcugagcccgagaccccuaacauggaugugaucggcgagaggaucaaaaggaucaaggaggaacacaacagcaccuggcauuacgacgacgagaacccguauaagaccugggcauaccacgguagcuacgaagucaaggcgacugguagcgcuuccagcaugaucaacggcguggugaaacuucugacaaagcccugggacguggugcccauggucacucaaauggcuaugacugauacgaccccuuucggucaacagaggguguucaaagagaaggucgauacucggaccccgcggucgaugcccggcacgcgccggguuaugggcaucacugccgaguggcucuggcgcacccuagggcgaaacaagaagccaaggcuguguacccgggaagaguucacgaagaagguucgcaccaacgcggccaugggcgcaguguucaccgaggagaaucaaugggacuccgccaaggccgcgguugaggacgaggacuucuggaagcugguggaccgcgagcgagagcuccacaaacugggaaagugcggcagcugcguguacaacaugauggggaagcgggagaagaaacucggugaguucgggaaggcgaagggcucccgggccauuugguacauguggcuuggcgccagguaucuggaguucgaggcccucggguuucugaacgaggaucacugguuuucucgggagaacuccuauucuggcguggagggggagggccugcacaaguuaggcuacauccugcgggacaucucgaagaucccagggggcgcaauguacgccgacgauaccgccgggugggacacacggauuaccgaagaugaccuucauaacgaggagaaaaucacccagcagauggacccggagcaccgccagcucgccaacgccauauucaaacucacauaccaaaacaaagucgugaagguccagcggcccacgccuaccggcacggugauggauaucauuucacgcaaggaucaacggggcuccggccaagugggcaccuacgggcugaacaccuucacgaauauggaagcacagcucauccgccagauggagggcgaaggggugcugagcaaggcugaucucgagaauccccacuugccggagaagaagauaacucagugguuagagacgaagggcguagaacgacugaagcguauggccaucuccggcgacgacugcguaguuaagcccauugacgaccgguucgccaacgccuuacuggcguuaaacgauauggggaagguacggaaggacaucccccaguggcagccuagcaaaggcuggcaugauuggcagcagguaccguucugcucucaucacuuccacgaacucauaaugaaggacgggagaaagcuagucgugccgugccgcccccaggacgagcucauuggccgggccaggauaagccagggggcuggcuggucgcucaaagagacugccugccucggcaaggcguacgcucagauguggucgcugauguacuuccaccggcgugaccugcgucuagccucuaacgccaucugcagcgccguucccgugcacugggugccgacgucccggaccaccugguccauccaugcucaccaccaguggaugaccacagacgacaugcugaccguguggaaccgggucuggaucgaggacaaccccuggauggaggauaaaacccccgugacaacgugggagaacguucccuaccuagggaagcgggaagaccaguggugcggaagccugauugggcugaccucccgcgccacaugggcccaaaauauaccgaccgcuauccagcaaguucguucacucauugguaaugaagaguuucuugacuacaugccaucgaugaagcgcuuccgcaaggaggaggagucggagggcgccaucugguga

SEQ ID NO: 25821 - RNA, 9873 nt, Artificial Sequence
  derived and/or modified CDS sequence (opt11) from DENV-3__HM181972__SS-prME
accucgcucugccugaugaugauccugccugcggcgcuugcauuccaucucaccagccgggacggggagccucggaugauaguggggaaaaacgagcgaggcaaaucuuuguuauucaagaccgcguccgggaucaauaugugcaccuuaaucgcaauggaccugggcgagaugugcgaugacacagugaccuacaagugcccccauaucaccgagguagagcccgaggacaucgauugcuggugcaaccucacaaguaccugggugacuuacgggacgugcaaccaggcaggcgagcacaggcgagacaagcgguccguggcgcuggcgccccaugugggcauggggcuggacacgagaacccagaccuggaugagcgccgagggcgccuggcggcaggucgagaagguggaaacgugggcccuucgccauccggguuuuacaauccucgcacuguuccuggcccauuacaucgggaccuccuuaacacagaaagucgugauauuuauuuugcugaugcucgucacgccgagcaugacaaugcgcugcguugguguaggcaaccgcgacuuugucgagggccugucaggggcgaccuggguggacgugguccucgagcacgggggcugcgucacaacaauggccaagaacaagccuacccucgacauugagcugcaaaagaccgaggcuacccaguuagcaacgcuccggaagcugugcaucgagggcaaaaucaccaacaucacuaccgacagccgcugccccacacagggcgaggccacucugccagaggagcaggaccaaaacuacgugugcaagcacacuuacgucgaccggggguggggcaacgggugcggucuuuucgggaaaggcucacugguaacaugcgccaaauuucagugccuggagcccauagaaggaaaggugguccaguaugagaaccucaaauauacggugaucaucacagugcacaccggggaccaacaccaagucggcaaugaaacccagggugugacugccgaaaucacgccccaggccucaaccacugaggcgauccugcccgaguacggcacacuggggcuagaaugcucgccucgcaccggccuggacuucaacgagaugauccuguugaccaugaagaacaaggcauggauggugcaucggcagugguucuucgaccuuccccuccccuggacaagcggcgcgaccacugaaacaccaaccuggaaccgcaaagaacuccuggugaccuuuaaaaacgcccacgcuaagaaacaagagguggucgugcuggguucgcaggagggcgcgaugcacacggcccucaccggggccacggagauacaaaacaguggcgggaccuccaucuuugcaggccaccugaagugccgccugaagauggauaagcucgagcugaaaggaaugucguaugccaugugcacuaacaccuucgugcuuaagaaggaagucucagagacacagcaugggaccauccucaucaagguggaauacaagggcgaggacgugccgugcaagaucccguucucgacggaggacgggcaggguaaggcucauaauggccgccugaucacggccaaccccgucguaaccaagaaggaggagcccgugaacaucgaagccgagccgcccuucggugaaagcaacauagucaucgguaucggggacaacgcccuuaagaucaacugguauaagaaggggucgagcaucggaaagauguucgaggcaaccgcacggggagcccgucggauggccauccugggcgacacggccugggacuuugggucagugggcgggguacucaacagucuagggaaaaugguccaccagauauucggauccgcguacaccgcgcucuucagcggcguguccugggugaugaagauagguaucgggguacuccuaaccuggaucggucuaaacucuaaaaauaccaguaugagcuucagcugcaucgcaaucgggauaauuacgcucuaccugggcgccguagugcaggcagacauggggugcgucaucaacuggaagggcaaggaguuaaaauguggaagcgggauuuucgugaccaacgagguacauaccuggaccgaacaguacaaguuccaagcggacuccccuaagcgcuuagccacggccaucgccggggccugggagaacggggucugcggcauccgcagcaccacccgcauggagaaccugcuguggaagcagauugcgaacgagcucaauuacauccugugggagaauaacauuaaacugaccguggugguaggagacaucauuggcgugcucgagcagggcaaaaggacgcugacgccucagccgauggagcugaaauauaguuggaagacuugggggaaggcgaaaaucguaaccgcagagacgcaaaacagcuccuucaucauugacggcccuaacaccccugagugccccagcgucucacgggccuggaaugugugggagguggaagacuacggguucggcgucuuuaccaccaacauuuggcucaagcuacgcgagguguacacccagcuaugugaccaucggcucaugagcgcggccgugaaggacgagcgcgcuguccacgccgacaugggguacuggaucgagagccagaagaacgguuccuggaaguuagaaaaggcgagccugaucgaggugaagacgugcaccuggccgaagucacauacccuguggagcaacggcgugcuggaguccgauaugaucauaccaaagucgcuggcggggcccauuucccaacacaaccaccgacccggcuaccacacccagacggcugggcccuggcaccucggcaagcuggagcuggauuuuaacuauugcgaaggcaccaccgucguaaucaccgaaaacugcggaacgcgcgggcccagccugcggaccaccaccgugagcggaaagcugauccacgaguggugcugucgcagcugcacccuacccccucuccgguauaugggcgaagacgggugcugguauggcauggagauccgccccaucagcgagaaggaggagaacauggucaagagccuggugagugccggcagcggaaaaguggacaauuucaccaugggcguccugugcuuggcaauccuguucgaggaagugaugaggggaaaguuuggcaagaaacacaugaucgccgggguguucuucaccuuuguccuuuuacugaguggccagauuaccuggcgggauauggcgcacacgcugaucaugaucgggagcaaugccucagaccggauggggaugggcgugaccuaccuagcccuaauagccaccuucaagauccagcccuuccugguucucggauucuuucugcgcaagcugaccucgcgggagaaccuuuugcugggagucggccucgccauggccacgacgcugcagcugcccgaggacauugagcagauggccaaugggaucgcccuuggucugauggccuuaaagcucaucacgcaguucgaaaccuaccaacucuggacggcucugaucagccugaccugcuccaacaccauauucacucugaccguggcuuggagaaccgccacgcugaucuuagccggggucagccugcugccggugugccagucgagcucgaugcguaaaaccgauuggcuccccauggccguggcggcuaugggcguaccgccccucccguuguucaucuuuagccuaaaggacacccugaagagacgcuccuggccgcugaacgagggggugauggccgugggucucgucagcauucuggccuccucgcugcuccggaaugacgugccaauggcaggcccgcugguggccggaggauugcucaucgccugcuacguuaucaccgguaccuccgccgaccugaccguggagaaggcugccgacaucaccugggaggaggaggcggagcagacuggcguuucccacaaucugaugaucaccgucgacgacgacggaacgaugcgcauaaaggacgacgagaccgagaacauccucacggugcuguuaaagaccgccuugcugaucguauccggcaucuuuccguacagcauccccgcuacucuguuggucuggcauacuuggcagaagcagacccagcgguccggcguccuaugggaugugcccagcccacccgagacccagaaggcagaacuggaggagggagucuaucgcauuaagcagcagggcaucuucggcaaaacccaaguggggguggggguacagaaggagggcguauuccacaccauguggcacgugacgcggggcgccguccucaccuacaacgggaaacgccuggagccaaacugggcgagugugaagaaggaccugauaagcuauggcggcggcuggcgguuguccgcgcaguggcaaaagggggaggaggugcaaguuaucgccguagagcccggcaagaacccgaagaacuuccagaccaugcccggcaccuuccagacgacgaccggggagaucggcgccaucgcgcuggacuucaaaccagggaccucuggcagccccaucaucaaucgcgaagguaagguggucggcuuguacgguaacgggguggugacaaagaauggcggguacgucuccggcaucgcucagaccaaugcggagccggacggccccacccccgaacuggaggaggagauguucaagaagcggaaccuaacuaucauggaucuucacccaggcagcgggaagacgcgcaaauaccugccggcgaucgugcgggaagccaucaagcgacgguugcgcacccuaauccuggcgcccaccagagucgucgcggccgagauggaggaggcccucaagggucugcccauccgcuaccagaccacugccaccaagucugaacauacuggccgugagaucguggaucugaugugccacgcgacauucacgaugcgccuccugagccccgugcggguaccgaacuauaaccugauuaucauggaugaggcccacuuuaccgaccccgccuccaucgcggcgcgcggguacaucucaacccggguagguaugggagaggcugcugccaucuucaugaccgccacuccuccaggaacggcggacgcuuucccgcaguccaacgccccuauacaagacgaggagcgcgacauccccgagcgcaguuggaacuccgggaacgaguggaucaccgauuuugccgggaagaccgugugguucgucccuagcaucaaggccggaaacgacaucgcgaauugccuccggaagaaugggaagaaaguaauccagcugucccgaaagaccuucgacaccgaguaccagaagaccaaguugaacgacugggacuucgugguuaccacggauaucagugagaugggcgccaacuuuaaggcagaccgugugaucgacccgcgccggugcuuaaaacccguaauucugaccgacggaccagagcgcgucauccuugccgggccaaugccggugacagcugcauccgccgcccagcgccgcggucgcguugggcgcaacccgcagaaggagaacgaccaauacaucuucaccggccagccgcucaacaacgaugaggaccacgcccacuggaccgaggcuaagaugcuacuggacaauaucaacacuccagaggggauaauaccggccuuauucgagcccgaacgggagaaguccgccgcuaucgacggcgaguaccgauugaagggcgagucccggaagacguucguggagcugaugcgucgcggcgaucuccccgucugguuggcccacaaggucgcgucugaaggcauuaaguauacugacagaaagugguguuucgacggccagcggaacaaccaaaucuuggaggaaaacauggacguggaaaucuggaccaaggaaggggaaaagaagaagcuccgcccccgguggcuagacgccaggacauauuccgaccccuuggcccugaaggaguucaaggaguucgcagccggccggaagagcaucgcccuggaucuggugaccgagauagggcgugucccgucgcacuuggcucacagaacgcggaacgcacuagauaaccuggugauguuacacaccagcgagcacggcggacgagcguaccggcacgcgguggaggagcuacccgagacgauggagacccugcuauuacuaggacucaugauacuacugaccgggggcgcgaugcuguuucugaucagcggcaaggggauuggaaagaccuccaucgggcugauaugcgucaucgccucaucaggcaugcucuggauggccgagaucccgcuccaguggauugccucagcaaucgugcucgaguucuucaugaugguccuccuaauacccgagccugagaagcagcgcacaccucaggacaaccagcuggcguacgucgucaucgguauccucacccuggccgccaucauagccgcgaacgaaaugggccugcucgaaaccaccaagcgggaccuugggauguccaaggagccgggggucgucagccccacgagcuaccuggacguagaccuucaccccgcgagcgcuuggacacuguacgccguggcuaccaccguuaucacgcccaugcuacgccauaccaucgagaacuccacagcgaacgugucccucgcugcaaucgcaaaccaagccgucguacugaugggccuggacaagggguggccuaucucaaagauggaccucggcgugccccuguuggcgcucgggugcuacucacagguaaacccccucacuuuaaccgcugcuguccuccugcugaucacucacuacgccaucauuggccccggccuacaagccaaggcaacccgggaggcccagaaacgcaccgccgccggcauuaugaagaacccgacggucgacggcauuaugacuauagaccuggaccccguuauuuacgauuccaaguuugagaagcagcuggggcagguaaugcuccugguacugugcgcggugcagcucuuacugaugaggaccaguugggcccuaugcgaggcccugacucuggcuacgggacccaucacuacccucugggaggguucccccgguaaguucuggaauaccacuaucgccgucaguauggcgaacaucuuucgagguuccuauuuagccggugccggucuggccuucagcaucaugaagucagugggcaccggcaagcgcggcaccgggucucagggugaaacccucggggagaaauggaagaagaagcugaaccaguuaagccgcaaggacuucgaccuuuacaagaagucgggcaucaccgaagucgacagaaccgaggcaaaggaggguuugaagcgcggagagaucacgcaccacgcugucucgagaggcuccgccaagcuccagugguucguggagaggaacauggugauuccggagggcagagucaucgaccucgguugcggccggggcggguggucauacuacugugccggcuugaagaaagugacagaggugagaggcuacaccaagggcgggcccggucaugaagagcccguccccaugucuacguauggguggaacaucgugaagcugaugagcggcaaggauguguucuaucuuccgcccgagaaaugcgauaccuugcugugcgacaucggcgagucgagccccagccccacaguagaggagucgcgcaccauccgcguuuuaaagaugguggagccguggcucaagaacaaccaguucugcaucaagguacugaaccccuacaugcccacgguaauagagcauuuagaaagguugcagcgcaagcacggcgggaugcugguacggaacccccugucccgcaacucgacccacgaaauguacuggaucuccaauggcaccgguaacaucgucgccagcgugaacaugguuucccgguugcugcugaacagguucacgaugacucaucggcgcccgacaauagagaaggacguagaccucggcgccggcacucggcacguaaacgcggagcccgagacccccaacauggacgugauaggggagcgcauuaagcggaucaaagaggagcacaacagcacuuggcacuacgacgacgagaacccguacaagacuugggcguaucacggcuccuacgaagucaaggccaccgguagcgccuccagcaugauaaacggcguggucaagcuacugaccaagcccugggacguugugcccauggucacccagauggcuaugaccgacacuacccccuuuggccagcagcgcguguuuaaagagaaaguggacacgaggacaccgcggagcaugccgggaacccggagagucaugggcaucaccgcagaguggcucuggcguacgcuggggcgcaacaagaagccucggcugugcaccagagaagaguuuaccaagaaaguucggaccaacgcugcuaugggcgccguuuucacggaagagaaccagugggacagugcaaaggccgccgucgaggacgaggacuucuggaaguugguggaucgggagcgcgaacuccacaagcugggcaagugcggcagcuguguguacaacaugaugggaaagcgggagaagaagcucggcgaguucggcaaagccaaggguagccgagcgaucugguacauguggcuuggggcgcgguaccuggaguucgaggcccuuggauuccuuaacgaggaccacugguucagccgugaaaacuccuacucgggcgucgagggggagggccugcacaagcucggcuacauacugcgggacauaaguaagauccccgggggcgccauguacgccgacgacaccgccgggugggacaccaggaucaccgaggaugaccuccacaacgaggagaagaucacgcagcagauggacccggagcaucggcagcucgcgaaugccaucuucaaguugaccuaccagaacaaaguggugaagguccaacgccccacccccaccggcaccgugauggacaucaucagccgaaaggaccaacgcggcucuggccaggugggcacguacggguuaaauaccuucacuaauauggaggcccaacucauccggcagauggaaggcgaggggguccugucgaaggcggaucuggaaaauccucaccucccggagaagaaaaucacccaguggcuggagacgaagggcguugagcgccugaaaagaauggccauauccggcgacgauuguguggucaagcccaucgacgaccgcuucgcgaacgcccugcucgcccugaaugacauggggaagguucggaaggauaucccacaguggcaaccuagcaagggcuggcacgauuggcaacaagucccguuuugcucccaccacuuucacgagcuuauaaugaaggaugggcgcaaacuggucguccccugccggccucaggacgagcuaauuggccgcgcucggauaagccaaggggccgguugguccuuaaaggagaccgcuugucugggcaaggcauacgcccagauguggagccugauguacuuucaccgccgggaccugaggcuggcaaguaaugcgauuugcagcgccguccccguucacugggugccgaccuccaggacaacguggaguauccaugcccaccaccaguggaugacaaccgaggauauguugaccguguggaacagaguauggaucgaggacaaccccuggauggaggacaagacucccgucaccaccugggggaacgugcccuaccuuggcaagcgugaagaccaguggugcgggucgcucaucggccugacaucccgggcgacgugggcccagaacauuccuaccgcuauacagcagguccgcagccucaucgguaacgaggaguuccuggacuacaugcccagcaugaagcgguuccgcaaggaggaggagagcgagggcgccaucugguga

SEQ ID NO: 25822 - RNA, 9873 nt, Artificial Sequence
  derived and/or modified CDS sequence (opt11) from DENV-3__HM631857__SS-prME
acuagcuuaugucucaugaugaucuugcccgccgcacuggcguuccaucuuaccagccgggacggcgagccaaggaugaucguggggaagaacgagcgcggcaaaucuuugcuguucaagaccgccagcgggauaaacaugugcacccucaucgccauggaccugggcgagaugugcgacgacaccgugacauacaagugcccgcacaucacugaaguggagcccgaggacaucgauugcuggugcaaccugaccagcaccuggguaaccuacgggaccugcaaccaggcaggcgagcacagacgcgacaaacgguccguggcccucgcaccgcacgugggcaugggccuggauacccgcacccagaccuggaugagcgccgagggagccuggcgccaaguggagaaggucgagaccugggcccugcgucauccgggguucaccauacucgcguuauuccuggcccacuacauuggcacaucccucacgcagaagguaguaaucuucauccugcugaugcuagugacucccagcaugaccaugcggugcgugggggugggcaaucgugacuucgucgagggccuguccggggcaaccuggguggacgugguccuggagcacggcgggugcgugacgacuauggccaagaacaagcccacccucgauaucgagcugcagaagaccgaggccacccaguuggcgacgcuaagaaaacugugcauugagggcaaaauuacaaacaucaccaccgauagccguugccccacacaaggugaggccacccuuccggaagagcaagaccagaacuacgugugcaagcacacguacgucgaccgaggguggggaaacgggugcggccuauucgggaagggcucccuugugaccugcgccaaguuccagugccuggagcccaucgagggcaaggugguccaguacgagaaucucaaguauacagugaucaucaccgugcacaccggggaccagcaccaggucggaaacgaaacccagggggucaccgccgagaucacgccccaggccagcaccaccgaggcgaucuugcccgaguacggaacucugggccucgagugcuccccacgcacgggccuggacuucaacgagaugauccugcucacgaugaagaacaaggccuggaugguccaccggcagugguucuucgacuuaccccugcccuggaccagcggcgccaccacugagacgcccacuuggaaccgcaaagagcuacucgugaccuucaagaacgcccacgccaagaaacaggagguggucguucuugggucacaagaaggcgcgaugcacacggcccucaccggugccaccgagauacagaacuccggcgguaccucgaucuucgccggccaccugaagugccggcugaagauggauaaacucgagcuuaagggaaugagcuacgccaugugcaccaauaccuucgugcugaagaaggaggucuccgagacccagcacggcaccaucuuaaucaaaguagaguacaaaggcgaggacgugccgugcaagaucccuuucagcacggaggaugggcaggggaaggcgcacaacggucgccugaucacggccaacccagucgugaccaagaaggaggagccaguaaacauugaggccgagccccccuucggggaaagcaacaucgucaucggcaucggggacaaugcauuaaagaucaacugguauaagaaaggguccucaauagggaagauguucgaagcgaccgcaagaggagcacgcaggauggccauccugggcgacacggccugggacuuugggucagugggcgggguucucaacagccugggcaagauggugcaucaaaucuucgguuccgcguacaccgcccuguucuccggcguguccugggugaugaagaucggcauagggguccuccugacauggauuggcuuaaauucaaagaacaccuccaugucauuuuccugcaucgccauagggauaaucacgcucuaccugggcgccguggugcaggcggacauggguugugucaucaauuggaagggcaaggagcugaagugcggcagcgggauauucgugaccaacgaggugcacaccuggaccgagcaguacaaguuccaggcugacucccccaagcgacuagccacggccaucgccggugccugggaaaacggggucugcggcauccgcagcaccacccgaauggagaaucugcuguggaagcagaucgcgaaugagcucaacuacauccugugggagaauaacaucaagcugaccgugguggucggggacauaaucggcgugcuggagcagggcaagcgcacucugacgccccagccaauggaguuaaaguacuccuggaagaccugggggaaggccaaaaucguuaccgcagagacccagaacagcagcuuuaucauagacggcccgaacacgcccgagugcccaagcgucuccagggcauggaacgugugggagguugaagacuacggguucgggguguucaccacuaacaucuggcucaagcuucgcgagguauauacccaguugugcgaccauagacucaugucagcggccgugaaggacgagcgcgccguacacgccgacaugggcuacuggauugagagccagaagaacggguccuggaagcuggagaaggccucucugauugaggugaagacgugcacauggccgaagucucacacccucuggagcaacggcgugcuagagucugacaugaucauccccaaaagccuagcuggacccaucucccaacacaaccaccggccgggguaccacacccagacggccggccccuggcaccucggcaagcuggagcucgacuucaauuauugcgagggcaccaccgucgugaucaccgagaacugcggcacccgcgguccuucgcuccggacaaccaccgugucugggaagcugauccacgaguggugcugccgcagcugcacgcuccccccgcuucgguauaugggcgaggacgggugcugguacggcauggagauccgccccaucagcgagaaggaggagaacauggucaagucauuagugucugcgggguccgggaagguggacaacuucacuaugggcguccuuugccucgccauccuguucgaggaggugaugcgcgggaaauucgggaagaagcacaugaucgccgggguauucuuuaccuucguccugcuccuguccggacagaucaccuggcgcgacacggcucacacccugauuaugaucggcuccaaugccuccgaucggauggggaugggcgugaccuaccucgcccugaucgccacuuucaagauccagccuuuccuggcccucggcuucuuucugcgcaagcuuacaagccgagagaacuuacugcugggcgugggccucgccauggccaccacccugcagcugcccgaggacaucgagcagauggccaacgggaucgcacucggucugauggcgcugaagcucaucacgcaguucgagaccuaccagcuguggacggcccugaucagccugaccuguuccaacacaaucuucacguuaaccgucgcguggcgcaccgccacccuaauucucgccggggugucucugcugccggugugccaguccucauccaugcggaagacggacuggcuccccauggcgguggccgccaugggcgugccgccacucccgcuguucaucuucggccucaaggacacccugaagcgccgcagcuggccccucaacgagggcgucauggccgugggcuuagucuccauacuggcgagcucgcugcuccggaacgacguccccauggcggggccacugguggccggcgggcugcucaucgccugcuaugugaucaccggcaccucggccgaccugacagucgagaaggccgcggacauuaccugggaggaggaggccgagcagaccggggugucccacaaccugaugaucacaguggacgacgacggcaccaugcgcaucaaggacgacgagacggagaacauauugacaguccugcugaagaccgcgcuccugauagugagcgggaucuucccguacuccauccccgccacccugcucguguggcacacuuggcagaagcagacccagcggagcggcguccucugggacgugcccagcccgcccgagacccaaaaggccgagcuggaggagggcguguaccgcaucaagcagcaagggaucuucggcaagacgcaggucggggugggcgugcaaaaggagggcgucuuccacacgauguggcaugugacccgcggggcgguucucaccuacaaugguaagcgucucgagccaaacugggccagcgucaagaaggaccugaucuccuacgggggcggguggcgacucucggcucaguggcagaagggcgaagagguccaggugaucgccgucgagcccgguaagaaccccaagaacuuccagaccaugcccgguacguuccaaacgaccaccggcgagauuggcgccauugcccuggacuuuaagcccggcacguccggcagccccaucaucaaccgcgaggguaagguggugggcuuguacgggaacggggucgugacuaaaaacgggggcuacguaagcggcauugcccagaccaacgccgagccggacgggccaacacccgagcuggaggaggagauguucaaaaagagaaaccugacgauuauggaccugcacccaggcuccgguaagacccgcaaguaccugccggccaucguccgggaggccauuaagcgcaggcuccgcacccuuaucuuagcccccacccgggugguggccgccgagauggaggaggcucuuaagggccuucccauccgcuaccagacuacggcgaccaagagcgagcacaccggacgggagauugccgaccugaugugccacgccacguucacaaugcgcuuacugucccccguccgggugccgaacuacaaccugaucaucauggacgaggcccauuucaccgaccccgccucuaucgccgcaaggggcuacaucuccacccgggugggcaugggggaggccgccgcuaucuucaugaccgccacgccacccggcaccgccgacgccuucccacagagcaacgcccccauccaggaugaggagcgugacauccccgagcgcuccuggaacagcgggaacgaguggaucaccgacuucgcuggcaagacaguaugguucgugcccaguaucaaggccgggaacgacauagccaacugccuccguaagaauggaaagaaggugauccagcugagccgcaagaccuucgauacagaguaccagaagaccaaguugaacgacugggauuucguggugacgaccgacaucuccgagaugggcgcgaacuuuaaggcugaccgggugaucgacccccgccggugccuaaagcccgucauccugaccgacgggcccgagcgcgugaucuuggccggcccgaugccggugaccgccgccagcgccgcgcagcggcgcggucgggucggccgaaacccccagaaggagaaugaccaauacauuuuuaccgggcagccgcuuaacaaugacgaagaucacgcgcacuggacggaggcaaagaugcugcuggacaacaucaacacccccgagggcauuaucccggccuuauucgaaccagagcgagagaaguccgccgcgaucgacggcgaguaccgccugaagggugagagccggaagaccuuuguggaacugaugaggcggggugacuugccuguguggcuggcccacaaggucgccuccgaggggaucaaguacaccgaccgcaaguggugcuucgacggccagcggaacaaccagauccuggaagagaacauggacguagagaucuggacgaaggagggcgaaaaaaagaagcuccggccccgguggcuggacgcccgcaccuacagcgacccgcuggcccucaaggaguucaaggaguucgcggcagggcgcaaauccaucgcgcuggacuuggucaccgagaucggccgggugcccagccaccucgcccauagaacccggaacgcgcuggacaaucuggugaugcuccauacgucggagcacggaggccgcgcauaccggcacgccgucgaggagcugcccgagaccauggagacccugcuccugcuaggguuaaugauccugcucacaggaggcgccaugcuguuccugauuagcgggaagggaauaggaaagacgagcaucggccugauaugcgugaucgccuccuccgggauguuguggauggccgagauaccgcugcaguggaucgcguccgccaucguccuagaguucuucaugauggugcucuugauccccgagcccgagaagcagcgcacaccccaggacaaucagcuggcuuacgugguaaucggcauccucacccuggccgccgucaucgcggccaacgagaugggccugcucgagaccaccaagcgugaccuggggaugagcaaggaaccgggcgugguaucucccaccagcuaccuggacgucgaccuccaccccgccuccgccuggacccuauacgcgguagccacaacggucaucacccccaugcuucgccacaccaucgagaacuccacggccaacgugucgcucgcggccaucgcuaaccaggccgugguauuaaugggguuagacaaaggcuggccgaucucaaagauggacuuaggggucccccugcuggcccucggcugcuacucccaggugaacccccugacccuuaccgcugcugugcuccuacugaucacacacuacgcgaucaucggccccgggcuccaggccaaggccacccgggaggcccagaagcgcacggccgcgggcaucaugaagaacccaaccguggaugggaucaugaccaucgaccuggaccccgugaucuacgacaguaaauucgagaagcagcugggccaggugaugcuccuggucuugugcgccgugcagcuccuccugaugcggaccucuugggcccucugcgaagcccugacgcuggccaccggacccaucaccacccuuugggaggggagcccuggcaaauucuggaacacgaccaucgccguguccauggccaacaucuuccgcgggagcuaccuggcuggcgcuggguuggcguucuccaucaugaagucagucggcaccggcaagcgggggaccgguagccaaggugagacccucggcgagaaguggaagaagaagcugaaucagcugagccgcaaggauuuugaccuuuacaaaaaguccggaaucacggagguggacaggaccgaggccaaggagggccugaaacgcggcgaaaucacccaucacgccguaucccggggguccgccaagcugcaaugguucgucgagcgcaacauggugaucccggaaggccgggugaucgaccucgggugcggccguggcggcuggucauacuacugcgccggccugaaaaaggucaccgaggugagaggcuacacgaagggcggccccggccaugaagagccggugcccaugagcacuuacggguggaacaucgucaagcugauguccggcaaggacguguucuaccucccacccgagaagugcgacacccugcugugugacaucggcgaaagcucccccagccccacgguagaagagagccgcacgaucagggucuuaaagaugguggagccuuggcucaagaacaaccaguucugcaucaaggugcugaaccccuacaugcccaccgucauagaacaccuggagcggcuccagcgcaagcacgguggcaugcuggugcggaacccacugagccgcaauuccacccacgagauguacuggaucuccaacgggaccggcaacaucguagcguccguuaacauggugagccggcuccugcugaaccgcuucacuaugacccaucggcgcccuacgaucgagaaggauguggaccucggagccgggacccggcauguaaacguggagcccgagacccccaacauggaugugaucggcgagaggaucaagaggauaaaggaggagcacaacagcaccuggcacuacgaugacgagaacccguacaagaccugggccuaccacgggagcuacgaggucaaggccaccggauccgcaagcuccaugaucaaugggguggucaagcuguuaacaaagcccugggacguggugcccauggugacacagauggccaugaccgacacaacgccuuucggccagcagcgcguguucaaggagaagguggacacccggacuccacgcagcaugcccggaacccguagaguaauggggaucacagccgaauggcuguggcggacucugggccgcaacaagaaaccccggcugugcacccgugaagaguucacuaagaaggugcgcacaaacgccgcaaugggagcgguguucacugaggagaaccagugggacucagcuaaggccgccgucgaggacgaggacuucuggaagcucguugaccgggagcgcgagcugcacaagcugggcaagugcggguccugcguguauaacaugaugggcaagcgggagaagaagcucggcgaauucgggaaggcuaaaggcagccgcgcgauaugguacauguggcugggggcccgguacuuggaauucgaggcccucggcuuccugaacgaggaccacugguucucccgcgagaacagcuauuccggugucgagggcgagggccugcacaagcuuggguauauccuccgggacauuuccaagauccccggcggggccauguacgccgacgacaccgcgggcugggacacccgcaucacggaggacgacuuacauaaugaggagaagauuacccaacagauggacccggaacaccggcagcucgccaacgccauuuuuaagcugacauaucagaacaagguggugaagguacagcgccccacucccaccgguacggugauggauaucaucucccgcaaggaccagcgugguagcggccaggugggcaccuacggccugaacaccuucacuaauauggaggcucaacucauccggcagauggagggggagggcguccugucgaaggccgaccuggagaauccccaccugccggagaagaagaucacucaauggcuggagaccaaaggcguggagcgccugaagcggauggccaucagcggggacgacugcguaguaaagcccauagacgaccgcuuugcuaacgcccuccuggcgcucaacgacaugggcaagguccggaaggauaucccccaguggcagcccuccaagggguggcacgauuggcagcagguaccguucugcagccaccacuuccacgagcucaucaugaaggacggccgcaagcuggucgugcccugccggccccaggacgagcugaucgggcgcgcccggaucucccagggcgccgguuggagccucaaagagaccgccugccuggggaaggccuacgcccagauguggucccugauguacuuccaucgccgcgaccucagacuggcgagcaacgccaucugcuccgccgugcccguucacugggugccgaccagccgcacgaccugguccauccacgcgcaccaccaguggaugaccaccgaggacaugcuuacggucuggaaccgugucuggauagaagacaaccccuggauggaggauaagacgcccgugaccaccugggaaaacgugcccuaucucggcaagcgcgaggaccaguggugcgggagccuuaucggccugacgagucgggcuaccugggcgcaaaacauccccaccgcgauccagcagguccgcuccuugaucgguaacgaagaguuucuggacuacaugcccagcaugaagcgguuccgcaaggaagaggaguccgaaggcgcuaucugguga

SEQ ID NO: 25823 - RNA, 9873 nt, Artificial Sequence
  derived and/or modified CDS sequence (opt11) from DENV-3__HM631860__SS-prME
accagcuuaugucucaugaugauccugcccgcagcgcuggcguuccaccuaacgucgcgggacggcgaaccgcggaugauuguagggaagaaugagcgcggcaaaagccugcuguucaagacagccuccgggauuaauauguguacucucauugccauggaccugggcgagaugugugacgacaccgugacauacaagugcccccacaucaccgagguugaacccgaggacauagacugcuggugcaaccugacgagcaccugggugacuuaugggacgugcaaccaggccggcgagcaccgacgcgacaagagaaguguggcgcucgccccccacgugggcaugggccuggacacccgcacucagacguggaugagcgccgaaggcgccuggcggcaggucgagaaggucgaaacaugggcccugcgacacccgggcuucaccauccucgcucuguuucuggcccacuacaucggcacgucccucacccaaaaggucgugaucuucauacugcugaugcucgucacgcccagcaugacaaugcggugcgucggggugggcaaccgcgacuucgucgagggccuguccggggccaccuggguggacgucguccuggagcauggcgggugcgugaccacaauggccaagaacaaaccaacccucgacaucgagcugcaaaagaccgaggccacucagcuggcgacgcuucggaagcuguguaucgaggguaagauuaccaacaucaccaccgacagccgcugccccacgcagggcgaggccacgcugcccgaagagcaggaccaaaacuacguuugcaagcacaccuacguugaccgcggguggggcaacgggugcgggcucuucggcaagggaucccugguaaccugcgccaaguuucagugcuuggagccgaucgagggcaagguuguccaguacgagaaccucaaguacacggugauaaucaccgugcacaccggggaccagcaccagguuggcaaugagacgcaaggggugacggcggagaucacuccccaggcuucaaccaccgaggcgauccugcccgaguacggcacccucgggcucgagugcuccccgcgcaccggccucgacuucaaugagaugauucugcucaccaugaagaauaaggcuuggaugguccaccgccagugguucuucgaccugccccugcccuggacgagcggcgccaccacugagacccccaccuggaaccggaaggagcuccucgugaccuuuaagaaugcccacgccaagaagcaggagguggucguuuuggguucccaggagggagcgaugcacacggcccucacuggggccaccgaaauccaaaauagcggcgggaccuccaucuuugccggucaccugaaaugccggcugaaaauggacaaauuggagcugaaggggaugagcuacgcaaugugcacgaacacuuucgugcugaagaaggaggucuccgagacccaacacggcacuauccucaucaagguggaguacaagggcgaagaugugccgugcaagauccccuucucuaccgaggacgggcagggcaaggcgcacaacggccgguuaauaaccgccaaccccgucguaacgaagaaagaggaacccgucaacaucgaggccgaaccgccauucggcgagagcaacaucgucaucggcaucggggauaacgcccugaagaucaacugguacaagaagggcucuagcauagggaaaauguucgaggccaccgcacggggagcgcgccggauggccauccugggcgacacggccugggacuuuggguccguggguggagugcuaaacagccugggcaagaugguccaccagaucuuugggucggcguacacugcacuguucagcggcgugucgugggugaugaagauuggcaucggaguccuacugacauggaucggccugaauagcaagaacaccuccaugucuuucuccugcaucgcgaucgggaucaucacgcucuaccugggcgcugucgugcaggccgacauggggugcgucgugaacuggaaggguaaggagcugaagugcggcagcgggaucuucgugaccaacgagguacacacauggaccgaacaguacaaguuccaggcugauucacccaagcgccucgccacggccaucgcuggcgccugggagaacggggugugcggcauccgcagcaccacccggauggagaacuugcuguggaagcagauugcgaacgagcucaacuacauacugugggagaacaacaucaagcugacuguggucgugggggacaucaucggagugcuagagcagggcaagcgcacgcugacaccccagcccaaagagcucaaguacuccuggaaaacuugggggaaggccaagaucgucaccgcugagacgcaaaauucauccuucaucaucgacggcccuaacaccccagagugccccucugugucccgggccuggaacgucugggaggucgaggauuacggguucggcguguucaccaccaacaucuggcugaagcugcgcgagguguacacccagcuuugcgaccauagacuuaugucagcggccgucaaggacgaacgcgccgugcacgccgacaugggauacuggaucgagagccagaaaaacggguccuggaaacuggagaaggccagccugaucgaggugaagacgugcaccuggccaaaaucccacaccuuguggagcaacggcguccucgaguccgauaugaucaucccuaagagccuggccggccccaucucccagcacaaccacaggcccggcuaucacacccagacggccgggcccuggcaccucggaaaguuagagcucgacuucaacuauugugaaggcaccaccguuguaaucacugagaacugugguacgcgcgggccuucucugcggaccaccaccguguccgggaaacugauacaugaguggugcugucgcagcugcacguugccgccgcuccgguacaugggggaggaugggugcugguacggcauggagaucagacccaucuccgagaaggaggagaacaugguuaagucgcugguguccgccggcuccgggaaagucgacaacuucaccauggguguacuguguuuagcuauccuguucgaggaggugaugcgggggaaguucggcaaaaagcauaugauagccggggucuucuucacauucguacugcuuuuguccggccagaucacuuggagggacauggcgcacacgcugaucaugaucggcucaaacgccagugacaggauggggaugggugugaccuaucuugcacugauugccaccuuuaaaauccagccguucuuagcccucggguucuuccugcgcaaacucaccagccgugaaaaccuccugcugggcguuggacucgcgauggcuacuacauugcaguuacccgaggacaucgagcagauggcuaauggcaucgcccucggccucauggccuugaaacugaucacgcaguucgagaccuaccagcuguggacggcccugaucagccugaccugcuccaacacguacuucacauuaacgguggccuggcgaacagccacccugauacucgccggggucagccugcugccggugugccaguccagcuccaugcggaagaccgacuggcuucccauggcgguggccgccaugggcgugccgccacuuccgcuuuucaucuucagcuuaaaggacacgcugaagcgacgcuccuggccacugaacgagggggugauggccgugggccucgugagcauccuagccucaagcuuauugcggaacgacgucccaauggcgggccccuuagucgcgggcggccugcucauugcgugcuacgucaucacggggaccuccgccgaucugaccguggagaaggccgcggacaucacgugggaggaggaggcggagcagacgggagugagccacaacuuaaugaucaccgucgaugacgacgggacuaugcgaaucaaggacgacgaaaccgagaacauacuuacggugcuucugaagaccgcccuccuaaucguuagcggcaucuucccguacagcaucccggccacucugcucgucuggcacaccuggcagaagcagacgcagcggucaggcguucugugggacgugcccagcccuccggagacccagaaagccgagcuggaggaggggguauaccgcaucaagcagcagggcaucuucgggaagacucaggugggaguggggguccagaaggagggcguguuccacaccauguggcacgugacgcggggcgcgguacugaccuacaacgggaagagacuugaacccaacugggcguccguaaagaaggacuugaucagcuacggagggggcuggcggcucuccgcacaauggcagaagggggaagaggugcagguaaucgccguggagcccggaaagaaccccaagaacuuccaaaccaugcccggcaccuuccagacgaccaccggggagaucggugcgauugcccuagacuucaagcccgggaccucaggcagcccuaucauaaaccgcgagggcaagguggucgggcuauacggcaacgggguugugacgaagaacggcggguacgucuccggcauagcccagaccaacgcggagccagacggccccacccccgaacucgaggaggagauguucaagaagagaaaucucaccaucauggaccugcaccccgggagcggcaagacgcgcaaguaccuuccggccaucgugcgggaggcaaucaagcgacgucuucgcacccugauccuggccccaacccggguuguggcagccgagauggaggaggcccucaaaggauugcccauccgauaucagaccacggcgaccaaguccgaacacacaggccgggagaucguugaccuaaugugccaugccaccuucaccaugcgccuccugagccccgugcgggugccuaauuacaaccugaucaucauggacgaggcccauuuuaccgaccccgccuccaucgccgcucguggguacaucagcacccggguggggaugggcgaggccgccgccaucuucaugaccgcgacgccgccggggaccgccgaugcauucccgcaguccaacgcuccgauccaggacgaggagcgcgacauccccgagcgcagcuggaacuccggcaacgaguggaucacagacuuugcggguaagacagugugguucguccccagcauaaaggcggggaacgacaucgccaacugucuccggaagaaugggaagaaggugauacagcugucccgcaagacauucgacacggaguaccaaaagaccaagcugaaugacugggacuucgucgucaccacggacauaucagaaaugggcgccaacuuuaaggccgaccgggugauugacccgaggcggugccucaagcccguaauccugaccgacggcccggagcgcgucauccuggccgggcccaugccugugacugcagccagugcagcccagcggcgcgggcgugugggacgcaacccccaaaaggagaacgaucaauacaucuucaccggccagccccucaacaacgacgaggaccacgcccauuggaccgaggcuaagaugcugcuggacaacaucaacacgccagaggggaucaucccggcccucuucgagcccgagcgagaaaaguccgcugccaucgacggugaguaccgccugaagggcgaguccaggaagaccuucgucgagcuaaugcgucgcggggacuuacccguguggcucgcgcacaaggucgccagcgaaggcaucaaauacacagaccgcaaaugguguuucgaugggcagcggaacaaccaaauccucgaggaaaauauggacguggagauuuggaccaaggaaggcgagaagaagaaacuccgcccccgguggcuugacgcccgcacguacagcgauccgcuggcccugaaggaguucaaggaguucgccgcgggccgcaagagcauugcacuggaccuggucacugagauugggcgcguccccucccacuuggcucaccgcacccgcaacgcccuggacaaccuggugaugcuccacaccuccgagcacggaggacgggcguaccggcacgcgguggaggaacuaccugaaacgauggaaacccuccucuugcugggccucaugauucugcugaccgguggcgcaaugcucuuuuuaauuagcggaaaggggauagggaagaccuccaucgggcugauuugcgucaucgccucgucaggcaugcucuggauggccgaaaucccgcuacaguggaucgccagcgcgauugugcuggaguucuucaugaugguucucuuaauccccgagcccgagaagcagcgcacgccccaggacaaccagcuggcguauguuguaaucggaauacucacacuggccgccaucaucgccgcgaacgagaugggcuugcucgagaccaccaaacgggaccugggcauguccaaagagcccggggugguaucccccacgucauaucuggacguggaccuccaccccgccagcgcuuggacccuguacgccguggccacgaccguuauuacgcccaugcuacgccacaccauagagaauuccacggcgaacgugucgcucgcugcgaucgcaaaccaggcagugguccugaugggccuggacaagggguggccgaucuccaagauggaucucggcguaccccugcuggcccucgggugcuacagccaggugaacccccugacccugacggccgccguacuccuuuuaaucacccacuacgccaucaucgggcccggccuccaggcgaaggcgacacgggaggcccagaagcgcaccgcugcggggauuaugaagaaccccacgguggacggcauuaugacuauagaccuggaccccgugaucuacgauuccaaguucgaaaagcagcucggccaagucaugcuccugguacuuugcgcggugcagcuccugcugaugcggaccucgugggcccucugcgaggcccucacccuggcuacgggccccauaaccacccuuugggaaggcucccccgguaaguuuuggaauaccacgaucgcgguaucaauggccaacauauuccgcggcuccuaccuggcaggagccggucuggcuuuuagcauaaugaaguccguagggaccggaaagcguggcaccgguagccagggcgaaacccuaggggagaaauggaagaagaagcugaaccaauugagcaggaaggacuucgaccucuacaagaaguccggaauuaccgaaguggauaggacggaggcgaaggaaggacugaagcgcggcgagaucacccaucacgcugucagucggggcuccgccaagcuccagugguucguggagcgcaacauggugauaccggaaggacggguaauagaccucggcugcgggcggggcggguggagcuacuauugugccggccugaagaaggugacugagguacggggcuacaccaaaggcggccccgggcaugaagagcccguccccauguccacguacggauggaacaucgugaagcugaugagcgggaaagauguuuucuaccucccgcccgaaaagugcgacacccugcugugugacauuggcgaguccagccccucgcccaccgucgaagagucucgcacaauccgagugcuaaaaaugguggagccguggcugaagaacaaucaguuuugcaucaaaguccugaacccuuacaugcccacggugaucgaacaccuggagcggcugcagcgcaagcauggcggcaugcuggugagaaacccccuuucccgcaacaguacccacgagauguacuggauuuccaaugggacagggaacauagucgccagcgugaacaugguguccaggcuuuugcugaacagauucacgaugacgcaucggcgcccuaccauugagaaggacgucgaccuuggggccggcacccggcacgugaacgccgaacccgagacccccaacauggacgugaucggcgagcgcaucaagcguauuaaggaggagcauaacucgacguggcacuacgacgacgagaacccauacaaaacuugggcuuaucauggcuccuacgaggucaaggccacagggagcgcuuccagcaugauaaaugggguggucaagcugcugaccaagccuugggacgucgugcccauggucacgcagauggcgaugaccgacaccacccccuucggacagcaacgcguuuucaaggagaagguggacacgcgcacuccgcgguccaugccuggcacccggagagucauggggauuaccgccgaguggcucuggcggacgcuagggcgaaacaagaagccccgccugugcacccgcgaggaguucaccaaaaaggugcgcaccaacgccgccaugggcgcgguguucacggaggagaaccagugggacuccgcgaaggccgccgucgaggacgaggauuucuggaagcucguggaucgugagagagagcugcacaagcugggaaagugcgggucauguguauacaacaugauggguaagcgggaaaagaaguugggcgaguucggaaaggccaagggauccagggcgaucugguacaugugguugggcgcacgguaccuggaguucgaggcucucgguuuccugaacgaggaccacugguuuucgcgcgagaauagcuacagcggcgucgaaggggaaggauugcacaagcugggcuacauccugcgggacauaaguaagauccccgggggcgccauguacgccgaugacaccgcggggugggacaccagaaucaccgaggacgaccugcacaacgaggagaagaucacgcagcaaauggacccggagcaccggcagcucgcgaacgcgauuuucaaguuaacauaccagaacaagguggugaagguccagcgccccacgccaaccggcacagugauggacauaauaucacggaaggaccagcgcgguucaggccagguggggaccuaugggcuaaacaccuucaccaacauggaggcucaacucauccggcagauggagggcgaggggguccugagcaaggccgacuuagagaacccccaucugccggaaaagaagaucacccaauggcuggagacgaagggaguggagcgacugaagcggauggcgaucuccggcgacgacugcgugguaaaaccuaucgaugaccgauucgccaacgcacugcuggcgcugaacgacauggggaaagugcggaaggacaucccccaguggcagcccagcaagggcuggcacgacuggcaacagguuccguucugcagccaucacuuccacgagcucauuaugaaggacggucgcaagcugguugugcccugccggccccaagacgaacugauaggacgcgcgcggaucucucagggggcgggguggucccucaaagagaccgccugccugggcaaagccuacgcccagauguggagccugauguacuuccaccgccgcgaccuccggcuagccucaaacgcuaucuguagcgccgugcccguccauugggucccgaccucccgcaccacguggagcauccacgcgcaucaccaguggaugaccaccgaggacauguugaccguguggaaucgggucuggauugaggacaaucccuggauggaggacaagacgcccgugacaacuugggagaacgugcccuaccucgguaagcgagaggaccaguggugcggcucacugaucgggcugacaucccgggccacgugggcucaaaacauaccgaccgccauccagcagguccgcucacucauuggcaacgaggaguuucuggacuacaugcccuccaugaagcgguuccgcaaggaggaggagagcgaaggggccaucugguga

SEQ ID NO: 25824 - RNA, 9873 nt, Artificial Sequence
  derived and/or modified CDS sequence (opt11) from DENV-3__HM181977__SS-prME
acuagccucuguuuaaugaugauccugcccgccgcccuggcguuccaccucacgagccgggacggugagccccggaugaucguggggaaaaaugagcgcggcaaaagcuuacuguuuaagaccgcgucaggaauuaacaugugcacccucaucgcuauggaccucggugagaugugugacgacaccgugaccuauaagugcccccauaucaccgagguggagcccgaagacaucgacugcuggugcaaucuaaccagcaccugggugaccuauggcacguguaaccaggccggcgagcaccggcgcgacaagcggucaguggcccucgcgccucaugugggcauggggcuggauacccgcacccagacguggaugagcgcagagggcgcuuggcggcagguagagaaggucgagacgugggcgcuccgccacccgggcuucacaauucuugcguuauuccuggcccacuacaucggaacaucccugacccaaaaggugguuaucuuuauacuguuaauguuggucacgcccagcaugaccaugcggugcgugggagucggcaaccgcgacuucgucgagggucuuucuggcgcuaccuggguggacgugguccuggagcauggcgggugcgugaccacgauggcgaagaauaagccgacccucgacaucgaacugcagaaaaccgaggccacccaacuggcgacccuacggaagcugugcauugaggggaagaucaccaacauaaccaccgacagccgcugucccacgcagggcgaagccacccugccggaggaacaggaccagaauuacgugugcaagcacaccuacgucgaucgcggguggggcaacgggugcggguuauucgggaagggcucccuggugacaugugccaaguuccagugcuuagagcccauagaaggaaaggugguacaauacgagaaccucaaguacaccgugaucaucaccguucacaccggggaucagcaccaggucggcaacgaaacccaaggugugacggccgaaaucacgccacaggccagcaccaccgaggcuauccugcccgaguauggcacccugggguuggagugcuccccgcgcacggggcuggacuuuaaugagaugauccugcucacaaugaagaauaaggccuggaugguacaucggcagugguucuucgaccugccgcugcccuggaccucuggggccaccacggagacucccaccuggaauagaaaggagcuccugguaaccuuuaagaacgcccacgcgaagaagcaggaagugguuguguuaggcucccaggagggugcgaugcacacggcgcucaccggggcuaccgagauccagaauagcggagggaccuccauuuucgccggccacuuaaagugccggcuaaagauggacaaguuggagcuaaaaggcaugagcuacgccaugugcacgaacacguucguacuuaaaaaggagguauccgagacccagcacgggaccauuuugaucaagguggaguacaagggcgaggacguaccgugcaagauacccuucucgacggaggaugggcaggguaaggcgcacaacggaaggcuuaucaccgccaaucccgucgucacaaagaaggaagaaccggugaacaucgaggcggagccgccguucggugagagcaacauugucauuggcaucggggacaacgcccugaagaucaacugguacaagaaggguuccucaauugggaagauguucgaggccacugcacggggcgcgcgccguauggccaucuuaggcgacacggccugggacuucggguccgugggcgggguacuuaacucgcugggcaaaaugguccaccagaucuucggguccgcguauaccgcccuguucagcggagugaguugggugaugaagaucggcaucgggguccuccuuaccuggaucggccugaacagcaagaacacuuccaugagcuucuccugcaucgccaucgguaucaucacgcucuaccucggcgcaguggugcaggcggacauggggugcgucgugaauuggaagggcaaggagcugaagugcgguagcgggaucuucgucaccaacgaaguccauaccuggaccgagcaauauaaguuccaggcggacucuccgaagcgucucgccacggccauugccggcgccugggagaacggggugugcgguauccgcagcaccacccggauggagaaucugcuuuggaagcaaaucgcgaacgagcucaacuauauccugugggagaacaacauaaagcugacggugguugugggggacaucaucggcguccuagaacagggcaagcgcacacugacgccacagccgaaggagcugaaguacuccuggaagacuuggggcaaggccaagaucgucaccgcggaaacgcagaacagcuccuucaucaucgacggccccaacacccccgaaugccccucugugucccgcgccuggaacgugugggaagucgaggacuacggguucggcguguucacaaccaauauauggcucaagcugcgugagguguacacgcagcugugugaucaccggcucaugagcgcagcugucaaggacgagcgcgcagugcacgccgacauggguuacuggauagagucucagaaaaaugguuccuggaagcuggagaaggccagccugaucgagguaaagacaugcacauggccgaagucccauacccucuggagcaacggaguccuggaguccgacaugaucauuccuaagagccuggcggggcccaucucccagcacaaccaccggcccggcuaccacacccagacggcagggccuuggcaccucgguaagcuggaguuagacuucaauuauugcgagggcaccaccguagugaucaccgagaacugugggacgcgcggccccucgcuccgaacuaccaccguguccgggaagcugauucacgaguggugcugccgcuccugcacgcugcccccgcuccgguacaugggggaagacgggugcugguacggcauggagauccgccccaucagugagaaggaggagaacauggucaagagccugguuuccgcaggcagcgggaaagucgacaacuucacuaugggcgugcugugccucgccauccuuuucgaggaggugaugagggggaaguucggcaagaagcacaugauugcaggagucuucuucaccuucgugcuacuguuguccggccagauuaccuggcgcgacauggcacacacccugaucaugaucggcagcaacgccuccgaccggauggguauggggguaaccuaccucgcccugauugccaccuucaagauccagccuuuucuggcccucggguucuuccugcgcaagcugaccucucgcgagaaccuccuacugggggucggccucgcgauggccacgacccugcagcuccccgaagacaucgagcagauggccaaugggaucgcccucgggcugauggcguugaaguugaucacacaauucgaaaccuaccagcuguggacggcucugaucagccugaccugcuccaacaccaucuucacacugacgguggccuggcgaaccgccacccucauauuagccggggucucuuugcugccggugugccaaucgagcucuaugcguaagaccgauuggcucccgauggcuguggccgccaugggcgugccgccccucccuuuguucaucuuuucacucaaggacacccugaagcgccgcuccuggccccucaacgagggggugauggccgugggccucgucuccauccuugcauccagccugcuccgaaacgaugugcccauggcgggcccccugguggccgggggccugcucaucgccugcuacgucaucaccgggacguccgcggacuuaaccguggaaaaagccgcggacauaacgugggaggaggaagcagagcagaccggcgugagccacaaccugaugaucaccguagacgaugacgggaccaugcguaucaaggaugacgagaccgagaauauccucacggugcugcuaaagacagcccuccugaucguauccggcauauucccauacagcauccccgccacccugcucgucuggcacaccuggcagaagcagacacagcggucugggguacuuugggacguucccucgccgcccgagacccagaaggccgagcucgaggagggggucuaccgcauaaaacaacaaggaaucuucggaaagacccaggugggcguggguguccaaaaggagggcgucuuccacaccauguggcacguaacgaggggcgcgguccucaccuacaacgggaagcgacuugagcccaacugggcguccgugaagaaggauuuaauaagcuacggcggaggcuggcggcucucggcccaguggcaaaagggggaggagguacagguuaucgcgguagagcccggcaaaaaucccaagaacuuccaaaccaugcccggcacuuuccagacgaccaccggggagaucggagcgaucgccuuggacuucaagcccgggaccagcgggagccccauaaucaaccgcgaggguaagguggucgggcuguacggaaauggggucgugacgaagaacggcgguuacguuuccggaaucgcccagaccaacgcagaaccggauggucccacacccgagcuggaggaggagauguucaagaagcggaaccucacaauaauggaccugcaccccgggagcggcaagacgcgcaaguaccugcccgccauugugcgggaagcaauuaagcgccggcuccgcacccugauccuggccccuacccgcguggucgcugccgaaauggaggaagcccugaaggggcugccgauccgcuaccagaccacggccaccaagagcgagcacacgggccgggagauagucgaucugaugugccacgccacauucacgaugcguuuauuaaguccugugcgagucccuaacuauaaucugaucaucauggacgaggcucacuucaccgaccccgccuccaucgccgcgcgcggguacaucagcacacgugugggcaugggagaggccgcggcaaucuucaugaccgcgacuccgcccgggacagccgacgccuucccgcagagcaacgccccgauccaagacgaggaacgcgacauccccgagcgcagcuggaacucuggcaaugaauggaucacggacuucgcagggaagaccgugugguucguccccagcaucaaggcgggcaacgacauagccaacugccuacggaagaacgggaagaaggugauccagcuuucccgcaagacguuugauacggaguaccagaagacuaagcugaaugacugggacuucguggucaccacugacauuuccgagaugggagcaaauuucaaggccgacagagugaucgacccgcgacggugccuaaagccggugaucuugaccgacggccccgagcgcgugauacuggcaggacccaugccagugaccgcggccuccgccgcacagcggcgaggucgaguggguaggaacccccagaaggagaaugaccaguacaucuucacaggccagccccuuaacaacgaugaagaccacgcccacuggacugaggcgaagaugcuacuugacaacauaaacacgcccgaggggaucaucccggcacucuucgagcccgagagagagaaguccgcggcgaucgacggcgaguaccgccugaaaggcgagucacggaagacuuucgucgagcuuaugagacgcggugaccucccgguauggcuggcucacaaggucgccagcgaggguaucaaguacaccgaccgcaagugguguuuugacgggcaacggaacaaccagauccuggaggagaacauggacguggaaaucuggacaaaagaaggcgagaaaaagaagcuccguccccgguggcuggacgcccgcacguacuccgacccucuggcccugaaggaauuuaaggaguucgccgcaggccgcaagagcaucgcccuggaccuggugaccgagaucgggcggguccccucccacuuagcccaccgaacccgaaaugcccuggacaacuuggucaugcuccacacgagcgagcacggcgggcgcgccuacagacacgcgguagaggagcugccggagacgauggagacccugcucuugcugggccucaugauucugcugacggggggugccaugcuguuucugaucagcggcaagggcauuggcaagacuuccaucgggcugaucugcgucaucgcgucauccgguaugcucuggauggcagagaucccgcugcaguggaucgcuagcgcgauagugcuggaauucuucaugaugguacuccugaucccagagccggaaaagcaacgcacgccccaggacaaccaguuggcauacgucgugaucgggaucuuaacccuggcugcaaucaucgccgccaacgagaugggccuguuggagacuaccaagcgggaucugggcauguccaaggagccggggguggucucgcccacguccuaucuggacguugacuuacacccugccagcgcuuggacguuguaugccguggccaccacuguuaucacgcccauguuacgccacaccaucgaaaacuccacggccaauguaagccuggccgccauugcaaaccaggcugugguccugaugggacuggacaagggcuggcccaucuccaagauggaccuaggcgugccccugcuggcgcuugguugcuacagccaggugaacccucugacucugacggccgccguccuccugcugauuacccacuacgccaucaucggcccuggccuccaagcuaaggccacacgggaggcucagaagcgaacggcggccggcauuaugaaaaauccuacaguagacggcaucaugaccaucgaccuggacccgguaaucuacgacuccaaauucgagaagcagcuggggcaagugaugcuacuggugcugugcgcaguccaacuccugcugaugcgcaccagcugggccuuaugcgaggcccugacccuggcaacgggucccauaaccacccucugggaaggcuccccggggaaauucuggaacaccacgaucgcggucagcauggcuaacaucuuucgcggcuccuacuuagcgggggccggccuggcauuuagcaucaugaagucaguggggaccggaaagcggggcaccgggagccagggcgagacccucggggagaaguggaagaagaagcugaaccagcucucgcguaaggacuucgaucucuacaagaaguccggcaucaccgagguggaccggacagaggcgaaggaggggcugaagcgcggggagauaacccaccacgcuguaucacggggcucggccaaauuacaaugguucguggagcgcaacauggugaucccggagggcaggguaauagaccucggcugcgggcgcggcgguuggagcuacuacugcgcaggccucaagaaagugacugaggugcggggauacaccaagggcgggccgggacacgaggaacccgugccgaugaguaccuauggcuggaauaucgugaagcugaugagugguaaagacguguucuaccucccgccugaaaagugcgauacccugcugugcgacauaggcgaguccucgccguccccuaccgucgaagagagccgcaccauccgcguguuaaagaugguggagccauggcucaagaacaaucaauucugcaucaagguccucaaccccuacaugcccacggugauugaacaucuggaacggcuucagcggaagcacggcgggaugcucgugagaaacccccugucccgcaacucgacccacgagauguacuggaucuccaacggcacggggaacauuguugccagcguuaauauggugucccggcuccugcugaaucgcuucacgaugacgcaucggcgaccuaccauagagaaggaugucgaccucggcgccggcacucggcacguuaacgccgaacccgagacccccaacauggacgugaucggggaacguaucaagcggaucaaggaagagcacaacagcacguggcacuacgacgacgagaauccguacaaaaccugggcauaucacggcuccuacgaagucaaggccaccgggucugccuccuccaugaucaacgguguggucaagcugcucaccaagcccugggacguggugcccaugguaacgcagauggcgaugacggauacuacaccauucgggcagcagcgcguguucaaagaaaagguggacacacguaccccgcgcagcaugccaggcacccgacgugucaugggcaucaccgccgaguggcucuggcggacgcuggggcgcaacaaaaaaccccggcuuugcacccgcgaggaguuuaccaagaaggugcgaaccaacgccgccaugggcgcgguguucacagaggagaaccagugggacucagccaaggccgcaguggaggacgaggacuucuggaagcucguggaccgcgagcgggaacugcacaagcuggggaaauguggcagcuguguguacaacaugauggguaagcgggagaagaagcucggggaguucggcaaagccaagggcucucgcgcuaucugguacauguggcugggcgcccgguaccuggaguucgaagcucucggguuccugaacgaggaccacugguucagccgggagaacuccuacucgggagucgagggggagggccugcacaaguugggcuacauccugcgggacauuucgaagaucccugggggugcaauguacgcugacgacacggcggggugggacacccgcaucacugaggacgaccuccacaacgaagagaaaaucacgcagcaaauggacccggagcaccggcagcucgccaacgccaucuuuaaguuaaccuaccagaacaaggucguaaagguccagagaccgaccccuaccggcaccguuauggacaucauuagccggaaggaccagcgcggcuccggccagguaggcacguacggucugaauaccuuuacaaacauggaggcccagcucauccggcagauggagggcgagggagucuugagcaaggcugauuuagaaaauccacaucuuccggagaagaagaucacacaguggcuugagacgaagggcguggaacgccugaagcggauggcgaucuccggugacgacuguguugucaaacccaucgacgaccgcuucgccaacgcccugcuugcccuaaacgacauggggaagguccggaaggacauuccccaauggcaacccagcaagggcuggcacgacuggcagcaggucccguucugcucccaccacuuccacgaacucaucaugaaagacggucgcaagcuggucgugcccugcaggccgcaggacgaacugaucggccgggcacggaucagucagggggcgggcuggucccucaaggagaccgccugccuaggcaaggccuacgcgcagauguggagccugauguacuuccaccgucgggaccucaggcuggcguccaacgccauaugcagcgccgugcccguccacugggugccgaccucccgcacaacguggagcauccaugcucaucaucaguggaugaccaccgaggacaugcuaacgguguggaacagaguguggaucgaggauaaccccuggauggaggacaaaacacccguaaccacgugggaaaacguacccuaccucgggaaacgcgaagaucaaugguguggaucccugaucggacuaaccucccgggcaacgugggcgcagaauaucccgaccgccauccagcaagugcgcagcuuaaucgguaaugaagaguuccuggacuacaugcccucuaugaagcgguuccgcaaagaggaggagagcgagggggccaucugguga

SEQ ID NO: 25825 - RNA, 9873 nt, Artificial Sequence
  derived and/or modified CDS sequence (opt11) from DENV-3__HM181978__SS-prME
acgagccucugucuuaugaugauccucccugccgcccuggcguuccaucucaccagccgggacggggaacccagaaugauaguggggaagaacgaacggggaaagucacugcuguucaagacggcauccgggaucaacauguguacguugauagcuauggaccucggcgagaugugcgacgacacugugaccuauaagugcccacacaucaccgagguggagccugaggauaucgacugcuggugcaaccugaccagcaccugggugaccuacgggacgugcaaccaggcuggcgagcaccggcgagacaagcgaucgguggcccucgcgccccacgugggcauggggcuugacacccgcacccagacuuggaugagcgccgagggugccuggcgccagguggaaaagguggaaacgugggcacugcgccacccgggguucacuauccucgcgcucuuucucgcccacuacaucggcaccucccucacgcagaagguugugaucuucauccugcuuaugcuagugacacccagcaugaccaugcggugcgugggggugggcaaccgcgacuucgucgagggccuguccggggccaccugggucgaugugguccuggagcauggcgggugcgugaccacgauggccaagaacaagccaacacucgacauugagcugcagaagacugaggccacccagcuagcgacguugcgaaagcugugcaucgaggggaaaauuaccaacaucaccaccgacagccgcugccccacgcagggcgaggccacccugccggaggagcaggaccagaacuacgugugcaagcacaccuacgucgaccgcggcuggggcaacgggugcggccucuuugggaaggggucccuggugaccugcgccaaguuccagugccuggagcccaucgagggcaaagugguacaguacgagaaucugaaguacacggugaucaucaccgugcacaccggggaucagcaccagguuggcaaugagacccagggagucacggccgagaucacgccccaggccagcaccaccgaggcgauccuccccgaguacggcacccugggucucgagugcuccccacgcacgggccuugacuucaaugagaugauccuccucacaaugaagaacaaggcguggaugguccaccggcagugguuuuucgaucugccccugcccuggaccagcggcgcgacuacugagacacccacguggaaccgcaaagagcuguuagugaccuucaagaacgcccaugccaagaagcaggagguggucgugcuggggucccaggagggcgcgaugcacacugcccugaccggggccaccgagauccagaacagcggcgggacauccaucuucgccggccaucugaagugcagacugaagauggacaagcucgaguugaagggaaugagcuaugcuaugugcacgaauacguucgugcugaaaaaggaggucuccgagacucaacauggcacaauacucaucaagguggaguacaagggcgaggacgugccgugcaagauccccuucagcacggaggacggccaggguaaggcgcacaauggccggcugauuaccgcuaaccccguggugacgaaaaaggaggagcccgucaacauugaggccgagccacccuucggcgagagcaacaucguuaucggcauaggggauaacgcucugaagauaaacugguacaaaaagggcuccagcaucggaaagauguuugaggcgacggccagaggcgcgcgcaggauggccaucuugggcgacacggccugggacuucggguccgugggugggguucuuaacagccugggaaagaugguccaccagauuuucggguccgcguacaccgcucuguucagcggagucuccugggugaugaagauagggaucgggguccuccuuacguggauuggccugaacagcaagaacaccuccaugucuuucuccuguaucgccaucgggaucauuacacucuauuuaggcgccguugugcaggccgacauggggugcgucaucaacuggaagggcaaggagcugaagugcggcagcgggaucuucgugaccaacgaggugcauacguggaccgagcaauacaaguuccaggcggauucccccaagagguuagccacggccaucgccggcgcaugggagaacggggucugcggcauucggagcaccacccggauggagaaccuguuguggaagcagaucgcgaacgaacugaacuacauccuaugggagaacaauaucaagcugaccgucguggucggcgacaucaucggcgugcucgagcaggggaagcgaacccuuacgccccagcccauggagcugaaguacucuuggaagaccugggggaaggccaagaucgugaccgccgagacgcaaaacucaucauucaucaucgacggcccgaauaccccugagugucccagcgucucccgggccuggaacguuugggagguggaggacuacggguucggcguauucaccaccaacaucuggcucaagcugagggagguuuacacccagcugugcgaccaucggcucaugagcgcggccgugaaggacgagcgcgccguccacgcagauaugggguacuggaucgagagccagaagaacgggucguggaagcucgagaaggccagccuaaucgaggugaagacgugcaccuggccgaagucccacacccucuggagcaauggcgugcuugaguccgacaugaucauccccaagagccuagcggggcccaucucacaacacaaucaccggccgggguaccauacccagacggcagggccauggcaccucggcaagcuggagcuggacuucaacuauugcgagggcaccaccgucgugaucaccgagaacugcgggacgcgcggccccucccuccggaccaccaccguguccgguaagcugauccaugagugguguugccgcagcugcacccugcccccgcuccgguauaugggagaggacgggugcugguacggcauggagauccgccccaucagcgagaaggaggagaacaugguaaagagccuggugagcgcgggcagcgggaagguagacaacuucaccaugggcgugcugugccucgccauccuguucgaggaggugaugcgcgggaaguucggcaagaagcacaugaucgcagggguguuuuucaccuucguccugcuccuguccggccagaucaccuggagagacauggcgcacacgcucaucaugauugggagcagugccucugaccggauggguaugggcgugacuuaccucgcccugaucgccacuuucaagauccaacccuuccuggcccucggguuuuuccugcgcaagcugaccagccgggagaaccucuugcugggggugggccucgccauggccacgacccugcagcugcccgaggacaucgagcagauggccaacgggaucgcgcucggccugauggcgcugaagcucaucacccaauucgagaccuaccagcuguggacggcguugaucucccugaccuguuccaacaccaucuucacccugacggucgcauggagaaccgccacccugauccucgccggggugucccugcugccggucugccagagcuccaguaugcggaaaacggacuggcucccgauggcgguggccgccaugggcgugccgccguugccacucuucauuuucgggcucaaggauacacugaagcgccgcuccuggccacucaaugagggggucauggcagugggccucgugagcauccuggccuccagccugcuccggaacgacguccccauggcggggccccugguagcuggcgggcuguugaucgccuguuacgugauuacaggcaccuccgccgaccucaccguugagaaagccgcggacauuacgugggaggaggaggccgaacagaccggggugagccacaaccugaugaucaccguggacgacgacggcaccaugcggaucaaggacgacgagaccgagaacauccuuaccguccuucuaaagacagcccuccugaucguguccggcaucuucccguacagcauccccgccacacugcucguauggcauaccuggcagaagcagacucagcggaguggggugcugugggacgugcccagucccccggagacccagaaagcagaacuggaggaggggguguaccgcaucaagcagcaggguauauuuggcaagacgcaagucggggugggcgugcagaaggagggcgucuuucacaccauguggcacgugacgcgcggagcggugcucaccuacaacggcaaaagacuggagcccaacugggccagcgucaagaaggacuugaucucguacgggggcggguggagacucagugcccaguggcagaagggcgaggagguccaggugauagcaguugagccaggcaagaaccccaagaacuuucagaccaugcccgggacguuccagacgaccaccggcgagaucggugcuaucgcacuggacuuuaagcccggaaccagcggcagccccaucauaaaccgcgaggggaaggugguugggcuguaugggaauggcgucgugacgaagaacgggggcuacgucucaggcaucgcgcagaccaacgcugagccggacgggccuacccccgagcuggaggaggaaauguucaaaaagcggaaccucaccaucauggaccugcacccaggcagcgggaagacgcgcaaguaccugccggcaaucguccgggaagcuaucaaacgccgucuacgcacccugauccuggcccccacccgggugguggcugccgagauggaggaagcccucaagggccugccgauccgcuaucagaccacggcgaccaaauccgagcauaccgggcgugagaucgucgaucugaugugccaugccacuuucacgaugagacuccugucccccgugcgggugccaaacuacaacuuaaucauuauggaugaagcucacuucacagacccggccuccaucgccgcccgcggcuacauuagcacccgagugggcaugggggaggccgccgccaucuucaugaccgcgacgccgcccggaaccgccgacgccuucccacaguccaacgcccccauccaggacgaggaacgcgauauucccgagcgcagcuggaacuccgggaacgaguggauaacggacuucgccggcaagaccgugugguuugugcccagcaucaaggcggggaacgacaucgccaauugccuacguaagaacggcaagaaggucauccagcuuucccguaagacguucgacacugaguaucagaaaaccaagcugaaugacugggauuucguggugaccacggacaucucggagaugggcgccaacuucaaagccgaccgggucaucgacccgcgccggugccucaagcccguuauucugaccgacggucccgaacgcgugauccuggccggccccaugccugucacugcggccuccgccgcccagcggcgcgggcgggugggccgcaacccccaaaaggagaacgaccaguacaucuucaccgggcaaccacucaacaaugacgaggaccacgcccacuggaccgaagcgaagaugcugcucgacaacaucaacacgcccgagggcauuauuccggcuuuauuugagcccgagcgagagaaaagcgccgccaucgacggcgaguaccgccugaagggggagucuaggaagaccuucguggagcugaugcgccggggcgaccuccccgucuggcuggcgcacaagguggccagcgaagggaucaaguacaccgaccgcaaguggugcuucgauggacaacggaacaaccagauacuggaggagaacauggacguugagaucuggaccaaggagggcgagaagaagaagcuccgcccccgguggcuggaugccagaacguacuccgacccgcuagcccucaaagaguucaaggaguucgccgcggggcggaagucaaucgcgcuggaccuggugaccgaaaucggcagggugcccucccaccucgcccaccgcacccggaacgcccuggacaaccuggucaugcuccacaccucggagcacggcggccgggccuaucggcacgcgguggaggaacugcccgagacuauggagacccuguugcugcuggggcucaugauccugcugaccggcggugccaugcuauuccuuaucagcgggaagggcauuggcaagaccuccauaggccugaucugcgugaucgccagcuccgggaugcucuggauggccgagaucccgcuacaguggaucgcgagcgcgaucgucuuggaguucuucaugaugguacuccugauccccgagccagagaagcagcgcacgccccaggacaaucagcuggccuacgugguuaucggcauucuuacgcuggccgcgaucaucgccgcgaacgagaugggccuccucgagaccaccaagcgggacuuggggaugucuaaggagccgggcguagucagucccacguccuaccuagaugucgaccuccaccccgccagcgccuggacccuguacgcuguugcgaccaccguuaucacgcccaugcugcgccacaccaucgagaacuccaccgccaaugucagccucgcggccaucgccaaccaggcgguggugcugauggggcuggauaaaggcuggccgaucuccaagauggaucucggggucccccugcuggcguuggguuguuacagccaggugaacccccugacauugacggccgccguguuauuacugauaacccacuaugccauuaucggccccggacuccaggcgaaagccacaagggaggcgcagaagagaaccgccgccggcaucaugaagaaucccacggucgacgggaucaugaccaucgaccuggaccccgucaucuacgauuccaaguucgagaagcagcugggccaagugaugcuccugguccugugcgcggugcagcuccugcugaugcggaccucgugggcgcucugcgaggcccugacccuggcgacgggccccauuaccacccugugggaggggucccccgggaaguucuggaauaccacgauugcgguaagcauggccaacaucuuccgcggauccuaucuugccggcgccgggcuggccuucaguaucaugaaguccgucggcaccggcaagcgggggaccggcucacagggggagacccucggcgagaaguggaagaaaaagcugaaccagcuaagccgcaaggacuucgaccucuacaaaaagagcgggaucaccgaggucgacaggacggaggcgaaggagggccugaaaagaggcgaaaucacccaccacgccgugagccggggguccgccaagcugcagugguucgucgagcguaacauggugauccccgagggccgggugaucgaccucgggugcggccgcggggguuggagcuacuacugcgccgggcugaagaaggugaccgaggugcggggguacaccaaaggagggcccggucacgaggaaccggugcccaugucuacguacggguggaacaucgucaaguugaugagcggaaaggacguguucuaucuuccgccagagaagugugacacccugcugugcgacaucggagaguccagcccaagccccacaguggaggagagccgcaccauacgcguccugaagaugguggagccguggcucaagaacaaucaauucugcaucaaggugcugaaccccuacaugcccaccguaaucgagcaucuggagcggcuacagcgcaagcauggggguaugcuggugagaaacccccugucccgcaacucgacccaugagauguacuggauauccaacgggacugguaauauaguggccucagucaacauggugucccggcuucuacugaaccgcuuuaccaugacacaccgucgcccgacgaucgagaaggauguggaccucggcgcggggacgcggcacgucaacgccgagccagagacccccaauauggaugugauuggcgagcgcaucaagcggauaaaggaggagcacaacagcacguggcacuacgaugaugagaacccguacaagacgugggccuaccacgggagcuaugaggugaaggcaaccggcagcgccaguagcaugaucaacggcgucgugaagcugcugaccaagcccugggacgucgugccgauggugacgcaaauggcgaugacggacaccacccccuuuggucaacagcgcgucuucaaagaaaagguggacacgcggaccccgcgcagcaugcccgggacccgccgcgugauggggaucaccgccgagugguuguggcgaacacuggggcgcaacaagaagccccggcucuguaccagagaggaguuuacaaagaagguccgcaccaacgccgcaaugggggcgguguucaccgaggagaaucagugggacucggccaaagccgcgguagaggacgaagacuuuuggaagcucguagaucgagaacgcgaguuacacaagcugggcaaaugcggauccugcguauacaacaugaugggcaagcgggagaagaagcucggcgaguucgggaaggccaaggguucccgcgcgauaugguacauguggcugggggcucgauaccuggaguucgaggcccucggcuuucugaacgaagaccacugguuuagccgcgagaacuccuacagugggguggagggugagggccugcacaaacucggcuacauccugcgggacaucagcaaaaucccaggcggugcuauguacgcugacgacaccgcgggcugggauacaaggaucaccgaagacgaccugcacaacgaggagaagauuacgcaacagauggacccggagcaccggcaacucgcuaacgccaucuucaagcucacguaccagaacaaggucgugaagguacagcgccccacccccacaggcacugucauggacaucaucagccgaaaggaucagcgcgggagcggucaggugggcacuuacggccugaacacuuucacuaacauggaggcucaacucauccggcagauggagggagagggcgugcugucuaaggccgaccuggaaaacccccaccucccggagaagaaaaucacccaguggcuggagacgaagggugucgagagacugaagcggauggcaauuucuggggacgacuguguggucaagcccaucgacgaccgcuucgccaacgcccuccuggcccugaacgacaugggcaagguccggaaggacaucccccaguggcagcccaguaaggguuggcaugauuggcaacaggucccguucugcucccaucacuuccacgagcuaaucaugaaggacgggaggaagcugguuguccccugccggccacaggacgagcugaucgggcgcgcccggaucagccagggcgccggcugguccuuaaaggagaccgcuugcuuagguaaggccuacgcccagauguggucgcucauguacuuccacagacgcgacuugcggcucgcuucgaacgcuauuugcuccgccgugcccgugcacugggucccgaccucccgcaccaccuggagcauccacgcccaucaccaguggaugaccaccgaggacaugcuuaccguguggaacagggucuggaucgaggacaaccccuggauggaggacaagacucccgucacaaccugggaaaacguccccuaccucgggaagagagaggaccaguggugcgggucucucaucggccugaccucucgggccacgugggcgcagaacaucccgaccgccauccagcagguccgcagccugaucggaaacgaggaguuccuggacuacaugcccuccaugaagcgguuccgcaaggaggaggagagcgagggcgcgaucugguag

SEQ ID NO: 25826 - RNA, 9873 nt, Artificial Sequence
  derived and/or modified CDS sequence (opt11) from DENV-3__JN183884__SS-prME
accagccugugccucaugaugauccugcccgcagcacuagcguuccaccucaccagccgggacggcgagccccguaugaucguggggaagaacgagcguggcaagucucugcuguucaagaccgccuccgggaucaacaugugcacccucaucgccauggaccugggcgagaugugcgacgacaccgugaccuacaaguguccccacaucaccgaaguggagcccgaggacauugauugcugguguaaccuuaccagcaccugggugaccuacgggacgugcaaccaggcgggcgaacaccggcgcgacaagcgguccguggcccucgcgccgcaugugggcauggggcuggacacccgcacccagaccuggaugagcgccgagggcgccuggcgccagguggagaagguggagacuugggcgcugcgccacccggguuucacuauccucgcgcuguuccuggcccacuacaucggcaccucccucacccagaaggucgugaucuucauauugcugaugcucgucacacccagcaugaccaugcggugugugggcgugggcaaccgcgacuucgucgagggccucagcggcgccaccuggguagacguugucuuagaacacggcgggugcgugaccacgauggccaagaacaagcccaccuuggauauagagcugcagaagaccgaggccacccagcuggcgacgcuccgcaaguuaugcaucgagggcaagauuaccaacaucaccaccgacagccgcugccccacgcagggggaggccacgcugccggaagaacaggaccagaacuacgugugcaagcauacuuacgucgaccgggggugggggaacgggugcggccucuucgggaaggggagccuggugacaugugcgaaguuccagugccuggagcccaucgagggcaagguugugcaguacgagaaccucaaguacacagugauaaucaccgugcacacaggggaucagcaccaggucggcaacgagacccagggggugacggccgagaucacgccucaggcuagcaccacggaggcgauacugcccgaguacgguacccuggggcucgagugcuccccgcgaacgggccuggacuucaacgagaugauccuccucaagaugaagaacaaggcuuggaugguccacaggcagugguucuucgaucugccgcugcccuggaccucuggcgccacgaccgagacgcccacguggaaccgcaaggaacuccuggugacguucaagaacgcccacgccaagaagcaggaggugguugugcuggggucgcaagaaggcgcgaugcacaccgcacucacgggcgccaccgagauccagaacagcggcgggaccuccaucuucgcaggccaucugaagugccggcugaagauggacaagcucgaauuaaagggcaugagcuaugccaugugcaccaacacguucguguuaaagaaggaagucuccgaaacccaacacggaaccauccuaauaaagguggaauacaagggugaggacguuccgugcaagauacccuuuagcaccgaggacggucagggaaaggcgcacaacggccgucucauaaccgccaaccccgucgugaccaagaaagaggagcccgugaacaucgaggccgagccgcccuucggcgagagcaauaucgucauaggcaucggagacaacgcccugaaaauaaacugguacaaaaagggcucaagcauagggaaaauguucgaagccacugcgcggggcgcacgccggauggccauucuuggcgacaccgccugggacuucggguccguaggaggggugcucaacagccugggcaaaaugguccaccagaucuucggguccgcguacacagcccuguucagcggcguguccugggucaugaagauuggcaucgggguccucuugaccuggauaggccugaacucuaagaacaccuccaugagcuucuccugcauagccaucggaaucaucacccucuaccuuggagccguugugcaagccgacauggggugcgugaucaacuggaagggcaaagagcugaaguguggaucggggaucuucgugacuaacgaggugcacaccuggaccgaacaguauaaguuucaggcggacucccccaagcggcucgccaccgcuaucgccggcgcgugggagaacgggguaugcggcauccgcagcacaacccggauggagaaccugcuguggaagcagaucgcgaacgaguugaacuacauucugugggagaacaacauaaagcugaccgugguugucggggacaucaucggcgugcucgagcagggcaagcgcaccuugacgccccagccaauggagcugaaguacuccuggaagaccuggggcaaggccaagaucgugacagccgagacccagaacagcuccuuuaucauagacggccccaacacgcccgagugcccuucggucucccgggcuuggaacgugugggagguggaggacuacgguuucggcgucuuuacuaccaauaucuggcuaaagcuacgcgaggucuacacccagcuaugcgaccacaggcucaugagcgcggccgugaaggacgagcgcgccguccacgcagacaugggcuacuggauugagagccagaagaacggguccuggaaacuggagaaggccagcuuaauugaggugaagaccuguacguggccgaagucccauacacucuggagcaauggcguccuggaguccgacaugaucauccccaagagccuggcggggcccaucucgcagcacaaccauaggccggguuaccacacacagacagcggggcccuggcaccucggcaagcuggagcuggacuucaacuauugugaaggaacgacugucgugaucacagagaacugcgggacgcgcggccccagccuccggacgaccaccguguccgguaaacuuauccaugaguggugcugcaggagcugcacccugccuccguuacgguacaugggagaggacgggugcugguacggcauggagauccgccccaucuccgagaaggaagagaacauggucaagagccuggucuccgccgguagcgggaaggucgacaacuuuacgaugggcguccugugccucgccauccuguuugaggaagugaugaggggcaaguucggcaagaagcacaugaucgccgguguguucuucaccuucguccuccuccugucgggccagaucaccuggcgcgacauggcgcacaccuuaaucaugauaggaagcaacgcaucagacagaauggggaugggagugacguaccucgcccugaucgccaccuuuaagauccaacccuucuuggcccucggcuuuuuccuccgcaagcucaccagccgggagaaccuccuguugggggugggccucgcgauggccaccacgcugcagcuaccagaggacaucgagcaaauggcaaacgggaucgccuugggcuuaauggcgcucaagcucauaacacaguucgagaccuaccagcuguggaccgccuugaucagccucacuugcucuaauaccaucuucacccucaccguggcguggcguacggcgaccuugauacucgcaggggugagccuguugccgguaugccaguccagcuccaugcggaagaccgacuggcuccccauggcgguugcugccaugggcgucccgccgcugccgcuguucauuuuuggguugaaggacacccugaagcgccggucauggccucugaacgagggaguaauggccgucggacucguguccauccuugccucuucccugcuccggaaugacguccccauggcggggccccugguggccggcgggcuguuaaucgcguguuacgugaucacgggcaccagugccgacuuaaccguagagaaggccgcggauaucaccugggaggaggaggccgaacaaacgggagucucccacaacuuaaugaucaccguggacgacgauggcaccaugcgcaucaaggacgacgagaccgagaauauccucacuguacuacugaagacggcccuuuugaucguuagcggcauauucccguacucuauucccgccacccugcucguguggcauaccuggcagaagcagacccagcggagcgggguucuaugggacguccccagcccgcccgagacgcagaaggccgaacuggaagagggcguguaucgcaucaagcagcaggggaucuucggcaagacccaggucggggugggcgugcagaaggagggcgucuuccacacgauguggcacgugaccagaggggcggugcucacguacaacggcaagcgcuuggagccaaacugggccagcgucaaaaaggaccugaucuccuacgggggcggguggcggcucagcgcccaguggcagaagggugaagagguccaggugaucgccgucgaacccggcaaaaauccuaagaacuuccagaccaugcccggaaccuuucagaccacgaccggcgagaucggagcgauagcccuggacuucaagcccgggaccuccggcagccccauaaucaaccgcgaggggaagguggucggccuguacgggaauggcgucgugaccaagaaugggggauacgugagcggcaucgcccagacgaacgccgagcccgacgggccuacccccgagcuggaagaggaaauguucaaaaagcggaaccucaccauuauggaccugcaccccggcuccgggaaaacccguaaguaccugccugcgaucguccgggaggcgaucaagcgccgccuccgcacgcugauccuggcccccacccgggucguggccgccgagauggaggaggcccucaaaggccugcccauccgcuaccagaccaccgccacgaaguccgagcacaccggacgggagaucguagaccugaugugccacgccaccuucaccaugcgccuccugaguccggugcgugugccgaacuacaaccucaucaucauggacgaggcccacuuuacggacccugcgagcaucgcagcgcgcggcuacaucuccacucgggucggcaugggggaggccgccgccaucuuuaugaccgcgacgccgcccggaacggccgacgcguucccucagagcaacgcccccauccaggacgaggagcgcgacaucccggagcgcuccuggaacagcgggaacgaguggaucacugacuucgcaggaaagaccgugugguuugugcccuccaucaaggcggggaacgacaucgccaacugccuccgaaagaacggcaagaaggucauccagcugagccgcaagaccuucgauacggaguaccagaagaccaaacuuaacgacugggacuucguggugaccaccgacauuuccgaaaugggggccaacuucaaggcagaccggguaauugacccgcgccggugccuuaagcccgugaucuuaacggacggucccgagcgcgugauccuggccggacccaugcccgucaccgcggccucggccgcccaaagacgugggcgggugggccgaaacccucagaaggagaacgaucaguacauauucaccggacagccacucaacaacgacgaggaccacgcacacuggaccgaggcgaagaugcuacuggacaacaucaacacccccgaggggaucaucccugcccuauucgagcccgagcgggagaagucggccgccaucgacggcgaauaccgccugaagggggaaagccggaagacauucguggagcugaugcgucggggcgacuugcccgucuggcuggcgcacaagguagccuccgaggggaucaaguauaccgaccgcaaguggugcuucgacggccagcggaacaaccagauccuugaggagaauauggacgucgagaucuggaccaaggaaggcgagaagaagaagcuccgcccccggugguuagaugcccgcaccuacucagacccgcuggcacucaaggaguucaaggaguucgccgcggggcgcaaguccauagcccuggaccuagugacggaaaucggccgggugcccucacaccucgcccacaggacccguaacgcccuggauaaccuagucaugcuccauaccuccgaacacgggggccgcgccuaccggcacgcgguggaggagcugccagaaaccauggagacgcugcucuugcuggggcucaugauccugcugaccggaggcgccaugcuguuccugaucagcggaaagggaaucgguaagaccagcaucggccugaucugcgugaucgccuccucggggaugcucuggauggccgagaucccgcugcaguggaucgccuccgcgaucguccuggaguucuuuaugauggugcuccugauccccgaacccgaaaaacagcgaacgccacaagacaaucagcuggcuuacguggucauuggcauccucacgcuggccgccaucaucgccgcgaacgagaugggccugcuggagacaaccaagcgggaccuggggaugagcaaggagccaggaguggugucacccaccucuuaccuggacgucgacuugcaucccgcaagcgcauggacgcuguacgccguggcgaccacagugaucacccccaugcugcgccacacaaucgagaacagcaccgccaacgucucccucgccgcaauagccaaccaagcaguggugcugauggggcuggacaagggcuggccgaucagcaaaauggaccuaggggucccccuccuggcccucggaugcuacucccaggugaacccccugacgcuuaccgccgcugugcuucugcugaucacgcacuacgcgaucaucggccccgggcuccaggcgaaggcgacccgggaagcccagaagcgcaccgccgccggcaucaugaagaacccuaccguggacgggaucaugaccaucgaccuggaccccguuauuuacgacagcaaauucgaaaagcaacuaggccaggugaugcuccugguccuaugcgcgguacagcucuugcugaugcggaccuccugggcgcuuugcgaggcccugacccuggccaccggccccaucacgacccucugggaggggagccccggcaaauucuggaacaccaccaucgcgguguccauggcgaacaucuuccgcgggagcuaccuggcuggcgccgggcuggccuucuccaucaugaaguccgucggcacggggaaacgggggacuggcagccagggggagacccucggcgagaaguggaaaaagaagcugaaccagcuaagcagaaaggacuucgaucuguacaagaaguccgggaucaccgaggucgaucggaccgaagcgaaggagggucugaaacguggcgagauaacgcaucacgccguaaguagggggagugccaagcugcagugguucgucgagcgaaacauggugauaccggaaggccgugugaucgaccucggaugugggcgcggcggcugguccuacuacugcgccggccugaagaagguuaccgaagugcggggguacaccaaaggagggccuggucacgaggaacccguacccaugaguaccuacggguggaacaucgucaagcugaugaguggcaaggacguguucuaccucccgcccgagaagugcgacacgcugcucugugacaucggggagagcucacccucgccuaccguugaggagucccggaccauccgcguccugaagaugguggagccguggcucaaaaacaaucaauuuugcaucaaagugcugaauccauacaugccaacagucaucgaacaccuggagcgccuccaacguaaacacgguggcaugcugguccggaauccccugucgcgcaacuccacgcacgagauguacuggaucagcaacggaacgggcaacauuguggccuccgucaacauggugucgcggcuccuacugaaccgcuucaccaugacccacagaagaccuacaauagagaaggacguugaccucggcgccgggacacggcauguaaacgccgagccggagacccccaacauggacgugauaggcgagaggaucaagcggaucaaagaggagcacaacuccaccuggcacuacgaugacgagaacccguacaagacgugggccuaucacgggucauacgaggugaaggccaccggcucggccagcaguaugaucaacggggucgugaaacugcugaccaagcccugggacgucgugcccauggugacucagauggcgaugacggacaccacccccuucggccagcagcgugucuuuaaggagaagguggacacccggacgccgcgcagcaugccaggcacccggcgaguuauggggauuacagccgagugguuauggcggacccugggccgcaauaagaaaccccgguugugcacgcgcgaggaauuuaccaagaagguccgcaccaacgccgccaugggggcggucuucaccgaggaaaaccagugggauagcgcuaaggccgccguggaagacgaggauuucuggaaguuggucgaccgggagcgggagcuacacaagcugggcaagugcggauccugcguguacaauaugaugggcaagcgggagaagaagcucggugaguucggcaaagcaaagggcucgcgcgcaaucugguauauguggcuaggggcccguuaucuggaguucgaggccuuaggcuuccugaacgaggaccacugguuuucccgcgagaacagcuauuccgguguggagggcgagggccugcacaagcucggguacauccugcgggacaucagcaagauccccggcggugccauguaugccgacgacacggcgggcugggacacccguaucaccgaagacgaccuucauaacgaggagaagaucacccaacaaauggaccccgagcaccggcagcucgccaacgccauauucaagcugacguaccagaacaaggucgugaaggugcagcgccccaccccgaccggcaccgucauggacaucaucucccggaaagaccagagggggagcggccagguggggacauacggccugaacacguucaccaacauggaggcucagcucauccggcagauggagggagaaggagugcugagcaaagccgaccucgagaacccccaccucccggagaaaaagauaacccaauggcuggagaccaaaggcgucgagaggcugaagcggauggcgaucucgggggacgacugcgucguaaaacccaucgacgaccgcuuugcuaaugcccuccuugcacugaacgacaugggcaagguacggaaggacauuccccaguggcagccgaguaagggguggcacgacuggcagcagguucccuucugcagucaccacuuccacgagcucaucaugaaggacggccgcaagcuggugguucccugccggccgcaagacgagcugaucgggcgcgcucguaucucccagggugcgggauggagccucaaggagacggcgugccuggggaaggccuacgcacagauguggucccugauguacuuucaccgcagggaccuccgguuagcgagcaacgccauuuguuccgccgucccaguacacugggucccgaccagccgcacaacuugguccauccaugcccaccaccaguggaugacaaccgaggacaugcugacgguauggaaccggguguggauugaggacaaccccuggauggaggacaagacccccgucacgaccugggaaaacgugcccuaccucggcaagcgcgaggaccaguggugcggaucucugaucggccugaccucucgggcaaccugggcccagaacaucccgacugcgauacagcaggucagaucccucauugggaacgaagaguuccuggacuacaugcccagcaugaagagguuccgcaaggaagaggaguccgagggcgccaucugguag

SEQ ID NO: 25827 - RNA, 9873 nt, Artificial Sequence
  derived and/or modified CDS sequence (opt11) from DENV-3__HQ541785__SS-prME
accucacucugccucaugaugaucuuacccgccgcccuggcguuccaccuuacaagccgggacggggagccucggaugauaguugggaaaaacgagcgggguaagucgcuuuuauucaagaccgccuccgggauaaauaugugcacacucaucgcgauggacuuaggggagaugugcgacgacacuguuacguacaagugcccucacauuaccgagguggagcccgaggacaucgacuguuggugcaaccugaccuccaccugggucaccuacgggacgugcaaccaggccggcgagcaccggagagacaagcgauccguggcccuggcgccccacgugggcauggggcuggacacgcgcacccagaccuggaugagcgccgaaggcgcauggcgccagguggaaaaaguugagaccugggcccugcgacaccccggguucaccauccucgcccuguuccuagcacacuacaucggcacaucccucacccagaagguugugaucuucauccuucugaugcuagucacgcccaguaugaccaugcguugcgugggggugggcaaccgcgacuucguggagggccuguccggggccaccuggguggacgugguucuggagcacggcggguguguuaccacgauggccaagaacaaaccuacacucgacauugaauuacagaagaccgaggccacccaacuggcgacgcuccguaaguugugcaucgaaggcaagaucacuaacaucacgaccgacagccggugccccacgcagggcgaggccacacugccggaggagcaggaucagaauuacguaugcaaacacaccuacgucgaccgggggugggguaacgguugcggccuguucgggaagggcucccugguaacuugcgccaaguuucagugcuuagaaccuaucgagggcaagguuguccaguacgaaaauuugaaguacacugugauaaucaccgugcacacuggugaccagcaccaggucggcaacgagacccagggcguaacggccgagaucacgccccaagccagcacaaccgaggcgauuuugcccgaguauggcacacugggucuggagugcucgccgcgcacggggcuggacuuuaacgagaugauacuucucaccaugaagaacaaggcauggaugguccaucgacagugguucuucgaccugccccugcccuggaccagcggugccaccacggagacgcccaccuggaaucgcaaggagcuccugguaacuuucaagaacgcccacgccaagaagcaggaggucguugugcugggcucccaggagggcgcgaugcacacggcacucaccggggccacggagauccagaauagcggcgggaccuccaucuucgccggccaccugaaaugucggcugaagauggacaagcucgaguugaagggcaugagcuacgccaugugcacgaacacguucgugcucaagaaggaggugagcgagacccagcaugggacgauacucaucaagguugaguacaagggcgaggacgugccgugcaagauccccuucagcacagaggaugggcagggcaaagcgcacaacggccgcuugaucaccgccaacccggucguaaccaagaaggaggagcccgugaauaucgaggccgagccgcccuucggagaauccaacauugucauugggauaggggacaacgcacugaagaucaauugguauaagaagggcuccagcaucggaaagauguucgaggcgacugccaggggggcccgcaggauggcgauacugggcgacaccgccugggauuucgggucuguuggggggguuuugaauagccuaggcaagaugguccaccaaauuuucgggucugcguacaccgccuuguucuccggaguguccugggucaugaagaucggcaucgggguacuccugaccuggaucggucugaacagcaagaacaccuccaugagcuucuccugcaucgccaucgggaucauaacgcuguaccugggagccgugguccaggccgacauggggugcgucauaaacuggaagggaaaggagcugaaaugcggcagcggaaucuucgugaccaacgaggugcacaccuggacggagcaguauaaguuccaggcggauagccccaagagacucgcuacggccaucgccggcgccugggagaacgguguuugcggcauccgcagcaccacccggauggaaaaccugcucuggaagcaaaucgcaaacgagcucaacuacauccucugggagaauaacauaaagcuaaccgucgucgucggggacaucaucggcguccuagagcaggggaagagaacgcuuacuccccagccaauggagcugaaguacucguggaagaccugggggaaagccaagaucgugacugcggagacccagaacagcuccuuuaucauagacgggcccaauacccccgagugccccagcgucucucgcgccuggaacgugugggagguggaggauuauggcuucggcguuuucaccaccaauaucugguugaagcugcgcgagguauacacccagcugugcgaccaucgauugaugucugcagccguuaaagacgagcgcgccguccacgccgacaugggguacuggaucgaaucgcagaagaacgguucguggaagcuggagaaggccaguuugauugaggugaagacaugcaccuggcccaagucccacacccuauggagcaacggcguccuggaguccgacaugaucauccccaaaagccuggcagguccuaucucccaacacaaccaccggccgggcuaccacacccagaccgccgggcccuggcacuuaggcaaguuggagcucgacuucaacuacugcgaggguacuaccguugugaucaccgagaauugugggacgagaggccccagcuuacggacuaccacagugucggguaaacugauccaugagugguguugucgcagcugcacucugccgccucuccgguacaugggcgaggacgggugcugguacggcauggaaauucgccccaucuccgagaaggaggagaacauggucaagagcuugguauccgccggcagcgggaaaguggacaauuuuaccaugggcguacuguguuuagcaauucuauucgaggaggugaugcgcgggaaguucggcaagaagcacaugauugccgggguguucuuuaccuucguacugcuacugucuggacagaucacuuggcgcgacauggcgcauacgcugauaaugauagggagcaacgccuccgaccggauggggaugggagugaccuaccucgcucuaaucgccaccuucaagauccagcccuuccuggcucucggguucuuccugcgcaaguugaccagcagagagaaccuccugcuaggcgugggacucgcgauggccacaacccugcagcugcccgaggacauugagcagauggcgaacgggaucgcccucggccugauggcgcugaaacucaucacccaguuugagaccuaccagcuguggacggcacugaucagccugaccugcagcaacaccaucuucacccugacggucgccuggcgaaccgcaacccucauccucgccggcguaagccuccugccggucugccagaguagcucuaugcggaagaccgacuggcuuccaauggcgguggcagccaugggcgugccuccccucccguuauucaucuucagccucaaggauacgcugaaacgcagaucguggccgcugaacgagggggucauggcugugggacucguguccauccucgccagcagccugcuccggaaugacguccccauggcgggcccccugguggccgggggauuacugaucgccugcuacgugaucaccgguacuuccgcagaucugaccgucgaaaaagccgcugacauaaccugggaggaggaggccgagcagaccggcgugucgcacaaccuaaugaucgccgucgacgaugacggcacaaugcgcaucaaagacgaugagaccgagaauauccucaccguccuguugaagacagcgcuccuuaucguguccggaaucuucccguacagcauccccgccacccuucucguguggcacacauggcagaagcagacccagcguaguggagucuuaugggacgugccaagcccgccugagacgcagaaggccgagcuugaggaggggguguaucguauaaagcagcagggaaucuucgggaaaacccaggucggcguggggguccagaaggagggcgucuuccacaccauguggcaugugaccaggggcgcagugcucacguauaacgggaagcgccuugagccgaacugggccuccgucaaaaaggaccuaaucagcuacggggguggcuggcgacucuccgcacaguggcaaaaaggugaggagguccaggugaucgcggucgagcccggcaagaaccccaaaaacuuccagaccaugccaggcaccuuucagaccacgaccggggagauaggcgccaucgccuuagauuucaagcccgggaccucgggcagucccauuauaaacagggagggcaaagugguggggcuuuacggcaacgggguagugaccaagaacgggggcuacgugucgggcaucgcucagacgaacgccgagcccgacggccccaccccagagcuggaggaggaaauguucaagaagcggaaucucaccaucauggaccugcaucccgggagcggcaagacaagaaaguaccucccggcgaucguacgggaggccaucaagagacgguugcgcacgcugauucuggcccccacucgaguuguggccgccgagauggaggaggcgcucaaagggcuucccauccgcuaccaaaccaccgccacgaagucggagcacaccggcagagagaucguugaccugaugugccacgccaccuucacuaugcggcucuuaagucccgugcggguaccgaacuacaaccucaucaucauggacgaggcccacuucacggaucccgccuccaucgcggcacgcggguauaucagcacucgcgugggcaugggcgaggccgccgcgaucuucaugaccgcuacgccccccgggacggcagacgcauucccgcaguccaacgcucccauccaggaugaggagcgcgacauccccgagcgcaguuggaacuccggcaacgaauggaucacggacuuugcggggaagaccgugugguucguucccagcaucaaggcaggcaacgacaucgccaacugccuccggaagaacgguaagaagguuauucagcuaucacgcaagaccuucgauacggaguaccagaagaccaagcugaacgacugggacuucguagugaccaccgacaucagcgagaugggagccaacuucaaagccgaccgggucauugacccacgacggugucucaagccuguuauccugacggacggccccgaaagggugauccuggcggggcccaugccagucacagccgccucagccgcccagcgccgcggccggguggggcgcaacccccaaaaagagaacgaccaguacaucuucaccggccagccgcucaacaacgacgaggaccacgcgcauuggaccgaggccaagauguuacucgauaacauuaacacacccgaggggaucauccccgcccuuuucgagcccgagcgggagaaguccgccgcaauugacggagaauaucgccucaagggcgagucccggaaaacauucguugaacugaugcgccgcggggaccuacccgucugguuggcccacaaggucgcuagcgaggguaucaaguauaccgaccgcaaauggugcuucgacggacagcggaauaaccagauccuggaggagaacauggacguggagaucuggacgaaggagggcgagaagaagaaacuccgcccccgcuggcuggaugcucgcaccuacuccgauccguuagcucucaaggaguucaaagaguucgccgcgggccgcaagucuaucgcgcuggaccuggugacggagaucgggagggugcccagucaccucgcccaccguacccggaacgcccucgauaaccuggucaugcuacauaccuccgagcauggcggacgcgcuuaccgucaugccguggaagaacugcccgagaccauggagacguugcuccuauuaggccucaugauccuguuaaccgggggcgccaugcuguuccugaucagcgguaaggggauuggcaagaccuccaucgggcugauaugcgugauuaccagcuccggcauguuauggauggccgagauuccccugcaguggaucgccagcgcgaucguccucgaguuuuucaugaugguguuacugaucccugagcccgagaagcagcgcacuccacaggauaaccaacuggccuauguugucauugggauccucacccuggccgccauuaucgccgcgaaugagaugggccugcucgagaccacgaagagggacuuaggcauguccaaggagccggggguagugagcccaacuuccuaccuggacgucgaccuccacccggcgagugccuggacccuguaugccguggcgaccaccguuauuacgcccaugcugcgccacaccauagagaacuccaccgcaaacgucagcuuagccgccaucgccaaccaggccguggugcugaugggccuggacaagggguggcccauuuccaagauggaccucggcguaccucugcuggcccucgggugcuacagucaagugaauccccugacccugacggccgccgugcuacugcugaucacccauuacgccauuaucggacccggccuccaagcgaaagcuacccgggaggcacagaagcguaccgcggccggaaucaugaagaauccuacggucgacggcaucaugaccaucgaccuggaccccgugaucuaugacuccaaguucgagaaacagcugggccagguaaugcuccugguccuaugcgcggugcagcuccuguuaaugcggaccagcugggcccucugugaagcccugacccuggccacuggacccaucacuacccucugggaggggucccccgguaaguuuuggaacacgacgauagcugucucuauggccaacaucuuccgcggcuccuaccuggccggggccggccuggccuucucaaucaugaaguccgucgggaccggcaagcggggcaccggcagccagggcgagacccuuggugagaaguggaagaaaaagcugaaucagcugagccgcaaagacuucgaccucuacaagaaguccggcaucaccgagguagaccggacagaagcgaaggagggacugaagcgcggcgagaucacucaccacgccgugagccggggguccgcgaagcugcagugguuuguagagcgcaacauggugaucccggagggaagggugaucgaucucggcugcgggcgcggcggguggagcuauuacugcgccggacuaaagaaagucaccgaggugcggggcuacaccaagggcgggcccgggcacgaggagcccgugcccauguccacuuacggcuggaauaucgucaagcugaugucggggaaggauguguucuaccucccgcccgagaagugcgacacccugcugugcgacauaggcgagaguagucccucccccaccguugaggagagccggaccauccgcguccugaaaaugguggagccguggcucaaaaauaaccaguucuguauaaagguccugaaccccuacaugcccacggucaucgagcaucuggagcgucuacaaaggaagcacggcggaaugcuggugcggaacccgcugucacgcaauuccacccacgagauguacuggaucuccaacggcaccgggaacaucguggccagcgugaacauggugucacgccuccugcugaaccgcuuuacaaugacgcaccggcgcccgaccauagagaaggacguggaccucggcgcgggcacgcggcacgucaacgcugagcccgagacccccaacauggacgugaucggggagcgcaucaagcguaucaaggaagagcacaauucaacauggcacuacgacgacgagaacccauacaagacaugggccuaccauggcuccuacgaggugaaggccaccggguccgcguccagcaugaucaacggcgucgugaagcugcugacuaagcccugggaugucgugcccauggugacccagauggcgaugaccgacaccacccccuuugggcagcagcgugucuucaaggagaagguggacacccggaccccgcgcucuaugcccggaacccggcgcgugaugggaaucacggccgagugguuguggaggacgcugggacgcaacaagaaaccccggcugugcaccagagaggaguucaccaaaaaggucaggaccaacgcggccaugggcgcgguguucacagaggagaaccagugggacuccgcaaaggccgccguggaggacgaggacuuuuggaagcucgucgaucgggagcgcgagcugcacaagcugggcaaauguggaagcuguguguauaacaugauggggaagcgcgagaagaaacucggcgaauucgggaaggccaaggggagccgcgcaaucugguacauguggcuuggugcccgguaccuagaauuugaggcgcucggguuucugaacgaggaccacugguucucgcgcgaaaacuccuacagcggaguggagggugaaggacuucacaagcucggguacauccuacgggacaucaguaagauccccgguggcgccauguacgccgacgacaccgccgggugggacacucgcaucaccgaggacgaccugcacaacgaggagaaaaucacgcagcagauggacccggagcauaggcaacucgccaacgccauauuuaagcucaccuaccagaacaaaguggugaaggugcagcgucccacccccaccggcacugucauggauauuaucagucggaaggaccagcgcggcuccggccaggugggcacguacggacuaaacaccuucacgaacauggaggcccagcucauccggcaaauggagggcgaggguguauuaagcaaggccgacuuagaaaacccccacuugccggagaagaagaucacccaguggcuggagacgaagggcgucgagcgcuuaaagcgcauggcgaucagcggugacgacugcguggugaagcccauugacgaucgcuucgccaacgcccuauuagccuuaaacgacauggggaaaguccguaaagacauaccccaauggcagccuagcaagggcuggcaugauuggcaacaagugccguucuguucccaccauuuccacgaacucauuaugaaggacgggcgaaaacuggugguccccugccggccgcaggacgagcugaucggccgcgcccggaucagccagggggcgggauggucccugaaggagaccgcaugccugggcaaggcguaugcccagauguggucgcugauguauuuccacaggcgcgaccuccggcuggcauccaacgccauaugcuccgcggugcccguccacugggucccgaccucccgcacgacguggagcauccacgcgcaccaccaguggaugacuaccgacgacaugcuaaccguguggaaccgaguauggaucgaggacaaccccuggauggaggacaagacucccgucaccaccugggagaacgugccguaccuugguaaacgcgaggaccagugguguggcagccugaucgggcugacaucgcgggcgacgugggcucagaacaucccgaccgcuauccagcaaguccgcagccucaucggcaacgaggaauuccuggacuacaugcccuccaugaagagauuccgcaaagaggaagagagcgaaggggccaucugguga

SEQ ID NO: 25828 - RNA, 9873 nt, Artificial Sequence
  derived and/or modified CDS sequence (opt11) from DENV-3__HM181975__SS-prME
acgagccuaugccucaugaugauccuaccggccgcgcuggcguuccaccucaccagccgggacggcgagcccagaaugaucgugggcaagaacgagcggggcaagagccugcuguuuaagacugccuccgggaucaacaugugcacccucauagcuauggaccugggggagaugugcgaugacaccgugacguacaagugcccccacauaaccgagguggagcccgaggacauagacugcuggugcaaccuaacgagcaccugggugacuuacgggaccugcaaccaagccggcgaacaccggcgggauaagcgcuccguggcgcucgcgccccacgugggcauggggcucgacaccagaacccagaccuggaugagugccgagggcgcguggcgccagguagaaaaaguggagacuugggcccugcgccacccgggguucaccaucuuagcucuguuucuggcccauuacaucggcaccucacugacucagaagguggugaucuucguccugcugaugcuggugacgcccagcaugaccaugcggugugugggggucggcaaccgcgacuucguggagggucuguccggggcaaccuggguggacguagugcucgaacacggugggugcgugaccacuauggccaagaacaagccaacccucgacaucgagcugcagaagacagaggcuacccaguuagcuacgcucagaaagcugugcauagaaggcaagaucacuaauauaaccaccgauucacgcugccccacgcagggcgaggccacuuugccggaggagcaggaucagaacuacgucugcaagcacaccuacguggaucggggguggggcaacgguugcggccuuuucgggaagggcuccuuggugaccugcgccaaguuccagugccuggagcccaucgagggcaaggucgugcagcacgaaaaccucaaguacaccgugaucaucaccguacacacaggugaccagcaccaggugggcaacgagacccagggggucacggccgagaucacgccccaggccagcaccacggaagcgauccugccagaauacggcaccuuggggcucgagugcuccccgcgcacgggccuagacuucaacgagaugauccugcucaccaugaagaacaaggccuggauggugcaccggcagugguucuucgaccuaccccugcccuggaccaguggcgccaccacggagacccccaccuggaauaggaaggagcuccuggugaccuuuaagaacgcccacgccaaaaagcaagaggucguugugcuggggucacaagagggcgcgaugcacacggcucucaccggugccaccgagauccagaacagcggcgggaccaguaucuucgccggccaccugaaaugccggcugaagauggacaaacucgagcugaagggaaugagcuacgccaugugcacgaacacguucgucuuaaaaaaggagguguccgagacccagcacgggacuauccucaucaagguggaguacaagggcgaggacgugccgugcaaaauccccuucucaacggaggacgggcagggcaaggcacacaacggccgccugaucacagccaaccccgugguuacaaaaaaggaggagcccgucaacaucgaagcggagccacccuucggggagagcaacauagugaucggcaucggggauaacgcccugaagaucaacugguacaagaaaggcucauccaucgggaagauguucgaggccaccgccaggggcgcccgcaggauggccauccugggcgauaccgccugggacuucggguccguggggggggucuugaacagcuugggcaagauggugcaccagaucuucggguccgcguacaccgcccuguuuagcggcguguccugggugaugaagaucggcaucggggugcuccugaccuggaucgggcugaacagcaagaacaccuccaugagcuucuccugcaucgccaucgggaucaucacucucuaucucggcgcggugguacaggccgacauggggugcgugauaaacuggaagggaaaggagcugaagugcggcagcgggauauucgugacgaacgaggugcacaccuggaccgagcaguacaaguuccaggcggacuccccuaagcgccucgccacggccaucgccggcgccugggagaacggggugugcggcauccgcagcaccacccggauggaaaauuuauuauggaagcagaucgcgaacgagcugaacuauauucugugggagaacaauaucaagcugaccguggucgugggggacaucaucggcguucucgagcagggcaagcgcacgcugaccccccaaccgauggaauugaaguacucuuggaagaccugggggaaggccaagauagucaccgccgagacucagaacagcaguuucaucaucgacggucccaauacccccgaauguccgagcguuucccgggccuggaacgugugggagguggaggacuacgguuucggcguuuucaccaccaacaucuggcucaagcugcgcgagguguacacccagcuaugcgaccaucggcucaugagcgcggccguuaaggacgagagggccgugcacgccgacaugggcuacuggauagagagccagaagaacggguccuggaaacucgagaaagccucgcugaucgaggugaagaccugcaccuggccgaaaucucacacccuguggagcaacgguguacuugaguccgacaugaucauccccaagagccuggcggggcccaucucccagcacaaccaccggccgggcuaccacacccagacggccgggccguggcaccucgguaagcuggaacuggacuuuaauuacugcgaaggcaccaccgugguuaucaccgagaacugcgggacgcgggggcccagccuccgcaccacgaccgucagugggaagcugauccaugagugguguugucgcagcugcacgcugcccccgcucagauauaugggcgaagacgggugcugguacggcauggagauccgcccgauauccgagaaggaggagaacauggucaagagcuuaguguccgccggcagcgguaaagucgauaauuucaccauggggguacuaugccuagccauauuguucgaggaggugaugcggggaaaguucgggaaaaagcacaugaucgccggggucuucuucaccuucguuuuacuccuguccggccagaucaccuggcgcgacauggcgcauacgcugaucaugaucggcagcaacgccagugaccggauggggaugggcgugacguaccucgccuuaauugccaccuucaagauccaacccuuccuggcccucggguucuuccugcgcaagcugaccagccgugagaaccuccugcugggcgucggccucgcgauggccacuacccuccaguugcccgaggacaucgagcagauggccaacgggaucgcccucggccucauggcgcuuaagcucaucacccaguucgagaucuaccagcuguggaccgcguuaaucucacucacuugcuccaauaccaucuuuacccuaaccguggccuggcgcacggccacccugauccucgcgggggucagccugcugccgaugugucaguccagcuccaugaggaagaccgauuggcuacccauggcgguggccgccaugggugugccgccccucccgcuguuuauuuuuucgcucaaggacacccugaagcgccguuccuggccgcugaacgagggaguuauggccguuggccucgugagcauccuggccaguagcuugcuccggaacgacguccccauggcgggcccucugguggccgggggguuacucaucgccugcuaugugauuacggggaccuccgccgaccucaccgucgagaaggccgcggacaucaccugggaagaagaggccgaacagacgggcgugagccacaaccugaugauaaccguggacgaugaugggaccaugcgaaucaaggacgacgagaccgagaacauccuuaccgucuugcugaagacugcccuccugauuguguccggcaucuucccguacagcauccccgccacacugcucguguggcacaccuggcagaagcagacccagcgguccggcguuuuaugggacgugcccucaccgcccgaaacgcagaaggccgaacuggaagaagggguguaccgcaucaagcagcagggcaucuucgguaagacccaggucggcgucggcgugcagaaagagggcgucuuccacaccauguggcacgugacccggggcgccgugcucacguacaacgggaagcgccucgagcccaacugggccagugucaagaaggacuugauaagcuauggcgggggcuggaggcuauccgcccaguggcagaagggugaggagguccaagugaucgccgucgaaccgggaaagaaccccaagaauuuccagaccaugcccggcaccuuucagaccacgacaggggagaucggugcgauugcacuggacuucaagcccgggacuagcggcagccccauaauuaaccgcgagggcaaggugguugggcuguacggcaacggggucgugaccaagaauggcggguacgugaguggcaucgcgcagacgaacgccgagccggacggacccacccccgaguuagaggaggagauguucaagaaacgcaaccuaacaaucauggaccugcacccagggaguggaaagacccgcaaguacuuaccggccaucgucagagaggcgauaaagcgccggcuccgcacgcuaaucuuggcccccacccgggugguggcggcagagauggaggaggcccucaaggggcugcccauuagguaccagacaaccgcgacgaaguccgaacacaccggccgggagaucgucgaccugaugugccacgccaccuucaccaugcgcuugcugagccccgugcggguuccaaauuacaacuugaucaucauggacgaggcccacuucacggaccccgccuccaucgccgcgcgcggauacauuucuaccaggguaggcaugggcgaggccgccgcuaucuucaugaccgccacuccacccgggacggccgacgcguucccgcagucaaacgcccccauccaggaugaggagcgcgacaucccggagcgcagcuggaacuccggcaacgaguggauaaccgacuucgccggcaagaccgugugguucgugcccucuaucaaggcgggcaaugacaucgcuaacugccuccggaagaacgggaaaaaggucauccagcugucccgcaagacguuugacacggaguaccagaagaccaagcugaacgacugggacuucguggugacgaccgauaucagcgagaugggcgcgaacuucaaggccgacagggucauugacccgagacggugccucaagcccgugauucugacagauggccccgagcgugugauccuggccggcccuaugccgguaacugcggccucugccgcccaacggcgcggacggguggggcgcaauccccagaaggagaaugaccaguauaucuucacaggccagccccucaacaacgacgaagaucacgcccacuggacagaggcgaagaugcugcucgacaacaucaacaccccagaggggaucauaccggcacucuucgagcccgagcgcgagaaguccgcagcgaucgacggcgaauaucgccugaagggcgagucacggaagacguucgucgagcuuaugaggcgcggggaccuccccgucuggcucgcucacaagguagccucugagggcaucaaguacaccgaccgaaagugguguuuugauggacagcggaacaaccagauccuagaggagaacauggacgucgagaucuggaccaaggaaggcgagaagaagaagcuccgcccccgguggcuugacgcccgcacauauuccgacccgcuggcccucaaggaauucaaagaguucgccgcgggccgaaagagcauagcgcuggaccuugugacggagaucgggcgggugcccucgcaccucgcccaccgcacccggaaugcccuggacaaccuggucaugcuacauaccucggagcacggcggacgcgccuaccggcacgcuguggaagagcuaccggagaccauggagacguugcuccugcugggccucaugauccuucugaccgggggugccaugcuauuccugauaagcgggaaggggaucggcaaaaccuccaucgggcugauaugcguaauagcgagcuccgguaugcucuggauggccgaaaucccgcugcaguggaucgccagcgcgaucguccuggaguucuucaugauggugcuccuaauucccgagccagagaagcagcgcacgccccaggacaaucagcuugccuacguggucaucgggauuuuaacgcuugccgccaucaucgcggccaacgagaugggccugcuggaaaccacgaaaagggaccugggcauguccaaggagccgggaguggugagcccaaccuccuaucuggaugucgaccuacacccggcuagcgcuuggacgcuguaugccguugcgaccaccgugaucacccccaugcugcgacauacgauugagaacuccacagcaaaugucagccucgccgccaucgccaaccaggcgguagugcugaugggccuggauaagggguggccgaucuccaagauggaccuaggcgucccccuacuggcacucggaugcuacagccaagucaacccccugacccugaccgcugcaguucuccugcugaucacgcauuacgccauaaucggccccggccuccaggcgaaagccacucgggaggcucagaagcgcaccgccgccgguaucaugaagaauccgaccgucgauggcaucaugaccaucgaccuggauccggugauauacgacaguaaauuugagaagcaacugggccaggucaugcuccugguccugugcgucgugcaacuccugcugaugcggaccucuugggcgcugugcgaagccuugacccuggccacaggccccaucacgacccugugggagggcagucccgggaaguuuuggaacaccacaaucgccgucagcauggcgaacauuuuucgcggcuccuaccuggccggugccgguuuagccuucucgauaaugaaguccguuggcacgggcaagcggggcacggggagccagggagaaacucucggggagaaguggaaaaagaagcucaaccagcugagucgcaaggacuucgaccucuacaagaaguccggcaucacugaggucgauagaaccgaggccaaggaggggcugaagaggggcgagaucacgcaccacgcugucagccggggcuccgccaagcugcagugguucguggaacgcaacauggucaucccggaggggcggguuaucgaccucggcugcgggcgcggcggguggagcuacuacugcgcgggccugaagaaagugaccgaggugcggggcuauaccaagggcgggcccgggcacgaggagcccguccccauguccaccuacggcuggaacauagugaaacugaugagcgggaaggacguguucuauuuaccgcccgagaaaugcgauacgcugcugugcgacaucggcgaguccagcccaucccccacagucgaggaaagccgcaccauccgcguccugaagaugguggagccauggcucaagaacaaccaguucugcauaaagguccugaaccccuacaugcccacugugaucgaacaucuagagcgucuccagcgcaaacacggcgggaugcucgugagaaaccccuugucccgaaacagcacgcacgagauguacuggaucuccaacggcacugggaauaucguggccagcguuaacauggugagucggcuccuucugaacagauucaccaugauccaccggcgcccgaccaucgagaaggacgucgaccucggggccgguacgcggcaugugaacgcggagccugaaacccccaacauggacgugaucggggagcgcaucaagcguaucaaggaggagcacaacagcaccuggcacuacgacgacgagaacccguauaagacuugggcuuaccacgguuccuacgaggucaaggccacgggcagcgccuccagcaugaucaauggaguggucaagcugcugaccaagcccugggauguggugccgauggucacgcagauggccaugaccgacacgacucccuucggucagcagcgcguguucaaagaaaagguggacacccggaccccgcgcuccaugcccggcacgcggcgcgucaugggcauuacagcggaguggcucuggagaacccucgggagaaacaagaagccccgccugugcacccgcgaggaguucaccaagaaggugcgcaccaacgccgccaugggcgcuguguuuaccgaggagaaucagugggacuccgcgaaggccgccgucgaggacgaggacuucuggaagcuuguggaccgggagcgcgaguugcacaagcuggggaagugcggcaguugcgucuacaacaugauggguaaacgcgagaagaaguugggagaguucggcaaggcuaagggguccagggccaucugguacauguggcucggcgcacguuaucuggaauucgaggccuugggguuccucaacgaagaccacugguucagcagggagaauaguuacuccggcgucgagggggagggccuucacaagcucggcuacauccugcgggauaucagcaaaauccccgggggcgccauguacgccgacgauaccgccgggugggacacgcgcauaacagaagacgaccugcacaacgaggagaagaucacccaacaaauggacccggagcaucggcagcucgcaaacgcaaucuucaagcugaccuaccagaacaagguggugaaaguccagcgccccacgcccaccggaacagugauggacaucaucagcaggaaagaccagcgcggcuccggacagguggggaccuacggguuaaacacuuucacgaauauggaggcccagcucauccgccagauggagggcgaaggcgucuugagcaaggccgaucuggagaacccccaccucccggagaagaagaucacgcagugguuagagaccaagggcguggagcgccugaagagaauggccaucuccggcgacgacugcgucguuaagccgaucgacgaccgcuucgcgaacgcgcuacuggcucugaacgacauggggaaggugcggaaggacaucccccaguggcagcccagcaaggguuggcaugacuggcagcaagucccguucugcucccaccacuuucacgagcugaucaugaaggacgggcgcaagcuggucgugcccugccgcccccaggacgagcugaucggccgggcgcggaucagccagggggccggcuggucgcuaaaggagaccgcgugccugggcaaagccuacgcccagauguggucccugauguacuuccaccgucgcgaccuccggcuggccuccaacgcgauaugcagcgccgugcccguccacuggguaccuacgucccgcaccaccuggagcauccacgcccaccaccaguggaugacuaccgaggacaugcugaccguguggaaucgggucuggaucgaggacaaccccuggauggaagacaagaccccugugaccacgugggaaaauguucccuaccucgggaagcgcgaggaccaguggugcggcagccugaucgggcugaccuccagggccaccugggcccaaaacaucccgaccgcgauccagcaaguacguagccuaaucggcaaugaagaguuccuggacuacaugcccucgaugaagcgguuccgcaaggaggaggagucagagggggccaucugguga

SEQ ID NO: 25829 - RNA, 9873 nt, Artificial Sequence
  derived and/or modified CDS sequence (opt11) from DENV-3__HM631864__SS-prME
accagcuugugccugaugaugauccuacccgcagcucuggcauuccacuuaaccagccgcgauggagaaccgcgaaugaucguggguaaaaacgaaagggguaaaagccuacuguucaaaaccgcaagcggaaucaacaugugcacucugauugcgauggaccugggcgaaaugugcgaugacacgguaacuuacaaaugcccacauaucacugaagucgaaccagaggauauugacugcugguguaaccuuaccagcaccuggguaaccuacgggacguguaaucaagcgggggaacaucgacgagacaaacgaagcgucgcacuggcaccacacguggguaugggacuagacacccgcacgcagacauggaugagcgcagaaggcgcauggcggcaggucgagaaagucgaaaccugggcgcuaaggcacccuggauucacaauucuagcgcuauuccucgcccacuacauuggaacaucucuaacacagaaaguagugaucuucaucuuacugaugcuggugacaccuucgaugacgaugcgcuguguagggguagggaacagagauuucguggaagggcugagcggcgcaacauggguagacgucguccucgagcacggcggcugcguaacuaccauggccaaaaauaaacccacgcucgacauagaacugcagaaaacagaagccacacagcuggcaacccuccgcaaauuauguauugagggcaaaauuaccaacauaacaaccgacagccgcugcccuacacaaggagaagccacucugccggaagaacaagaucaaaacuaugucuguaagcacacuuacguggacagagguugggggaacggcugcgggcuauuuggaaaggguaguuuggugacaugcgcgaaauuccaaugccuagaaccaauagaaggaaaggugguacaauacgagaauuuaaaguacacgguaauuaucacagugcauaccggcgaucaacaccaggucgggaaugaaacgcagggggucacggccgaaaucacgccacaggccagcaccacugaggcgauucuaccggaauacggaacccucggcuuagaaugcagcccgagaacggggcuugacuucaaugaaaugaucuuacucaccaugaaaaacaaagcguggaugguccaccgccagugguucuucgaccuaccacucccguggaccagcggcgcaacaacagagacaccgacauggaauaggaaggaacuuuugguaaccuucaaaaacgcccacgccaagaaacaagaggucgucguacucggcucacaggagggcgcaaugcacaccgcgcucaccggcgcgacugaaauccaaaauagugggggaaccagcauauuugcuggacauuugaaaugccgacuaaaaauggacaaacuagaacuuaagggaaugagcuaugccauguguacgaacacauucguucucaagaaggaaguaagugaaacccaacacgggaccauucugaucaaggucgaauacaaaggcgaggauguaccuugcaaaaucccauucuccaccgaagacggucaaggcaaagcgcacaauggacgguugauaacugcaaaucccguggucacaaagaaggaggaaccuguaaauauagaagccgaacccccguucggugaaagcaacauagucauaggcaucggcgacaacgcucugaaaauaaacugguacaaaaaggggagcucuauuggaaagauguucgaggccacggcgcgcggagcgcgccgaauggccauacuuggggacaccgcaugggacuucggaucugucggaggaguacucaauucguuaggaaaaauggugcaucagaucuucggaucggcuuacacugcauuauuuucgggagugaguugggugaugaaaauaggaauaggagugcuccuaacauggauagguuuaaacucaaagaacacgucaauguccuuuagcugcauagccauaggcauuauaacucuuuaccucggggcaguaguucaggccgauaugggcugcgucauuaauuggaaagguaaggagcucaaaugcggcagcggcaucuuugucaccaacgaaguccacacauggacggaacaauacaaauuccaagcagauagccccaaacgucuggccaccgcuaucgcaggagcgugggaaaacggaguauguggaauacguucgacgaccagaauggagaaucuacuguggaagcagauugcaaacgagcugaacuacauccuaugggaaaacaacauaaagcuaacgguagucguaggagacaucauagggguacucgaacaaggaaaaagaacacucacaccccagccuauggaacuaaaguacaguuggaagacgugggggaaggcaaagaucgucacggccgaaacacaaaauuccucguuuauaauugacggaccgaacacgccagagugcccuucgguuagcagagccuggaacguaugggaaguagaagacuauggauuuggcguauucaccaccaauaucugguuaaagcuccgggaaguauacacacaacugugcgaccaccgguugaugucugcagccgugaaggacgagaaagcgguccaugcugacaugggcuauuggauugaaucccagaagaaugggucauggaaauuagagaaagcgagccuaaucgaaguaaagaccugcaccuggccuaagagccacaccuuguggagcaacggagucuuagaaagcgauaugaucauuccuaagagccucgcaggacccaucagucagcacaaccaccggccaggauaccacacccaaaccgccgggcccuggcaccuggggaagcucgagcuagacuucaauuauugcgagggaacgacaguagugauaacagaaaacugcggaacccgcggacccagucuaagaacaacgacuguaagcggcaagcuaauacacgaguggugcugucggagcuguacacuaccaccacuccgauacaugggugaggacgggugcugguauggcauggaaauacggcccauuagugaaaaagaggaaaacauggucaaaucauuaguauccgcuggcaguggaaagguagacaacaguacgaugggggugcuuugccuagcgauacuguucgaagaaguaaugagaggcaaguucggcaagaagcacaugauugccgggguauuuuucaccuuuguacuucuacuguccggacagaucacguggagagacauggcgcacacgcugauuaugaucgguagcaacgcuagcgacagaaugggcaugggcgucacauaccuagcacucauagccacauucaagauccagcccuuucucgccuuaggauucuuccugcguaaacuuaccagcagggaaaaccuuuuacuaggcguggggcuggcgauggcaacgacacuacaacugccugaggacauagagcagauggccaauggaauagcacucggacucauggcgcuuaaguugaucacacaauucgaaaccuaccaacuauggacagcacuaauaucccugaccugcucuaacacaauauucacucucacaguggcauggagaacagcgacgcucauccuggcaggagugagccuccuaccgguaugucaaucaucaucaaugcggaagacagauugguugccuauggcggucgcggcgaugggugucccaccgcucccacucuucauuuucucacucaaagauacgcugaagaggcguagcuggccauugaacgaaggagucauggcagucggccucgugagcauccuggcgucaucccuucuacggaaugacguuccgauggcaggcccccugguggccgguggucuccucauagcaugcuauguaauaacaggcacgagcgccgaccuuaccguagagaaggcggcagacauaacgugggaggaggaggcugaacaaacgggggucucacacaaccugaugaucgccguagacgacgacgguacaaugagaauaaaggaugacgaaaccgaaaacauacucacgguacuccuaaagacagcccuauuaaucgugagcggaauuuucccguacagcauaccagcaacucuccuaguauggcauacauggcaaaagcagacccaaagauccgggguccugugggauguaccgucacccccagaaacacaaaaggcagagcucgaggaaggcguuuaucgcaucaaacaacaaggcauauucggcaaaacgcaaguaggcgugggcguucagaaagaaggcgucuuccacacgauguggcacguaacccgcggcgcgguccucacuuauaacggaaagaggcuagaaccgaauugggcauccguaaagaaggaccucaucucguauggaggcggauggagguuaucggcgcaguggcagaagggagaagagguccagguaaucgcaguggagccuggaaagaaccccaaaaauuuccaaaccaugccugguaccuuccaaacgaccaccggagaaaucggagcuaucgcccuggacuuuaaaccgggaacuuccgggaguccgauaauaaauagagaaggaaaggucgucggucucuacggaaacggcguugugacgaagaacggaggauacguauccggaauagcacaaacaaaugcagaaccggauggaccuaccccagagcuagaagaggaaauguucaaaaagaggaaccugacaauuauggacuuacauccugggagugguaagacacggaaauaucugcccgcaauaguacgggaagccaucaagcggcgauugaggacucuaauacucgcacccacgagaguuguugcggcggaaauggaagaagcauugaagggacuaccgauacgcuaccagaccacggcaaccaaaucagagcacacggggagagagauaguggaccugaugugccaugcgaccuucacuaugcgccuucugucgccaguacguguaccuaacuacaaucuaaucauuauggaugaagcccacuucacggauccggcaucuaucgcggcgcgaggguauaucagcacgcguguaggaaugggagaagccgccgcgaucuucaugacggcaacgccgccaggcacagccgacgcguucccacaaucgaacgcgccaauccaagacgaagaacgagauauuccggagagguccuggaacagcggaaacgaauggauaaccgacuucgcaggaaagacaguuugguuuguaccaagcauaaaggccggcaacgacaucgcgaauugccuaagaaagaacggcaagaaagugauacaacuaagcaggaagacauucgacaccgaauaccagaaaacaaaacucaacgauugggacuucguagucacaaccgacaucagcgagaugggcgcaaauuucaaagcggaccgagucauagacccgcgucggugcuuaaagcccguaauacuaacggauggcccugaacgagucauccuagcaggacccaugccggucaccgccgcaucagccgcccagcggaggggccgcguaggccggaauccccaaaaggagaaugaccaauacauuuucacgggacaaccgcuuaauaacgacgaagaucacgcgcacuggaccgaggcgaaaaugcucuuggacaauauaaacacgccggagggaauaauaccugcacuguuugaaccagagagagaaaagagcgcagccauagacggcgaauacagacucaagggagagagcagaaagacauucguagaacuaaugaggaggggcgaccuacccguauggcuugcacacaagguggccagcgagggaauuaaauacaccgaucggaaauggugcuucgauggucagagaaacaaucagauacuggaagaaaacauggacgucgagaucuggacuaaagagggcgagaaaaagaaguuaagaccacgauggcuagaugcacgcaccuacuccgauccguuagcccugaaagaguuuaaggaguuugcugcggggagaaaaucgaucgcguuagaucuaguaacagaaaucggccgcgugccgucccaccuagcccacagaacacgaaacgcacuugacaacuuggugauguuacauacuucugaacacggaggacgugccuaccgacacgcuguagaagaacugccggaaacgauggaaacgcuccuacuacuagggcugaugauucuacugacaggaggcgccaugcuauuccuaaucagcggaaagggcaucgggaagaccucuauaggucucaucugcguaauugcaaguagcggaaugcuguggauggccgagaucccacuccaauggauagccucagccauaguccuggaguucuuuaugaugguccuucuaauuccugaaccagaaaaacagcgcaccccucaagacaaccaacuagcauacgucguuauagggauacucacgcucgcggcugucauagccgccaacgaaauggggcuacuggaaaccacgaagagggaucugggcaugucuaaagaaccaggcguaguaucuccuacaucguaucucgacguugaccuccaucccgccuccgcguggacccuauacgcuguagcgacaaccguuaucaccccgaugcuaagacauacgauagagaacaguaccgcgaaugucucccuggcagcaaucgcaaaucaggcagugguauugaugggacucgacaaaggauggccuauuaguaaaauggaucuaggggugccacuacucgcacuaggauguuacucgcaggucaacccccuaaccuugacggcagccguucuucuccugaucacgcacuacgccauaauaggaccaggccuccaagccaaggccacccgagaagcccaaaagcgaacggcagcugggaucaugaagaaccccacagucgauggaauaaugacgauagaccucgaccccgucauauacgauaguaaauuugaaaaacaacucggccaaguaaugcuccuuguucucugcgcugugcaauuacuccuaaugcguacuuccugggcacucugcgaggcgcucacacuagcaaccgggccaauaaccacacuaugggaaggaagcccagggaaauucuggaacacgacaaucgccguaagcauggcgaauauauuccggggcagcuaucuagccggagcaggacucgcuuucaguauaaugaagucggugggaacgggcaaacgaggaacugggucccagggcgaaacccucggugaaaaguggaagaaaaagcuaaaccagcuaagucgaaaagacuucgacuuguauaagaaaagcggaauaaccgaaguagaccgaaccgaggcgaaggaaggcuugaagcguggcgagaucacucaccacgccgugucgcgaggaagcgcuaagcuacaaugguucguagagagaaauaugguaauccccgaaggacgagucaucgaccuuggaugcggacgaggcggcugguccuacuacugugcaggccucaagaaggugacagaggugcgcggcuacacgaaagguggcccaggccaugaagaaccaguaccaaugagcacguacggcuggaacaucgucaaacucaugucgggaaaagacguguuuuaucucccuccugaaaagugcgauacuuuacugugcgauauaggugaguccucacccucgccaaccgucgaagaaagcaggacuauacgcguucuaaaaaugguugagcccuggcuaaagaacaaccaguuuugcauaaaagugcucaaccccuauaugccgaccguuauagaacaccuggagaggcuccaacggaagcacgguggaaugcuaguacguaacccccuaucgcguaacaguacacacgaaauguacuggauuagcaacgggaccggaaauaucguagcguccguaaauaugguaaguaggcuucuacuaaacagguuuacaaugacacacagacgaccuacuaucgaaaaagauguagaccuaggagcagggaccagacaugugaaugccgagccagaaaccccgaauauggacguaauaggggagagaaucaagcggauuaaagaagaacacaacuccaccuggcacuacgacgacgaaaaccccuacaaaacaugggccuaccacggguccuacgaagugaaggcgaccgggucggcaagcuccaugaucaacgggguaguaaagcuccuaaccaagccaugggaugugguuccgaugguaacgcaaauggccaugacagacacaacuccguucgggcaacagagaguuuucaaagagaaaguggauacaagaacaccucguagcaugccagggacccgcagaguaaugggaaucacagccgaauggcuguggcggacgcuggggaggaacaagaaaccacgccugugcacacgcgaagaauuuaccaagaaaguaagaacgaacgcggccaugggagccguauucacggaggaaaaucaaugggauagcgcaaaggcggcagucgaggacgaagacuucuggaaacugguugaccgagaacgagaacuucacaaacuaggaaagugcggaucuugcguuuauaacaugauggggaaaagagaaaagaagcucggcgaguucggcaaagcuaaagguucgagagccauaugguacauguggcucggagcccgguauuuagaguucgaagcucugggauuucugaacgaagaccacugguuuucgagagagaacucauauucagguguggaaggugaaggacuacacaaacuaggauacauucugagagauauaagcaaaauaccagguggagcgauguacgcagacgauacggccggaugggauacacgcauaacagaagacgacuugcacaacgaagagaaaauaacacagcagauggaccccgaacauagacagcuagcaaaugccaucuucaaacuaaccuaucagaacaaggugguaaaaguacaacgcccgacuccaaccggaacaguaauggauauuaucuccagaaaagaccaacggggcaguggccaaguaggcaccuacggauuaaauacguuuacgaacauggaagcgcaacugaucagacagauggagggcgaagguguguugagcaaggcggaccucgaaaacccgcacuuacccgagaagaaaauuacgcaguggcucgagacaaaaggagucgagcgccugaaaaggauggcaaucuccggggacgacugcguaguaaaaccaauugacgacagauucgcgaaugcgcugcuagcccuaaaugacaugggcaaaguccguaaggacaucccgcaauggcagccgucaaaaggguggcacgacuggcagcaagugccguucuguucacaccacuuccaugaacucauaaugaaagacggucguaaacuuguagucccaugucgcccacaggacgaacugauaggaagggcuagaauaagccaaggugcggguuggucgcuaaaggaaaccgcgugccuggggaaggcguacgcucaaauguggucacuuauguauuuccaccgccgagaccugagacuggcaucaaacgcgauauguagcgccgucccagugcacuggguaccgacuagccggacaacguggagcauacacgcacaccaccaguggaugaccacagaugacaugcuuacaguauggaacagagucuggaucgaggauaauccguggauggaggacaaaacaccgguuaccacuugggagaauguaccguaccuggggaagagggaagaccagugguguggcucacugauaggacuuaccaguagagccacgugggcacagaacauaccaacggcaauacaacagguccguagucuaauugguaaugaagaguuccuugacuauaugccgucaaugaagcguuucagaaaggaagaagaauccgagggugcaaucugguag

SEQ ID NO: 25830 - RNA, 9873 nt, Artificial Sequence
  derived and/or modified CDS sequence (opt11) from DENV-3__HM631859__SS-prME
accagucugugccucaugaugauucugccggccgcucuggcguuccaccucaccagccgagacggggagccccggaugaucguagggaagaacgagcggggcaagagccugcuguucaagacggcauccgggauaaauauguguaccuugaucgcaauggaccugggggagaugugcgacgauaccguaacguacaagugcccucacauuaccgagguggagcccgaggacaucgacugcuggugcaaccugaccaguaccugggugaccuacgggaccugcaaccaggcuggcgagcaccggcgggacaagcgguccguugcucuugcaccccacgugggcauggggcuugacacaaggacccaaacauggaugucagccgagggcgcguggcgccaggucgagaaggucgagacaugggcccugcgccacccaggguuuaccauauuagcucuguucuuagcccacuacauuggcaccucgcuuacgcagaaggucgugaucuuuauacugcugaugcucgucacgcccuccaugaccaugcggugcgugggggugggcaauagagacuucgucgagggccuuagcggcgccacguggguggacgugguccucgagcacggagggugugugacaacgauggccaagaacaagcccacacuggauaucgagcuccagaagacggaggccacgcagcuggcgacacuacggaaacuuuguaucgagggcaagaucaccaacaucaccaccgacagccgcugccccacgcagggcgaggcaacuuugccugaggaacaagaccagaacuaugugugcaagcacaccuacgucgaccggggcugggggaacgggugcgguuuauucgguaagggcuccuuggucacaugcgccaaguuccaguguuuagaacccaucgagggcaagguaguccagcacgagaaccucaaguacacggugaucauuaccguccacaccggagaucagcaccagguuggcaacgagacccaaggggugacagccgagauuacaccccaggccagcaccacugaggcuauccugcccgaguacggcacccuggggcucgagugcuccccgcgcacgggccuggacuuuaacgagaugauccugcucacgaugaaaaacaaggcuuggaugguccaccggcaaugguucuucgacuuaccacugccauggaccagcggagccaccacggaaacccccaccuggaaccgcaaagagcuccuggugaccuuuaagaacgcccacgccaagaagcaagaagucgucguucuggggucccaggaaggugcgaugcauacagcccucacgggggccaccgaaauccagaacagcgguggcaccucaauauuugccggccacuuaaagugccggcugaaaauggacaaacuagagcugaagggcaugaguuaugcuauguguacgaacacauucguccugaagaaggaggucuccgagacucagcacggaacgauucucaucaaaguggaguacaagggcgaggaugugccguguaagauccccuucuccacugaagaugggcagggcaaggcgcacaacgggcgccugaucaccgccaaccccgucgugacuaagaaagaggagcccgugaauaucgaggccgagccacccuucggagagagcaacaucgucauugggaucggggacaacgcucuaaagauaaacugguacaagaaaggcuccagcaucgggaagauguucgaggcuaccgccagaggcgcccgccguauggccauccugggcgacaccgcuugggacuuugggaguguuggcggggugcucaacagccugggcaaaaugguccaccaaaucuucggaagugcuuacacggcccuguucagcggcgucucaugggugaugaagauuggcauagguguccuccugacuuggaucggccuaaacucgaagaacaccagcaugaguuucuccugcaucgccaucgguaucaucacacucuauuugggggcaguggugcaggcggauauggggugugucaucaacuggaaaggcaaggagcugaaaugcggaucagggaucuucguaacuaaugagguacacaccuggaccgagcaguauaaguuccaagccgacucacccaagcgacucgccacggccaucgcgggcgcgugggagaacggugucugcgguauccgaagcaccacccgaauggagaaccugcuguggaagcagauugcgaacgagcugaacuauauucugugggaaaacaacauuaagcugacggugguugucggggacaucaucggcguccucgagcaagggaaacgcacacugacgccccagccuauggaguugaaauauuccuggaagaccugggggaaggccaaaauugugacugcggaaacccagaacagcuccuucaucaucgacggcccaaauacacccgagugccccagugucucccgggccuggaacguaugggagguggaggacuacggguuuggcgucuucacaaccaacauauggcuaaagcugcgagagguguacacccagcugugugaccauagacucaugucugcggccgugaaggacgaaagggcgguccacgcagacaugggcuacuggaucgagucccagaagaauggguccuggaaacuggagaaggccagcuugauagagguaaagacgugcaccuggccaaaaucccacacccucuggagcaacggaguucuggaguccgacaugauaauacccaaaagccuggcggggccgauaucccaacacaaccaccgcccagguuaucacacccaaacggccgguccguggcauuuaggcaagcuggagcucgauuuuaacuacugcgagggcaccacaguugugaucacggagaacugcgggacacggggucccagucuccggacuacaaccgugagugguaagcugauucacgaguggugcuguagaucuugcacguuaccgccguugcgguacaugggcgaagacggcugcugguacggcauggagauacgucccaucuccgagaaggaggagaacauggucaagucccuagugucagccggcaguggaaagguagacaacuucaccaugggcguccugugccucgccauccuguucgaagaggugaugcgggggaaguuuggcaagaagcacaugauugcagggguguucuucacauucguccugcuucucucgggucagauuaccuggcgcgacauggcgcacacgcuuaucaugauaggcagcaacgccuccgacaggauggggaugggcgugaccuaccucgccuugaucgccaccuucaagauccagcccuuccuggcccucggguuuuuccugcggaagcugaccucacgggagaaucucuuacugggcgugggccucgcgauggccacaacccugcaguuaccugaggacaucgagcagauggcgaacgggauagcccucggccuaauggcgcugaagcucauuacccaauucgagauauaccaacuguggaccgcacugaucucucucacauguucgaauaccauauucacccugaccgucgcuuggcgcacggccaccuuaauucucgccggggugucgcugcugccgaugugccaaucgagcuccaugcgcaagaccgacuggcugcccauggcggucgccgcuaugggcguucccccucucccuuuguucaucuuuagccucaaggacacccugaagcgaagauccuggccccuaaacgagggggugauggccguugggcucguguccauccucgccuccucacugcuccggaacgacgugcccauggccgggccccuggucgccgguggacuccuuaucgccugcuacgugauaacgggaacaagugccgaucucaccgucgagaaggcugcggacauaacgugggaggaagaagcggagcagacgggcgucucucauaaucugaugaucacaguggacgaugacggcaccaugcgcauuaaggacgacgaaaccgagaacauccucaccguacugcuaaagacggcccugcuaaucguaagcggaaucuuucccuacagcauuccggccacacugcucguguggcacacuuggcagaaacagacacagcguuccggcgugcugugggacguuccgucaccgcccgagacgcagaaggccgaacuggaggaggggguguaccgcauaaagcagcagggcauuuuugggaagacccaggugggcgucggaguucagaaggaggggguguuccacaccauguggcaugucaccagaggggcagugcucacguacaaugguaagcgcuuggagcccaacugggccucugucaagaaagaccugaucagcuacggagggggcuggcggcuguccgcccaguggcagaagggggaggaaguccagguaaucgccguggagcccggaaagaacccgaaaaauuuccaaaccaugcccggcaccuuccagaccacaaccggggagauaggggcgaucgcccuugacuucaagccuggcacaagcggcagcccaauuaucaaccgcgaggguaaagucguuggucuguacggcaauggcguuguuaccaagaauggcggcuacguguccggaauugcccaaacgaacgcugagccggacggcccuacgcccgagcuugaggaagagauguuuaagaagagaaaccuuaccauuauggaccugcacccggggagcggcaagacccgcaaguaccuaccggcuaucgugcgggaagcgaucaagcgccggcugcguacgcugauuuuggccccaacccggguaguugcggcggaaauggaggaagcccucaaggggcugcccauucgcuaucagaccaccgcgaccaaaucggagcacaccggacgugagaucguggaccuuaugugccacgcaacauuuaccaugagacuccugagccccguucgggugccuaacuauaaccugaucaucauggacgaggcgcacuuuacggaccccgccuccaucgccgcgcgcggguacaucagcacgcggguaggcaugggcgaggcagccgcuaucuuuaugaccgcaacaccgcccggcacggccgaugcauuuccgcagucuaaugccccaauacaggacgaggaaagagacauaccggaacgcucguggaacuccggaaacgaguggaucaccgauuucgccggcaaaacagucugguucguacccucaaucaaagcgggaaacgauaucgccaauugccuccggaaaaacggaaagaaggugauccagcugucccgcaagaccuucgacaccgaguaccaaaagaccaagcugaacgacugggacuucgucgugacgaccgacaucucugagaugggcgccaacuuuaaggccgaucggguaaucgacccgcggaggugccucaagcccguaauucugacggauggccccgagcgugugauccuggcggggcccaugccggugacagccgccuccgcagcacaacgccgcggccggguugggagaaacccacagaaggagaacgaccaguacauauucacaggccaaccgcucaacaaugaugaggaccacgcccacuggacugaggcgaagaugcugcuggacaacauaaacaccccugaggggaucaucccggcucuuuucgagccagagcgcgagaaauccgccgccauagacggcgaauaccgacugaagggggaaucccggaaaacauucguggagcugaugcgccgcggcgaccuccccguguggcuagcgcauaaggucgccagugaaggcaucaaguauacugaccggaaguggugcuucgaugggcaaagaaacaaccaaaucuuagaggagaauauggauguagagaucuggacuaaggaaggcgagaagaagaaacuccguccacgguggcuggacgcgcgcacauauagugauccgcuggcacuaaaggaguucaaggaguuugccgcuggcagaaaguccauugcacuggaccuggucacagagaucgggcgugugcccagccaucuagcucaccgcacgcggaaugcccuggauaaccuggugaugcuacacaccagugagcacggcgggcgagccuacaggcaugcggucgaggagcugccugagaccauggagacgcuucugcugcugggccucaugauacuguuaaccggaggggccaugcuguuccuaaucagcggcaaagggaucggcaagaccuccaucggccugauaugugugauagcgagcaguggcaugcucuggauggccgaaaucccgcugcaguggaucgccucagcaauuguauuggaguuuuucaugaugguccugcuuauccccgagcccgagaagcagcgcacgccgcaggacaaccaacucgcauacgugguuaucggaauccucacgcuggccgcaauuaucgccgccaaugagaugggccuucuggaaaccaccaaaagggaccugggcauguccaaagagccgggagucgugucucccaccuccuaucuggacguugaccuccacccugccucugcguggacauuguaugccgucgccaccaccgugaucaccccaaugcugcgacacacgaucgaaaauucaacagccaaugucagucucgccgccauugcuaaucaggcaguugugcugaugggccuggacaagggauggcccauauccaaaauggaccucggcgugccuuuacuggcccucgggugcuauucacaagucaacccauugacucugacagcggccguacuccugcucauuacgcacuaugcuaucaucgggccaggccuccaggcgaaggccacccgggaggcacagaagcgcacugccgccgguaucaugaagaacccgacuguggauggaauuaugacaaucgaccuggaccccguaaucuacgauaguaaguuugaaaaacagcuaggccagguaaugcuccugguacugugcgucguacagcuccugcugaugcgaaccagcugggcgcuuugcgaggcccugaccuuggccaccggaccgaucacgacccucugggaggguucccccgggaaguucuggaacacaaccaucgccgucagcauggcuaauauauuccguggauccuaccuggccggggccggccuggcguuuuccaucaugaaguccgucgggaccggcaaacgcgguaccgggucacagggcgagacuuuaggggagaaguggaagaagaaacuuaaccagcuuagucgcaaggacuucgaccucuacaagaaguccggcaucacugagguggaccgcaccgaggccaaagaggggcuaaaacgaggcgagaucacccaucacgcggugagccggggaagugcgaagcugcagugguucguagagcgcaacaugguaaucccggaagggcgggugaucgaucucggaugcgggcgcggcggguggagcuauuacugugccgggcugaagaaggucacagaagugcggggauacaccaaaggcgguccugggcacgaggagcccgugcccauguccacguacggauggaacaucgucaaguuaaugagcgggaaagacguguucuaccugccgcccgaaaaaugugacacgcuucuuugcgauaucggcgaguccucccccucacccacaguugaggaaucucggaccauucgcguccugaagaugguagagccguggcucaaaaacaaucaguucuguauuaaagugcugaaccccuacaugcccaccgugaucgagcaccuggaaaggcuccagcgcaagcacggcgggaugcuaguacggaacccacugucucgcaauagcacccacgagauguacuggaucagcaacggaacggggaacauuguggcgagcguuaacauggucucucggcuccugcugaacagguucacuaugacccacaggagaccgacuaucgagaaggacgucgacuugggagccgguacgcggcaugucaaugccgaacccgagacccccaauauggacgugaucggggagcgcaucaagcggauuaaagaagaacacaacagcaccuggcacuacgacgacgagaacccguacaagacgugggccuaccauggguccuacgagguaaaggcgaccggguccgcauccucuaugaucaacggcguugucaaguugcuuaccaagcccugggacguggugcccaugguuacacaaauggccaugacggacaccacccccuuugggcaacagcgcgucuuuaaggagaaaguggacaccagaacuccgcgaagcaugccgggcacccggcggguaaugggaauuaccgcggaguggcucuggcggacccugggaagaaacaagaagccccggcugugcacccgcgaggaguucaccaagaagguccgaaccaacgccgccaugggggcgguauucacggaggagaaccagugggacuccgcgaaagcugccguugaagacgaggacuucuggcggcucguugaucgcgagagagagcuucauaaguuaggaaaguguggcucguguguuuauaacaugaugggaaaacgggaaaagaagcucggagaguucggcaaggcgaaggggucccgcgccaucugguauauguggcuaggcgcacgcuacuuggaguucgaggcucucggguuccuuaacgaggaccacugguucagcagagaaaauuccuacagcggaguggagggggagggacugcauaagcucggcuauauccugcgcgacauauccaagauccccgggggcgcuauguacgcugacgacacggccggcugggauaccagaauaaccgaggacgacuuacacaacgaggagaagaucacccagcaaauggacccggagcaccgccagcuggcgaacgccaucuucaagcuaacauaccagaacaaggucgucaagguucagcggccuacccccaccggcaccgucauggacaucauaagcagaaaggaucagcgggguucuggccaaguagguaccuacggccuuaacaccuuuaccaacauggaagcccagcuuauccggcagauggaaggggaggguguucugagcaaggccgaccuggagaacccacaccucccggagaagaagauaacccaguggcuggagacaaagggugucgagcggcugaagcgcauggccauauccggcgacgauugcguggugaagccaaucgacgaccguuucgcgaaugcccuccuggcccugaaugacauggggaagguccggaaagacaucccccaguggcagccauccaagggcuggcacgacuggcagcaggucccguuuuguagucaccacuuccacgaguuaaucaugaaagaugggagaaagcugguagucccgugucgcccccaggaugaguugaucggccgggcccguaucagucagggagccgguuggucccucaaagagacggcgugccugggcaaagccuacgcacaaauguggagccugauguauuuccaccgccgcgaucuccgccuggccucgaacgcgaucugcagcgccgugcccgugcacugggugcccacaucgcggacaaccuggagcauucacgcccaccaccaguggaugacgaccgaggacaugcugaccguguggaaucgcguguggaucgaagacaaccccuggauggaagacaagacccccgucacgacaugggagaauguacccuaccuagggaagcgggaagaccaguggugcggcagccugaucggguugaccucccgggccacgugggcacaaaacaucccgacggcgauccagcaggucagaagccucaucggcaacgaagaguuucuugacuauaugcccucuaugaagcgcuuccggaaggaagaagaguccgagggggccaucugguaa

SEQ ID NO: 25831 - RNA, 9870 nt, Artificial Sequence
  derived and/or modified CDS sequence (opt11) from DENV-3__HM631856__SS-prME
accagccugugucucaugaugauccugcccgccgcccuggcuuuccaccucaccagccgggacggggagccccggaugaucguggggaaaaacgagcgagggaagucacuacuguucaaaacugccuccgggaucaacauguguacucuuaucgccauggaccugggcgagaugugcgacgacacagugaccuacaaauguccccauauuacagaaguggagccagaggacauugacugcuggugcaaccugacaaguacuugggugacuuacgggacgugcaaccaggcaggcgagcaccggcgcgacaagcggagugucgccuuagcgccccaugugggaauggguuuagauaccagaacccagaccuggaugagcgccgagggcgccuggcggcaggucgagaaggucgaaaccugggcccugcgucacccgggguucaccauacucgcgcuguuccuggcccacuauauuggcacgucccucacccagaaagucgugaucuuuauccuucugaugcuggucacgcccucaaugaccaugcggugcgugggaguaggcaaccgugacuucguagaaggccugagcggugccaccuggguugacgucgucuuagagcacggcgggugugugaccacuauggcaaagaacaagcccacccuugacaucgagcugcagaagaccgaggccacccaacuggcgacgcuccggaagcuuugcaucgaaggcaaaaucaccaacaucaccaccgacagccgcugccccacgcagggagaagccacccugccugaggagcaggaucagaacuacgugugcaagcacaccuacgucgacagaggguggggcaacgggugcggccucuucgggaaggggucccuggugacgugcgccaaguuucagugccuagagcccaucgagggcaaagugguccaauaugagaaccucaaguacacugugauuaucaccguacacaccggggaccaacaucaggucggcaaugagacccaggggguuacggccgagaucacgccccaggccagcacuaccgaggcaauccugcccgaguacggcacccugggguuggagugcuccccacgcacggggcucgacuuuaacgagaugauccugcucaccaugaagaauaaggcuuggaugguccaucggcaaugguuuuucgaucugccccugccguggaccaguggcgccacuaccgagacccccaccuggaacaggaaggagcuccucgugaccuucaaaaaugcccaugccaagaagcaggagguggucgugcuggggucccaggaaggcgcgaugcacacggcccucaccggggcgacggagauccaaaacagcggcggaaccuccaucuuugccggccaccugaagugucgccugaagauggacaagcucgagcugaaggguaugagcuacgccauguguacgaacaccuucguguuaaaaaaggaagucuccgagacccagcacggaacuaucuugaucaagguggaguacaagggcgaggacgugccgugcaagauucccuuuagcacggaggacgggcaaggcaaggcgcacaacggccgccucauaaccgccaaucccgucguuaccaaaaaggaggagcccgugaacaucgaggccgagccgcccuucggggagagcaacauugucaucggcaucggggacaacgcucucaagaucaacugguacaagaagggcucuuccaucgggaagauguucgaggcgaccgcccggggcgcccgccggauggcuauucuaggcgacacagccugggacuucgggagcgugggcgguguucucaacagccuggggaagaugguccaucagaucuucggauccgcuuauaccgcucuguucagcggaguuuccugggugaugaagaucggcaucgggguguugcugacauggaucggccugaacagcaagaacaccuccaugagcuuuucgugcaucgcaauaggcaucaucacgcucuaccugggcgccguggugcaggcggacauggggugugucgugaacuggaaaggcaaggaacugaagugcgguagcgguaucuucguaacaaacgagguccacaccuggacugagcaguacaaguuccaggcggauuccccaaagagacuagccacggcaaucgccggugccugggagaacggagugugcggcauacgcagcaccacacggauggagaaucuacuuuggaagcagaucgcgaaugagcucaacuacauccugugggagaacaauaucaaacugacgguagucgugggagacaucaucggcgugcuugagcaaggaaaacguacguuaacaccccagccgaaggagcuaaaguauucguggaagacuugggggaaggccaagaucgucaccgcagaaacccagaacagcuccuucaucaucgacggcccuaauacccccgagugucccuccguuucucgggccuggaacgugugggaggucgaggacuacggcuucggcguauucaccacgaacauuuggcuaaagcugcgcgaaguauacacccagcugugcgaucauagacucaugagcgcugcggucaaagaugagcgugccguacacgccgauaugggcuauuggauugagucacagaagaacggguccuggaagcuugagaaggccaguuuaaucgaggugaagacuugcaccuggccuaagucccacacucugugguccaaugguguacuggagagcgacaugauaaucccuaagagccuggcagggccgauaagccaacauaaccaccgcccgggcuaccauacccagacggcggggccuuggcaccucgguaagcuggagcuggacuuuaacuacugugagggcaccaccguggugauaaccgagaacugcggcacgcguggcccaagccuccggaccaccacgguguccgguaaauugauccaugaguggugcugucguagcugcacuuugccuccgcuccgguauaugggagaggauggcugcugguacggcauggagauucgacccaucucggaaaaggaagagaacauggucaaaucgcuggucuccgccggcagcgguaagguugacaacuucaccauggguguacugugccucgccauccuguucgaggagguuaugagagggaaguucggcaagaagcacaugaucgcaggcguguucuucacauucguccuacuucuguccggccagaucaccuggcgugauauggcgcauacucuuauuaugaucgguagcaacgccuccgaucggauggguaugggcgugaccuaccucgcccugaucgccaccuucaagauccagccuuuccuagcuuuaggguucuuccuuagaaagcuaaccucgcgggaaaaccuccuccugggcgucggccucgccauggccacuacccugcaguugcccgaggacauagagcagauggccaaugggaucgccuuaggucucauggcguuaaagcucaucacucaguuugagaccuaccagcuauggacagcccugaucagccugaccugcucuaacaccaucuucacgcuaacgguggcguggcgcaccgccacgcugauucuggccgguguuagccugcugccggugugucaguccagcagcaugcggaaaaccgacuggcucccuauggcgguggcggcgaugggggugccgccccucccgcuguuuaucuucucacucaaggacacgcugaagcggcgcuccuggccccugaaugaggguguaauggccguaggacucgucagcauccuggccuccagccuguugcgaaaugacguacccauggcgggcccacugguggccgggggccugcucaucgccuguuacgugaucaccgggaccagugccgaccugaccguagagaaggccgcugacaucacgugggaggaagaggcggagcagaccggugugagccauaaucugaugaucaccguggacgacgacgggaccaugcgcaucaaagaugacgagaccgagaacauccucacggugcuguugaagaccgcccuauugauuguguccggcaucuucccguacagcauccccgccacccugcucgucuggcauacauggcagaaacagacacagcgguccggcguccugugggacguacccagccccccggaaacccagaaggccgagcuggaggagggggucuacagaauaaagcagcagggcaucuucggcaagacccaaguuggcguagguguccaaaaggagggcguguuucacaccauguggcacguaacaaggggcgcgguacucacuuacaacgggaaacgccucgagccaaacugggccucagugaagaaggaccugauaucauauggcggcgguuggaggcucuccgcucaguggcaaaagggagaggaggugcaggucaucgcaguggaacccggcaagaaccccaagaauuuccagaccaugccaggcaccuuccagacaaccacuggcgagaucggcgcgauagcccuugacuucaaaccugggaccagcggaucuccgaucaucaaccgcgaggggaaaguggucgggcucuacgggaacgggguugugaccaagaacgggggguacgucuccgguaucgcacaaaccaacgccgaaccggacggcccaacucccgaacuggaagaagaaauguuccggaagcgcaaccucaccaucauggaccugcacccagguuccggcaagacgcggaaguaccugccugccauuguccgggaggcaauaaagcggcgccuccggacacugauccuggcacccacccgcgucguagccgccgagauggaggaagcacucaaggggcugcccauacgcuaccagacaaccgcgaccaaguccgagcacacgggacgggagaucguugaccugaugugucacgcuacguucacgaugcgguuacugucgcccguucgcgucccgaauuacaaccugauaaucauggacgaggcccauuucaccgauccugccucaaucgccgcccggggguacauuagcacccgcgugggcaugggcgaggcugccgccaucuuuaugaccgcgacuccgccagggaccgccgacgccuuuccccagaguaaugcccccauucaggacgaggagcgcgacauucccgagcggucguggaacuccggcaaugaauggauaaccgacuucgccgggaagacagugugguucguccccagcaucaaggcaggcaacgacaucgccaacugccuccgcaagaacggaaagaaaguuauacagcugucacggaagacguucgacacugaguaccaaaaaaccaagcugaacgacugggacuucguggucaccacugacaucagcgagaugggcgcgaauuucaaggccgaccgcgugaucgacccgcggcgcugccucaagcccgugauucugaccgacggccccgaaagagugauucuggccgggcccaugccugucacagcggccucugccgcccagaggcggggccgugucgggcggaacccccagaaagagaacgaccaguacaucuucaccggccaacccuuaaacaacgacgaggaccacgcccacuggacugaggcgaaaaugcuguuggacaacauuaacacgccggaagggaucaucccggcccuuuuugaacccgaacgcgagaaguccgcagccaucgauggcgaguaccggcuaaagggcgagucccggaaaaccuuugucgaacugaugcgccgcggggaccucccuguuuggcuggcgcacaaagucgccucugagggcaucaaguacaccgaccggaaguggugcuucgacgggcagcgcaacaaccagauccuggaggagaacauggacguggagauauggacgaaggaaggggagaagaagaagcuccggccccgcuggcuggaugcccgcacguacucggacccgcucgcgcucaaggaauucaaggaauucgccgcgggucgcaagagcauagcccuggacuuagugaccgagaucgggcgcgugcccucccaccuggcccacaggacacgaaacgcccuagacaaccuggugaugcuccacaccucugagcauggugggagagccuaccgccacgcgguggaagagcugccagagacgauggaaacccuucugcugcugggcuuaaugauuuuacugacugggggcgcaauguuauucuuaaucagcggcaaagggaucggcaagaccuccaucgggcugauaugcguuaucgccuccucggggaugcuauggauggccgagaucccccuucaauggaucgcaagcgcgauugugcuggaguuuuucaugauggugcuccuaauaccggagcccgagaaacagcggacgccccaggacaaccagcuggcauacguugugauagggauccucacccuggccgcaauaauagcggcgaacgagaugggccugcucgagaccacuaagcgggaccuggggauguccaaggagccugggguagucucgcccacgaguuaccucgacguagaccuccaccccgccagcgccuggacguuguacgcuguggcgacaaccgucauuacgcccaugcugcggcacacuaucgaaaacucgaccgccaaugucucucucgcagcaaucgccaaccaggcgguaguccugaugggccuggauaagggguggcccaucuccaagauggaccuuggcguuccccuucuggcgcucgggugcuacagucaaguuaacccucugaccuuaaccgccgccguucuccugcugaucacccauuaugcuauuauaggccccgggcuccaggcaaaagcgacccgcgaggcccagaagcggaccgccgccgggauaaugaagaacccaacgguggacggcaucaugacaauagaccuggaccccguaaucuacgacuccaaauucgagaaacagcugggacagguaaugcuccuggugcugugcgcgguucaguugcuucugaugcgcaccagcugggcacucugcgaggcauugacccuggccacgggcccaaucaccacccucugggaggguucacccgggaaguucuggaacaccacaauagccgucagcauggcaaacaucuuucgggguuccuaccuugccggcgcuggucuggccuucagcaucaugaaguccgucgggaccggcaaacguggcaccgggucacagggggaaaccuugggggagaaguggaagaagaagcugaaucaacugucgcgaaaagacuucgaucuauacaagaaguccggcauaaccgaggucgaccgcacggaagcaaaggaagggcugaaacggggcgagaucacgcaccacgccgucagccgcggcucugccaagcuccagugguucguggagcggaacauggugaucccggaggggcgugucaucgaccuagguugcgggcggggcgguuggagcuacuacugcgccggccugaaaaagguuaccgagguccgcgguuacaccaaaggaggucccgggcaugaggagcccguccccauguccacguacggcuggaacauugugaaacugaugagcgggaaggacguguucuaccucccacccgagaagugugacaccuuacugugugacauuggcgagucaagccccagccccaccgucgaggagucccgcacgauccggguucugaaaaugguggagccguggcucaaaaacaaccaguucugcaucaagguccugaaccccuacaugcccacgguuauagagcacuuggagcgacuccagcggaaacauggcgggauguuggugcgcaacccccugucccggaacucaacgcacgagauguacuggauaagcaauggaacagggaacauugucgccucagugaacauggugucgcgccuccuccugaauagauuuacgaugacgcaccgccggccuaccaucgagaaggacguggacuuaggcgcggggaccagacaugugaacgccgagccugaaacccccaacauggacgugauaggggagcggaucaaacgcaucaaggaggagcacaacagcacguggcacuacgacgacgagaacccguauaagaccugggcguaucacgguuccuacgaagucaaggcuaccgggagcgccaguagcaugauaaacggaguagucaaacugcugacaaagccaugggacgucgugcccauggucacgcagauggcaaugaccgacaccacucccuuugggcagcaacggguguuuaaggagaagguggauacacgcaccccgcggaguaugcccggcacccgccgggucauggguaucaccgccgaguggcucuggcgcacgcugggucggaacaaaccucgccugugcacccgcgaggaguucaccaagaaggugagaacgaacgccgccaugggagcgguguucaccgaagagaaccagugggacuccgccaaggcggcugucgaggacgaagacuucuggaagcuuguggaccgcgagagggaacugcacaaacugggcaaguguggcagcuguguguauaacaugauggggaagcgcgagaaaaaguuaggcgaguucggcaaggccaaggggagccgggcgaucugguacauguggcugggugcaagguaccuggaguucgaggcccucgguuuucugaaugaagaccacugguuuucgcgugagaacucauacagcggagucgagggugaggggcugcacaagcucggcuacauccuccgcgacaucuccaaaauccccggcggugccauguacgccgaugacaccgcggguugggacacucgaaucaccgaggacgacuugcauaacgaggaaaagaucacgcagcagauggacccagaacaccgucagcucgccaacgccaucuucaagcugaccuaucagaacaaggucgugaaaguccagcggcccaccccgaccggcacagugauggacaucauuagccgaaaggaccaacgcggaagcggccagguggguacguacggguuaaacaccuuuaccaacauggaggcccagcucauccgccagauggagggcgaggggguguugagcaaagcagaccuugagaacccccaccucccggaaaagaagaucacccaguggcuggagacgaaggggguggaacggcugaagagaauggcgaucucaggcgacgacugcgugguuaagccgauugacgaucgcuuugcuaacgcccuccucgcccuaaaugacauggggaaggugcgaaaggacaucccccaguggcagccgagcaagggcuggcacgacuggcaacaggugccguucugcucccaccacuuccacgagcugaucaugaaggaugggcggaaacugguugugcccugccgcccgcaggacgagcugaucggacgggcccguaucagccaaggugcgggcuggucucucaaggagacugccugccuggggaaagccuacgcccagauguggucgcugauguacuuucaccgacgggaucuccgccuggcgucgaacgcuaucugcagcgccguccccguccauugggugccaaccucccggaccacguggucuauccacgcccaccaccaguggaugaccaccgaggacaugcugaccguuuggaaucgcguauggauugaggauaaccccuggauggaggacaagacgcccgugaccaccugggagaacguucccuacuuggguaagagggaagaccagugguguggaagccugauagggcuaacgagucgagcuacuugggcccagaacauccccaccgcuauccagcagguacggagccuaaucggcaacgaagaauuucuggacuacaugcccaguaugaagcgguuucggaaggaggaggagagcgagggggccaucugguag

SEQ ID NO: 25832 - RNA, 9873 nt, Artificial Sequence
  derived and/or modified CDS sequence (opt11) from DENV-3__HM756276__SS-prME
accucauugugucucaugaugauacuccccgccgcccuggccuuccaccucaccucgcgggacggggagccccgcaugauuguggggaagaacgagcgcggcaaaagccugcuguucaaaacugcauccggaauuaacaugugcacccucauagccauggaccugggcgagaugugcgacgauaccgugaccuauaagugcccacacaucaccgaggucgagcccgaggauaucgauuguuggugcaacuuaaccagcacgugggucacuuaugggacgugcaaccaggccggcgagcaccgccgcgauaaaagguccguggcccucgcuccccacgugggcaugggacuggacacucgaacccagaccuggaugagugcugagggugccuggcgacagguggagaaagucgagacuugggcccuucgccacccgggguucaccauccuugcguuguuucuggcccacuacaucggcaccucguuaacccagaagguggugauuuucauacuuuugaugcucgucacccccucgaugaccaugaggugcgucgggguggggaaccgcgacuuugucgagggccuguccggggcaacguggguggacgugguccuggagcauggcggguguguuaccacgauggccaagaauaaacccacccucgacaucgagcugcagaagacggaagccacccagcucgccacgcuucgcaaguuguguaucgaggggaagaucaccaacaucaccaccgacucgcgcuguccuacucagggugaggcaacccuacccgaggagcaagaccaaaacuacguuugcaagcacaccuauguggacagagggugggggaacgggugcggccucuucgguaagggcucccucgugaccugcgccaaguuucagugccuggagcccaucgagggcaaggugguccaguacgaaaacuugaaguacacugugaucaucacggugcacaccggggaccagcaccaggucggcaacgagacccaaggugugaccgcggagauuacuccacaggccagcaccaccgaggcgauccugcccgaguacggcacccuagggcuagagugcagcccccggacaggccuugacuucaacgagaugauccugcucacgaugaagaacaaggcuuggaugguccaccggcagugguucuucgaccugccccugccguggaccagcggggccaccacggagacccccacguggaaccguaaggagcuccuggugacuuuuaagaacgcgcacgcgaagaaacaggaggugguagugcuggggucacaggagggcgcaaugcacacggccuuaaccggagccaccgagauacaaaauucaggcgggaccucgaucuucgcgggccaccugaaaugucggcugaagauggacaagcucgagcucaagggaaugagcuacgcaaugugcacaaauaccuucguacugaagaaggagguauccgaaacucaacacgggacgauccucaucaaaguggaguacaagggagaagacgugccgugcaagauccccuucaguacggaggacgggcagggaaaggcgcacaacggccgccugauaacggccaacccaguagugacaaagaaggaggaacccguaaacauagaggccgagccaccuuucggugaguccaauauagucaucggcaucggggacaacgcgcugaagaucaauugguacaagaaaggcuccagcaucgggaagauguucgaggcaacagcccggggagcccgccggauggcaauccugggugacacggccugggacuucgggagcguagggggaguucucaacaguuuaggcaaaauggugcaccagaucuuuggguccgcguacaccgcgcuuuucagcggggucuccugggucaugaagaucggcaucggggugcugcugaccuggauagggcugaacucuaagaacaccagcaugagcuuuucaugcaucgcaaucgggaucaucacgcucuaccugggagccguggugcaggccgacauggggugcgucgucaauuggaagggcaaagaguuaaagugcgggagcgggaucuucgugaccaacgaaguccacacuuggaccgagcaauacaaguuucaggccgacucucccaagcgcuuggccacggccauugcgggagccugggagaacgggguuuguggaauccgcagcacaacucggauggagaaucugcuguggaagcaaaucgcgaaugaacuaaacuauauucuaugggagaacaacaucaagcugacugugguggugggggauaucaucggcguccucgagcagggcaagcguacgcucaccccgcagccgauggagcugaaauacuccuggaagaccugggggaaggccaaaaucgugaccgccgagacgcagaauagcaguuuuaucaucgacggcccuaacacuccugaaugucccagcgugucccgggccuggaacgucugggaggucgaagacuacggguucgguguguucaccaccaacaucuggcucaaacugcgcgaggucuauacccaacuuugugaccaccggcucaugagcgcggcagucaaggacgagcgcgcggugcacgccgauaugggauacuggaucgagagccagaaaaacgggucguggaaacuagagaaggccagccugaucgaggugaagacaugcaccuggccgaaaucccacacccucuggagcaacggcguccuggagucagacaugaucauccccaagucucuggcgggaccuaucucccagcacaaccaucggccuggauaccauacccaaacggccggccccuggcaccucgguaaacuugaguuggacuuuaauuauugugaggguacuacgguugugaucacggagaacugugggacucgcggcccgagccuacggacaaccacagucucggggaagcugauccacgagugguguugccgcuccugcacgcugccaccgcugcgguacaugggcgaagauggcugcugguacggcauggagauccgccccaucuccgagaaggaggagaacaugguaaagucucuggugagugccgggagcgggaagguugacaacuucaccaugggcguguuaugccucgcaauacuguucgaagaggucaugcguggcaaguucgguaagaaacauaugauugccgggguuuucuucacguuugugcugcuacuguccggccaaaucacguggcgcgacauggcgcacacgcugaucaugauuggcagcaacgccucagaccggauggguaugggcgugacguaccucgccuugaucgcuacauucaaaauccagcccuuucuugcccucggguucuuccugcgcaaacugaccagccgggaaaaccuccugcucggaguuggccuagcgauggccacuacccugcagcugcccgaggauaucgagcagauggccaacgggauagcucucggccugauggcgcugaagcucauaacucaguucgagacuuaccagcuguggacagcgcuaauuagccugacuugcuccaacaccaucuucacacuaacaguggccuggcguaccgcgacccugaucuuggccggggucucgcugcuuccggucugccaguccucaaguaugagaaaaacagacuggcucccuauggccguagccgcgaugggcgugccuccauuaccccuguuuaucuucagucucaaagacacucugaaacgccgaucauggccucucaacgagggggugauggccgugggccucguguccauccuggccucgagcuuacuucggaacgaugugcccauggcgggcccucugguggcugggggcuugcucauugcaugcuacgucaucacaggcacguccgcugaccuaaccguggagaaggccgcggacaucacgugggaggaagaggcugagcagacaggcguuagccacaaucugaugauaacuguugacgacgacggcaccaugcggaucaaggaugacgaaaccgagaacauccucaccguacuucugaaaaccgcccuccucauuguguccggcaucuucccuuacaguaucccggccacacuccucguauggcauaccuggcaaaagcagacgcagcgcuccggcgugcugugggacguaccaagucccccggagacccagaaggccgagcuggaggagggcgucuaccggaucaagcagcaggguaucuucgggaaaacccagguaggcguggggguucagaaggagggcguguuccauaccauguggcauguuacgcggggcgcggugcuaacauacaauggcaagcgucuugagcccaauugggccuccguaaagaaggauuuaaucucuuacggcgggggcuggcgccucucagcccaguggcagaagggggaggaagugcaggucaucgccguggagccaggcaagaaccccaaaaacuuccagacaaugcccggaaccuuucagacgaccaccggggaaauuggugcgaucgcacuagacuucaaaccaggcacaucaggauccccaaucaucaaccgcgaaggcaagguuguuggucuguacgggaacggaguggugaccaagaacgguggguacguaucgggcaucgcccaaaccaaugcugagccggacgguccaaccccugaguuggaggaggagauguuuaagaaacggaaccucaccaucauggaccugcaucccgggagcggaaagacgcgcaaguaccuacccgcgaucgugcgggaagcaauuaagcgccgacuccgcacccucaucuuggccccaacgcguguggucgcugccgagauggaggaggcgcucaaggggcugccaauccgauaccaaaccacugcuaccaaguccgagcacacgggccgggagaucguggaccugaugugccacgccacguucacgaugcgccuucucaguccugugcgugucccgaacuauaaccugaucaucauggacgaggcccacuucaccgacccugccucuaucgccgcccguggcuacauuagcacccgggugggcaugggcgaagccgccgccauauucaugacugcgacaccgcccgggaccgcagacgccuucccgcaauccaacgccccaauccaggacgaggaacgcgacauccccgagcgcagcuggaacucuggcaacgaguggauuaccgacuucgcaggcaagaccguuugguuugucccgaguaucaaagcagggaacgacaucgcgaacugccuccggaagaaugggaagaaaguaauccagcuguccagaaagacguucgacaccgaguaccagaagacuaaguugaacgacugggauuucguggucaccaccgacaucagcgagaugggcgccaacuucaaggccgaucgggugaucgacccaagaaggugccucaagcccgugauccuaaccgauggcccugagcgcgucauacuggccggacccaugccggucaccgcggcgagugcggcccagcggcgcggccggguagggcgcaacccccaaaaggaaaacgaucaguacaucuuuaccggccagccgcucaacaacgacgaggaccaugcccacuggacugaagcgaaaaugcuccuugacaauauuaauacaccggagggaauaauuccggcccuuuucgagcccgagcgggaaaagucugcggccaucgauggagaguaccgccucaagggcgagucccggaagacguucguagagcugaugcgacgcggggaccuccccguguggcuggcgcacaaaguggccagcgagggcauuaaguacaccgaucguaaguggugcuuugacggucagcggaacaaccagauccucgaggagaacauggacguggagauuuggaccaaagagggugagaaaaagaagcucaggccccgguggcucgacgcccgaacguauuccgacccgcuggcccuaaaggaguucaaagaguuugccgcgggacgcaaaagcaucgcccuagaccuagugaccgaaauagggcggguccccucccaccuugcccaucgcacacggaacgcccuggauaaccuagucaugcugcacacaagcgagcacgggggccgcgcguaccggcaugcgguggaagaacuaccggagacgauggagacacuauugcugcugggacucaugauucugcugacaggaggcgccaugcuguuccugaucaguggaaaggggauagggaaaacgucuaucggccugaucugcguuauugcauccucuggcaugcucuggauggccgagaucccgcugcaguggaucgcaagcgcgauaguuuuagaguuuuucaugaugguacuccugaucccugagcccgaaaaacagcgaacuccccaggacaaccagcuggcauaugucgugauugggaucuugacccuggccgccauaauugcagccaacgagauggggcuacucgagaccaccaagcgggacuuagggaugaguaaggagccggggguagugagccccaccucauaccuggacguggaccuccaccccgccucagccuggaccuuguacgcaguggcuaccaccgucaucacacccaugcuucgacauaccaucgaaaauuccacggccaaugugucacucgccgccaucgccaaccaggcggugguacugaugggccuggacaagggguggccuauauccaaaauggaccuuggcgugccccuccuggcgcuuggguguuacucacaaguaaacccccuuacccugaccgccgccguccuccuccugaucacccacuaugccaucauaggccccgggcuccaagcaaaggcgacccgggaagcccagaagcggacggcggccgggauaaugaagaacccgacgguggacggcaucaugaccaucgaucuagacccgguuauuuacgacucuaaguucgagaagcagcuagggcaggucauguuacucgugcugugcgcuguucagcuccugcugaugcggaccagcugggcgcucugcgaggcccugacccuggccacgggccccaucacaacucucugggagggcucccccgggaaguucuggaauaccaccaucgcggucucgauggccaacaucuucagaggauccuaccuggccggggccggccuagccuucagcaucaugaagucuguagggaccggcaaaagagguaccggaucccaaggcgagaccuugggggagaaguggaaaaagaagcucaaccagcugucccgcaaggauuucgaccucuacaagaaguccggcauaaccgaaguggaccggaccgaggcaaaggaaggguuaaagcgaggcgaaaucacccaucacgcuguaagccguggcucagccaaacuucagugguucguagaaagaaauauggugauaccggaggggcgcgucaucgacuuggguugcggccgcggcgguuggagcuacuacugcgccggccucaaaaagguuacagaggugcggggcuauaccaaaggcgguccugggcaugaggagcccguccccaugagcacguacggcuggaauaucgugaagcugaugucugggaaggacgucuuuuaucuaccuccggagaaaugcgacacacuccugugcgacauuggggaguccucccccucaccgacagucgaggagagucgcacaauccgcgugcucaaaauggucgagccguggcucaagaacaaccaguucugcaucaagguguuaaaccccuacaugcccacggugaucgaacacuuggagcggcuccagcgcaagcauggcgguauguugguaaggaacccccuuuccaggaauagcacacacgaaauguacuggaucuccaacgggaccgggaauaucgucgcgagcguaaacauggugucccgccucuuacugaaccgcuuuaccaugacgcaucggaggccgaccaucgagaaggacgucgaucuuggcgcgggcaccagacacgucaacgcagagcccgagacccccaacauggacgugauuggagaacgcauaaaacggaucaaggaggaacacaacucaacguggcacuaugaugacgagaacccuuauaagaccugggccuaccacggguccuaugaggucaaggccaccgguagcgcauccucgaugaucaacggggucguaaaacuguuaaccaagcccugggacguugugcccauggucacgcagauggcuaugaccgacacgacccccuuugggcagcagcguguauucaaggaaaagguggacacgcggaccccgagaucaaugccagggacccggcgcgucaugggcauaaccgccgaguggcucuggcguacgcucgggaggaacaagaagccgcggcuauguacacgcgaggaguucaccaagaagguaagaaccaacgccgcaaugggcgccguuuuuacugaggaaaaccagugggacuccgccaaggccgcaguugaggacgaggacuucuggaagcucguagaccgggagcgcgagcugcauaagcugggaaaguguggaaguugugucuauaacaugaugggaaagcgggagaagaagcucggcgaguucggcaaggccaagggcagccgcgcgaucugguauauguggcuuggcgcccgguaccuggaguucgaggcccuuggcuuccugaacgaggaccacugguuuagccgcgaaaacagcuauagcgggguugagggggagggccugcacaaacucggcuacaucuuacgggacaucagcaagaucccagggggagccauguaugccgacgacacggccggcugggacacuaggaucaccgaggacgaccugcauaacgaggagaagaucacccagcagauggacccggaacaucgacagcucgcaaacgccaucuucaagcugacuuaccaaaacaaaguagugaaaguccaacgccccacgccaacagguacggugauggacauaaucucccguaaagaccagcgaggcucuggccagguaggcacuuauggcuuaaacaccuucaccaacauggaggcccaacuuauccggcagauggagggcgagggagugcugagcaaggccgaucuggaaaauccccaccuaccggagaaaaagauaacccaguggcuggagacgaagggcguggagcgccugaaaaggauggcgaucuccggagaugacugcguggucaagcccaucgacgaccgcuuugccaaugcccuucuggcccugaacgacauggggaaggugcgaaaggacauuccgcaguggcagcccucgaagggcuggcaugacuggcaacaagucccuuucugcucccaccacuuccacgaacucauaaugaaagacgggcgcaagcugguggugccgugccgcccccaggaugagcugaucggcagggcacggauuagccagggggcgggguggucgcuuaaggagacggccugccugggcaaggcuuaugcccagauguggagccuuauguauuuccaccgccgcgaucuccgguuggcgucuaacgccaucuguuccgccguucccguccacuggguuccgaccucccgcacuacguggaguauccacgcccaccaccaguggaugacaaccgaggauaugcugaccguuuggaaccgaguauggauagaggacaaucccuggauggaggacaaaacgcccguuacgacuugggagaacguacccuaccucgggaagcgcgaagaccaauggugcggcucucugaucgggcugacuucccgggcaacgugggcacaaaacaucccgaccgccauccagcagguccggagccucaucggcaacgaggaguuccuagacuauaugccguccaugaagcgguuccgcaaggaggaagaaagcgagggggccaucugguag

SEQ ID NO: 25833 - RNA, 9873 nt, Artificial Sequence
  derived and/or modified CDS sequence (opt11) from DENV-3__HM756279__SS-prME
acaucccucugccucaugaugauccugcccgccgcccuggcguuccaccucaccagccgggacggggagccacgcaugaucguuggaaagaacgagagggggaaaucacuacuguucaagacugccucugggaucaacaugugcacccucauugcgauggaucugggcgagaugugcgaugacacuguuacauacaaauguccccacaucacugaaguggagccugaggacauugacugcugguguaaccugaccucaaccuggguaacauacgggaccugcaaccaagcgggugagcauaggcgcgauaagagaagcguggccuuagcgccccaugugggcauggguuuggacacacgcacccaaaccuggaugagcgccgagggagccuggcgccaggucgagaaaguggagacaugggcacugcgacacccgggguucaccauacuggcgcuguuccuggcccacuacauaggcaccaguuugacccagaagguggugauuuucauccugcugaugcucguuacgcccagcaugaccaugcggugcgucggcgugggcaaccgggacuucgucgagggccuauccggggccacauggguagacgugguacuggaacacggugggugcgucacaacaauggccaagaauaagcccaccuuagacaucgaacuucaaaaaacggaggccacacagcuggcgacgcugcggaagcugugcaucgaagggaaaauuacaaacaucaccacagacagccgaugucccacacagggcgaggcuacccugccggaggagcaggaucagaauuacguguguaagcacaccuacgucgaucgggguuggggcaacggaugcggccucuucgggaaggggucacuugugaccugugccaaguuucaaugccuagagccuaucgagggcaaggucguccaguacgagaaccuaaaguacacggugaucaucaccguacacacaggagaccagcaccaggucgggaacgaaacgcagggaguaacggccgagaucaccccccaagccagcacgaccgaggccauacuucccgaguacgguacccugggguuggagugcaguccgcguaccggccuggacuucaacgagaugauccuguuaaccaugaagaauaaggccuggaugguucacagacagugguucuucgaccugcccuugcccuggaccucgggugccaccacggagacgcccaccuggaaccgcaaggaacuccuagugaccuucaagaacgcccacgccaaaaagcaggaggugguuguucugggcucccaagaaggggcgaugcacacggcccugaccggugccacggagauccagaacagcggcggcaccuccaucuucgccggucaccugaagugccggcugaagauggacaaacucgagcugaaaggcaugucuuacgccaugugcacgaacaccuucguauugaagaaggaggucuccgagacucagcacgggaccauucucaucaagguggaguacaagggcgaggacguacccugcaagaucccguucagcacggaggacgggcagggcaaggcgcacaacggacgucugaucaccgcgaaccccgucgugaccaagaaggaggaacccgucaauauagaggcggaaccucccuucggggagaguaacacggucaucggcaucggagacaacgcacugaagaucaacugguauaagaagggauccucuaucgggaagauguucgaagcgaccgcccggggcgcccgccguauggcgauacugggcgacacugccugggacuucggguccgugggcggggugcucaacucgcuggggaagaugguacaccaaaucuucggauccgcguauaccgcgcuguucagcggugucucuugggugaugaaaaucgguauaggaguccuccugaccuggauuggccucaacagcaagaacacgucuaugagcuuuagcugcaucgccauugggaucauuacccuauaccugggcgccguggugcaggcugauaugggcugcgugaucaauuggaaggggaaggagcuaaagugcggcagcgggaucuuugugacgaacgaaguucacaccuggacugaacaguacaaauuccaagcggacucccccaagcgccucgcgacugcgauugccggugcuugggagaacggggucugcgguauccgcagcaccacccggauggaaaaccuguuauggaagcagaucgcuaacgagcucaacuacauccugugggagaauaacauaaagcugacggugguugucggggacaucaucggcgugcucgagcagggaaagcgcacacugacaccacaaccgauggaacuaaaguacucuuggaagacaugggggaaggcuaaaaucgugacggcagagacacaaaacagcuccuuuauuaucgacggccccaauaccccagagugccccagcgugucccgggccuggaacguuugggaggucgaggacuacggcuucggcguuuucaccacaaacauauggcucaaguugcgcgagguguacacgcagcugugcgaucaccggcuaauguccgcggcggugaaagacgaaagggccguccacgccgacaugggcuacuggaucgagagucaaaaaaaugggagcuggaagcuggaaaaagcaagccugauugaggugaagaccugcaccuggccgaagucgcacacucuauggagcaacggcgugcuggagucagauaugaucauacccaagucacuggcggguccgaucucccagcauaaccaccggcccggcuaccacacgcaaaccgccgggcccuggcaccucggcaagcuggagcuggacuucaauuauugcgaaggcaccacagucguaauaacggagaacugcgggacgcgcggccccagccuaaggacgacuacgguguccgggaagcugauccaugaguggugcugccgcagcugcacccugcccccgcugcguuacaugggcgaggaugguugcugguauggcauggagauacgacccaucucagagaaggaggagaacauggucaaaagccugguguccgccggcagcgggaagguagauaacuuuaccaugggcguccugugccucgccauccucuucgaagaggugaugcgggggaaguucggcaagaagcacaugaucgcugguguuuuuuuuacuuucguccugcugcugucugggcagaucacguggcgggacauggcgcacacguugaucaugauugguucaaacgccuccgaccggauggguaugggcguuaccuaucucgcccuaaucgccaccuucaaaauccagccauuccuggcgcucggguucuuccuucgcaagcugacgagccgggagaaccugcugcuuggcgugggucucgcgauggccaccaccuuacagcugcccgaggacauugagcagauggcuaacggcaucgcccugggccugauggcacugaagcucaucacccaauuugagacuuaccaacuguggaccgcacugauaagccugacuugcagcaacacgaucuucacguuaaccgucgcuuggcguaccgccacgcugauccucgcaggggugagucuucuuccgguuugccaaaguagcucgaugcggaagacagauuggcuacccauggccguggcugccaugggagugccgccucugccgcuguucaucuucgggcucaaggacacccugaagcgccgcaguuggccccugaacgaaggcgucauggcugucggccucgucuccauccuggcaagcucccugcuccggaaugacgucccgauggccgggccucuaguggccggggggcugcucauagcuugcuaugugaucaccggcacgucagccgaccuuacggucgagaaagccgcggacaucaccugggaggaggaggccgaacagaccggggugagccacaaccugaugaucacgguggacgacgacggcaccaugcgcaucaaagacgaugagacugaaaacauccucaccguccugcugaagacugcguugcugaucgugucagggaucuucccauacuccauccccgcuacccugcucguguggcauaccuggcagaagcagacucagcggucgggaguacugugggacguccccagcccacccgagacacaaaaggccgagcuugaggaggguguguaccgaauaaagcagcaggggaacuucugggagacucaggucggcgucggcgugcagaaggaaggcguauuccacacgauguggcacgugacgcggggcgcggugcucacauacaacgggaagcgccuggagcccaacugggccucggucaagaaggaccugaucuccuacggcgggggauggcggcucagcgcccaauggcaaaagggggaggagguccaggugauugccguugagcccggcaagaacccuaaaaauuuccagacuaugccugggacguuucaaaccaccaccggugagaucggugcgaucgcccuugauuuuaagcccgggacguccggcagccccaucaucaaccgcgagggcaagguuguagggcuauaugggaacgguguggugaccaaaaacgggggauacgugucggggaucgcccagaccaacgccgaaccggacggccccacccccgagcuggaagaggaaauguucaagaagcggaaccucacgaucauggaccugcaccccggguccggcaaaacucgcaaguaccugccggcuauaguucgcgaagcgaucaagcgccggcuccgcacccugauccuggcccccacucgggugguugccgccgaaauggaggaagcccucaaaggguuacccauccgcuaucagaccaccgcgaccaagagcgagcacacaggccgcgaaaucgucgacuuaaugugccacgccacguucaccaugcgccucuuguccccagugcgggugccgaacuauaaccucauuaucauggaugaggcccacuucaccgaccccgccagcaucgcggcgcggggguacaucuccacccgcgucggcaugggcgaagccgcagcgaucuucaugacugcgacgccgccugggaccgccgacgccuuuccgcagagcaacgcccccauccaagacgaggaacgcgacauccccgagcgcaguuggaacucagguaacgaguggaucaccgacuucgcugguaagacggucugguucgugcccuccauaaaagcuggcaaugacaucgccaacugccuccggaaaaacgguaagaaagucauccagcugagucgcaagaccuucgacaccgaguaccagaaaacaaagcugaacgacugggacuucgugguaacuaccgacauauccgagaugggugcaaacuucaaggcagaccggguuaucgacccgcgccggugccucaaaccugugauccugacugacgguccugagcgcgugauccuggcgggccccaugccggucacggcggccucugccgcucagaggcguggcagggucgggaggaacccccaaaaggaaaacgaccaguauaucuucaccggccagccccucaacaacgaugaggaucacgcccacuggacugaggcuaaaaugcugcuggacaacaucaauacccccgaggggaucauaccggcccucuucgaacccgagcgggaaaagagugcggccauagacggagaguaccgccugaaaggcgagucucggaagaccuucguugagcugaugcgacgcggggacuuaaccgucuggcuggcgcacaagguggccuccgagggcaucaaauacacggaccgaaaguggugcuucgacgggcagcggaacaaccagaucuuagaagagaacauggaugucgagaucuggaccaaggagggcgagaagaagaagcuccgccccagauggcuggacgcccgcaccuacagcgacccccuggcucucaaggaguucaaggaguuugcggccggccgcaagucgauugccuuagaccuugugaccgagaucgggcggguuccgagccacuuagcccacaggacacggaacgcccuggacaaccuggucaugcuccauaccagcgaacauggcgggcgggcauaccgacaugcgguggaggaacugcccgagaccauggaaaccuuacuccugcuggggcucaugauccucuugaccggcggggccaugcuauuucuaaucagcgggaaggguaucggaaaaaccaguauugggcugaucugcguaaucgccagcagcgguaugcucuggauggccgaaaucccacugcaguggaucgcauccgcgauaguucuggaguucuucaugauggugcugcugaucccggagcccgagaagcagcgcacgccccaggacaaucaauuagccuacguagucaucgggauccuaacacuggccgcuaucauugccgcgaaugagaugggacugcuugagacuaccaagcgugaccugggcaugucaaaggaacccgggguggugucccccaccagcuaccuggacgucgaccuccaccccgccuccgccuggacccuauacgcaguggcgacgacuguaaucaccccaaugcucagacacacgaucgagaauagcacggccaacguaucccucgccgccaucgcgaaccaggcgguggugcuaaugggccucgacaagggguggcccaucagcaaaauggaucucggggucccgcuguuagcccuuggguguuacucccagguaaacccccugacccugacagcugccgugcuccugcucauaacccauuacgcuaucaucgggccaggccuacaggcgaaggcgacgcgugaggcccaaaagcggacagcugccgggauaaugaaaaacccuaccgucgacggcaucaugaccaucgaccuggacccggugauauaugacagcaaguucgagaagcagcugggccagguuaugcuuuuagucuuaugugcgguacaacuacuucugaugcgaacguccugggcccugugcgaggcccugacccucgccaccggccccaucaccacgcucugggagggaucgcccgguaaauucuggaacacgaccaucgcggucucgauggcaaauauauuccguggcagcuaccuggcuggugccggcuuggccuucucaaucaugaagucgguaggcaccgguaaacgggggaccggcucccaaggcgagacgcucggggagaaauggaagaaaaagcugaaccaguugucccgcaaagacuucgaccucuacaaaaagagcgggauaaccgagguggaccgcaccgaagcgaaggaagggcugaagcgcggcgagaucacccaccacgccgugucccgggguagcgccaaauugcagugguucguagagcguaacauggugaucccugaggggcgagugauagaccucggcugcgggcggggcggguggucguacuacugcgcuggcuugaagaaggucacggaaguaaggggguauaccaagggcgggccggggcacgaggaacccguacccaugucgacguacggcuggaacauagucaaguugauguccggcaaggacguguucuaccucccgcccgagaagugcgauacgcuacugugcgacauaggagagaguagcccgagcccgacgguggaggaaagcaggacgauucgcguuuuaaagaugguggagcccuggcucaagaacaaccaguucugcaucaaagugcugaauccguacaugcccaccgucaucgagcaccuggagcggcuacaaagaaagcacggcgggaugcuggugcggaacccucugucucggaacaguacccacgagauguauuggaucagcaacggcaccgggaacaucgucgccaguguuaacauggucuccagguuacugcucaaucgguucacaaugacgcaucggcgccccacaauagagaaggauguggaccucggcgcgggcacgcggcacgucaacgccgagccagagacccccaacauggacgugaucggagagagaaucaagcggauuaaggaggagcauaacuccaccuggcauuaugacgaugaaaaccccuacaagacgugggcguaccacgguagcuacgagguuaaagcgacgggauccgccagcuccaugaucaauggugucgugaaauuguuaacgaagccgugggacgucgugcccauggugacccagauggcgaugaccgacacgacccccuucggccagcagcggguauuuaaggagaagguggacacccggacgccucggagcaugccuggcacgcggcgcgugaugggcaucacagccgagugguuguggcggaccuuggggcgcaacaaaaagccccgcuuaugcacccgcgaagaguuuacgaagaaggugcgcaccaacgccgccaugggcgcggucuucaccgaagagaaccagugggacuccgcgaaggccgccguggaagacgaggacuucuggaagcucguagacagggaacgagagcugcauaagcuggggaaauguggcucaugcguuuacaacaugauggggaaacgggagaagaaacucggagaguucggcaaggcaaaggggagucgagcgaucugguacauguggcugggcgcccguuaccuugaguuugaggcccucggguuccugaaugaagaccacugguucucccgugagaacagcuacucaggcguggagggggagggcuugcacaagcucggguacauccugcgggacauaagcaagaucccagggggcgccauguacgcugacgacacugcggggugggacacacgaauuacugaggacgaccuccauaacgaagagaagauuacccagcagauggaccccgagcaccggcagcucgccaacgcgauuuuuaaacugacauaccagaacaagguuguaaaaguucagagaccgacccccacaggcaccgucauggacaucaucucccggaaggaccagcgcggcagcggccagguggguaccuacgggcuaaauaccuuuacaaauauggaggcccagcuuauccggcaaauggagggcgagggggugcuguccaaggccgaccuggaaaacccgcaccuccccgaaaaaaagaucacccaguggcuggagaccaagggugucgagcgcuugaagagaauggcgaucagcggcgacgacugcguaguuaagccgaucgacgaucgcuucgcaaacgcucuccuggcguuaaacgauauggggaaagucagaaaggacaucccucaguggcagccuuccaaaggcuggcaugacuggcagcaaguccccuuuuguucgcaccacuuccacgagcucauaaugaaggacgggcgcaagcugguugucccgugccggccgcaggaugagcuuaucggccgcgcccggaucucccaaggcgcaggguggagcuugaaggagaccgccugcuugggcaaggccuacgcucagauguggucccugauguacuuucacagacgcgaucugcggcuggcgagcaacgcaaucugcuccgccgugccggugcacuggguacccacgucucgcaccacuuggaguauccacgcccaccaucaguggaugaccacugaggacauguuaaccguauggaaccgcguguggaucgaagacaacccguggauggaggauaagacccccgucaccaccugggagaacgugcccuaccuggggaagcgagaggaccaguggugcggcagucugaucgggcucaccagucgggcgaccugggcgcagaacauucccacggccauucagcagguccgcagcuugaucggcaacgaggaauucuuagacuacaugccuagcaugaaacgguuccgcaaggaagaggaaucugagggggccauuugguga

SEQ ID NO: 25834 - RNA, 9873 nt, Artificial Sequence
  derived and/or modified CDS sequence (opt11) from DENV-3__HQ891025__SS-prME
accagccuuugccucaugaugauccugcccgccgcccuggcguuccaccucacgagccgcgacggcgaaccccggaugauaguggguaagaaugagcgcggcaaaagccuguuauucaaaaccgccuccgggauaaauaugugcacucuuaucgccauggaucugggcgagaugugcgacgauacagugacuuacaaaugcccccacaucaccgagguggagcccgaggacaucgacugcuggugcaauuuaacaagcaccugggugaccuacgggacgugcaaccaagccggcgagcaccgcagggacaagcggucuguggcccucgcaccccacgugggcauggggcuggauacacgcacgcagaccuggaugagcgccgagggcgccuggagacagguggaaaaggucgagacaugggcccugcgccacccgggguucacuauuuuggcgcuuuuccuugcccauuauaucggcaccuccuugacucagaagguuguaaucuucauccugcugaugcucgucacucccucgaugaccaugcggugcgugggggugggcaaucgggacuucgucgaggggcuguccggggcaaccuggguggauguugugcuggagcauggugggugcgucaccacgauggcgaagaauaagcccacccucgacaucgagcugcagaagaccgaggcuacccagcuagccacgcuccggaaacugugcaucgaagggaagaucaccaacaucaccaccgacucacgcugcccaacgcagggcgaggccacccugccggaggagcaggaucagaacuacgucugcaagcacaccuacgucgaucgggggugggggaacggguguggcuuauuuggaaagggcuccuugguaacaugcgccaaguuccagugucuggagcccaucgagggcaagguuguccaguaugagaaccucaaguacacggucaucaucaccgugcauaccggggaccagcaucaggucgggaaugagacccagggaguuacggccgaaaucacaccccaggccagcacaacugaggcaauccugcccgaguacggcacguuagggcuggaaugcuccccgcguacgggcuuagacuucaaugagaugauacugcucaccaugaagaacaaggccuggaugguccaccgacagugguucuucgacuuaccccugcccuggaccagcggcgcuacgacugaaaccccaaccuggaaccgcaaggagcuccuggugaccuucaagaacgcccacgccaagaaacaggagguggucguacuggggucccaggaaggcgcgaugcacacggcccucaccggggccacggagauucaaaauagcggcgggacguccaucuuugcuggccaccugaaaugccggcugaagauggacaaguuggagcugaagggaaugagcuacgccaugugcacgaauaccuucguucuuaagaaagaagucucagagacccagcaugggacuauccucaucaaaguggaguacaagggcgaggacgugccgugcaagauccccuucagcacggaggacggacaaggcaaggcgcacaacgggcgccugauaacagccaaccccgucgugaccaagaaggaggagcccgugaauauagaggccgagccgccguucggggagagcaacauuguaaucggcaucggggacaacgcacugaagaucaacugguacaagaagggcuccaguaucggaaagauguuugaggcaaccgccagaggggcccgccggauggccauccugggggacacggccugggacuucgggagcgugggcggggugcucaauagcuuaggcaaaaugguccaccaaaucuucgggucggcguacacggcccuuuuuagcggaguuucauggguuaugaagaucggcauaggaguccuccuuaccuggaucggucucaacagcaagaacaccagcaugucauucuccuguaucgcaaucgggaucaucacccucuaucugggugccguggugcaggcagauauggggugcguuaucaauuggaagggcaaggaacugaagugcggcagcgggaucuucgucacgaaugaaguucacaccuggaccgaacaguacaaguuccaggcggacucccccaagcggcuagccacggccaucgccggugccugggaaaacgggguguguggcauccgcagcacgacccggauggagaaccugcuguggaagcagaucgcgaacgagcucaacuauauacugugggagaacaacaucaaacugacagugguugucggagacauuaucggcguacucgagcaggguaagcgcacgcuuacgccccaaccgauggagcugaaguacagcuggaagaccugggggaaggccaagaucgugacggccgaaacgcagaacagcuccuucaucaucgauggcccgaacacccccgagugccccaguguuucgcgagcguggaacgugugggagguggaagacuacggauucggcgucuucaccaccaacaucuggcucaagcugcgcgagguguacacccaguugugcgaccaccggcucaugagcgcggccgugaaggacgaacgggcgguacacgccgauaugggcuauuggaucgagagccagaagaacggguccuggaagcuggagaaggccagccugauugaggugaaaacgugcacauggccgaaaucccacacucucuggaguaacggugugcuagagucggacaugaucauccccaaaucacuggccggaccaaucucccagcacaaccaucguccgggcuaccacacccagacggcuggacccuggcaccuuggcaaacuggagcucgacuucaacuacugcgagggcaccaccgucgugauaacggagaacugcgggacgaggggccccagccuucggaccaccacuguauccggcaagcugauccacgaauggugcugccgcagcuguacguuacccccgcuccgguacaugggagaagacgggugcugguacgguauggagauccgccccaucuccgagaaggaggagaauauggucaagagccuggugucugccggcagcgggaaggucgacaacuucaccaugggcguccugugccuggcaaucuuguucgaggaagugaugcgggggaaguucggcaagaagcacaugaucgccggaguguucuucacauuuguccugcuccuaucuggucaaaucaccuggcgggacauggcucacacacugaucaugaucggcagcaacgccagugaccggaugggcaugggcguuaccuacuuagcacugaucgccaccuucaagauccagcccuuccuggccuuaggcuucuuccugcgcaagcugaccagccgggagaaccuucugcugggcgugggacucgcuauggccacgacccugcagcuccccgaggacaucgagcaaauggccaacgggaucgcccuaggucugauggcgcugaaguuaauaacccaauucgagaccuaccagcuguggacggcccugaucagccugacuuguuccaacaccaucuucacgcucacggucgcguggcgcaccgcaacccugauucucgccggggugucacuguuaccugucugccaguccagcuccaugcggaagaccgauugguugcccauggcgguggccgcaauggguguaccaccccuaccgcuguucaucuucggccucaaagacacccugaagcgccgcucuuggccgcugaacgaaggcgucauggccgugggccucguguccaucuuggcuagcucacugcuucggaacgacguccccauggcgggcccccugguagccggagggcugcuaauugccugcuacguaaucaccggcaccagcgccgaccugaccgucgagaaagccgcugacaucaccugggaggaagaggccgagcagacaggugugucucacaaccugaugaucaccguggacgacgauggcacaaugcgaaucaaggaugacgagacagagaacauccuaacgguacuguugaaaacagcccuccugaucguuucuggcaucuuccccuacuccauucccgccacccuacucguguggcacacuuggcagaagcagacgcagcggagugggguccuaugggaugugcccagcccgcccgagacccagaaagccgagcuggaggagggcguguaccgcaucaaacagcaggggaucuucggcaagacccaggucgggguuggugugcaaaaggaggggguguuccauaccauguggcacguaacucgaggggcgguucucaccuacaacggaaagcgccuggagccaaacugggccuccgucaagaaggaucugauuuccuacgggggcggcuggcggcucagcgcgcaguggcagaaaggcgaggagguccaagucauagccgucgaacccggcaagaaccccaagaauuuccaaacuaugccugggaccuuccagacgaccacgggcgaaaucggcgcgaucgcccuggacuucaagcccggcacauccggcucccccaucaucaacagggaggggaaggucgugggccuguauggcaacggggucgucacgaagaacggaggguacgugagcggcaucgcccagaccaacgcagagccggacgggccuacccccgagcuagaggaggaaauguucaagaagcggaacuuaaccaucauggaucugcaucccggcuccgguaaaacgcgcaaguaucugccggcgaucguacgggaagcgaucaagcgccgucuccgcacccugaucuuggcccccacucgggugguggccgccgagauggaggaggcccuuaaaggccucccaauccgcuaccagaccacggcgaccaaaagcgagcacaccgggcgggagaucguagaccugaugugccaugccacauucacaaugcgccuccuuucccccguacgggugccaaacuauaacuugauuaucauggaugaagcacacuucaccgaccccgcguccaucgcugcgcgcggcuacaucuccacuagagugggcaugggggaggcugccgcaauuuucaugaccgcgacgccgcccgggaccgccgacgccuucccgcaguccaaugccccuauccaggacgaggagagggauaucccggagcgcuccuggaacuccgguaacgaguggaucaccgacuucgccggcaagaccgucugguucgugcccuccaucaaggcggggaacgacaucgccaauugccuccgcaagaacggcaagaaagucauucagcugagccgcaaaacguucgauacugaguaccagaagacaaaacugaaugacugggauuucguggugaccacugacaucuccgagaugggcgccaacuucaaggcagaccgugucaucgacccccgccggugcuugaagccugucauccugaccgacgggcccgagcgcgugauucucgccggcccgaugccggugaccgccgcguccgccgcccaacgccgcggccggguggggcgcaacccccagaaagagaacgaucaguacaucuucaccgggcagccgcucaacaacgacgaagaccacgcccacuggacagaggcaaagaugcugcuggacaacauaaauacgccagaagggaucauuccggcccucuuugagccagagagggaaaaaucugccgccaucgacggcgaguaccgacugaagggggaaagccgcaagacauucguggaacugaugcgccggggcgaccucccgguguggcuggcgcacaagguggcgucagaggggaucaaguauaccgaccgcaaguggugcuucgacggccagcgcaacaaccagauccuggaggagaacauggauguagaaauuuggaccaaggagggugagaagaagaaauugcgcccccgauggcuggacgcccgcacguacucugacccgcuggcucuaaaggaguucaaggaguucgcagcgggucgcaaaucaauugcccuugacuuggugaccgaaauuggccgagugcccagccaccucgcucaucgcaccaggaacgcacuggacaaucuggugaugcuccauacguccgagcauggcggccgggcguaccggcacgcuguggaggagcugcccgagacuauggagacccuguuguugcuggggcucaugauccugcugacaggcggcgccaugcuguuccugaucagcgggaaagguauugggaagaccagcauuggccugaucugcgugauagccuccagcgggauguuauggauggcggaaaucccgcugcaguggaucgccuccgcuauaguccuggaguucuuuaugaugguucucuuaaucccagagcccgagaagcagcgcacgccccaggacaaccagcuagcguacguggucaucgguauccucacccuggcagcaaucaucgccgccaacgagaugggccugcucgaaaccacaaagcgggaccuggggaugagcaaggagccgggugucguaucccccacgagcuaccuggauguggaccuccauccagccucggccuggaccuuauacgcaguggcgaccaccguuaucacaccuaugcuccgccacaccauugagaacagcaccgcgaacgucucacucgccgccaucgccaaccaggcgguggugcugauggggcuggacaagggguggcccauuagcaagauggaccucgggguaccccugcuggcccucggcugcuauucucaggugaacccccuuacccugacagcggccgugcugcuacuaauaacccacuacgccaucaucggccccgggcuccaggcaaaggcgacccgggaggcccaaaagaggaccgccgccggcauaaugaagaacccgacgguagacgggaucaugaccaucgaccuggaccccgugaucuacgauucaaaguucgagaaacagcugggccaggugauguuauugguccuaugcgcggugcagcuucugcugaugaggacuuccugggcccucugcgaggcacuaacacuggccacuggccccaucacaacacucugggaggggaguccaggaaaguuuuggaacaccaccaucgcgguguccauggccaauaucuuccgcggguccuaccuggccggcgccgggcuggccuucucuaucaugaagucggucggcaccggcaagcgggggaccggcucccagggggagaccuugggugagaaguggaaaaagaagcuaaaccagcugagucgcaaggacuucgacuuauacaaaaaguccgggaucaccgagguggaccggacggaggcgaaggaggggcuuaagcguggcgagaucacccaccacgccgugucccgggggagcgccaagcugcagugguuugucgagcgcaacauggugaucccagaggggcgggugaucgaucuugggugcggacgcggcggguggucuuacuacugcgccggccugaaaaaggucacagaggugcggggguacaccaagggcgggcccggccacgaggagcccgugcccaugagcacguacggguggaacaucgucaagcugauguccggcaaggauguguuuuaccucccgccugagaaaugcgacaccuuacugugcgacauuggggagagcucucccagccccacgguggaggagucccgaacuauacgcgucuugaagaugguggaaccgugguugaaaaacaaccaguucugcauaaaggugcugaaccccuacaugcccacgguaauagagcaccuggagcgucuccagcgcaagcacgguggcauguuggugcggaacccccuaagccgcaacuccacccacgagauguacuggaucagcaacggcacgggcaacaucgucgccuccgucaacauggugagccggcucuuacugaaccgcuucaccaugacgcaccggcgcccgaccaucgaaaaggaugucgacuuaggcgcggggacccgacacgucaacgccgagcccgagacacccaauauggauguuaucggcgagcgcauaaagcggaucaaagaggagcauaacuccacguggcacuacgacgacgagaacccguacaagaccugggccuaccaugggagcuacgaggugaaggcuaccggauccgcuagcuccaugaucaauggggucgucaaacuacugacuaaacccugggacgucgucccuauggugacgcagauggcgaugacagacacuacacccuuuggucagcaacgcgucuucaaagagaaaguugauacccggaccccgcggagcaugcccggcacccggcgcgugauggggaucacggccgaguggcucuggcggacucugggucggaacaagaagccucgucucugcacgcgcgaggaguucaccaagaagguccgcacgaaugccgcaaugggggcgguguucacugaggaaaaccagugggauuccgccaaggccgcggucgaggaugaggacuucuggaagcuagucgaucgggagcgcgagcuucauaaacugggcaagugcggauccugcguauacaacaugauggggaagcgagagaaaaagcucggagaguucggaaaggccaaaggcagccgugcuaucugguacauguggcugggagccagauaucucgaguucgaggcccucggcuuucugaacgaggaccacugguucucccgcgagaacucuuauaguggggucgagggcgaggggcugcacaagcucggguacauccuucgggacauuagcaagaucccggguggagccauguacgccgacgacacggcgggcugggacacccgcaucaccgaggaugaccugcauaacgaggagaaaaucacgcagcagauggacccugagcaccggcagcuugccaaugccauauuuaagcugacguaccagaacaaggucgugaaggugcagaggcccacacccaccgggaccgucauggacauaaucucgagaaaggaccagagggggucaggccaggugggaacuuacggcuugaacaccuucaccaacauggaggcgcaacucaucaggcagauggagggggagggcgugcuguccaaagccgaccuggagaacccccaccuccccgagaagaagaucacucagugguuggagacgaaaggcgucgagcgcuugaagcggauggcgaucagcggagacgacugcguggugaagcccaucgaugaccgcuucgcgaacgcccuccuugccuugaacgacaugggcaagguccggaaggauaucccccaguggcagcccuccaagggguggcacgacuggcagcagguaccguucugcagccaccauuuccacgagcucauuaugaaggacggccgcaagcugguggucccgugucguccacaggacgagcugauaggacgcgcccggaucucccaaggcgcgggcuggagccucaaggagaccgccugccuggggaaggccuacgcccagauguggagucuaaugaacuuccaucgacgcgacuugcguuuagcgagcaacgccauuugcuccgccgugccgguccacugggucccaaccagccgcaccaccuggucaauccacgcgcaucaccaauggaugaccaccgaggacaugcugacgguguggaaccggguguggauagaggauaaccccuggauggaagacaagacgccuguaaccaccugggagaacgugcccuaccucggcaagcgcgaggaccaguggugcgggagcuugaucggccugacaagccgugccacaugggcgcagaacaucccgaccgcgauacagcagguccggucacucaucgguaacgaggaguuccucgacuacaugccgucuaugaagagauuccgcaaggaagaggaguccgagggggccaucugguga

SEQ ID NO: 25835 - RNA, 9873 nt, Artificial Sequence
  derived and/or modified CDS sequence (opt11) from DENV-3__HQ705617__SS-prME
accagccuaugcuugaugaugauacugcccgccgcccuggcguuucaccucaccagccgggacggcgagccgcggaugaucgugggcaagaacgagaggggcaagagcuugcuuuucaagaccgccagugggaucaacaugugcaccuuaaucgcuauggaccucggcgaaaugugcgacgacaccgugaccuacaagugcccacacauuaccgagguggagcccgaggauaucgacugcuggugcaauuugaccagcacgugggugaccuacgggacgugcaaccaagccggcgagcaccggagggauaagcgguccguggccuuggccccgcacgugggcauggggcuagauaccagaacccagaccuggaugagcgccgagggcgccuggagacagguggagaagguggagacgugggcucugcgccauccgggcuucaccauccucgcgcuguuccuggcccacuacaucggcaccucccucacccagaaaguggugaucuucauccugcugaugcuggucacgccgagcaugaccaugaggugcgugggagugggcaaccgcgacuucguagagggccucuccggggccaccugggucgacguggucuuagaacacggcgggugcgugaccacgauggccaagaacaagcccacccuagacaucgagcugcagaaaaccgaggccacccagcuggcgacgcuccggaagcugugcaucgagggcaagaucaccaacaucaccaccgacagucgcugccccacgcagggcgaggccaccuuaccugaggagcaggaccagaauuacgucugcaagcacaccuacgucgaccgagggugggggaacgggugcggccuuuucggcaagggaagucuggugaccugcgccaaguuccagugcuuggagcccaucgaggguaaggucguacaguacgagaacuugaaguauacggucauuaucaccgugcacacgggggaccagcaccaggucggaaacgaaacgcaggggguaaccgcggagaucacgccccaggccagcaccaccgaggcgauccugcccgaguacggcacccuggggcucgagugcuccccgcggacgggccuggacuucaacgaaaugauucuguuaaccaugaaaaacaaggccuggaugguccaccggcagugguucuucgaccuuccccugcccuggaccagcggugccaccaccgagaccccuaccuggaaccgcaaggagcuccucgugaccuucaagaaugcccacgccaaaaagcaggagguagucguacuggggucccaggagggcgcgaugcacacggcgcuaaccggggccaccgagauccaaaauucuggcgggaccuccaucuucgccggccaccugaagugccgguugaaaauggacaaacucgagcugaagggcaugagcuacgccauguguacgaacacauucguguugaagaaggaggucagcgagacccagcacgggaccauccucauuaagguggaguacaagggcgaggaugugccauguaagauccccuucagcacggaggacgggcagggcaaagcgcacaacggccgccugaucaccgccaacccagucgucaccaagaaggaggagcccgucaauauugaggcggagccgccguucggggagagcaauauugucaucggaaucggggacaaugcccugaaaaucaacugguacaagaagggcuccagcaucgggaagauguucgaggcgaccgcccggggcgcaaggaggauggcuauucugggcgacacagccugggacuuuggcagugucggcgggguacucaauagccugggcaagaugguucaccagaucuucgggucggcuuacaccgcgcucuucagcggcguguccugggugaugaagaucggcaucgggguacuccugacguggaucggcuuaaacucuaagaacacgucgaugagcuucuccugcaucgccaucgguauuaucacccucuaucugggcgcuguggugcaggccgacauggggugcgucaucaacuggaagggaaaagaacugaaguguggcagcgggaucuucgugacgaacgaggugcacaccuggaccgagcaauacaaguuccaggcggacucgcccaagcgucucgccaccgccaucgccggcgccugggagaacggggucuguggcauccggagcacgacccggauggagaaccugcuguggaagcaaaucgcgaacgaacucaacuauauccugugggagaacaacauuaaacugaccgugguggucggugacaucaucggcgugcuggagcagggcaaacgcacgcugacgccccagccgauggagcugaaguacuccuggaagaccugggggaaggccaagaucguaaccgccgagacgcagaacaguuccuucauaauagacggccccaacacccccgagugcccaagcgucucccgggccuggaacgugugggagguagaggacuacggauucggcguuuucacgaccaacaucuggcucaagcugcgagagguauauacccagcugugcgaccaccggcucaugagcgcggcugugaaggacgaacgcgccguucacgcagacaugggguacuggaucgagucgcaaaagaacggguccuggaagcuggagaaggccagccugaucgaggugaagacgugcaccuggccgaagucccacacccucuggagcaauggcguacuggaauccgacaugauaauccccaaaaguuuggcggggcccaucucccagcacaaccaccggccgggcuaccacacccagacggccgggccauggcaccucgggaagcuggagcuggacuucaacuacugcgagggcaccaccgucgugaucaccgagaacugcggcacgcgcggccccagccuacguacgaccacgguguccgggaagcugauccaugaguggugcugccgcagcugcacgcugcccccgcuccgguauaugggagaggaugggugcugguacggcauggagauccgcccuaucuccgagaaggaggagaacauggucaagucguuaguguccgccggcagcggaaagguggacaacuucaccaugggcguccugugccuggccauucuguucgaggaggugaugcgggggaaauucggaaagaagcacaugaucgccgggguguuuuuuaccuuugucuuacuacugucaggccagaucacuuggcgcgacauggcgcacacgcucaucaugaucggcagcaaugccuccgaucggauggggauggguguaacauaccucgccuuaaucgccacuuucagaauacagcccuucuuggcccucggauucuuccugcggaaguuaaccagccgcgagaauuugcugcugggcgugggccucgcgauggccacgacccugcagcugcccgaagacaucgaacaaauggcaaacgggaucgcccucggccugauggcgcuaaaacucaucacccaguuugagaccuaccagcuguggacagcccugaucagccugacaugcucgaacaccaucuucacccugacagucgcauggcggaccgccacccugauccucgccggggugagucucuuaccggucugccaguccagcucaaugcgcaagaccgacuggcuccccauggcggucgccgccaugggcguuccgccccugccguuauucaucuuugggcucaaggacacgcugaagcgccggagcuggccccucaacgaaggcgucauggccguagggcucgugagcauucuggccagcagucuucuccgcaacgacguucccauggcgggaccccugguggccggcggucugcucauagccugcuacgugaucaccggcaccagcgccgaccugaccgucgagaaggcagcugacaucacgugggaggaggaggccgagcagaccggggugucccacaacuugaugaucaccguugaugacgacggcaccaugcggaucaaagacgacgagaccgagaacauucucacaguccuguuaaagaccgcacuccuuaucgugagcggcaucuucccguacuccauucccgcgacccuacucguguggcauaccuggcagaagcagacgcaacgcagcgggguucugugggauguucccagcccgcccgagacccaaaaggccgaauuagaggaaggagucuaccggaucaagcaacaggggaucuucggcaagacucagguuggagugggcgugcagaaagaaggagucuuccacaccauguggcacgugacgcgcggggcgguguuaacguacaauggcaagaggcuagagcccaauugggccagcguaaagaaggaucugaucuccuacgggggcgguuggcgccucagcgcccaguggcagaagggcgaggagguccaaguaaucgccgucgagcccggcaagaaccccaaaaacuuccagaccaugccugggaccuuccaaacgacaaccggcgagaucggggcgaucgcccuggacuuuaagccggggaccuccggcagccccauuaucaaccgggaggggaagguggugggauuauacgggaacggcgucgugacgaagaacgggggguacguuagcggaaucgcccagaccaaugccgagccugacgggcccacccccgaacuggaggaggagauguucaagaagcgcaaccucaccaucauggaccugcacccaggauccgggaagacgcggaaguaccugccugccaucguucgcgaggcuaucaaacggcgccuucggacccugauccuugcccccacccgcgugguggccgccgagauggaggaggcccucaagggccuccccaucagguaccagaccacggcgaccaagagcgagcacaccggccgcgagaucgucgaccugaugugccacgcuacuuucacgaugcggcuccugaguccugugcgcgugcccaauuacaauuuaauaaucauggaugaggcccacuuuaccgaccccgcuagcaucgccgcgcguggcuacaucuccacccgcgucggcaugggggaggccgcugccaucuucaugaccgcgacgccgccaggcaccgccgacgccuucccgcaaagcaacgcucccauccaagacgaggaacgcgacauccccgagcgguccuggaauagugggaacgaauggaucaccgacuuugcgggcaaaacggugugguucguccccuccaucaaagcugguaacgacaucgccaauugucugcgcaagaacggaaagaagguaauccaauuaagccggaagacguucgacaccgaguaccagaagaccaagcugaacgacugggacuucguugugacgacggacaucuccgagaugggcgccaacuuuaaagccgaccgcgucaucgaccccaggaggugccucaaacccgugauucugaccgacgggcccgaacgggugauccuggccggccccaugccggucacagcggccagcgccgcccagcgccgcgggcgugugggccggaacccccagaaagagaacgaucaguacaucuucaccggucagccccucaacaacgacgaggaccacgcccacuggaccgaggcgaaaaugcuucuggauaacaucaacacgcccgaaggaaucauacccgcccuauucgagcccgagcgcgagaaguccgccgccaucgacggcgaguaccgguugaagggugagagcaggaagaccuucguggagcucaugcggcggggcgaccucccggucuggcuggcacacaagguggccagcgaggggaucaaauacaccgaccggaaauggugcuucgacggccagcgaaacaaccagauccuggaagagaacauggacgucgagaucuggacuaaggagggcgaaaagaagaagcuccggccccgauggcuggacgcccgcacguauucugacccgcuggcccucaaggaauucaaggaguuugccgcggggcggaaguccaucgcucuggaccuugugaccgagaucggccgcguccccagccaucucgcccaccggacccgcaacgcccuagacaaccugguaaugcuccacaccagcgagcacggcggccgggccuaccggcacgcgguggaggagcugcccgagacgauggaaacccuccuccugcugggucugaugauccuguugaccggcggcgccaugcuguuccugaucagcgggaagggcauugggaagaccagcaucggccugauuugcgugaucgccucaagcgggaugcucuggauggccgagauaccgcuacaauggaucgcuuccgcgaucgugcuggaguucuucaugaugguguugcugaucccugagccagagaagcaaagaacgccccaggacaaccagcuggccuacgugguaaucggcauccucaccuuagccgccauaaucgccgcgaacgagaugggccucuuagaaaccacuaagcgcgacuuggggaugagcaaagagccgggcgugguaucccccacgucguacuuagacgucgaccuccaccccgccagcgccuggacccuguaugccguggcgacuaccgugaucacgcccauguuacggcauaccaucgaaaauagcaccgccaacgucucccucgccgccaucgcaaaccaggcgguggugcugauggggcuggacaaaggcuggccuaucagcaagauggaccucggggucccccugcuggcccucggcugcuacucccaggugaacccccucacccugacggccgccguucuccugcucaucacccacuacgcuaucaucggccccgggcuccaagcgaaggccaccagagaggcccaaaagcgaaccgcagccggcaucaugaagaacccgacggucgauggaaucaugaccaucgaccuggaccccgugauauacgauagcaaguucgagaagcagcugggccaagugaugcuccugguccugugcgccgugcagcuccugcugaugcgaaccuccugggcgcucugcgaggcccuaacacuggccacgggccccauaacgacucuuugggaggggagcccaggcaaguucuggaacaccacgaucgcaguguccauggccaacaucuuccgggggagcuaccuggccggcgccgggcuggccuuuuccaucaugaaaucggugggcaccggcaagcgggggaccggcucgcagggagagacccugggcgagaaauggaagaagaagcugaaccaauugucucguaaggacuucgaccuuuacaagaaguccggcaucaccgaggucgaccgcacggaggcgaaggaagggcugaagcggggcgagaucacccaccacgccgugucgcgcggauccgccaaguugcagugguucgucgagcggaacauggugauaccggaaggccgcgugaucgaccucgggugcggccgagggggcugguccuacuacugcgccggccugaagaagguaaccgaggugcgcggguacaccaagggaggccccggucacgaggagcccgugcccauguccacuuacggguggaacaucgucaaacugauguccggcaaggacgucuuuuaccucccgccugagaagugcgacaccuugcugugcgacauuggcgagagcagcccuagccccaccguggaggagucccguacaauccggguccugaagaugguggagccguggcucaaaaauaaccaguucugcaucaagguguugaaccccuacaugcccacggucaucgaacauuuagagcgccuccagcggaagcacgggggcaugcuggugcgcaacccacuaucgcgaaacuccacccacgagauguacuggaucagcaacgggaccggcaauaucguggcuuccgucaacauggugucgcgccuccugcugaaccgguucaccaugacgcaccgccggccgaccaucgagaaggacguggaccucggcgcugggacucgccacgucaaugccgagccugagaccccaaacauggacgugaucggcgagaggaucaagcgcaucaaggaggagcauaacucaacguggcauuacgacgacgaaaauccguauaagaccugggccuaccacgggagcuacgaggugaaggcaacaggcuccgccagcuccaugaucaauggggucgugaagcugcuaaccaagcccugggacguggugcccauggugacgcagauggcgaugaccgacaccacccccuucggacagcagcgaguuuucaaggagaagguggauacacgcaccccgcgaagcaugcccggcacccgccgggugauggggaucacagccgaguggcucuggagaacgcugggacggaacaagaaaccgcgccugugcacgcgugaagaauuuaccaagaagguccggaccaacgccgccaugggugcgguguucacggaggagaaccagugggacagcgccaaagcagcuguggaggacgaggacuucuggaagcucgucgacagagagcgggagcugcacaagcugggcaagugcgggucuugcguguacaauaugaugggcaaacgcgagaagaagcucggcgaguucgggaaggccaaggguagccgggcgaucugguauauguggcuuggggcccgauaccuggaguucgaggcgcugggcuuccugaacgaggaccacugguuuucaagagagaacuccuacuccgggguggaaggcgagggacugcacaagcucggguauauucugcgcgacaucagcaagauccccggcggggccauguacgccgacgacaccgccggcugggacaccagaaucacugaggacgaccuucacaacgaggaaaagauaacgcagcaaauggacccggagcaucgccaacucgccaacgcgauauucaagcuuaccuaccagaacaaggucgugaaggugcagcggccaacuccuaccggcaccgucauggacaucaucagccgcaaggaccagcgggggagcggucagguugggacguacggucugaacaccuucaccaauauggaggcccaacucauccgccagauggagggagagggagugcuguccaaggccgaccuggagaacccccaccucccggagaagaaaaucacccaguggcuggagacgaagggcguagaacggcugaagcgcauggcgaucagcggggaugacugcguggugaaacccaucgacgaucgguucgccaacgcacuucuggcccugaacgacaugggcaagguccgcaaggacaucccccaguggcagcccuccaaaggguggcacgacuggcagcaggugccguucugcagccaccacuuccaugaacucauaaugaaggacggccgaaaguuagugguccccugucgcccccaggacgaacuaaucgggcgggcccgcauuucccagggugcgggcuggagccucaaggagacugcuugccuggguaaggccuacgcccaaauguggucccugauguacuuccaccgccgggaccuccgccuugcuagcaacgccaucugcuccgcugugcccguacacugggucccgacgaguaggaccacguggucaauccaugcccaccaccaguggaugacaaccgaggacauguugaccguguggaaccgcguguggaucgaggacaaccccuggauggaggacaagacucccgucaccaccugggagaacgugcccuaccucggcaagcgggaggaccaguggugcggcucucugauaggccuaaccagcagggccacgugggcgcagaacauccccaccgccauccaacagguacggucccucauugggaacgaagaguuuuuagauuacaugcccagcaugaagcguuucagaaaggaggaggaguccgagggagccaucugguag

SEQ ID NO: 25836 - RNA, 9873 nt, Artificial Sequence
  derived and/or modified CDS sequence (opt11) from DENV-3__HQ705619__SS-prME
acuucucugugucugaugaugauccuaccugcagcguuagcguuccaucucaccagccgggacggcgagccccgcaugaucgucgggaaaaacgaacgggggaagagccugcuguuuaagaccgccuccgggaucaacaugugcacccucauagccauggaccucggcgagaugugcgacgacacgguaacguacaaguguccccacauaacggaaguggagcccgaggauaucgacuguuggugcaaccugaccagcacuugggugaccuacggaacgugcaaccaggccggagagcaccggcgagacaaacggucaguugcgcucgcaccucacgucgguauggggcuggauacccgcacccagaccuggaugucggccgaaggugccuggcggcagguugagaagguggaaaccugggcgcugagacauccgggguucaccauacuggcacuguuccuggcccacuacauaggaacuucccuaacccagaagguggucaucuucauccugcugaugcucgucacgccgucaaugacgaugaggugugugggggugggcaaccgcgauuuugucgagggccugagcggggccacguggguugacgugguccuggaacauggcgguugcgucacaacgauggccaagaacaagcccacccucgacaucgagcugcagaagaccgaggccacccagcuagcgacucuccggaagcuauguaucgaaggaaaaauuacuaauaucaccaccgacagccguugccccacccagggcgaggcgacacugcccgaggagcaggaccagaacuacgugugcaagcacacuuacgucgauagaggguggggaaacgggugcggccuauucgggaaaggcagucuagugacuugugccaaguuccaaugucuagagccuauugaaggcaagguggugcaauaugaaaacuugaaguauacgguaaucaucaccgugcacaccggagaccagcaucagguuggcaacgaaacccaaggggugacagcagagaucacgccccaggccucuaccaccgaggcgauucucccggaauacggcacgcugggacuagaguguuccccccgcacggggcuugacuucaacgagaugauuuuacucacaaugaagaacaaggccuggaugguccaucggcagugguuuuucgaccuaccucuacccuggaccaguggugcgacgacggagacccucaccuggaaucgcaaggagcuccuggugacauucaagaacgcccacgcgaagaagcaggaaguggucgugcucgggucgcaggagggcgcgaugcauacugcccugaccggggccaccgagauccaaaacagcggcgggaccuccaucuuugccggccaucucaaaugccggcucaagauggacaaguuggaauuaaaggguaugucauaugcgauguguacgaauacguuuguccucaagaaggagguuuccgagacccagcaugguaccauacucaucaagguggaguauaagggcgaggacgugcccugcaagauccccuucagcaccgaggacgggcagggcaaagcgcacaauggucgucucauaaccgcaaacccuguagugaccaagaaggaagagcccgugaacaucgaggcugagccaccguuuggggagucgaacauuguuaucggcauaggggacaacgccuuaaaaaucaacugguauaagaagggcucgucgaucggcaagauguucgaggcgaccgcccggggagcucgccggauggccauccugggcgacacggccugggacuucgggucgguagggggaguccugaauagcuuaggcaaaaugguccaccagaucuucgggucagcguauaccgcccuguucaguggcguguccugggugaugaagauaggcauuggcguccugcugacuuggauuggccucaacagcaaaaacacauccaugagcuucagcugcaucgcuaucgggauaaucacauuauaccugggagcuguugugcaggcagacauggggugcgucaucaacuggaagggaaaggaguuaaagugcgggagcggaaucuucgucaccaacgaggugcacacguggaccgaacaguauaaguuucaggcggacuccccaaaacgcuuagccacugcaauagccggcgcuugggaaaauggggucugcggcauacguagcaccacccgcauggagaaccugcucuggaaacagauugcgaacgagcugaacuacauccuuugggagaacaacaucaaguuaaccgugguugugggagacaucaucggaguguuggaacagggcaaacgcaccuuaacaccucagcccauggaacucaaguacaguuggaagaccugggggaaagcuaaaaucgugacggcugaaacgcaaaacagcuccuuuauuauagacggcccgaacacgccggaaugcccgagcguuucccgggccuggaacgucugggagguugaagacuauggguucggcgucuucaccacaaauaucuggcuuaagcuacgugaaguguauacacagcuuugcgaccaccggcuuaugucugcagccgugaaggaugagcgcgcaguccacgccgacaugggcuauuggaucgaaucucagaagaacgggaguuggaagcucgaaaaagccagccugaucgaggugaagacauguaccuggccaaagucccacacguuaugguccaacggcgugcuggagucugacaugaucauccccaaaucacuugcaggucccaucucccagcacaaccaccggccaggauaccacacccagacggccgggccguggcaccucggcaagcucgaacucgacuucaacuacugcgaaggcaccaccgucguuauaaccgagaauugcgggacgcgcgguccaagccuucggaccacaaccguauccgggaagcugauucacgagugguguugccgcucaugcacccuaccgccccuacgcuacaugggcgaggacggguguugguacggaauggagauccgccccaucucugagaaggaggagaacaugguuaagagccuggucucggcgggcagcgggaagguggauaacuuuacaaugggugucuuaugucuugcuaucuuguuugaggaggugaugagaggaaaguucggcaagaagcacaugaucgccgggguauuuuuuaccuuuguauugcugcugagcggccagaucacuuggcgcgacauggcucacacccucauaaugaucggcaguaacgccuccgacagaauggggaugggcgugacuuaccuggcccuuaucgccacguucaagauucaacccuuccucgcacugggcuucuuccugcgcaaacucaccagccgugagaaccuguuacucggugugggccuggcgauggcaacaacccugcagcuaccggaggacauagagcagauggccaacggcauugcccuaggguugauggcauugaaacuaaucacucaguuugagacuuaucagcuguggacggcccuaaucagccugacuugcagcaauacaauauucacccuaacggucgccuggcgaaccgccacccuuauccuggccgggguaagccugcucccuguuugccagagcuccaguaugcggaagaccgacuggcugccaauggcaguagccgcgauggggguacccccccugccucucuucaucuucggucuuaaggacacucuuaagcggcgcagcuggccgcucaacgagggcgucauggcugucggccuggucuccauccucgccagcucccuacugagaaacgacguuccaauggcggggccccugguugccggcgggcuccugaucgcgugcuaugugaucacugggaccagcgcugaucugacugucgaaaaagcugcugacaucacgugggaggaagaggcugagcaaacagggguaucccacaacuugaugaucaccguagaugacgaugggacaaugcggauaaaagacgacgagacggagaacauacuaaccgucuuauugaagacggcgcuguuaauagucucgggcauuuucccuuauuccauaccagcuacccugcucguguggcacaccuggcagaaacagacccagcggagcggggugcuaugggacgugccuucuccgccagagacccaaaaggccgaauuagaggaaggaguguacaggaucaagcagcaggggaucuucggcaaaacucaggucgguguaggcgugcagaaggagggcgucuuccauacgauguggcacgugacgaggggggcgguacugacguacaaugggaaaaggcuggagccaaacugggccagcgugaaaaaggaccucauaagcuauggggguggguggcggcuuucagcucaauggcagaagggagaggaaguccagguaaucgcgguagagccuggcaagaaccccaaaaacuuucaaacuaugccaggcaccuuccagacaacaaccggagaaaucggagcaaucgcccucgacuuuaaaccggguaccaguggcagucccauaaucaacagggaaggaaagguaguuggccuguacgggaauggugucgugacaaaaaacggcggauacgugagcggcaucgcccagaccaacgcggaaccagacgguccgacucccgagcucgaggaggaaauguucaagaagcguaacuuaaccaucauggaccugcaccccggcucggggaaaacacgcaaauaucuccccgccaucguacgggaggcgauaaagcgccggcuucgaacgcuuauacucgcaccgacacggguggucgcugccgagauggaggaggcccugaaaggccugccuauccguuaccagaccacagcuaccaagagugagcacaccggaagggaaauaguggaucucaugugccacgcuaccuucacgaugcgacugcuguccccgguacgcgugccaaacuacaaucucauuaucauggacgaggcacacuucaccgauccagcuuccaucgccgcucgcggcuacauuuccacccgcguaggcaugggugaggcggcugccauuuuuaugaccgcgacuccaccgggcacagcugacgccuuuccccagagcaacgccccgauccaggacgaggagagagacauccccgaacgcuccuggaacuccgguaacgaauggaucacagauuucgccggcaagaccgucugguuugugccaucgauuaaggccgggaacgacaucgcuaauugucugcguaagaauggcaagaagguaauccagcuaucaagaaagacguuugacaccgaauaccagaaaaccaagcucaacgauugggacuuuguggugaccacggacauuuccgaaaugggcgcgaacuucaaagccgaucgggucaucgauccuaggcgaugccugaaaccggugauccugacagacggucccgaaagggucaucuuggccggccccaugcccgugaccgcggccagcgccgcacagagacguggacggguggggcgcaauccacagaaggagaaugaccaguacauauucacggggcagccgcuaaacaaugaugaggaccaugcgcauuggaccgaggcgaagaugcuuuuagacaauaucaacaccccagagggcaucauccccgcccuuuucgaaccggagcgggaaaagucugccgcaauugacggggaguaccgguuaaagggggagagccggaaaaccuucguggagcuaaugcgccggggagaucugcccgucuggcuggcacauaaagucgccuccgaagggauuaaauacaccgaccgcaaguggugcuucgacggccaaagaaacaaccagauuuuggaggagaacauggacguagagaucuggaccaaggaaggagagaagaagaagcugagacccagauggcuggacgcccgaacguauagcgacccucuagcccugaaggaguucaaggaguucgcugcgggucguaagucgauugcccuggaucucgugaccgagaucggccggguucccagccaucucgcccaccgcacgaggaacgcccuggacaaucucguaaugcugcacaccuccgagcacgggggccgcgccuaccggcacgcgguggaggagcuccccgagacgauggagacgcuccugcuacucggacuaaugauccuucugacaggcggagccaugcuguuucugaucucggggaaaggcauugggaaaaccucaaucggucucaucuguguuauugcgaguagcgggaugcucuggauggcggagauaccccuucaguggaucgcauccgcaauugugcucgaguucuuuaugaugguucuccugaucccggagccggagaagcagagaacaccccaggacaaucaauuggccuacguugucauuggcauccuuacuuuggccgccauuaucgccgcgaaugaaaugggcuuguuggaaaccaccaagagagaccuggguaugucaaaggaacccggaguaguuucgccgacgagcuaccucgacguggacuuacacccugcuucggcauggaccuuauacgcgguugcgaccaccgucauaacucccaugcuccgccauaccauagagaacagcacggccaaugucucccuggcugcgaucgcaaaccaagcggugguccugaugggccucgacaagggguggcccaucuccaagauggaccucggcgucccgcuacuagcacuaggcuguuacucgcaggugaacccccuuacccucacugccgccguucuguugcuuaucacccauuaugccaucauaggucccgguuugcaagcaaaggccacacgugaggcccagaaacgcacggccgccggcaucaugaagaacccaaccgucgacggcauuaugacgaucgaucuggacccuguuaucuacgacagcaaauucgaaaagcagcucggccaagucaugcugcuuguacuuugugcgguacagcugcuucuaaugcggaccuccugggcccugugcgaggcccugacccucgcuacgggccccaucacgacucuuugggaggggagccccggcaaguucuggaauacuacgaucgcggucuccauggcgaacaucuucagggggaguuaccuugccggggccggucuagccuucuccaucaugaaguccguaggaaccggcaaaagagggaccggaucccaaggggagacccugggcgaaaaguggaagaagaagcuaaaucaacucagccgcaaggauuucgaccucuauaagaagucugggaucaccgagguggacagaacggaggcgaaggagggucuaaaacgcggcgagaucacccaucacgccguaucccggggcucagcgaaguugcagugguucgucgaacgaaauauggugauuccagaaggcagagugaucgaccuggggugugggcgcgggggauggaguuacuauugcgccggccugaagaaggugacagagguccgggguuacaccaagggcgggccuggccaugaggaaccggugccuaugucaacguacggguggaacauuguuaagcucauguccggcaaggacguuuucuaucugccaccggagaagugugacacucuucugugcgacauaggcgagagcucccccagccccaccguggaggagagucgcacuauucgcguguugaagaugguagagccauggcugaagaacaaccaguuuugcaucaaggugcuaaacccguauaugcccacgguaaucgagcaccucgaaaggcugcagcgcaagcacggaggcaugcuaguucggaacccauuaagucgcaauuccacacaugagauguacuggauaagcaacggcaccggaaacaucguugcguccgucaacauggucagccgccuccugcucaaccgcuuuacgaugacacaccggcgacccacuaucgagaaggacguagaccugggggcggguacccggcacguaaaugcugagccggagaccccaaacauggacgugaucggugagcgcaucaagaggauaaaagaagagcacaacucaaccuggcacuacgaugacgaaaaccccuacaagaccugggcguaccacgggagcuacgaggugaaggcuaccggcuccgccagcuccaugaucaacggcgucgugaagcugcuaacaaagccgugggacgucguacccauggugacucaaauggcgaugaccgacacgacgccguuuggacagcagagagucuucaaggagaagguugacacgagaacgccacggaguaugccgggaacgcggcgcgucaugggaaucaccgccgaguggcucuggcggacccugggccgcaacaaaaagccccggcucugcaccagagaggaguuuacuaagaaagucagaaccaacgcggcuaugggcgcuguuuucacggaggagaaccagugggacagcgccaaggcggccguggaagacgaagacuucuggaaacuugucgaucgggagcgugagcuucacaaacucggcaaaugcggguccugcgucuacaacaugauggggaaacgggagaagaagcucggcgaauucgggaaggccaaggguagccgggcuaucugguacaugugguuaggggcccgguacuuggaauucgaagcacucgguuuucugaaugaggaccacugguucucacgcgagaauucauacuccgggguagagggugagggccuccacaaguugggguacauacugcgggauauuagcaagauccccggcggggcgauguacgccgacgacacggcgggcugggacacgcguaucaccgaggaugauuugcacaacgaggagaaaaucacgcagcagauggaccccgagcaccggcagcuugcuaaugccauuuucaagcugaccuaccaaaacaaggucgugaaggugcaacgcccgacacccaccggcaccguaauggauauuauuucccggaaggaccagcgcgguagcggccaggugggaacguacggucucaacacauuuaccaacauggaggcccagcugauacggcagauggagggggagggcgugcuguccaaggcggaccuggagaauccucaccuacccgagaagaaaaucacccaguggcuggaaacgaagggcguggagcgcuuaaaacggauggcgaucagcggggacgacugcguggugaagccgaucgacgaccgcuucgccaacgcauugcuggccuuaaacgacauggguaaggucagaaaagacaucccccaguggcaaccuuccaagggguggcaugauuggcagcaggucccauucugcucucaccacuuccacgagcugaucaugaaggacggccgcaagcugguaguuccgugccgcccccaagacgagcucaucggacgcgcacgaaucucacagggcgcgggguggagccugaaggagacagccugccuagggaaggccuaugcacagauguggucacuuauguacuuccaucggcgcgaucugagacucgcgagcaaugcgaucugcuccgccgugcccguucacugggugcccaccagucgcacgacaugguccauacacgcucaucaccaguggaugaccaccgaggacaugcucaccguuuggaaccggguguggaucgaggacaaucccuggauggaggauaaaacgcccgucacuacgugggagaauguucccuaccugggcaagcgcgaggaucaguggugugggagccugaucggcuugaccucacgggccaccugggcacaaaauaucccaacugccauccagcagguccguucccugaucgggaaugaggaguuccuugacuauaugcccucuaugaaacgguucaggaaagaggaggaguccgaaggcgccaucugguga

SEQ ID NO: 25837 - RNA, 9873 nt, Artificial Sequence
  derived and/or modified CDS sequence (opt11) from DENV-3__HQ705620__SS-prME
accagccucugucucaugaugauccuaccugccgcauuagccuuccaccucaccagccgggacggggagcccagaaugauuguggggaagaacgagcgcggaaagucucugcuguucaagaccgccuccgggaucaauaugugcaccuugaucgccauggaccugggcgaaaugugugacgacaccgugacguacaaguguccccacauaaccgagguagaacccgaggacaucgacugcuggugcaaccugacuagcaccugggugacauacggcacgugcaaccaggccggcgagcaccggcgcgacaagcggaguguggcccucgccccccacgugggcauggggcuggacacccguacccagaccuggaugagcgcagaaggcgccuggcggcagguagagaaggucgagacgugggcccugcgccauccggguuucaccauucucgcgcuguuucuggcccacuacaucggcaccucccucacccagaaggucgugaucuucauccugcugauguuggucacgcccagcaugaccaugcggugugugggggugggcaaccgcgacuucgucgagggccuguccggggccaccuggguggacgugguacuggagcacggcgggugcgugacaacgauggccaagaacaagccuacccuugacauugagcugcagaagacggaggccacccagcuggcuacgcuccggaagcugugcaucgagggaaagauaacuaacaucaccaccgacagcagaugcccaacgcagggagaggccacccuccccgaggagcaagaccagaacuacgugugcaagcacaccuacguggaucgggggugggguaaugggugcggccuguucgggaagggcucccuggugaccugugccaaguuccagugccuggagccuaucgagggcaagguuguccagcacgaaaaccucaaguacacggugaucauuacggugcacacaggagaccaacaccaggucggcaaugagacccagggggugacugccgagaucacuccccaggccagcacaaccgaggcgauccugcccgaguaugggaccuuagggcuggaaugcuccccgcgcacgggccuggacuucaacgaaaugauccuucucaccaugaagaacaaagccuggaugguacaucggcagugguucuucgacuugccccugcccuggacgagcggcgccacaaccgagacgcccaccuggaaccgcaaggagcuccuggugacguucaagaacgcccacgccaagaagcaggaggugguuguacuagggucgcaggagggagcgaugcacacggcgcucacuggggccaccgagauccagaacagcggcggaacgaguaucuucgccggacaccugaagugucgguuaaagauggacaagcucgagcugaagggcaugagcuaugcaaugugcacaaacaccuuugugcuaaagaaagaggucucagagacccagcacgguaccauccuuaucaagguggaguacaagggugaggaugugccgugcaagauccccuucucgaccgaagacgggcaaggcaaggcucacaacggccggcugaucaccgccaaccccgucgugaccaagaaagaggagccugugaacaucgaagcagagccgcccuucggggaaagcaauauugucaucggcaucggugauaacgcgcugaagaucaauugguacaagaagggcagcagcauagggaaaauguucgaggcgaccgcccgaggggcccgcagaauggcuauccucggcgacacugccugggauuuuggguccgugggcggggugcucaacagcuugggcaaaaugguccaccaaauuuucgggagcgcauacaccgcccuuuucagcgggguguccugggugaugaagaucggcaucggggucuugcugacguggguaggucugaacagcaagaacaccagcaugagcuucucaugcaucgccaucgggaucauaacgcuauaccuaggcgcggugguccaagccgacauggggugcgugaucaacuggaaggggaaggagcugaaguguggcagcggaaucuuugugaccaacgagguccacaccuggaccgagcaguauaaguuccaggcggauucccccaagcgcuuggccacggccaucgccggagcgugggagaacggggucuguggcauccgcucaaccaccagaauggagaaucugcuguggaagcagaucgcgaacgagcucaacuacaucuugugggagaacaacaucaagcugacgguugucgugggggacauuaucggcguacucgagcaaggcaagagaacacugacgccccagccgauggagcugaaguacuccuggaagacguggggcaaggcuaagaucgucaccgcagaaacucagaacagcuccuucaucaucgacggaccuaacaccccggaaugccccagcgugucccgggccuggaacgugugggaggucgaggacuacggguucggcguguucaccaccaacaucuggcucaagcuacgcgagguguauacccaacugugcgaccaccggcucaugagcgcagccguuaaggacgagcgcgccguacacgccgacaugggguacuggaucgagagccagaagaacggguccuggaagcuggagaaggccagccugaucgaggugaagacguguaccuggccgaagucccacacccucuggaguaacggcguccuugaguccgacaugauuauccccaaaagccuggcggggccuaucucccagcacaaccacaggccgggcuaccauacccaaacagcgggucccuggcaccucggcaagcuggagcuggacuucaauuacugugaaggcaccaccgugguuaucaccgagaauugcgggacucgcgggcccagccuccgaaccaccaccgucagcgguaagcuuauacacgaauggugcugcaggaguugcacccugccgccgcuccgguacaugggcgaggacggcugcugguacggcauggagauccgccccaucuccgagaaggaggagaacauggucaagagccucguguccgccggcagcgggaaggucgauaacuucacuaugggcgugcugugccuagcaauacuguucgaggaggugaugcgggggaaguucggcaaaaagcacaugauagccgggguguucuucacguucgugcuguuacuguccgggcaaaucaccuggcgcgacauggcacauacgcugaucaugaucgggagcaacgccuccgaccggauggggaugggugugacguacuuagcccugaucgccaccuucaagauccagcccuuccuggcccucggguucuuccugcgccggcugacuagccgcgagaaccuucugcugggcgucggguuagcgauggccacgacccugcagcugccggaggacauugaacagauggccaacggaaucgcauugggccucauggcgcugaagcucaucacccaguuugagaccuaccaacuguggacagcccugaucuccuuaaccugcaguaacaccaucuucacccugacgguggccuggaggaccgccacucugauccucgccggggucagccugcugccggucugccaguccagcucuaugcgcaaaaccgacuggcuacccauggcaguggccgcuaugggcgugccgccccucccccuguucaucuucagccucaaggacacgcugaaacgccgguccuggccucugaacgaaggggugauggcagucggccucgucagcauccuggccucuucacugcuccgaaacgacgugcccauggcgggcccacucguggccgggggccuucucaucgcaugcuacgugaucacggggaccucugccgaccugaccguggagaaggccgcggacaucacgugggaggaggaggccgagcaaacgggcgugagccauaaccugaugauaaccgucgacgacgacgggacaaugcggaucaaggacgacgaaaccgagaacauccucacggugcugcugaagaccgcccucuugaucguguccggcaucuucccguacagcaucccggccacucugcucgucuggcacaccuggcaaaaacaaacgcagcgcuccggcguacugugggacgugcccagcccgccagagacgcagaaggccgagcuggaggagggggucuaucggaucaagcagcagggaaucuucgguaagacccaggucggcguggggguccagaaggagggcguguuucacacgauguggcacgugacacgcggagcgguccucaccuacaacgggaagagacuugagcccaauugggccuccguuaagaaggaucugaucucguacggcgggggcuggaggcucuccgcccaguggcagaaaggggaggagguccaggucauagccguggaacccggcaaaaacccuaagaauuuccaaacgaugcccggcaccuuccagacuaccaccggggagaucggcgcgaucgcccuggacuucaagcccgggacgagcggcagccccauuaucaaccgagaaggcaaagugguagggcucuaugguaacggcguggugacgaagaacgguggguacguguccggcaucgcccagaccaaugccgagccggacggccccacccccgagcuggaggaggaaauguucaagaaacgcaaccucaccauuauggaccugcacccagggagcggcaagacgcggaaguaccucccggccauugugcgagaggcgaucaagcgacgccugcggacccugauacuggcacccacccgcgugguagcggccgaaauggaggaggccuugaaggggcugcccauccgcuaccagacgacggcgaccaagucugagcacacgggacgcgagaucguggacuuaaugugccacgccaccuucacgaugcggcuccugagccccgugcgcgucccgaauuauaaccugaucaucauggacgaggcacacuucaccgaccccgccuccaucgccgcgcggggguacaucagcacacgcgugggcaugggcgaggcggccgccaucuucaugaccgcgacgccgcccggcaccgccgacgccuucccgcaauccaaugcccccauccaggacgaagagcgcgacauccccgagcgguccuggaacuccggcaacgaguggaucaccgacuucgccgggaagacagugugguucgucccgagcaucaaggcgggcaacgauaucgccaauugccuccgcaagaacggcaagaaagugauucaacugucccggaagacauuugacacggaauaccagaagaccaagcugaacgacugggacuucguugucaccacggacaucagcgagaugggcgccaacuucaaggcggaccgcgugauugacccuagacgcugccucaagccugugauccugaccgacggccccgaacgggucaucuuggccgggccgaugccggugaccgcggccuccgccgcccagcgccggggucgcgugggucggaacccccagaaggagaacgaccaguacauuuucaccgggcagcccuugaacaacgacgaggaccacgcccacuggaccgaggcgaagauguuauuagacaacaucaacacgcccgaggggaucaucccggcccucuucgaaccggagcgcgagaaguccgccgccaucgacggugaguaccggcugaaaggagagucacgcaagacauucgucgagcugaugcggaggggagaccuccccguguggcuggcgcacaaggucgccucugaggguaucaaauacaccgaccggaaguggugcuucgacggacagcgcaacaaucagauccuggaggagaauauggacguugagaucuggacgaaggagggcgagaagaagaagcuccggccccgcuggcuggacgcacgcacguacucggacccgcuggcccugaaggaguuuaaggaguuugccgcgggccgcaagucuaucgcccuggaccuaguaaccgagaucggccgcguccccucccaccucgcccaccggacccgcaacgcccucgacaaccuggugaugcuccacaccagcgagcacggcgggagagccuaccgccacgcggucgaggagcugcccgagacgauggagacccuucuccuucugggccugaugauccuccugacagggggcgccaugcuguuccugaucagcggcaaagggauaggcaagacuuccaucggccugaucugugucauagccaguuccggcaugcucuggauggccgagaucccgcugcaguggauagccagcgcgaucguucuugaguucuucaugauggugcuccugauccccgagccggagaagcagcggacgccccaggacaaccagcuggccuacgucgugauugggauccucacccuugcugccaucaucgccgccaacgaaaugggccugcucgagaccaccaagcgcgaucuuggcauguccaaggaaccggggguggucagccccacguccuaccuggacguggaccuccaccccgccucugccuggacccuguacgcuguggcgaccaccgucaucacgcccauguuacgucacaccaucgagaacagcaccgccaacgugucgcucgccgccaucgccaaccaggcggugguccuaauggggcucgacaagggguggccgaucucuaagauggaucucggcgugccgcuguuggcccucgguugcuauagccaggucaaccccuugacccugacggccgccguucuacugcuaaucacacacuacgccaucaucggccccggucuccaggcgaaggccacccgcgaagcccagaagcggaccgccgcggggaucaugaaaaacccgacgguggacggcaucaugacgaucgaccucgaccccguuaucuacgacagcaaguucgagaaacagcuggggcaggucaugcuccucgugcugugugcgguucagcuccugcucaugcgcaccagcugggcgcucugcgaggccuugacccuggccacgggccccaucaccacccucugggagggcucccccgggaaguucuggaacaccacgauagcggucagcauggcuaacauuuuccguggcucguaccuggccggggccggccuggccuucagcaucaugaaauccguggggacaggcaagcgagggaccgggucccagggcgagacucucggagaaaaguggaaacggaagcugaaccagcugagccgcaaggacuucgaccucuauaaaaaauccggcaucacugagguggaccgcacggaggcgaaggagggguugaagcgcggcgagauuacccaccacgcugucagcaggggcuccgccaagcuucaaugguucguggagcgcaauauggugaucccggagggccgggucaucgaccucggcugcgggcgugggggguggagcuacuauugcgccggauugaagaagguaacagagguccgcggcuacaccaaagggggacccggacaugaggagccgguccccauguccacguacggcuggaacaucgugaaauugaugagcgggaaggauguguucuaccucccacccgagaagugugacacccuacugugugauaucggcgagaguagccccucucccaccgucgaggagagccggaccauacgcgugcugaagaugguggagccguggcucaagaacaaccaguucugcaucaaaguccugaacccuuacaugcccacagugaucgagcaccuggaacggcuccagcgcaagcacggggggaugcugguccggaauccccugagccgcaacagcacccacgagauguacuggauaucgaacggcacggggaacaucgucgccagcgucaacauggugucccggcuccugcugaaccgcuucaccaugacgcaccggagaccgacgaucgagaaggaugucgaccucggcgcgggcacccggcacgucaacgcugaaccggagacccccaacauggaugugauuggggaacggaucaagcggauuaaggaggagcacaacaguacguggcacuaugacgacgagaacccguacaagaccugggccuaucacggcuccuacgaggucaaggccaccggaagcgccagcagcaugaucaacggagucgucaagcuccugaccaaacccugggacgucgugccuaugguuacgcagauggcgaugaccgacacgacccccuucgggcagcagcgcguguuuaaggagaagguggacacgcggaccccgcgcagcaugcccggcacgcgacgcgucauggguauuaccgcggaguggcucuggcggacgcuggggcgcaacaagaagccccggcugugcacccgagaggaauucaccaagaaggugcgcaccaacgccgccaugggcgcgguguucacggaggagaaccagugggacuccgcuaaggccgccgucgaggacgaggacuuuuggaagcuaguggaccgggaaagagaacugcacaagcuugggaagugcggcucuugcguguacaacaugauggggaagcgggagaagaagcucggcgaguucggcaaggccaaggggagcagggcgauaugguacauguggcugggcgcccgguacuuggaguucgaagcucucggguucuugaacgaggaccacugguucagccgcgaaaauuccuauagcggagucgagggagagggacugcacaagcugggauauauccugcgggacaucuccaagaucccggguggagccauguacgcagacgacaccgcggggugggacacucgcaucacugaggacgaccugcacaacgaggagaagaucacgcagcagauggacccugagcaccgacagcuugccaaugccaucuucaagcugaccuaccagaacaaggucgugaagguccagcgccccaccccaaccggcaccgucauggauaucaucucgcggaaggaccagcgcggaucaggccaggugggcacuuacgggcucaauacauucaccaacauggaggcccagcuuauucggcagauggagggagagggcguccugagcaaggccgaccuggagaauccccaucucccggagaagaagaucacccaguggcuggaaacgaagggcguggagcggcugaaacguauggcuaucuccggcgacgauugcguugucaaacccaucgacgaccgcuuugcgaacgcccuccuggcccugaaugacaugggaaaggugcgaaaggacaucccccaguggcagccaagcaagggcuggcacgacuggcagcaggucccguucugcucccaccacuuucacgagcucaucaugaaggauggucguaagcucguugugcccugcaggccucaggacgaacugaucggccgcgcccgcauaagccagggcgcgggcuggucccugaaggagaccgcaugccugggcaaggccuacgcccagauguggagccuuauguacuuccaccggcgcgaccuccggcuagcguccaacgcgaucugcagcgcagugcccgugcacugggugccgaccucccgcacgacuuggagcauccacgcccaccaccaguggaugaccaccgaggacaugcugaccgucuggaaucggguguggaucgaggacaacccguggauggaagacaagacgccagugaccaccugggagaaugugccuuacuuggggaagcgcgaggaccaguggugcggcagccugauagggcugaccucccgggccacgugggcgcagaacaucccgacggcaauccagcagguccgcagccucaucgguaaugaggaguuuuuggauuacaugcccuccaugaagcgguuccgcaaagaggaagagucagagggggccauaugguga

SEQ ID NO: 25838 - RNA, 9873 nt, Artificial Sequence
  derived and/or modified CDS sequence (opt11) from DENV-3__HQ705621__SS-prME
accagccugugccucaugaugauccugcccgccgcccuggccuuucaccucaccagcagggacggcgaaccccggaugauaguaggcaagaacgagcggggcaagagccucuuguucaagaccgccagcgggaucaacauguguacccuuauagcgauggaccugggggagaugugcgaugacaccgugaccuacaagugcccccacaucacggagguugagcccgaggacaucgacugcuggugcaaucugacgagcaccuggguuacguacgguaccugcaaccaggcuggcgagcaucggcgcgacaagcgauccguggcgcucgcgccccauguugggauggggcuggauacccgcacccagaccuggaugagcgccgagggcgccuggcgccagguggagaaagucgagaccugggcacugaggcacccgggguucaccauacucgcgcuauucuuggcccacuauaucggcacaucgcucacucagaaagugguaaucuucauccuguuaauguuaguuacgccaagcaugacgaugcggugcguggguguuggcaaccgcgauuucgucgaggggcugucuggugcgacauggguggacgugguccuggagcacggcgggugcgugaccaccauggccaagaacaagcccacccucgacaucgagcugcagaagaccgaagccacacagcuggcgacacuccggaaacugugcaucgaggggaagaucacuaacauaaccaccgacagccgcugccccacgcagggcgaggccacucugccugaggagcaggaccaaaacuacgucugcaagcacacuuacgucgaccggggcugggggaacgggugugguuuguucgguaagggcucccuggugaccugcgcuaaguuccagugccuggagccaaucgaaggcaagguggugcagcacgaaaacuugaaauacacgguaaucaucacugugcacaccggggaccagcaccaggucggcaacgaaacccaagggguuacggccgaaaucacgccccaggcuagcaccacggaggcgauccuccccgaguacggcacccuggggcucgaaugcucgccgcgcaccggucuggacuucaacgaaaugauccuucucaccaugaagaacaaggcguggaugguccaucgacagugguucuuugaccugccccugcccuggaccucuggggccaccacggaaacccccacauggaacagaaaggagcuccucgugaccuuuaagaaugcgcacgcgaagaagcaggagguggucgugcugggcucccaggaaggcgcgaugcacaccgccuugacgggggccaccgagauccagaacucaggcggcaccuccaucuucgcaggccaccucaagugccgccugaaaauggacaaguuagaacuaaagggcaugagcuacgcaauguguacgaauacguucgugcugaagaaggaggucuccgaaacgcagcacgggaccauccuaaucaaggucgaguacaagggugaggaugugccgugcaagauccccuucagcacggaggauggacaaggaaaggcccacaacgggcgccucaucacugccaacccuguugugacuaagaaagaggagcccgugaacauagaggcggagccucccuucggugagucaaacaucguaaucggcaucggcgacaacgcccucaagaucaauugguauaagaagggguccagcaucggaaagauguucgaggccaccgccagaggugccagacggauggccauccugggcgacaccgccugggacuucgggucggugggagggguucucaacagccuuggcaagaugguccaccagaucuucggguccgcguacaccgcccuguucucaggaguguccugggugaugaagaucgguauugguguucuccuuaccuggauaggccugaacaguaagaacacguccaugagcuucuccugcauugccaucgggauuaucacacucuaccugggcgcgguagugcaggccgacauggggugcgucaucaacuggaaaggcaaggagcuaaagugcggcagcgggaucuucgugaccaacgagguucacaccuggacugaacaguacaaguuucaggcggauucacccaaacgcuuagccacggccaucgccggcgccugggagaacggugucuguggcauccgcagcaccacucggauggagaacuuacucuggaaacagauugcgaacgagcucaauuacauccugugggagaacaacauaaagcugacggugguggucggcgauauaaucggcgugcucgaacaagggaagaggacgcucacuccccagccgauggagcugaaguacuccuggaagaccuggggaaaggcgaaaaucguuaccgcugagacacaaaauucgucguucaucauagauggucccaauacucccgagugucccuccgucuccagggcauggaacguaugggagguggaggacuacggauucgggguguucacgaccaacauuuggcuuaagcugcgcgagguauacacccagcuaugcgaucauagacucaugagcgcggccgugaaggacgaacgcgccguccacgcugacaugggcuacuggauagagucucaaaagaacggcuccuggaagcuagagaaggcuagccuaaucgaggucaagacgugcaccuggccgaagucucacacucuguggagcaacggagugcuggaguccgacaugaucauucccaaaagccuggcaggucccaucucccagcacaaccaccggcccggcuaucacacgcaaacggccggacccuggcaccuaggcaaguuggagcuggacuucaacuacugcgaagguaccacagucguuaucacagaaaacugcgggacccgcggccccucccuuaggaccacaacaguguccgguaagcugauccacgaauggugcugccgcaguugcacgcuacccccgcugcgguacaugggcgaggauggguguugguacggcauggaaauccgccccaucuccgagaaggaggagaacauggucaaaagccugguuuccgccggaagcggaaagguggauaacuucacgaugggcgugcuuugucucgccauccuguucgaggaggugaugcgggggaaguucggcaaaaagcacaugaucgccgggguguucuucacauuuguucugcuccugaguggccaaaucaccuggagagacauggcgcauacacugauuaugaucgggagcaaugccuccgacaggaugggaaugggcguaacauaccucgcacugaucgccaccuucaagauccaacccuuccucgcacucggguuuuuccugaggaaacugaccagccgggagaaucuccuccucggcgugggccucgcgauggccacgacucugcagcugcccgaggacaucgagcagauggcuaaugggauugcucucggccugauggcucugaagcucauaacccaauuugagauauaucagcuguggaccgcccuuauaagccucacgugcagcaacacuaucuucaccuuaaccgucgccuggcgcacggccacacugauucucgccggggugucacugcugccgaugugccaguccagcuccaugcggaagaccgauuggcugcccauggcuguugccgccaugggcgugccgccucucccucuguucauauuuagccucaaagauacacuuaaacgccgcuccuggccccugaaugaaggcgugauggccgucggccuugugucaauacuggcuuccagccuccuccggaaugaugugcccauggcgggcccccuggucgccgggggccugcucaucgcguguuacguaaucaccgggaccagugccgaccugaccguggaaaaggccgcggacauuaccugggaggaggaggccgagcagacgggagucagucacaaccugaugauuacuguggaugaugacgggaccaugcguaucaaggacgacgaaaccgagaacauccucacuguguuacucaagacggcccuccugaucgucucaggcauuuuuccauacagcaucccggccacucuguuaguguggcacaccuggcaaaaacaaacccagcguuccggcgugcugugggacguccccucgccacccgagacgcaaaaggcggagcuggaagagggggucuauagaaucaagcagcagggcauauuugggaagacccaggugggcgucggggugcaaaaggaaggcguguuccacaccauguggcacgucacucggggcgcuguucucacguacaacggaaagcgccuggagcccaauugggccuccgugaagaaggacuugauuucauacggcgggggcuggcgccuauccgcccaguggcagaagggugaggagguccaggugauugccguggagcccgguaagaacccaaagaacuuccagacaaugccuggaaccuuccagaccacgaccggggagaucggcgcgaucgcguuggauuucaaacccggcaccagcggcagccccaucauaaaccgcgagggaaaggucguaggucuguauggcaacggcguggucaccaagaacggcggguacgugaguggaauagcccagaccaacgccgagccugacggucccacccccgaacuggaggaggaaauguucaaaaagcggaaccucaccaucauggaccugcaccccggaucggguaagacgcgcaaguaccugccggccauugugcgggaggcgaucaagcgccggcuccgcacauugauucuggcccccacccgggucguugcagcugaaauggaggaggcccucaaggggcugccuauccgguaccagaccacugcgacgaagucggagcauaccggccgagaaaucguggacuugaugugucaugccaccuucaccaugcgccuccuguccccuguccgggugccgaacuacaaccugaucauaauggacgaagcccacuucacggaccccgccucgaucgccgcacgcggcuacaucagcacacggguaggcaugggcgaggccgcggccaucuucaugaccgcgacgccuccggggacggcugaugccuucccgcaauccaacgcccccauccaagacgaggagagggacauucccgagcgcagcuggaacuccggaaacgaguggaucaccgauuucgccgggaagaccgucugguucguucccagcaucaaagcuggcaacgacaucgcgaauugccuucggaagaacggcaaaaaggucauccaguugucucgcaagaccuucgauaccgaguaccagaagaccaaguugaacgacugggacuucguuguaacuacagacauuucggagaugggcgcgaacuuuaaagccgaccggguaaucgauccgcgccggugccuaaagcccgucauccugacggacggcccugaacgcguaauccuggccggcccaaugccggugaccgcggccagugccgcccagaggaggggccgggucgggcgcaauccccaaaaggagaaugaucaguacauauuuacuggacagccccucaacaacgacgaggaccacgcccacuggacagaagcaaagauguuacuggacaauaucaacaccccagaagggaucaucccggccuuauuugagcccgagcgggagaaguccgccgcgauagacggcgaguaccggcugaagggggagucacggaagacguuuguggaacucaugcgccgcggggaccuccccgucuggcuggcgcacaagguagccagcgagggaaucaaauacacggaccgcaagugguguuucgacgggcagcggaacaaccagauucucgaggaaaacauggacguggagaucuggacaaaggagggcgagaagaagaaguuaaggccccgguggcuggacgcccguaccuacuccgacccgcuggcucuuaaggaguucaaagaguucgccgcggggcgcaagagcauagcccuggacuugguuacggagaucggccggguacccucucaccucgcccaccgcacccgcaacgccuuagacaaucuagugaugcuucauaccagcgagcacggcgggcgcgcauaucggcacgccguagaggaguugcccgagacgauggagacgcugcuccugcugggccucaugauccuucugacugggggcgccaugcucuuucugauaagugggaaagggaucggcaagaccucuaucggccuuaucugugugaucgccagcuccggcaugcucuggauggccgaaauaccgcugcaauggaucgcgagcgcgaucgugcuggaguucuucaugaugguucuccugauccccgaacccgagaagcagcgcacgccccaggacaaccaauuggccuacgucgugaucgggauucuaacgcuggccgccaucaucgcugcgaacgagaugggucugcucgagaccacgaagcgggaccuuggcauguccaaggagccgggggucgugucccccaccuccuaucuugaugucgaccuccaccccgccagugccuggacacuguacgccguggcgacaaccgugauaacacccaugcugagacacacgauugaaaauuccacggccaacgugagccucgccgccaucgccaaccaggcggucguucugaugggccuggacaaggguuggccgaucucuaagauggacuuagguguuccccugcuggcgcucgggugcuacagccaggucaacccccugacccugaccgcggccguucuccuccugaucacccauuacgcaaucaucggccccggccuucaggcuaaggccacucgggaggcccagaaacgcaccgccgcggggaucaugaagaaccccacaguggacgguaucaugacgauugaccucgacccgguuaucuacgacuccaaguucgagaagcagcugggccaggugauguugcuggugcugugcgucgugcagcuccugcuuaugcguaccucuugggcccucugcgaggcccugacccuagccaccggccccaucacgacgcuaugggagggcuccccagggaaguuuuggaacaccaccauugccgugucuauggcaaacaucuuccgcggcuccuaucuagcgggugccggacuggccuucagcaucaugaaaucagucgguacgggcaagcgcggcacugggagccagggcgagacguuaggggaaaaguggaagaaaaagcugaaccagcucucgcgcaaggacuucgaccuguacaagaagaguggcaucaccgagguggacaggaccgaggccaaagaggggcugaaacgcggcgaaauaacucaccacgcggugucgcggggauccgccaagcugcagugguuugucgaacgaaacauggucaucccggaggggagagugaucgaccucggcuguggucgcggcggguggagcuauuacugcgccggccugaagaaggugaccgaagugcggggcuacaccaaaggagggccuggccacgaggagcccgugccaaugucuaccuacgguuggaacaucguuaaacugaugagcgggaaggacguauucuauuuaccucccgaaaagugcgacacucugcuaugcgacaucggugaauccagccccuccccaaccguagaggagucacguaccauccgcguccuaaagaugguggagccguggcucaagaacaaccaguucugcaucaagguacugaaucccuauaugcccaccgucauagagcaccuggagcggcuccagcgcaagcacggcgguauguuagugagaaauccccuuucucgcaacagcacgcacgaaauguacuggaucucaaauggcaccggcaacauagucgcaagcgugaacauggugucccggcuccugcugaaccgcuucacgaugacccaucggcgcccaacgaucgagaaagauguggaucuaggcgccggcaccaggcacgucaacgcggagcccgagacuccaaacauggacgugaucggggagcggauaaaacggaucaaggaggagcacaacucaaccuggcaccaugacgacgaaaacccguacaagacgugggccuaccacggcucauacgaggugaaggccacaggguccgcaagcagcaugauuaacggcgucguuaagcuccuuacuaagcccugggaugugguacccauggugacccagauggccaugacggacaccacccccuucggacagcaacgugucuucaaggagaaaguagacacucggaccccgagguccaugcccggcaccaggcgcgugauggguauuacagcggaguggcuauggcggacacuggggcgcaacaagaagccccggcuguguacucgagaggaguucaccaaaaagguccgcaccaaugccgcgaugggggcgguguucacugaggagaaccagugggauuccgcaaaggccgccguggaggaugaggacuuuuggaagcugguugaccgcgagcgcgagcugcacaaacuugggaagugcggcaguugcguguacaacaugauggggaagcgggagaaaaaguugggugaguucggcaaggcgaagggaucacgcgccaucugguacauguggcugggcgcgagauaccuggaguucgaggcccucggcuuucugaacgaggaccacugguucagccgcgaaaauuccuacagcggcguggaaggggagggccugcacaagcuaggcuauauccugagggauaucuccaagaucccugggggugccauguacgcugacgacacggccgggugggauacccguaucaccgaagacgaccugcacaacgaggagaagaucacccagcagauggauccggagcaucgucaguuagcuaaugccaucuucaagcugacguaccagaacaaggucgucaagguucagcgccccaccccgaccggcacaguaauggauaucauuagccguaaggaccagcgcggcuccggucaagucgguacuuacggccugaacacauucacaaacauggaggcacaacucauccggcaaauggagggcgaaggggugcugucuaaggcggaucuugagaacccccaccuaccggagaagaagaucacccaguggcuagagacaaagggcgucgaacgccugaagcggauggccauauccggcgacgauuguguggucaagcccaucgacgaccgcuucgcgaacgcauuguuagcucugaacgacaugggcaagguccggaaagacauaccucaguggcagccuucuaaaggcuggcacgacuggcagcaagucccguucugcucacaccauuuccacgaguugauaaugaaggacgggcgcaagcuggugguaccgugccggccgcaggacgagcugaucgggcgcgcccggaucagucagggggccgguuggucucucaaggagacggcgugccuaggcaaagccuacgcccagauguggagccugauguauuuccaucgccgugaccuccgacucgcguccaaugcuaucugcucagccguuccuguacacugggucccgacaagccgcaccaccuggagcauacacgcgcaccaccaguggaugacgacugaggauaugcugaccguguggaaccgcgucuggaucgaggauaaucccuggauggaggacaagacacccguaacgaccugggagaacgucccguaccucgggaagagggaggaucaguggugcgggagccugaucggccugaccuccagagcgaccugggcccagaacaucccgaccgccauccagcaggucaggagccucauuggcaacgaggaguuccuggacuacaugccuuccaugaagcgguuccggaaagaggaggaaagcgagggggcaaucugguga

SEQ ID NO: 25839 - RNA, 9873 nt, Artificial Sequence
  derived and/or modified CDS sequence (opt11) from DENV-3__HQ671176__SS-prME
acgucucucugccucaugaugauauugccggccgcauuggcguuucaccugaccagccgggacggcgaaccccgcaugaucguggggaagaaugagcggggcaagucucugcuguucaagaccgccuccgggaucaacauguguacccuaaucgccauggaccugggggaaaugugcgacgacaccgugacguacaagugcccccacaucaccgagguggaacccgaagacaucgauugcuggugcaacuugacauccaccugggugaccuauggaaccugcaaccaagccggggaacaccggcgcgacaagagauccguggcccucgcgccccacgugggcauggggcuggauacccgcacccagaccuggaugagcgccgagggcgccuggagacaaguugagaaggucgagaccugggcgcugcgccacccgggguucacaauacucgcgcuguuccuggcucacuauauagggaccuccuugacgcagaagguggugaucuucauacugcugaugcucguuacgcccagcaugaccaugcgaugugugggcguggggaaccgcgacuucgucgaaggccuauccggggcgaccuggguugacgucguacuggagcacggagggugcgucacgacaauggccaagaacaagcccacccuagauaucgagcugcagaagaccgaggccacccagcuggcgacguuacggaagcugugcaucgagggcaaaaucacuaauauaaccaccgacucucggugccccacgcagggagaggccacccugccggaggaacaggaccagaacuacguguguaaacacaccuacgucgaccgcggauggggcaacggguguggccucuuuggaaagggcucgcuugugacuugcgccaaauuccagugcuuagagcccaucgaaggcaaggugguccagcacgaaaaccucaaauacacggugaucauaacugugcacaccggugaccagcaucaagucggcaacgagacucaggggguaacggccgagaucacgccacaagccagcacgaccgaggcgauacugcccgaauauggcacccugggacucgagugcuccccgaggacgggccuagacuucaacgagaugauucugcucaccaugaagaacaaggcguggaugguccaucgucagugguucuuugaccuaccccuccccuggaccagcggcgcgaccacggagacccccacguggaacagaaaagaguugcuugugaccuucaagaacgcccaugccaagaagcaggaaguggucgugcucgggagccaggagggugcgaugcauacggcccucaccggggccaccgagauccagaacagcggagggaccuccaucuuugcaggccaucugaagugccggcuuaagauggacaagcuggagcugaagggcaugagcuacgcgauguguacgaacacguucgugcugaaaaaggaggucagcgaaacccaacaugggacgauacuuauaaagguggaauacaaaggcgaggacgugccgugcaaaaucccguucagcacggaggauggucagggcaaggcccacaacggcaggcuaaucacggcuaaccccgucgugaccaagaaggaggaaccugugaacaucgaagccgagccgcccuucggggagagcaacaucgucaucgguaucggggacaacgcccugaagaucaauugguauaaaaagggcuccaguaucgggaagauguucgaggcgaccgcccguggcgcccgacggauggccauucugggcgacacugccugggacuuugggucaguuggcgggguccucaacuccuuggggaaaaugguucaccagauuuucggauccgcguacaccgcccuguucucaggugucuccugggucaugaagauuggcaucgggguccuccugacauggaucggccugaacucgaagaacaccucaaugucguuuucaugcaucgcaaucggcauaaucacgcucuaccugggcgccguggugcaggccgacaugggcugcguaaucaacuggaagggcaaagagcugaaaugcgggucugggaucuucgugaccaacgaggugcacaccuggaccgagcaguauaaguuucaggcggacuccccaaagagacucgccacagccaucgccggcgccugggaaaacggggucugcggcauccgcagcaccacccggauggagaaucuguuguggaagcagauagcgaacgagcuuaacuauauccugugggaaaacaacauuaagcuaaccgugguggucggggauaucaucgguguguuagagcagggcaaaaggacauugacgccccagccgauggaauugaaguauuccuggaagacguggggcaaagccaagaucgugaccgcagagacgcagaacucguccuuuaucaucgacggccccaauacucccgaaugccccagugucucaagagccuggaacgucugggagguggaggacuacggguuugguguuuuuacgaccaacauuuggcucaaguuacgcgagguguauacccaguuaugcgaccaccggcuaaugagcgcagccguuaaggacgaacgugcaguccacgccgauaugggcuacuggaucgagucacaaaagaacggguccuggaagcuggagaaggcgucgcugaucgaggugaaaacgugcaccuggccgaagucccauaccuuauggagcaacgguguccuggaauccgacaugaucauucccaaaagccuggccgggcccaucucccagcauaaucacaggcccggauaccacacgcagacggccgguccauggcaccucgguaagcuggaacuggauuucaacuacugcgagggcaccacuguagugaucacagagaauugcggaacucgagguccgagccuucggacaacgacagugucugggaaacuuauucacgaguggugcugucggagcugcacgcuacccccgcuucgguacaugggcgaggacgggugcugguacggcauggaaauccgccccaucuccgagaaagaggagaauauggucaagucccuaguguccgccggaucggggaagguugacaacuucaccaugggcgugcugugcuuggccaucuuauucgaggaagugaugcgggggaaguucggcaagaaacacaugaucgcaggaguauucuuuaccuuuguccugcuccugaguggucaaauuacuuggcgcgacauggcgcauacgcugauaaugauuggcagcaacgccuccgaccggauggguaugggagugaccuaccuugcccugaucgcaaccuucaagauccagccguucuuggcauugggguucuuccuacgcaagcugaccucccgggagaaccuccuacugggaguggggcuagcgauggccacgacccugcagcugcccgaagacauagaacaaauggccaacgggaucgcgcucggccugauggcgcucaagcucaucacccaguucgagaucuaccaacuguggaccgccuuaaucagccucacgugcucgaacaccaucuucacuuuaaccgucgccuggcgcaccgcaacgcugauucuagcuggagugagccuuuuaccgaugugccaguccagcuccaugaggaagaccgacuggcuccccauggcgguagccgcuaugggcgucccgccacucccguuauucaucuucucacuaaaggacacgcugaagcgccguagcuggccccugaacgagggggugauggccguagggcucgugucgauccuggccucuucgcugcuacgaaacgaugugcccauggcaggccccuuagucgccggggguuuacuaauagcuuguuacguaaucacgggaacauccgccgaccuaaccguggagaaggccgccgauaucaccugggaggaggaggccgagcaaacgggcgucagccacaacuuaaugauaaccguggacgacgacgggacuaugaggauaaaggacgaugagacggagaacauucucaccguacugcugaagacggcccuguuaauugucagcgggaucuuuccguauagcaucccugccaccuugcugguguggcacaccuggcagaagcagacgcagcgguccggcgucuugugggacguccccagcccgcccgagacgcagaaggccgaacuggaggaagggguguaccgcaucaagcagcaagguaucuucgguaagacccagguggggguuggggugcagaaggagggcgucuuucauacuauguggcaugucacacggggugcggugcucacguacaacgggaagcgccuagagccaaacugggccuccgugaagaaggaucugaucucguacggcgggggcuggcggcucagugcccaauggcagaagggagaggagguccagguuauugcuguggagccaggcaagaacccuaagaacuuccagacgaugcccggcaccuuucagaccacgaccggcgaaaucggcgcgauugcccucgauuucaagcccgggacaucgggcagcccaauuaucaaccgagagggaaaggucgugggguuauacggaaacgggguggugaccaagaacggcggcuauguguccggcaucgcgcagaccaacgccgagccggacggacccacgccagagcucgaggaagagauguucaagaaacgaaauuuaaccaucauggaucugcaucccggguccggaaagacgcgcaaguaccuacccgccauaguaagagaggcaauaaaaaggcggcuccguacgcuuauccuggcacccacccgagucguagcagcugagauggaagaagcccugaagggccugcccauacgguaccagaccaccgcgacuaaguccgagcacaccggccgugagauugucgaccugaugugccacgccaccuucaccaugcgcuuacugagcccgguccggguacccaacuacaaccugauagugauggaugaggcccacuucacggaccccgccuccaucgcggcgcgcggauacauuagcacccggguuggcaugggcgaggccgccgccauuuucaugacugcgacgccgcccgggacggccgacgccuucccgcaauccaacgcccccauccaggacgaggagcgugauauccccgagcgcucauggaacuccggaaaugaguggauaaccgacuuugcgggaaaaaccguaugguucguucccagcauuaaggcgggcaacgacaucgcaaacugucuccggaaaaacgggaagaaggucauccagcugucccgaaaaaccuucgacacggaguaccagaagacaaaacucaacgacugggacuucguagugacaaccgauaucagugagaugggagccaacuuuaaagcagaccgggucaucgacccgagaaggugccucaagcccgugauccugacggacggcccggagcgcgugauccucgccgggcccaugccgguaaccgcugccuccgcugcacagcggcggggcaggguggggcggaacccccagaaggagaacgaccaauacaucuuuaccggccagccccucaacaacgacgaggaucaugcccauuggaccgaggcgaagaugcugcuggacaauaucaauacccccgaagguaucaucccggcgcuauucgagcccgagcgggagaaguccgccgcuaucgacggcgaguaccgccugaagggcgagucccggaagacuuucguggagcugaugcgccgcggcgaccuaccagucuggcuggcgcacaagguugccucagagggcaucaaguacaccgaccguaaguggugcuucgacgggcagcggaauaaccagauucuggaagagaacauggacgucgagaucuggaccaaggagggugagaagaagaagcugcguccgagauggcuggacgcccgcaccuacuccgacccguuggcucucaaggaguucaaggaguucgccgcuggccgcaaaagcaucgccuuagaccuugugacggagaucgggcgagugccgucccaccucgcccaucguaccaggaaugcccucgacaaccuggugauguuacacaccagcgagcacggcgggagagcguaccgucacgcaguggaggagcugccagagacgauggagacgcugcuccuccugggccucaugauccuguuaaccgggggcgccaugcuguuucuuaucagcggcaaagggaucggcaagacuuccaucgggcugaucugcgugauagccagcuccggcaugcuauggauggcagagaucccgcugcaguggauagccuccgcgaucguccuggaguucuucaugauggugcuccuaauccccgagcccgaaaaacagcgcaccccacaggacaaucagcucgcauauguagucaucggcauccucacacuggcagccaucaucgccgccaacgagaugggccugcuugagaccacuaagcgugaucugggaaugucuaaagagccgggggucguuagccccaccuccuaccuggacguggaccuacaccccgcuucagccuggacccuguacgcaguggcgaccaccgugaucacacccaugcugaggcacacuauugagaacucgacugccaacgucagcuuggccgcgaucgcaaaccaagcgguugugcugaugggcuuggacaagggguggccgauuuccaagauggaccucggcgucccccugcuggcccucgggugcuacucucaggugaacccccuaacccugacugccgcggugcuucugcugaucacgcacuacgcgaucaucggccccggccuccaggcgaaggccacccgggaggcccagaaacguaccgccgccgggaucaugaagaacccuaccgucgauggcauuaugaccaucgaccuggaccccgucaucuacgauucgaaguucgagaagcaguuaggacaggugauguuauuaguccugugcgcggugcagcuccuucucaugagaaccagcugggcucucugcgaggcccugacccuggccacgggccccauuacgacccucugggagggcucucccgggaaguucuggaauacaacaaucgcgguaagcauggccaacauuuuucgcggcaguuaccuggcaggggccggccuggccuucagcaucaugaaguccgucgggacagguaagaggggcaccggcagucaaggagagacguuaggggagaaguggaagaagaaacuuaaccagcuaucucggaaagacuucgaccucuacaagaaauccggcauaacggagguugaccggacugaggccaaagagggccugaagcgcggagagauuacgcaucacgccgugucacguggcagugccaagcuacagugguucguugaacgcaacauggucauaccggagggacgggucaucgaccucgggugcggaagaggcgguuggagcuacuauugcgcggggcugaagaaggucaccgaggugagaggguacacaaaaggagggccggggcacgaggagcccgugccuaugucaaccuacggcuggaauaucgugaaguugaugagcgggaaggauguguuuuaccucccgcccgagaagugcgauacguuguugugcgacaucggggaauccagccccucgcccaccguggaggaaagcagaaccauuagagucuugaagaugguggagccguggcucaagaacaaccaauucugcaucaagguauuaaauccuuacaugcccaccguuauagagcaucuggagcggcugcagcggaagcaugggggaaugcugguucggaacccgcuuagccgcaauagcacgcacgagauguacuggauauccaacgguacggggaacauaguggccagcguuaauauggugucacgacuccugcugaaucgcuuuacaaugacccaccguaggcccacaauagagaaggacguugaccucggcgcgggcacccgucacgucaacgccgagcccgagacccccaacauggacgugaucggcgaaaggauaaagcguaucaaggaggagcauaacucgacguggcacuaugacgacgagaacccguacaagacgugggcauaccacggcucauacgaggugaaggccacugggagcgcgaguuccaugauuaacggcgucgugaaacugcucaccaagcccugggauguggugcccauggugacccagauggccaugacggacacuacccccuucggccagcaacgcgucuuuaaggagaagguggauacgcgaacgccgcgcagcaugcccggcacccggcgcgugaugggcaucacugcggaauggcucuggagaacccuggggaggaauaagaagccgcggcugugcacgcgcgaggaguucaccaagaaggucagaacuaacgcugcuaugggggccguguucaccgaggagaaccagugggacagugccaaagcggccgucgaagacgaagacuucuggaagcucgucgaccgggagcgcgagcugcacaaacuugggaagugcggaaguugcguguacaacaugauggggaagcgggagaagaaacucggcgaguucgguaaggccaaggggucucgcgcgaucugguauaugugguugggcgcccgguaccuggaguuugaagccuuaggguuccugaacgaagaccacugguucagccgcgaaaauuccuacagcggaguggagggggaggguuugcacaagcucggcuacauccugcgggacauaaguaaaauucccgggggcgccauguacgcggacgacaccgcagggugggacacccguaucacugaggacgaccugcacaacgaggagaagaucacccagcagauggacccggaacaccgccagcuugccaaugccauauucaagcugacauaccagaacaaggucguuaagguacagagaccgaccccaaccggcaccgucauggacauaauaagccggaaggaccagcgcggguccgggcaggucggcaccuacggccugaacacguuuaccaacauggaagcccaacucaucaggcagauggaaggugagggggugcugagcaaggccgaccuagagaauccccaccucccggagaagaagaucacccaguggcuggagaccaagggcgucgagcgccugaaacggauggcgaucuccggcgacgauugcgucguuaaacccauugacgaccgcuucgccaaugcccuccuagcccugaacgacauggggaagguccggaaggacaucccccaauggcaaccgucaaagggcuggcacgacuggcagcagguuccguucugcucccaccacuuccacgagcugaucaugaaggacgggcguaagcuggucguccccugccggccccaggacgagcuuauuggcagagcccggaucagccagggugcuggcuggagccucaaagagacugcaugccuggggaaagccuacgcucagauguggucucucauguacuuccaccgacgcgaccuccggcuggcgucgaaugccaucugcucugccguccccguccacugggucccuaccucgcgcacaaccuggagcauccacgcccaccaccaauggaugacgaccgaggacaugcugaccguguggaaccggguguggauagaggauaaccccuggauggaagacaagacgccggucacgaccugggaaaacgugcccuacuuagggaagcgcgaggaccaguggugugggagccugaucgggcugaccucccgagccaccugggcgcagaacauuccgacggcgauccagcagguacgcucgcucauaggcaacgaggaguuccuggauuacaugcccuccaugaagcgguuucgcaaggaggaggagagcgagggugccaucugguga

SEQ ID NO: 25840 - RNA, 9873 nt, Artificial Sequence
  derived and/or modified CDS sequence (opt11) from DENV-3__HQ705609__SS-prME
accagccucugcuuaaugaugauuuuacccgccgcccuggcguuccaccucaccagccgagacggggagccucgaaugaucguggggaagaacgagcgcggaaaaagccugcuguucaaaaccgcguccgggaucaauaugugcaccuugaucgccauggaccugggcgagaugugcgacgacaccgugaccuacaagugcccgcacauaaccgaaguggaacccgaggacaucgacuguuggugcaaccugaccagcaccugggugacuuacgguaccugcaaccaggcuggcgagcaccggcgcgacaaacgcuccguggcgcucgcgccgcacguaggcauggggcuggacacgcgaacccagaccuggaugucugcugaaggcgcauggcggcaggucgaaaagguggaaacgugggcccuccgccacccgggguuuaccauccucgcacuauuccuggcucacuacaucggcaccucccucacccagaaaguggugaucuucauccugcugaugcucgucacccccagcaugacgaugcggugugugggggugggcaaccgagacuucgucgagggccugucaggggccaccuggguggauguuguccuugagcacggcgggugcgugaccacgauggccaagaauaagcccaccuuagacaucgagcugcagaaaaccgaggccacgcagcucgccacgcuccgcaagcugugcauugagggcaagaucaccaacauaacaaccgacagccgcugccccacgcagggcgaggccaccuugccggaggagcaggaccaaaacuacgugugcaagcacaccuacguugaccgcggguggggcaacgggugcggccucuuugguaaaggcucacuggugaccugcgccaaguuucagugccuggagcccaucgagggcaagguaguacaguacgagaaccucaaguacacggugaucaucaccguccacaccggggaccagcaccaggucggcaacgagacacagggggugacggccgaaauaacaccccaggccaguacuaccgaggcaauccuucccgaguacgggaccuuaggucucgagugcuccccgcgcacgggccuggauuucaaugagaugauccugcuaaccaugaagaacaaggccuggaugguccaccggcagugguuuuucgaccugccacugccuuggaccaguggcgccacgaccgagacacccaccuggaaccgcaaggagcuacuagugacuuuuaagaacgcccacgccaagaagcaagaaguggucgugcuggggucccaggagggcgcuaugcauacggcccucaccggggccaccgagauccagaacagcggggggaccuccaucuucgccggacaccucaagugccgacugaagauggauaagcucgagcugaagggcaugagcuaugccaugugcaccaacacauuuguguugaagaaggaagucuccgagacccagcacgguacaauccucaucaaagucgaauacaagggcgaggaugucccaugcaagauucccuucagcacggaagaugggcaagguaaagcacacaacggccgcuuaauaacugccaaccccgucguuacuaagaaagaggagccagugaacaucgaggccgagccgcccuucggggagagcaacauugucaucggcaucggggacaacgcccugaagaucaacugguauaagaagggcuccagcauagggaagauguucgaggcgaccgcacguggcgcgcgacggauggccauacugggggacacugccugggacuucgggagugugggcgggguucucaacagccuuggcaagaugguccaccaaaucuucgggucugccuacaccgcccuguucagcggcguguccugggucaugaagaucggcaucggagucuuacugaccuggaucgggcuuaacagcaaaaacacuuccaugagcuucucuugcaucgccaucggaaucaucacgcucuaccugggcgccgucgugcaggcggacauggggugcgucguaaacuggaaaggcaaggagcucaaaugcgguagcgggauuuucguuaccaacgagguacauacuuggaccgagcaguacaaauuccaggcggacuccccuaaacgcuuagccacggccaucgcgggggcuugggagaacggggugugcggcauaagguccaccacccggauggagaaucugcuguggaagcagaucgcgaaugagcugaacuacauccugugggagaacaacauuaagcugaccguaguugugggugacaucaucgggguacuggaacagggcaagcgcacauuaaccccgcaaccuaaagaacugaaguacaguuggaaaaccuggggaaaggccaagaucgucaccgccgagacgcagaacagcucguuuaucaucgacggccccaacacccccgaaugcccaagcgucucccgggccuggaacguuugggagguggaggacuacgguuuugggguguucacaacuaacauaugguugaagcucagagaggucuacacccagcugugcgaccaucggcucaugagcgcggccgugaaggaugagcgcgccgugcaugcggauauggguuauuggaucgagucgcagaagaaugggucuuggaagcucgagaaagcaagccucaucgaggugaagacgugcacguggccaaaaagucacacccucuggagcaacggcguccuggaauccgacaugaucaucccaaagagccuggcggggcccauaucccagcacaaucaccguccgggcuaccacacccaaacagccgggcccuggcaccucggcaaacuggagcucgacuucaacuacugugagggcacuaccguaguaaucaccgagaacugugggacucgcggacccagucuccggaccacaacagucuccgggaaacugauacacgaguggugcugccgcagcugcacguugccgccguugagauacaugggugaagacgggugcugguacggcauggagauccgucccaucuccgaaaaggaagagaacaugguuaagagccugguuuccgcgggcagcgguaagguugacaacuuuaccaugggugugcugugccucgccauccuguucgaggaaguuaugcggggcaaguucggcaagaagcauaugauugcuggggucuucuucaccuucguccugcuccuguccggccagaucaccuggagggacauggcgcauacgcugauuaugauaggcaguaacgccagcgaccgaauggggaugggcgugaccuaccucgcccugauugcuaccuucaaaauccagcccuuccuggcucucggguuuuuucugaggaagcugaccagcagggagaaccuccuacucggcgucggccucgcaauggccacuacccuacaguuaccugaggacauugagcagauggcaaaugggaucgcccucggcuugauggcguugaaauugaucacccaguucgaaaccuaccagcuguggacagcucucaucagccugaccugcagcaacacaauuuucacgcugacgguggccuggcgcaccgcaaccuuaauccuagccggugugucguuauuaccggugugucaguccucauccaugcguaaaacggacuggcuccccauggcgguggccgccaugggcguuccgccccucccucuguuuauuuuuagccuaaaggauacgcugaagcgccgcuccuggccucugaaugaaggggugauggccgucggucucgucucgauccuggccuccucccugcuccggaacgacgugccgauggcgggcccccuuguggccggggggcugcucaucgccuguuacgucaucaccgggacuagcgcagaucugaccguggagaaggcggcggacaucacaugggaggaggaagcugagcagaccggcgugagccacaaccugaugauuaccgucgacgacgacgggaccaugcgcaucaaggacgacgagaccgagaacauccucacgguguuacugaagaccgcacuccugaucguguccggcaucuucccguacagcaucccggccacccuguuggucuggcacacauggcagaagcaaacgcagcgauccggcguacuuugggacgugcccagcccgcccgagacccagaaagccgagcucgaagaaggggucuaccgcaucaagcaacagggcauuuucgggaagacccaggugggaguaggaguccagaaggagggcguguuccacaccauguggcacgucacgaggggcgcgguucuuaccuacaacgggaagaggcuggagccgaacugggcgucagugaagaaggaucugaucagcuacggcggcggcuggcgacucuccgcacaguggcagaagggggaggaggugcaggucaucgccguggagccuggcaagaaccccaagaacuuccagacgaugcccggcaccuuccagacgaccaccggggagaucggcgcgaucgcacuugacuucaagcccggcaccagcgggucgccgaucaucaaccgcgagggcaaggucgucggguuguacggcaacgggguggugacgaagaacgguggguacguguccggcaucgcccagacaaaugcagagccggacggccccacucccgaacuggaggaggagauguucaagaagcggaaccucaccaucauggaccuucaccccgggucgggaaaaacgcgcaaguaccugccggcuaucgugcgggaagcgauaaagagacggcuacggacccugaucuuagcccccacacgaguugucgcggccgagauggaagaagcccucaaggggcugcccauccgcuaccaaaccacagcgacuaagucugagcacacuggccgggagaucguggaccugaugugucaugccaccuucacgaugcgccugcugucccccguacgaguuccgaauuauaaccugaucaucauggaugaggcgcacuucaccgaucccgccuccaucgccgcgcgcggguacaucagcacccggguggggaugggcgaggccgccgcuauuuucaugaccgcgacgccgccugggaccgcggaugccuuuccgcaguccaacgcccccauccaggacgaggagcgggacauucccgagcgcagcuggaacuccggcaacgaguggaucaccgacuucgcagggaagaccguuugguucguccccagcaucaaagcgggcaacgacaucgccaacugccucagaaagaacgguaagaaggugauccagcugucccgcaagacguucgacaccgaguaucaaaagaccaagcugaacgauugggacuucguggucaccacggacaucagcgaaaugggggccaacuucaaggccgaucgcguuaucgacccccggcggugucucaagccugugaucuuaaccgacgggcccgagagagucauacuggcggggcccaugccugugacugcggccagcgccgcccagcggagaggccgggugggucgcaacccccagaaagagaacgaccaauacauuuucaccggccagccccucaacaacgacgaggaucacgcccacuggaccgaggcgaagaugcuguuagacaacaucaacacgcccgaggggaucaucccggcccucuucgagcccgagcgggaaaaguccgcggccauugauggggaguaccgucugaagggcgagucccgcaaaaccuucguugagcugaugcgcagaggggaccucccuguguggcuggcgcauaagguagccagcgagggcauuaaguauaccgaccgcaagugguguuuugacgggcagcggaauaaccagauauuagaggaaaacauggacgucgagaucuggaccaaggagggcgagaaaaagaaacuccgcccccgguggcuggacgccagaacguacagugacccucuggcgcucaaggaauucaaggaguucgcggcaggcaggaagucaauagcccuggaccuggugaccgagauaggucgagucccgucccaccucgcccaccgcacccguaacgcuuuggacaaucugguaauguugcauacgagcgagcacggcggccgcgcguaucggcacgcgguggaggaauugcccgagacgauggaaaccuugcuccuccugggacucaugauucugcugacggggggcgccaugcucuuucuaaucucgggcaaagggaucgguaagaccuccaucggacugaucugcgucaucgccagcuccggaaugcucuggauggccgagaucccgcugcaguggauugccagcgcuauaguguuagaauucuucaugauggugcugcugauccccgagcccgagaaacagcgcacgccacaggauaaccagcuggccuaugucguuauugggauacucaccuuggcagccaucaucgccgcgaaugagaugggccugcucgagacgacgaagagagaucugggcauguccaaggagccggggguugucagccccacguccuaccuggauguggaccuccaccccgccagcgcauggacccucuacgccguggcgacaacggugaucacaccaaugcugcgccacaccaucgaaaacaguaccgcgaacgugucauuggccgcaauugccaaccaggcugugguccugaugggccuagauaagggauggccgaucuccaagauggaccucggcgugccccugcuggcucucgggugcuacucacaagucaaccccuuaacccugacggcggccguucuccugcugauuacccacuaugccaucaucggccccggccuccaggcaaaggccacccgggaggcccaaaagcgcaccgccgcggggaucaugaagaaccccacgguagacggcaucaugacgaucgacuuagaccccguuaucuaugacuccaaguucgagaagcagcuggggcaggucaugcuacuggugcucugcgcgguucagcuccugcugaugaggaccagcugggccuuaugcgaagcccugacccuggcgaccggccccaucaccacgcucugggagggcuccccuggaaaauucuggaacacuacgaucgcggucagcauggccaacaucuuucgcggcuccuaccuggccggugcaggguuagccuucuccauuaugaaguccguugggaccggcaagcgggggaccgggucucagggcgagacgcucggcgagaaguggaaaaagaagcugaaccagcugagccgcaaggacuucgaccucuacaaaaagagcgguaucaccgagguggaccggacggaggcgaaggagggucugaagcgcggggagauaacccaccacgccgucagccgcggcuccgcgaaguugcagugguuuguggagcgcaacauggugaucccggaagggcgggucaucgaccuggggugcgggcgcggagguuggagcuauuacugcgccggccugaagaaggugaccgagguccggggcuauacuaaggguggaccgggccacgaagagcccguaccgauguccacguauggcuggaacauaguuaagcugaugagcggaaaggacguuuuuuaccucccgccugagaagugcgacacccugcugugcgacaucggcgaguccagccccuccccuaucguagaagagucaagaaccaucagagugcuuaagaugguggagcccuggcucaagaacaaccaguucugcauaaaggucuuaaaucccuauaugccuaccgugaucgagcaucuggagcggcugcaacgcaagcacggcgggaugcuggugcggaauccgcugucccguaacucuacacaugaaauguauuggaucuccaauggcaccgggaacaucgucgcauccgugaauauggugucccggcuccugcugaaccgcuucaccaugacccaccggcgcccgacaauugagaaagacguggaccucggcgcgggcacccggcaugucaacgcagagcccgagacgcccaacauggacgucauaggugagcgcaucaaacggauaaaagaggaacacaacaguaccuggcacuaugacgacgagaacccguauaaaacaugggcauaccacggcuccuacgagguaaaggccaccgggagcgcauccaguaugauuaacggcguggucaaguugcugaccaagcccugggacguggugcccauggucacccagauggcgaugacggacaccacccccuucggccagcagcgcguguuccgggagaagguggacacccguacuccucggagcaugccgggcacccgccgggucauggguaucaccgccgaguggcucuggcgcacccugggccggaacaagaaaccacgccugugcacccgcgaggaguucaccaagaaagugagaaccaaugccgccaugggagcggucuucacagaggaaaaccagugggacuccgccaaggccgcggucgaggaugaggacuucuggaagcuaguggaccgcgagcgggagcuacacaagcuggggaagugcgggagcugcguuuacaauaugauggggaaaagagagaagaaauugggcgaguucggcaaggccaaaggguccagagcgaucugguacauguggcugggcgcccgcuaccuggaguucgaggcccucggguuccugaacgaggaccacugguucucccgggagaacuccuauagcggcgucgagggggagggacuccauaaacuuggcuauauacugcgcgauauuagcaaaauacccgguggcgccauguacgccgacgacacugcggggugggacacaagaaucaccgaggaugaccuucacaaugaagagaagauaacccagcagauggaccccgagcaccgccagcucgcuaacgcgaucuucaagcugacguaccagaacaagguugugaaggugcagcguccaacgccaaccggcacugugauggacaucaucagucgcaaggaccagcgaggcucuggccaggugggcaccuacgggcugaacacguucaccaacauggaggcccagcucauucgccagauggaaggcgaggggguccugagcaaggcugauuuagagaacccccaccucccggaaaagaaaaucacccagugguuggagaccaagggcguggaacggcugaaacgcauggcgaucucuggcgaugacugcgugguaaaacccauagacgaccguuucgccaacgcacuccuggcccugaacgacauggggaaggugcgcaaggacaucccccaguggcagccuucaaaggguuggcacgacuggcaacaaguaccuuucugcucccaccacuuccacgaguuaaucaugaaggaugggcgaaagcuggucgugcccugccgcccccaggaugagcugaucggccgggcccgcaucagccagggcgcgggcugguccuugaaggagacggcgugccuggggaaagcguacgcccagauguggagccugauguacuuucacagacgggaccuccgccuggcguccaaugccaucugcuccgccgugccgguccacugggucccgaccucccggaccaccuggucgauacaugcccaccaccaguggaugacaaccgaagacaugcugaccguguggaacagagucuggauugaggauaauccuuggauggaggacaagacccccgugacgacgugggaaaacguuccauaucucgggaagcgugaggaccaguggugcggaagccugaucgggcugaccucacgcgccaccugggcgcagaacauuccgacggcaauccaacaaguccguagccucauuggcaacgaggaguuucucgacuacaugcccuccaugaagagauuccggaaggaagaggagagcgagggggcaaucugguga

SEQ ID NO: 25841 - RNA, 9873 nt, Artificial Sequence
  derived and/or modified CDS sequence (opt11) from DENV-3__HQ705610__SS-prME
accagccucugcuugaugaugauccugccugccgcccuagcguuccaccucaccucacgggacggggagcccaggaugaucguggggaaaaacgagcguggaaaaagccuguuguuuaaaaccgccuccgggauaaacaugugcacacuuaucgccauggaccugggggagaugugugacgacaccgugaccuacaaaugcccccacauuaccgagguggagcccgaggacaucgacugcuggugcaaccugaccagcaccugggugacauacgggacgugcaaccaagcgggggaacaucggcgggacaagcggucaguggccuuggcgccucacgugggaauggggcuggacacccguacacagacuuggaugagcgcagaaggcgccuggcgccaggucgaaaaggucgaaacgugggcccugaggcacccuggguuuaccauucucgcucuguucuuagcccacuacauuggcacaucccucacccagaagguuguaaucuucauacugcucaugcuggucacccccuccaugaccaugcgguguguugggguggguaaccgcgacuucgucgagggccuguccggggccacguggguggacguggucuuggagcacggcgggugcgugacuacgauggccaagaacaagcccacccuagacaucgagcugcagaagacugaagccacccaauuagccacgcuccguaagcuguguauugagggcaagaucaccaacauaaccaccgauucuaggugcccgacgcagggcgaggccacccugccggaagagcaggaccaaaacuacguaugcaagcacaccuacgucgaccggggguggggcaacggcugcggccucuucgguaaaggcucgcuagugaccugcgccaaauuccaaugccuggagcccaucgagggcaaggugguacaauacgagaaucuaaaauauacgguaaucaucacagugcacacuggggaccagcaccaagucggcaacgagacgcaagggguuacggccgagauaacaccucaggccucuacaaccgaagcuauacugcccgaguaugguacccuggggcucgagugcucuccgcgcacgggccuagacuucaacgaaaugauccugcucaccaugaagaacaaggccuggaugguccacaggcagugguuuuucgaucuaccccugcccuggaccagcggcgcuaccacggaaacccccaccuggaaccgcaaggagcugcuggucacuuucaagaacgcccacgcgaagaagcaggagguggugguucuggggagccaggagggcgcgaugcacacugcccugacuggggcgaccgagauccagaacagcggcggcaccucuaucuucgccggccaucugaagugucgguuaaagauggauaagcucgagcugaagggcaugagcuacgcaaugugcacuaacaccuucgugcuaaagaaggagguaucugagacccagcacgggaccauccucaucaaaguggaauacaagggcgaggacguuccaugcaagaucccuuucagcacugaggaugggcaaggcaaagcgcacaacggucgccucaucaccgccaaucccgucgugaccaaaaaagaggagcccgugaacaucgaggccgagccacccuucggggagagcaacauagucauaggaaucggggacaacgcgcugaaaauuaacugguacaaaaagggcuccagcaucgggaaaauguucgaggccaccgcgcggggggcccgccggauggccauccugggcgacacggccugggacuuuggguccgugggagggguccucaacagccuggggaagaugguccaccagaucuucggcuccgcguacacugcccucuucuccggcguguccugggugaugaagaucggcaucgggguccuccugacuuggaucggccugaacagcaagaacaccaguaugagcuucuccugcaucgcgaucgggauaauaacgcucuaucucggugccgugguccaggcagacauggggugcgucauuaauuggaagggcaaggagcucaagugcgguagugggaucuuuguuaccaaugaggugcauaccuggacugagcaguacaaguuccaggcggauagucccaagcggcucgccacggccauugccggcgccugggaaaacggggucugugggauccggucuacuacccguauggagaaccuguuauggaagcagaucgcgaacgagcucaacuacaucuuaugggagaacaacauaaagcugaccguuguugucggcgacauuaucggcgugcucgagcagggcaagcgcacucugacgccccagccuauggagcugaaguacuccuggaagaccugggguaaggccaagaucgugacagcugaaacgcaaaauagcuccuuuauaaucgacggccccaacacccccgagugccccucggucagccgggcuuggaacgugugggagguggaggacuacggguucggaguauucacuaccaacaucuggcucaaacuacgggaggucuacacccagcugugcgaccaucggcucaugagcgcggccguuaaagacgaacgcgccguccacgccgacaugggcuacuggauugaaagccagaagaacggcagcuggaaguuggaaaaagcgagccucaucgaggucaaaacaugcaccuggccgaagagccacacaauauggagcaacggagugcuggaguccgacaugauuauacccaagagccuggcggggcccaucucgcagcacaaccaucggccggguuaucacacccaaacggccggucccuggcaccugggcaaacucgaauuagacuucaacuauugcgaggggacaaccgucgucaucacagagaacugcgggacccgcggccccagccugcguacuaccacuguguccgguaaguugauacacgaauggugcuguaggagcugcacgcugcccccguugcgguauaugggagaggacggaugcugguacggcauggagauccgccccaucucugagaaagaggaaaacauggucaagagcuuaguguccgcggguagcgguaagguggacaauuuuaccaugggcgucuugugccuagcuauccuuuucgaagaagugaugcgggggaaauucggcaaaaagcacaugaucgccgggguguuccugaccuucguacuucuccuguccggccagauaacauggaaagacauggcgcacacccuaauuaugaucggcaguaacgccuccgacaggaugggaaugggagugaccuaucucgcccugaucgccaccuucaaaauccaacccuuucucgcccucggguucuuccuccggaagcucacgucgagggaaaaccuccugcugggggugggccuggcgauggccacuacccuccagcuaccggaagacaucgagcagauggcuaaugggaucgcgcucggacugauggcgcugaagcucaucacgcaguucgagaccuaccagcuguggacggcccugaucagccugaccugcuccaacaccaucucgacccugacuguggcuuggcggaccgccacacuaaucuuggccggagugucccugcugcccguaugucaaagcucgagcaugcgcaagaccgacuggcuaccgauggcgguugccgcgaugggcguuccgccacuuccgcuguuuaucuuuucucucaaagacacgcuaaagcggcgcucuuggccucugaaugagggggucauggccgugggcuuggucuccauacuugcaagcucccuucuccgcaacgacguacccauggccgggccccugguggcugggggacugcucaucgccuguuauguuaucaccgggaccagcgccgaccuaaccgucgagaaggccgcggacaucacgugggaagaggaggcggaacagaccggcgucucccauaaucuaaugaucaccguggacgacgacgggacaaugagaaucaaggacgacgaaaccgaaaauauucucacaguccugcugaaaaccgcacuccucaucgugagcggcaucuucccguacucgauacccgccacccucuuaguguggcauaccuggcagaagcagacccagcgcagcggcguccugugggaugugcccucgccgcccgaaacccagaaggccgagcuggaagaagggguuuacagaauaaagcagcaaggcaucuucggaaagacccaaguuggagugggggugcagaaggagggagucuuucacaccauguggcacguuacgcgaggcgcggugcugaccuauaacgggaagcggcuggagcccaacugggcuagcgucaaaaaggaccugaucucguacggcgggggcuggcgacucagcgcccaguggcagaagggggaggagguccaggugaucgccguggaaccgggcaagaacccgaaaaacuuucaaaccaugccgggcacguuccagacgaccacaggggagauaggggcgaucgcguuggauuucaagcccgggaccuccggcuccccuaucaucaaccgggagggcaaggugguggggcuguauggcaacggcgucgugacgaagaauggcggguacgugagcggcaucgcacagaccaacgcagagccugacggccccacccccgaacuggaggaggagauguucaagaagcgcaaucucaccaucauggaucuucaccccggcucuggcaaaacgcggaaauaccuaccggccauaguccgcgaggcgauuaagaggcgccuccggacccugauccuggcucccacccggguaguugcugcggagauggaggaagcccucaagggacugcccauucgguaccagaccacggcgaccaagagcgagcacaccggccgcgagauuguagaccugaugugucacgccaccuucacuaugcgacuccugucaccgguuagagugccuaacuacaaccugauaaucauggaugaagcucacuucacugaccccgccagcaucgccgcgcguggguacaucucuacccgugucggcaugggcgaggcggccgccaucuucaugacagcuacgcccccugggaccgccgacgccuuuccgcaaagcaacgcgcccauacaggacgaggaacgugacauccccgagcggucuuggaacagcgguaaugaguggaucaccgacuucgccgggaaaaccgucugguucgugccuuccaucaaggcgggaaacgacauugccaauugucuuagaaagaacgggaagaagguuauccagcugucgaggaagacguucgacaccgaguaucagaaaaccaagcugaacgauugggacuucguggucaccacggauaucuccgagaugggcgccaacuucaaagccgacagagucaucgaccccagacggugccuuaagccggugauccugacagauggccccgagcgggugauccuagccggacccaugcccguaacggcggccucggcagcccagcgcagaggcaggguugggcggaacccacaaaaggagaacgaccaguacaucuucacgggccaaccccugaacaacgacgaggaccacgcccacuggacggaagcuaaaaugcugcucgacaauauuaacacacccgaggggauaauaccagcccucuucgaaccggagcgcgagaaguccgccgcuaucgacggcgaguaccggcugaaaggggagagccgcaagaccuuuguggagcugaugcgccgcggggacuuacccguaugguuagcucauaaggucgccucagaggggaucaaguacaccgaucgcaaguggugcuucgauggacagaggaacaaccaaauccuagaggagaacauggacgucgagaucuggaccaaggagggugagaagaagaaacuucggccgcgcugguuagacgcccgcacguacagcgacccccucgcccucaaggaguucaaggaguucgccgcaggccgcaaguccauugcccuggaccuggucacggaaaucggccgugugcccucacauuuagcucaccggacccguaacgcccuggauaaccugguaaugcuccacacuagcgagcacggggggcgggccuaccgccaugcuguggaggagcugccugaaacgauggagacuuugcuccuacugggccucaugauccugcuuaccgggggcgcaauguuauuccugaucucggguaaggggaucgguaagaccagcaucggacugaucugcgugaucgccuccagcgguaugcucuggauggcagaaaucccguugcaguggauugccuccgcgaucguacuggaguucuuuaugauggugcuccugaucccagagccagagaagcaacggacgccucaggacaaccagcuggcauacguugucaucgggaucuuaacacuugccgccaucaucgcugcgaaugagaugggacugcucgagaccacgaagcgcgaccuggguaugagcaaagagccgggaguggugucgcccacuagcuaccuggacgucgaccuccaccccgccuccgccuggaccuuauacgccguggcgacgaccgugauaacacccaugcugcggcacaccaucgagaacagcaccgccaacgugucccuugccgcaaucgcgaaccaggcggugguguuaaugggcuuggacaagggguggcccauaagcaaaauggaccuaggcgucccccuacuggcccucggaugcuacagccagguaaacccccugacguuaacggccgcuguacuccuguugaucacacauuacgccauuauaggcccgggccuacaggcuaaggccacccgggaggcacaaaagcggaccgcugccgggaucaugaaaaacccgacggucgacggcauuaugacgaucgauuuagaccccgugaucuacgacagcaaauucgagaagcagcugggccaggucaugcuccugguacugugcguggugcagcuccugcugaugcgaaccaguugggcgcucugcgaggcccugacuuuggccacgggccccaucaccacccuuugggaggguagucccggcaaguuuuggaacacaacgaucgcggucucuauggccaacaucuuccggggcagcuaccuggccggggcuggccuggccuucuccaucaugaaguccguggggaccgggaagaggggcaccggcucucagggcgagacccucggggaaaaguggaagaaaaaguuaaaccagcuaucccguaaggacuucgaccucuacaagaaauccggcaucacggaaguggacaggacggaggcuaaggaggggcugaagaggggcgagaucacccaccacgcggucucgcgcggcucagccaaguuacaaugguucguggagcgaaauauggugaucccggaggggcgcgucaucgaccucggcugugggcggggcggaugguccuacuacugcgcaggccugaagaaagugaccgaggugcguggcuacaccaagggcgggccggggcacgaagaacccguccccaugagcacguaugguuggaacaucgucaagcuaaugucggggaaggacguguucuaccucccgcccgagaaaugcgacaccuugcugugcgauaucggcgagagcucgcccucaccaacagucgaggaaucccggaccauucgcgugcucaagaugguggaacccugguugaaaaacaaccaguucugcaucaaggucuuaaaccccuacaugccaacgguaaucgaacauuuagagcgcuuacagagaaagcacggcgggaugcugguacgcaaucccuuaagccgcaacucuacccacgagauguacuggauaagcaacggcacagggaacaucgucgcguccgugaacauggugagccgccuccugcucaaccguuucaccaugacgcaccgucggcccaccaucgagaaggacgucgaccucggcgccggaacucgccacgugaacgccgagcccgagacccccaacauggauguaaucggggagcgaaucaagcgcaucaaggaggagcacaacuccacguggcacuacgaugaugagaacccguacaagacgugggccuaccauggaagcuacgagguaaaggcaaccggguccgcgagcagcaugaucaauggaguggucaagcugcugaccaagccaugggaugugguacccauggucacgcagauggccaugacagacaccacccccuucgggcagcagcgggucuucaaggagaagguggauacgaggaccccgcgguccaugcccggcacacgccgggucauggguauaaccgcggaguggcucuggaggaccuuggggcggaacaagaagccucggcuguguaccagagaggaguucacgaagaagguucgcaccaacgccgccaugggcgccguuuucacggaggaaaaccagugggacucggcgaaggccgccgucgaggacgaagacuucuggaaacucguggaccgggagagagagcuccacaagcuugggaagugcggcucaugcguguacaauaugauggggaagagagaaaagaagcucggcgaguucggcaaagcuaagggguccagagccauuugguacauguggcugggcgcgcgcuacuuggaguuugaggcgcucggguuucugaacgaggaucacugguucagccgggaaaacagcuacuccggcgucgagggggaggggcugcacaaguuaggguacauccugagggacaucagcaaaauccccgggggagccauguacgccgacgauacugccgggugggacacgagaauaaccgaggacgaucuucauaaugaggaaaagaucacucaacagauggacccggaacaucgacaguuagcaaacgcgaucuucaaguuaaccuaccaaaacaagguugugaagguucagcggccuacccccaccggcaccgugauggacauaaucucccgcaaggaccaacggggcagcggccaggugggcacguacggguuaaacaccuucaccaacauggaggcccagcucauccgccagauggagggcgagggagugcuguccaaagccgaccuggagaacccgcaucucccggagaagaagaucacccaauggcuagagaccaaggguguggaacgacugaagcgcauggcuaucagcggcgacgacugcgugguaaagccuaucgaugaccgguucgcgaacgcacugcuggcccugaaugacauggggaaggugcgcaaggacaucccucaauggcaacccuccaaggguuggcaugauuggcaacagguucccuucugcagucaccacuuccacgaauuaaucaugaaggacggucggaagcuggucguccccugccggccgcaagacgaacugauaggccgggcuaggaucucccaaggggccggauggagccuaaaggagaccgcgugucuugggaaggccuacgcccagaugugguccuugauguacuuucaccggcgcgaucuucgucuggcaagcaacgccauaugcuccgcuguccccguucacugggugccuaccucgcgaaccacguggucgauccacgcacaccaccaguggaugaccaccgaggacaugcugacgguguggaaccgcgucuggaucgaggacaauccguggauggaggauaagacgccugugaccaccugggagaacgugcccuaccuugggaagcgagaggaccaguggugcggcucacugaucggguuaaccagccgagcaacgugggcccaaaauauuccgaccgcuauccagcaagugcggucacucaucggcaacgaggaguuucuggacuacaugcccaguaugaagcgcuuccggaaggaagaggagagcgaaggggccaucugguga

SEQ ID NO: 25842 - RNA, 9873 nt, Artificial Sequence
  derived and/or modified CDS sequence (opt11) from DENV-3__HQ705611__SS-prME
accagucugugccuaaugaugauccucccugcagcccuagcguuccaccucacuagcagggauggcgaaccacggaugaucguagggaagaacgaaaggggcaagucgcugcuguucaaaaccgcuuccgggaucaacaugugcacccucaucgccauggaccugggcgagaugugugacgacacugugaccuauaaaugcccccacaucaccgagguggaacccgaggacauugauugcuggugcaaccugacaagcacgugggugaccuacgggaccugcaaccaggccggcgagcaucggcgcgacaagcggucuguggccuuggcgccccacgugggcaugggguuggacacgcgcacccagacguggaugagcgcugagggggccuggcgccaagucgagaaggucgagacgugggcccuucgccaccccggguucaccauccucgcgcuguucuuggcccacuacaucggcacgagcuugacccagaaagugguaaucuuuauacugcugaugcucgugacgcccagcaugaccaugcggugcguggggguuggcaacagggacuucgucgagggacugaguggugccacauggguagacgugguccuugagcacggcgguugcguaaccacuauggcgaaaaacaaacccacccucgauaucgagcuccaaaagaccgaggccacacagcuggcgacgcucagaaagcugugcaucgagggcaagaucaccaacaucacuaccgacagccgcugccccacgcaaggcgaggccacccugccggaggagcaagaucagaacuacgugugcaagcacaccuacgucgaccggggguggggcaacggguguggcuuguucggaaaagguucccuggugaccugcgccaaguuccagugccuggaacccaucgagggcaaaguggugcaauacgagaaccucaaauacacggugaucaucacuguccacaccggugaucagcaucaagucggcaacgagacccaaggggugacggccgagaucacaccccaggcgagcaccaccgaggcgauccugccagaguacggcacgcuggggcucgagugcuccccgcgcacgggcuuggauuucaacgagaugauccugcucaccaugaagaauaaggccuggaugguucaucggcagugguuuuucgacuugccacugccguggaccagcggcgccacuacagagaccccaaccuggaaccgcaaggagcuacuggugaccuucaagaaugcgcacgcuaagaagcaagagguugucgugcugggcagccaggagggcgcaaugcacaccgcccucaccggggccaccgagauccagaacaguggcgguaccucuaucuucgcaggccaccugaagugcagguugaagauggauaagcucgagcugaagggcaugagcuaugccaugugcacuaacacauucguucugaagaaggaagucuccgagacacagcacggcaccauccucaucaagguggaguauaagggagaggacgugccgugcaagaucccauucagcacggaggacgggcagggcaaggcacacaacggccggcugaucaccgcaaacccggucgugaccaagaaggaggagcccgugaauaucgaggccgaaccgccauuuggagaaagcaauauugucaucggcaucggggacaacgcccuaaagauaaacugguacaagaaaggauccagcaucgggaagauguuugaggcgaccgcccggggcgcccgucggauggcaaucuuaggagacacggccugggacuuugggucagugggagguguucucaacagccuuggcaagaugguccaccaaaucuucgguuccgcguacacugcccuguucagcggaguuuccugggugaugaaaaucggcauaggaguccuccugacauggaucgggcugaacagcaaaaacacuucaaugagcuucucaugcauagcuaucgguaucaucacucucuaccugggcgccguggugcaggccgauauggggugugucaucaacuggaagggaaaggaguuaaagugcggcaguggaaucuucgugacgaacgaggugcacacuuggaccgagcaguacaaauuccaggcagacuccccgaaacgccucgccacugcgaucgcuggcgcuugggaaaaugguguuugcggcauacggagcacuaccaggauggagaaccugcuguggaagcagaucgccaacgagcucaacuacauccuuugggaaaauaauauaaagcugaccgucguggucggggauauaaucggugugcucgagcaggggaagcgaacgcugacuccccagccgauggagcucaaguacuccuggaaaaccuggggcaaggccaagaucgugacagcggagacacagaacagcuccuuuaucaucgauggucccaacacaccggagugccccuccgucucccgggccuggaaugugugggagguggaggacuacggguucggcguguucaccaccaacaucuggcucaaacugcgagagguguacacucaacugugugaccaccguuugaugagcgcagccgugaaggaugagcgcgcaguucacgccgacaugggguacuggaucgagucgcagaaaaacggguccuggaagcuggaaaaggccagccugaucgaggugaagacgugcacuuggccuaagucccauacccucuggucaaacggcgugcuggaguccgacaugaucauccccaagagccuggcggggcccaucagucagcacaaccaccggccaggcuaccacacccagacggccgggcccuggcaccucggcaagcucgaacuggauuucaacuacugcgagggcaccaccgucgugaucaccgagaacugugggacgaggggucccagccuccggaccaccaccguauccgguaaguuaauucacgaauggugcugccgcucgugcacgcugcccccgcuccgguacaugggcgaggacggguguugguacggcauggagauucgccccaucuccgaaaaggaggagaacauggucaaaagccuggugucagcuggcagcgggaagguggacaauuucaccaugggcguccuuugccucgcgauccuguuugaggaggugaugcgggggaaguucggcaaaaagcacaugaucgccgggguuuucuucaccuuuguccugcucuuauccggacaaaucaccuggagggacauggcgcacacgcuuaucaugaucgguagcaacgccuccgaucggauggggaugggaguaaccuaccucgcccugaucgccacauucaagauacagcccuuccuggcucuuggguucuuccuccgcaaguuaaccagccgagagaaccuccugcugggcgugggccucgcgauggcaacgacacugcagcuacccgaggacaucgagcagauggccaacgggauugcccucggccuaauggcgcuaaagcucauaacccaguucgagaccuaccagcuguggaccgcccugauuucacuaacuuguuccaacaccaucuucacccugacggucgccuggcggacugccacccuaauccucgccggagugucucuacugccagucugccaguccuccuccaugcgcaagaccgacuggcuccccauggcaguggccgcgaugggcgugccaccccucccgcuuuucaucuucgggcucaaagacacccugaagcgcagaagcuggccccugaacgagggcgucauggccgugggucucgucuccauccuggcaucaucccuacuccggaaugacgucccuauggcggggccccuaguggccggcggccuucucauugccugcuacguaauuacagggaccagcgcggaccucacuguagagaaggccgcggacauaacgugggaagaggaggccgagcaaacgggggucucccacaaccugaugauaaccguagacgacgacggcaccaugcgcauuaaggacgacgagacagagaacauccugacggugcugcugaagaccgcccuccugauagugagcgguaucuucccguacucaaucccggccacccugcugguguggcacaccuggcagaagcagacgcagcguagcggggugcugugggacgugccaucaccgccggagacacaaaaggcugagcuagaagaaggaguguaccgcaucaaacaacaaggaaucuuugggaagacccaggucggggucgggguacagaaggaagggguauuccauaccauguggcacguaacgagaggggcggugcuuaccuauaauggcaaacgccuggaaccaaacugggccagcgucaagaaggaccugaucaguuacggagggggcuggcguuuaucagcgcaauggcagaaaggagaggaaguucagguuaucgcggucgagccaggcaaaaaucccaagaacuuucagaccaugcccgggacguuucagacgacgaccggggaaaucggggcuauagccuuagacuucaagccggggaccagcggcucccccauuauaaaccgggaagggaagguggugggucuguacgggaauggggucguuacgaagaacggaggguacguuaguggcauugcacaaacuaacgccgagccugacgggcccacccccgaacuggaggaggagauguucaaaaagagaaacuuaaccauuauggaccugcaccccggaucaggaaagacgcgcaaguaccugccagccaucguacgggaagcgaucaagcggcgccuccgcacccugauccuggcccccaccaggguggucgccgccgaaauggaagaggccuugaagggccugcccauccgcuaccaaaccacggcgaccaaaucggagcacaccgggcgggagaucgucgaccugaugugccacgccaccuuuacuaugcgccuccuguccccggugcgagugccgaacuacaaccugaucaucauggacgaggcacauuucaccgacccagcuagcauugccgcgcgaggcuauaucuccacacgggucggcaugggggaggccgccgccaucuucaugaccgcgacgccuccaggcaccgcagacgccuucccgcaaagcaaugcgcccauccaagacgaggagcgcgauauuccugaacgcagcuggaacagcgguaacgaauggaucaccgauuuugcaggcaagacaguaugguucgugcccuccaucaaggcgggaaacgacaucgccaacugucuccggaaaaacggcaagaaggucauccagcugagccgcaagacguucgacaccgaauaccagaagacaaagcugaacgacugggacuuuguggugacaacugacaucuccgaaaugggcgcuaacuucaaagccgaccgggucaucgacccaagacggugucucaagcccguaauccugaccgacgggcccgagagagugauacuagccggcccaaugccggucacugcggcgagcgccgcucagcggagagggcggguggggcgcaacccccagaaagagaaugaucaguacaucuucacugggcaaccauugaacaacgaugaggaccacgcccacuggaccgaggcgaagaugcuccuggacaauauuaacacucccgagggcaucaucccggcccuuuucgagccagagcgagagaaguccgcugccaucgauggcgaguaccgccucaagggugagagccggaagacguucguugagcugaugcgccggggcgaccuccccgucuggcucgcccacaagguugcaucagaggggaucaaguacaccgaucggaagugguguuucgauggccagcggaauaaccagauccuggaggagaauauggacguggagauauggacgaaggagggcgagaagaagaagcucaggccccgguggcuggacgcccgcacuuacagcgacccgcucgcccucaaagaguucaaggaguuugccgcgggcaggaaguccaucgcgcuggaccugguuaccgagaucgggagagugccgagccaccucgcccacagaacccgaaacgcacucgacaaccugguuaugcuacacaccagugaacacggaggucgagccuaccggcaugcgguagaagaacugcccgagacaauggagacuuugcuccuacugggacucaugauccuguuaaccggcggcgccaugcuguuccugaucagcgguaaagguauagguaagacgagcauaggccugauuugugugauagccuccuccgggaugcucuggauggcggaaauaccacugcaguggaucgcguccgcgaucguccuugaguucuucaugauggugcuccucauccccgagccagaaaagcaacgcacgccgcaggacaaccagcuggccuacguggucauaggcauccucaccuuagccgccauaauagccgcgaacgagaugggccugcucgagacuaccaagcgcgacuuggggaugagcaaggagccgggcguuguauccccgacgagcuaccuggacguagaucuacaccccgcguccgcauggacccuuuaugccguggcgaccaccgugaucacgcccauguuacgccacacgaucgagaacuccaccgcuaaugucucccuggccgccaucgcaaaccaagcaguagugcugauggggcuggacaagggcuggccgaucaguaagauggaccucggcgucccccuccucgcucucggguguuacucacaggugaacccccugacccugacggccgcuguucuccugcuuaucacccacuaugccaucaucggcccagggcugcaggcuaaggccacacgggaagcacagaagcgcacggccgccggcauuaugaagaacccgacggucgacggcaucaugacuaucgaccuggauccggugaucuacgauagcaaguucgagaagcaauugggccaggugaugcuccugguccucugcgcgguacaacuccuucugaugagaacuuccugggcccucugcgaggcccugacacuggccacuggccccaucacgacccucugggaggggagccccgguaaguuuuggaacaccacaaucgcgguguccauggcgaacaucuuccgcgggucuuaccucgcuggcgcagggcuggcguucaguaucaugaagucagucggcaccggcaagcgggggaccggcucgcagggggagacccugggugaaaaguggaagaagaagcugaaccaacucagccggaaagacuucgaccuguacaagaaguccggcaucaccgagguagaccgaacggaggcgaaagaaggccucaagcggggugagaucacacaccacgccgugucgcgggguagcgccaaacugcagugguuugucgagaggaacaugguuaucccggagggccgagugauugaccucgggugcgguagagggggcuggucguauuauugcgccggccuaaagaagguaaccgaggugcggggauauaccaaagggggccccggccaugaagaacccgucccuaugucgacguauggguggaacaucgucaaguuaauguccggcaaagacguauucuacuuaccgcccgagaagugcgacacccugcugugcgacaucggcgagagcucgccuucccccacuguggaggagucccgcaccaucagaguccugaagauggucgagccguggcucaaaaacaaccaguucugcaucaaggugcugaaccccuauaugcccacagucauugagcaccuggagcggcuccagcguaagcaugggggcaugcugguacggaauccccugagccggaacuccacccacgaaauguacuggaucuccaaugggacugggaacaucguggccuccgucaacauggugagccgacucuuacugaaccgcuucacgaugacgcaccggcgcccaacaaucgagaaagacguggaccucggcgccgggacuagacacgucaaugcggaacccgaaacccccaauauggacgugaucggugaacgcauaaagaaaauaaaagaggagcacaacuccacuuggcauuacgacgacgagaacccguacaagacuugggcuuaccacgggagcuaugaggugaaggcgacggguuccgccaguucuaugaucaacggagucguuaagcugcugaccaagccuugggacgucgugcccauggugacgcagauggcgaugaccgacaccaccccauucggucaacaaagagucuucaaggagaagguggacacgcgcaccccgcggagcaugcccggaacccgccgggugauggguaucacugccgaguggcucuggcgcacgcugggucggaacaagaagccccgccuguguacccgggaggaguucacaaagaagguucgcaccaacgcagccaugggggcgguguucaccgaggagaaccagugggauagugccaaggccgccguggaggaugaggacuucuggaagcucguugaccgcgaacgggaacugcacaagcugggcaagugcgggucuugcgucuacaauaugaugggcaaaagagagaagaagcugggagaguuugggaaagccaagggcagccgcgcgaucugguauauguggcugggggcacgcuaccuggaguucgaggcccugggguuccugaacgaggaucacugguucucccgggaaaacaguuauucuggaguugagggcgagggucuacacaagcucggauacauucugcgcgacauaucaaaaauccccggaggggcaauguacgccgaugauaccgcggguugggauacccggaucacugaggaugaccugcacaaugaggagaagaucacgcagcagauggauccggagcaccgacaacucgcgaacgccaucuucaaacuuaccuaccagaacaagguagugaagguacagcggcccacccccacgggcaccgucauggacaucaucucccgcaaggaccagcgggguagcggccaaguggggaccuauggacugaacaccuucacgaacauggaagcccaguugauccgacagauggagggcgagggcgugcuuucuaaggccgaccuagagaacccucaccuaccggagaaaaagaucacccagugguuagaaacuaaaggcguggaacggcuuaagcggauggcgaucagcggggacgacugcguugugaagccgaucgacgaccgcuucgccaacgcgcuccuggcucugaacgauaugggcaaaguccgcaaggacaucccgcaguggcagccuagcaagggauggcaugacuggcaacaggugccuuucugcagccaccacuuccacgaacucaucaugaaagacggccggaagcucguggucccuugccgcccgcaggacgagcugaucggccgggcccgcaucucccagggggcaggcuggagccucaaggagaccgccugccuggggaaggccuacgcccagauguggucacucauguauuuccaucggagagaccuccgccuggccagcaacgccauaugcucugcagugcccgugcauugggucccaacaagucggaccacguggucgauccacgcccaucaccaguggaugaccaccgaggacauguuaaccguguggaaccgcguguggaucgaggacaaucccuggauggaggacaagacgcccguaaccaccugggagaacgugcccuaccucggaaagcgggaggaccaguggugcgggagccuuaucggccucaccagccgcgcaaccugggcgcagaauaucccgacagcuauccagcagguucggucccucaucgguaacgaagaguuccuggauuacaugcccucuaugaagcgguuucggaaggaggaggagucggagggcgcaaucugguga

SEQ ID NO: 25843 - RNA, 9873 nt, Artificial Sequence
  derived and/or modified CDS sequence (opt11) from DENV-3__HQ705612__SS-prME
accagccucugucucaugaugaucuuacccgccgcucuggcuuuccaccucaccucccgugacggcgagccgcggaugaucguggggaagaacgagcgaggcaagucccuacuauucaagaccgccuccgggauaaacaugugcaccuugaucgcaauggaccugggcgagaugugugacgauacggugaccuauaaguguccccauaucacggagguagagccggaagacaucgacuguuggugcaaccuuacaagcaccugggugacauaugggaccugcaaccaggccggcgagcacagaagagauaagcggaguguggcccucgcgccucacgugggcaugggccuggacacccgcacucagacauggauguccgccgagggggccuggcgccaaguggagaagguggaaaccugggcacugcgccacccgggguucaccauccucgcucuguuccuggcccauuacauuggcaccucccuaacccagaaggugguuaucuucauucuauuaauguuggucacucccagcaugacaaugcggugcgugggggugggaaaccgcgacuucgucgagggccuguccggugccaccugggucgacgugguccuggagcacggggggugcgugaccacgauggccaagaacaagcccacccuggauauagagcugcagaaaacggaggcaacccaauuggcgacacuccggaagcugugcaucgagggcaaaaucacuaacauuaccaccgauagccgcugcccuacgcagggcgaagccacccugccagaggagcaggaccaaaacuacgugugcaaacacaccuacguugaucgcggaugggggaacgggugcgggcucuucgggaagggcucucugguaacgugcgcaaaguuccagugccuugagcccaucgagggcaaagugguccaguacgagaaccucaaguauacggugaucaucaccgugcacaccggggaccaacaccaggucggcaacgaaacacaggggguaacggccgagaucacgccccaggcgagcaccacagaggcgauccugccagaguacggaacucuggggcucgaauguuccccgcgaacgggccuggacuuuaacgagaugauccugcugaccaugaagaacaaggccuggaugguucaccggcagugguucuuugaccugccccugcccuggaccucgggcgcuaccacggaaacccccacguggaauagaaaggaguuacuggucacuuuuaagaacgcucaugccaagaagcaggagguugugguccuugggucccaggagggggcgaugcacacagcgcugaccggggccaccgagauccagaacagcggcggcaccuccaucuucgccggccaccugaagugccggcugaagauggacaaacucgaguuaaagggcaugagcuacgccaugugcacgaacacuuucguucuaaaaaaggaggucagugagacccagcacgggaccauccucaucaagguggaguauaagggagaggaugugccgugcaagaucccguucucuacugaggaugggcagggcaaggcgcacaacggccgccugaucacggccaacccagucgugacgaagaaggaggaaccagugaacauugaggccgagccgccuuucggagaaagcaauaucgucaucgggaucggggauaacgcguugaagaucaacugguauaagaagggcagcagcaucgggaagauguuugaagcgaccgcgcggggcgccagacggauggccauccugggugacacggccugggauuucggaucagugggcgggguucucaacucucuggggaagaugguccaccagaucuucgggucggcguacacagcacuguucuccggcguguccugggugaugaagaucggcaucgggguccuccuuaccuggauaggcuuaaauagcaagaauacguccaugagcuucuccuguaucgccaucgggaucauaacccuguaccugggcgcuguggugcaggccgauauggggugcgucaucaacuggaagggcaaggagcuaaagugcggcagcgggaucuuugugaccaacgaggugcacacuuggacugagcaauacaaguuucaggcggacagccccaagcgucucgcgaccgccaucgccggcgcgugggaaaauggggucugcggcauccgcagcaccacgcguauggaaaaccugcucuggaagcagaucgccaaugagcugaauuacauccugugggagaacaauaucaagcugacggugguggucggggacauuaucggcguccucgaacaaggaaagcguacgcugacaccucaaccaauggaauugaaguauucuuggaagaccugggggaaagccaagauagugacggccgagacgcagaauuccuccuucauaaucgacggccccaacacccccgagugccccagugucucccgggccuggaaugugugggagguggaagauuacgguuucggugucuucaccacuaacaucugguuaaaacugcgcgagguguacacccagcuaugcgaucaccgacucaugagcgcggccgugaaggacgagcgcgcggugcacgccgauaugggguacuggauugaaagccagaagaacgguucauggaagcuggagaaggccucgcugauugaggugaagacgugcacguggccgaagagucacacacucuggagcaacggcgugcuggaguccgacaugaucauccccaagagccuagcgggacccaucucccagcacaaucaccggccgggcuaucacacccaaacggcuggacccuggcaccucggcaagcuggaguuggacuucaacuacugcgagggcaccacugucgugaucaccgagaacugcgggacgcguggacccagccuucggaccacuacuguguccgggaagcugauucacgaguggugcugccgaaguugcacccugcccccgcuccgguauaugggugaggacggguguugguacggcauggaaauccgcccaauuuccgagaaggaggagaacaugguuaaaucauuaguauccgccgggagcgggaagguggacaacuuuaccaugggggugcugugccuggccauccuguucgaggagguaaugcgggggaaguucgguaagaagcauaugauagccgggguguucuucaccuucguccugcuccuuagcgggcagaucaccuggcgcgauauggcgcacacgcugaucaugaucggaagcaacgccuccgaccggauggggaugggugugaccuauuuagcuuuaaucgccaccuuuaagauacagccauuccuggcccuaggguucuuccugcgcaaacugaccagccgagagaaccuccugcuaggcgugggccucgccauggccacuacccugcaacugcccgaggacaucgagcaaauggccaacggcauugccuuggggcugauggcguugaagcucaucacacaguucgagaccuaccaacuguggacggcauuaaucagucugacuugcuccaauaccaucuuuacccugaccgucgccuggcggaccgccacacuaauccucgccggggugagccugcugccggucugccaguccagcuccaugcgcaaaaccgacuggcuccccauggcgguggccgcgaugggggucccgcccuugccguuauucaucuucgggcucaaggacacgcugaagcgccgcagcuggccccucaacgagggcgucauggccgugggccucguguccauccucgccagcagucugcucaggaacgacguccccauggcggggccccugguggccggcggguuauuaaucgcaugcuacgugaucaccgggaccagcgccgacuuaaccgucgagaaggccgcugacacaaccugggaagaggaagcggagcagaccggggugagccauaaccugaugauaaccgucgaugacgacggcaccaugcgcauaaaagacgacgagacagagaacauccucaccguacugcucaaaaccgcucuccuuauugugucugggaucuucccguacagcauacccgcgacauugcucguguggcacacauggcagaagcagacacagaggagcgggguacugugggaugugcccagcccgcccgagacccagaaggcggaacuggaggagggcguguaccgaaucaagcagcaggggaucuucgguaagacgcaggucggagugggcguccagaaagagggcgucuuccacacgauguggcaugugaccaggggggccguccucacccacaacgggaagcgccuggagcccaacugggccagcgucaagaaggaccugaucucuuauggcggcggguggcgucucagugcccaguggcagaagggcgaggaggugcagguuaucgccguagagcccgguaagaacccaaaaaacuuccagaccaugccagggacguuucagaccaccaccggugagaucggggcuauugcccuggacuucaagcccggcacguccgguucacccaucaucaaccgcgaagggaaggucguaggccucuaugggaacggcgucgugacaaagaaugggggcuacgugucagguaucgcccagacuaaugcggagccagaugggcccacccccgagcuggaggaggagauguucaagaaacggaaccucacgauaauggaccugcacccuggcucugggaagacacgcaaguaccugccggcgaucgugagggaggcgaucaagcgacggcugcgaacccugauccuggcgccuacacgggugguagcggcugagauggaggaggcccuaaaaggccugccgauccgcuaccagacgaccgcaaccaagucggagcacaccgggcgagagaucgucgaccugaugugucacgcgacauucaccaugcgccuccuaagcccgguuagaguaccgaacuacaacuugaucaucauggacgaggcacacuucacugauccagcaagcaucgcggcgagaggcuauaucuccacccgggugggcaugggggaggcagccgccaucuucaugaccgccacgccgcccggaacagcagacgccuuuccgcagucuaacgcgcccauacaggacgaggaacgcgauauccccgagcguucauggaacagugguaaugaguggauaaccgacuuugccggcaagacgguaugguucguuccauccauuaaggccggaaaugacaucgccaacugccuccggaaaaacggcaagaaggugauccagcugagccgcaagacuuuugacacagaauaucagaagacuaaacugaacgacugggacuucguugugacgaccgacaucuccgagaugggcgccaacuucaaggcagaucgggucaucgauccgcgccggugccucaagccagugauccugaccgacgggccugagagagugauccuggccggccccaugccggucaccgcggccagcgcagcccagcggcgcgggcgaguuggcaggaacccacagaaggaaaacgaccaauacaucuuuaccgggcagccccucaacaacgacgaggaucacgcgcacuggaccgaggcgaagaugcugcucgacaacaucaacacccccgaggguauaaucccugcccuguuugagcccgagcgggagaaguccgccgcgaucgacggugaauaccgccugaagggggagagucggaagaccuucguagagcuuaugcgccgaggggaucuccccgucuggcuggcgcacaaggucgccuccgaggguaucaaguauaccgaccgcaaguggugcuuugauggacagcggaauaaucagauccuggaagagaacauggacgucgagauuuggacgaaggaaggcgagaagaagaagcuacgcccccggugguuagacgcccgcaccuacagcgacccgcuggcucucaaagaguucaaagaguucgcggcagggcgcaaauccaucgcccuggacuuaguaacagaaauuggccgggugccgagccaccucgcgcacaggacucggaacgcgcuggacaacuuggucaugcuccacacguccgagcacgguggucgugccuaccgacacgcugucgaggagcuccccgagaccauggagaccuuauuacugcuggggcucaugauccugcugaccgguggggcuaugcuguuucucaucucagguaagggcaucgggaagacuucuaucggccucaucugcguuaucgccuccagcggaaugcucuggauggccgaaaucccguugcaguggaucgccagcgccaucguccuugaguucuucaugauggugcuccugauccccgagccugagaagcagcgaacuccccaagacaaccagcuggccuacguugucauuggcauacucacccuggccgcgaucaucgccgcgaacgagaugggcuuacucgagaccacgaagagggaccuggggaugaguaaagagccgggcgugguguccccuaccaguuaccucgacgucgaccuucaccccgcgucggccuggacccuguaugcaguagcgaccacggucauaacccccaugcugcgccacaccaucgagaacuccacggcuaaugucucccucgccgccaucgccaaccaggcgguggugcugauggggcuggacaagggcuggccgaucucaaaaauggaccucggggugccccugcuggcccucggcuguuauucccaggugaacccccugacacuuaccgcugcugugcuccuccucaucacacacuaugccaucauuggucccgggcuucaggccaaggcgacccgugaagcccagaagcgaacagccgccggcaucaugaaaaacccgaccguagacgggaucaugacgaucgaccuagaccccguaaucuacgacagcaaguuugagaagcagcugggccaggugaugcuuuuagucuuaugcgcgguacagcuccugcugaugcggaccuccugggcacucugcgaggcccugaccuuagccaccgggcccaucaccacgcucugggagggaagccccgggaaguucuggaauaccaccaucgccgucuccauggcuaacaucuuccgcggaagcuaucuggccggcgccgggcuagcauucuccaucaugaagagugucggcaccgguaagcgggggaccggcucccagggugagacccucggcgaaaaguggaaaaagaagcugaaccagcugagccgcaaggauuucgaucucuauaagaaaagugggauaaccgagguggacaggaccgaggcaaaggaagggcugaagagaggcgaaaucacucaucacgccgugucucgggggagcgcaaagcugcagugguuugucgagcgcaacaugguaaucccggagggucgggucauagaccucgggugcggccgcggcggcugguccuacuacugcgcuggccugaagaaggucacagaaguucggggguacacgaagggugggcccggccacgaggagcccgugcccaugagcacauaugguuggaacaucgugaagcugaugucggguaaagacguguucuaccucccgcccgaaaagugugacacccugcuaugcgauaucggggagagcucacccagccccacaguugaagaaucccggacgauacgcguccuaaagaugguggagccguggcucaagaacaaucaguucugcaucaagguacugaacccauauaugccgaccgucauugagcacuuagaacgacuccagcgcaagcaugggggaaugcucguccggaacccccugaguaggaacuccacccaugaaauguacuggauuagcaacgguaccggcaacaucguugccucugucaacauggugagccggcuccugcucaaccgcuuuacgaugacccaucggcgcccgaccaucgagaaagacguggaucucggggcggggacccgccauguaaacgcggaaccggagacucccaacauggaugugaucggcgagcgcauuaagcggaucaaggaagagcauaacuccacguggcacuacgacgacgagaacccguacaagaccugggcauaucaugguuccuacgaggugaaggccaccggcuccgccagcaguaugaucaacggggucgugaagcuguuaacgaaaccuugggaugucgugccaaugguaacgcagauggcgaugacggacacaacaccguuuggccagcagcgcguauuuaaggagaagguggacacccggaccccgcguagcaugcccggcacccgucgaguuaugggaaucacggccgaguggcucuggcggacccugggccgcaacaagaagccccgacuguguacgcgcgaagaauuuaccaaaaagguccgcacgaacgcagccaugggggcgguguucaccgaggagaaccagugggacagcgccaaggcugccguggaggacgaggacuucuggaagcucgucgaccgagagcgcgaguugcacaagcuggggaagugcggcuccuguguguacaauaugaugggaaaaagggagaagaagcucggcgaauucgggaaggcaaagggcagccgcgcuauuugguacauguggcugggggcccgguaucuggaauucgaggcccucggcuuccuaaacgaagaccacugguuuucccgcgagaacagcuacuccgggguggagggcgagggccugcacaagcuaggguacaucuugcgggauauuagcaagauccccggcggggccauguacgcggaugacaccgcgggaugggacacacggaucacggaggaugaucugcacaacgaggaaaagaucacgcaacagauggacccggagcaccggcagcucgccaaugcgaucuucaagcugaccuaucagaauaaggucgugaaagugcagcgccccacuccuaccggcacggucauggacaucaucucccggaaggaccagcgcgguagcggccaggugggaacuuacggccucaacacuuucaccaauauggaagcccaacugauccggcaaauggagggugagggggugcugaguaaggccgaccuggagaacccccaccugccggagaaaaagaucacgcaguggcuggagaccaagggcguagagcgccuuaagagaauggcgaucucgggggaugacuguguagugaaacccaucgacgaccgcuuugccaacgcacugcuggcccugaacgacauggggaagguccggaaagacaucccucaguggcaacccuccaagggguggcaugacuggcagcagguccccuuuugcucgcaccacuuccacgagcucaucaugaaggacggccgcaaacuggucgugccuuguagaccccaggacgagcugauuggaagggcacggaucucccaaggcgcgggcuggagcuugaaggagaccgccugccuggggaaggccuaugcucaaaugugguccuugauguacuuccaccgccgcgaccuccggcuggcgagcaacgccauuugcagugccguaccaguacacugggucccuaccagccgcaccacgugguccauucaugcccaccaccaauggaugacuaccgaggacaugcugaccguguggaaccggguguggauagaagacaacccguggauggaggacaagacccccguuaccacgugggaaaacgugcccuacuugggaaagcgagaggaccaauggugcgggagucugauaggccugacgagccgcgcaaccugggcgcagaacaucccaaccgccauccagcaggugcgcucccuuauagggaacgaggaguuccuggauuacaugccgagcaugaagcgguuccgaaaagaggaggaguccgaaggugcgauaugguaa

SEQ ID NO: 25844 - RNA, 9873 nt, Artificial Sequence
  derived and/or modified CDS sequence (opt11) from DENV-3__HQ705613__SS-prME
acgucucuaugccuaaugaugauccucccggcugcacuugcguuccaucucacauccagggauggggaacccagaaugauuguggggaaaaacgaacgggggaaaagccuccuauucaaaacagccaguggcaucaacaugugcacauuaauugccauggacuuaggggaaaugugcgacgacaccguaacauacaaauguccgcacaucacagaaguagagcccgaggauauagacuguuggugcaaccugacaagcacgugggucacauacggcacaugcaaucaagcuggugaacacagacgcgauaaaaggagcguggcgcucgccccacaugugggcaugggacucgacacaagaacacagaccuggaugucagcugaaggcgcguggcgacaagucgaaaaagucgaaacaugggcccuccggcauccaggcuucacaauacucgcgcuguucuuggcacacuacaucggcaccagucugacccaaaaaguggucauauuuauccuacucaugcucguaaccccaucgaugaccaugaggugcguaggcguggggaaucgcgacuucgucgaaggacucuccggagccacguggguggacguaguacuagagcacggcgguuguguaacaacgauggcgaaaaauaaaccgacccuugacaucgagcugcagaaaacggaagccacgcaacuagccacgcugagaaaauugugcaucgaagguaaaauaacaaacaucaccacggacuccagguguccuacgcagggggaagcgacacuaccggaagaacaagaccaaaacuaugugugcaagcacaccuauguggaccgaggauggggaaacgggugcggacuguucggcaaaggaagccuaguaacuugcgccaaauuucaaugccuggagccaaucgaagggaaagucgugcaguacgaaaaucugaaauacacaguaauuaucacaguccacacaggagaccaacaccaagugggcaaugaaacgcagggggucacggcagaaauuacaccgcaagcaucaaccacagaagcgauccuaccggaguacgggacucuugggcucgagugcuccccgaggaccgggcuggauuucaacgaaaugaucuugcuaacgaugaaaaacaaagcauggaugguacaccgccaaugguucuucgaccugccccucccauggacgucgggcgcgacaaccgaaacacccaccuggaaccgcaaagaacugcuagucaccuuuaaaaacgcgcacgcgaagaaacaagagguaguaguccugggcucgcaagagggcgcgaugcacaccgcccuaacaggcgccacagaaauacaaaauucgggaggcacaaguauauuugccgggcacuugaaaugcagauugaagauggacaagcuagaacuaaaaggaaugagcuacgccauguguacaaauaccuuuguccucaagaaagaggucagcgaaacccagcacggaacuauauuaauaaaggucgaauacaaaggggaagacgucccguguaagauccccuucagcaccgaagauggccaggggaaggcucacaacggaagacuaaucacggcaaaccccguagucaccaagaaagaggaaccuguaaacauagaggcagagccaccauucggggaaucaaacauagucaucggcauuggcgacaaugcgcugaagauaaacugguauaagaaagguagcaguaucgggaagauguucgaagccaccgcgcgcggagcgcgccguauggcaauauugggggauacagcaugggauuucggaagugucggaggaguacuuaacagccuagggaaaaugguacaucaaaucuucggcucagcauacaccgcgcuauucucggguguuagcugggucaugaagauagggaucggaguacuccuuacauggaucggccucaauagcaagaacacgaguaugucguucagcuguauugccaucggcaucauaacccuauaccucggggcagucguacaggcagacaugggcugcgugaucaacuggaagggaaaagagcuuaaauguggcagcgggaucuuugugacaaaugaaguccauacguggacugaacaguauaaguuucaagcagacucucccaagcgccuagcaacagccaucgcgggugccugggaaaauggugucugugggauacggucaaccaccagaauggaaaacuugcuauggaaacagaucgcuaaugagcucaacuacauccucugggaaaacaacaucaaguugacgguuguaguaggugacaucaucgggguguuagaacaggggaaaaggacccucacuccacagccaauggaacuaaaauacucguggaaaaccuggggaaaagcaaagauuguaacagcggaaacgcaaaauagcagcuucauuaucgacgggcccaacacgccggaaugcccuagcguaagcagagcuuggaacguaugggaaguagaagacuacggauucggaguauucacuacaaacaucuggcugaagcucagagaggucuacacgcaguugugcgaccacaggcugaugagcgccgcagucaaagacgagagagccguccacgccgacauggguuauuggaucgaaagccaaaagaacggcuccuggaagcuggagaaagccagccucauugaaguaaagaccugcaccuggcccaaaucgcacacgcucuggagcaauggagugcucgaaagcgacaugauuauaccgaaaagccucgcaggccccaucucacagcauaaccaccggcccggauaccauacucagacagccgggccguggcaccuuggaaaauuagaacuggacuucaacuacugcgaaggcaccaccguggugauaaccgaaaacugcgggacgcggggccccagucugcggacaaccacaguuaguggcaaacuuauacacgaguggugcugucgaagcuguacccuuccaccccuucgauacaugggugaggauggguguugguacggcauggagauaagaccaauaagugagaaagaagaaaacauggucaaaagccucguuagcgcagggagcggcaaggucgauaauuuuacaauggggguacucugccucgcaauccuauucgaagaaguuaugagaggaaaauucggcaagaaacacaugaucgcaggagucuucuucaccuucguacuauuguuaagcggccaaauuacguggcgagacauggcgcacacucucaucaugaucggcucuaacgcuagcgaucguauggggaugggcguaacguacuuggcccucauagccacguuuaaaauacaaccauucuuggcacuaggcuucuuucugaggaaacuaacaagccgggaaaaucuguuacugggcguuggacuagcaauggccacgacacuccaguuacccgaggauauagaacaaauggcuaacggcaucgcacucggacuaauggcauugaaacucauaacccaauucgaaacguaucaacucuggacagcguuaaucaguuugacgugcucaaacaccauauucacccucaccguagcauggaggacggccacgcugauacuggcuggcguaucacuauuaccuguaugccaauccuccucaaugagaaagaccgacugguuacccauggcuguagccgcaaugggaguaccaccucuaccauuauucauuuucggacuaaaggauacacucaagcguagauccuggccacucaacgaggguguaauggccguaggccuagucucgauucuagccagcagccuacugagaaacgauguacccauggccggaccacugguagcaggagguuuacucauugccugcuacgugauaacagggacguccgccgaccucacugucgagaaggccgccgacaucaccugggaggaggaagcagagcaaacgggagucucgcauaaccuaaugaucacaguagacgacgauggcacuaugcgaauaaaggacgacgaaaccgaaaacauccuaacggugcuccuaaagacagcacucuugauugucucggggaucuuucccuauaguauuccagcaacccugcuggucuggcauacguggcaaaagcaaacacaaagaucaggcguacuaugggauguaccgagcccuccagagacccaaaaggcggaacuagaagaaggaguguaccguauaaagcaacaaggcaucuucggcaagacacaagugggugucggcgugcagaaagaaggagucuuccacacaauguggcacgucacaagaggggcgguauugaccuauaacggaaagcggcuagagccgaacugggcgagcguuaagaaagaucugaucucguacggaggaggauggcgacugucggcacaguggcagaaaggggaagagguacaggucaucgccgucgagccaggcaagaaccccaaaaauuaccagacuaugcccgggaccuuccaaacgaccacgggcgaaauaggugcaaucgcauuagacuucaaaccugggacuuccggaagcccaauaaucaaccgggagggcaaggugguuggacucuauggcaauggaguggugacgaaaaacggaggauacguauccgguaucgcacaaacaaaugccgagccugauggcccaacgccagaauuagaagaagagauguuuaagaaaagaaaccucacgaucauggaccuacacccuggaagcggcaaaacccguaaauaccuacccgccauugugagggaagcaauaaagagaagacuccgaacucuaauucucgccccgaccaggguugucgcagcugaaauggaagaagcauuaaagggauugccgauccgauaucagacaacggcgacgaaaagcgagcacacaggcagggaaaucguggaccuaaugugccacgcaaccuuuacaacacgauugcuauccccgguacgagugccaaacuauaaccugauaauaauggacgaggcgcauuucaccgaccccgcgucuaucgcagcucguggcuacauuuccacacggguuggaaugggggaagcagccgccauuuucaugacggcaacgcccccggggacugcggacgcguuuccacagaguaaugcacccauccaggacgaagaaagagacauaccagaacgcagcuggaauagcggcaacgaauggaucaccgacuucgccggaaagacgguuugguucguaccuagcauuaaagcagggaacgauauugcuaacugccucaggaagaacggaaagaaaguaauacagcuaucacgaaagacuuucgacacagaauaccaaaagacaaaacuaaacgacugggauuucguagugacgacggacauuagugaaaugggagccaacuucaaggcggaucggguaauagauccaaggcgaugccuaaaaccugucauccucacggacggccccgaaagaguaauacucgcaggaccgaugcccgugaccgcggcgagcgccgcccagcgccguggcagaguaggacgaaacccgcaaaaagaaaacgaccaauacauauucaccggucaaccgcucaacaacgacgaagaccacgcacacuggacagaagccaagaugcugcuagacaacauuaacacuccugaaggaauuauccccgcccucuucgagcccgaacgagaaaagucggcggccauagacggagaauaccgacugaagggggaaucccgaaagaccuucguagaacuaaugcgucggggcgacuuacccguguggcuagcccauaaaguggcgucggagggaaucaaauauacggaccguaaauggugcuucgacgggcaacggaauaaucagauuuuggaagagaacauggacgucgaaauauggacuaaggaaggcgagaaaaagaaacuacgaccacgauggcuagaugcgcggaccuacagcgauccccuagcccuuaaagaguuuaaggaguucgcggcuggccggaaaagcauagcacucgaccucgucaccgaaaucgguagaguaccaagccaccuagcgcacagaacccggaaugcgcuagacaaccucgugauguuacacacaucagagcacggaggacgagcuuaccggcacgcagucgaggaacuacccgagacgauggagacgcugcuccuucuaggccuaaugauccugcucacaggaggugccaugcucuuucuaauuagcggcaaaggcauaggaaaaacgaguauaggcuugauaugcgucauagccagcucagggauguuguggauggcggaaauaccccuacaauggauugccagugcgauaguccuagaguucuucaugaugguccugcuaaucccagaacccgagaaacaacggaccccacaagacaaccagcuagcauacgucgugauuggaauacucaccuuagcagcaauaauagcagcgaacgagaugggccuacuugaaaccacgaagcgggacuuggggaugaguaaagagccaggggucgucagccccaccagcuaccuagacguagaccugcacccugcaucggccuggacccuauacgcgguagcuacaaccguaauuacaccaaugcugcggcacacaauagagaacucaaccgcgaacgucucccuagcugcgauugccaaccaagcgguuguucucaugggauuagacaaaggcuggccaauaucuaaaauggaccuagggguaccacugcucgccuugggaugcuacagccaagugaauccacucacucugacagcggcaguacuucuacucauuacacauuaugcaauaaucggacccggacuacaggcgaaagcgacacgcgaggcgcagaaacgaacagcugcaggcaucaugaagaaucccaccgucgacgggaucaugacgauugaccuagauccugucaucuacgacuccaaguucgaaaagcaacucgggcaaguaaugcuccuugugcucugugcagugcaacuccuacuaaugaggaccaguugggcgcugugugaagccuuaacccucgcgaccggaccaaucaccacauuaugggagggaucacccgggaaauuuuggaacaccacgaucgcaguaagcauggcgaacauauuccgcggcucguaccuggcaggcgcagggcuagcguucucaauaaugaaaagcguggggacgggcaagcgcggaacagggucgcagggggaaacgcuaggugaaaaauggaagaagaaacugaaccagcugagcagaaaagacuucgacuuguauaagaaaucaggaauaacagagguggaucgcacagaagcuaaagaaggccuaaaacgaggggaaaucacacaccaugcggugucgaggggaagcgcgaaacuacagugguuugucgagaggaacaugguaauuccggagggccgaguaauagacuuagggugugggcgcggcggauggagcuacuacugcgccggucugaagaaagugacugagguccgaggauauacaaaaggcggaccuggccacgaagaaccagucccuaugagcacauacggcuggaacaucgugaagcucaugucuggcaaagauguguucuacuuaccuccugagaagugugauacacuacugugugacauuggcgaauccucaccgagccccacgguagaggaaucacgaacaaucagaguacucaagaugguggagccguggcucaagaauaaccaguuuugcauaaaaguacuuaacccguauaugcccacaguaaucgaacaccuagaacgguuacaaaggaagcauggcggaaugcucguucgaaacccucuaaguagaaacagcacccaugagauguacuggauaaguaacgggacugggaacauagucgcaagcguuaacauggucagccgauuacuacuaaacagauucacaaugacccauagaagacccacgauugaaaaggauguagaccugggggccgguacccgacauguaaacgcggaaccggaaacuccaaacauggacguaauuggagagcgaauaaaacguaucaaggaagaacauaacucgacauggcacuaugacgacgaaaaucccuauaaaacgugggccuaccacggcagcuacgaagugaaggcgaccggcagcgcuuccagcaugaucaacggcgugguaaagcugcucacuaaaccaugggacgucgucccaauggucacucaaauggcuaugaccgacacaaccccguuuggccaacaacguguuuucaaagaaaaaguagauacaagaaccccgagaaguaugcccggaacacggcggguuaugggcaucacggccgaauggcuuuggagaacucuugggcggaacaagaaaccucgacuauguaccagagaggaguucaccaagaaaguaagaaccaacgcggcaaugggugccgucuucaccgaagaaaaccagugggacagugccaaggcugcaguagaagacgaagacuuuuggaagcuaguugacagggaacgcgagcuacacaaacuaggaaaaugugggagcugcguauacaauaugauggguaagcgcgagaagaaacuaggagaguuuggaaaagcaaagggaagcagagcaauaugguauauguggcuaggagcucgauaccucgaguucgaagcgcuuggauuuuuaaaugaagaucacugguucagcagagaaaacucauauaguggggucgagggugaaggguugcacaaacuaggcuacauccuucgggacaucaguaaaauuccaggaggagcaauguaugcggaugauaccgcaggaugggacacccggaucacagaagacgaccuacauaacgaagaaaagauaacccagcaaauggauccagagcacagacaacucgccaacgcuauauucaaacuuaccuaucagaacaagguaguaaagguccaaaggccaacacccacggguacagugauggauaucauaagccgcaaggaucaaagagggagugggcaagucggaacauacggacugaacaccuuuacgaacauggaagcacagcuuauucgucaaauggagggagaggguguacuaucaaaagccgaccuagaaaacccgcaccuaccagagaagaaaauaacucaguggcuggagacgaagggcguggagcgccugaaacgaauggcgauaucaggcgaugacugcguggucaaacccauagaugaccgguucgcuaacgcucuccuugcucucaacgacauggggaaagugcgaaaggacauuccacaguggcaaccgucaaaaggcuggcacgauuggcaacagguaccauucuguucccaccacuuccacgaacuaauaaugaaggacggccgcaagcucguagugccaugccgcccgcaggacgaacucauagggcgggcccgaaucucccagggagcaggcuggagccuaaaggaaacagcgugccuagguaaggcauacgcgcaaauguggucgcucauguacuuucacagaagagaccucaggcucgcaagcaaugcgaucugcagugcaguuccaguccauuggguaccgacgagcagaacgacuuggaguauacaugcgcaccaccaauggaugacaaccgaagacauguuaacuguauggaaccggguauggaucgaggacaacccguggauggaagacaaaacaccggucacaaccugggaaaacguaccauaccuaggaaaacgagaagaccaauggugcgggucccugaucgggcuuacgucgcgggccaccugggcacaaaacauuccaaccgccauccagcaaguaagaagucuuaucgguaacgaagaauuucucgacuacaugccgucaaugaagcguuuccgcaaagaggaggaauccgagggcgccaucugguaa

SEQ ID NO: 25845 - RNA, 9873 nt, Artificial Sequence
  derived and/or modified CDS sequence (opt11) from DENV-3__HQ705615__SS-prME
acgucccuaugcuuaaugaugauccugcccgcggcccuagcguuccacuugaccagccgggacggggagccgcggaugaucguggggaagaacgagcggggcaagagccugcuguucaagaccgcuagugggaucaacaugugcacgcucauugcuauggaccugggggagaugugcgacgauaccgugaccuacaagugcccucacaucacugaaguggagccugaggacauagauugcuggugcaaccugaccagcaccuggguuaccuacgggacgugcaaccaggccggagagcauaggagagacaagcgguccguggcccucgcgccccacgugggcauggggcuggacacccgcacccagaccuggaugucggccgagggugccuggcgccagguggagaaggucgagacuugggcgcuccgccacccggguuuuaccauccucgcacucuuccuggcccacuauauuggcaccucccucacucagaagguggugaucuucauccuuuuaaugcucgucacgcccagcaugacuaugcggugcguggguguaggaaaccgcgacuucgucgagggccuguccggugccaccuggguggacguuguccuggaacacggugggugcgugacgacgauggccaagaauaagccuacccucgacauugagcugcagaagacggaggccacccagcuggcgacgcugcgcaagcugugcaucgaggguaagauuaccaauaucacaaccgacagucgcugucccacgcagggcgaggccacgcugccggaggaacaggaccagaacuacgucugcaagcacaccuacgucgaccguggguggggcaacggguguggcuuauucggcaaaggcucccuggugacgugcgccaaguuccagugccuggagccuaucgagggcaaggugguccaguacgaaaaccuaaaguacacggugauuauaaccgugcacaccggggaccagcaccaggucggcaacgagacccagggggugacagccgaaauuacgccccaggccagcaccacagaggcgauccuucccgaguauggcacgcugggguuggagugcuccccgaggacgggccuggacuucaacgagaugauccuccucaccaugaagaacaaagccuggaugguucaccggcaaugguucuucgaccuuccccugcccuggaccaguggcgccacaacggagacccccaccuggaaucgcaaggaguuacuggugaccuucaagaacgcccacgccaagaagcaagagguggucgugcuggggucgcaggagggcgcgaugcacacggcgcucaccggggccacggagauucaaaauagcggcgggaccuccaucuucgccggccaccugaaaugccggcugaagauggacaaacucgagcugaagggcaugagcuacgccaugugcacgaacaccuucguucugaagaaggaggucucugaaacccagcacgggaccauccucaucaaggucgaguacaagggcgaggacguuccgugcaagauccccuucagcacggaggacgggcagggaaaagcgcacaacggucgcuugaucacugccaaccccgucgugacuaaaaaggaggagcccgugaacaucgaggcggagccgcccuuuggggaauccaacaucgucaucggcaucggggacaacgcccugaagaucaacugguacaaaaagggcucaagcauugggaagauguucgaggcuaccgcccggggcgcaagacggauggccauccuaggcgacacggccugggacuucggauccguaggcggggugcucaacagcuuaggcaagaugguccaccaaaucuucggguccgcguacaccgcucuuuucagcggcguuuccuggguaaugaagaucggcaucgggguacuucugaccuggaucggccugaacagcaagaauaccaguaugagcuucucuugcaucgccaucgggaucaucacguuguaucugggcgccguggugcaagcggacauggguugcgugaucaacuggaagggcaaggaacucaagugcggaagcgggaucuucgugaccaacgaaguucacaccuggaccgagcaguacaaguuccaggcggauucccccaagcgccuggcaacggccaucgcuggcgcgugggagaacggggucugcggcauccgcagcaccacucggauggagaaucugcuguggaagcagaucgcgaacgaguugaacuauauccugugggagaacaacauuaagcugaccgucgugguaggggacaucaucggcgugcucgagcagggcaagcgaacucugacgccccagcccauggaguugaaguacuccuggaaaacaugggggaaggcgaagaucgugaccgccgagacucagaacagcuccuucauaaucgacgggcccaacacccccgagugcccgucagucucccgggccuggaacgugugggagguugaggacuacggguucggcgucuucacaaccaacaucuggcucaagcugcgcgaaguauacacucaguuaugcgaccaccggcuuaugagcgcggccgugaaggacgagcgcgcuguucacgccgauaugggcuacuggaucgagagccaaaagaauggguccuggaaguuggagaaggccagccugaucgaggugaagacauguaccuggccgaagucucacacccucuggagcaacggcguucuggaguccgacaugaucauacccaagucgcuggcggggccaaucucccagcacaaucaucggccgggcuaccacacccagacggccgggcccuggcaccucgggaagcuggagcuugacuuuaacuacugugagggcacuaccgucgugauuaccgagaacugcgggacacgcggccccagccuccggaccacuacuguguccgggaaauuaauccacgagugguguugccgcagcugcacgcugcccccacuuagauacaugggcgaagacgggugcugguacggcauggagauccgccccauuucggagaaagaggagaacaugguaaagagucuggucucagcugggagcggcaaagucgacaauuucaccaugggcguccugugccucgcgauccuguucgaggaggugaugcggggcaaauucggcaagaagcacaugaucgccgggguguuuuucacguucguccugcuccucuccggccagaucaccuggcgcgauauggcgcacacucucaucaugaucggcaguaacgccuccgaccggaugggcaugggagugaccuaccuagcucucauagccacauucaagauacagccguuuuuagcccucggguucuuccuucgaaagcugacaagccgggagaaccuccugcugggcgugggcuuggcgauggccacuacccugcagcugcccgaggacaucgagcagauggccaacgggaucgcccucggccugauggcucugaagcucauaacccaguucgagaccuaccagcuguggacggcccugaucagccugaccugcagcaacaccaucuucacccugaccgucgcguggcgcaccgccacccucauccuagccggggugucucugcugcccguaugccaguccagcuccaugcggaagaccgauuggcuccccauggcggucgccgccaugggagugccaccccucccacuguuuauauucucguugaaggacacguuaaagcgccguuccuggccccugaacgaaggcgucauggccgucggccucguuagcauccuugcuuccagcuuguuacguaaugacgucccuauggcgggcccccucguggccgggggacuacucaucgcuuguuaugugaucacagggacauccgccgaucucaccguggagaaggccgccgacauaacgugggaggaggaggcggagcagaccggugugagccacaaccucaugaucgccguggacgacgacggaaccaugcgcaucaaggacgaugaaaccgagaauauacucaccgucuugcugaagacagcucuccugaucgucuccggaaucuucccguacucaauccccgccacccugcucguguggcacaccuggcagaagcagacucagaggucuggcguccugugggacguuccaagcccgcccgagacacagaaggcggagcuggaggaggggguguaccgcaucaaacagcagggcaucuucggaaagacgcaggucggcguggguguucagaaggagggcgucuuccacacgauguggcacgugaccagaggggcgguucucacuuacaacgggaagcgucuggagcccaacugggccuccgucaagaaagaccugaucucguacggcggcggcuggcggcucagcgcccaguggcagaagggcgaagagguccaggugaucgcagucgagccugguaagaacccaaagaacuuccagaccaugccgggaacuuuccagacaacgaccggggagaucggcgcgaucgcgcuggacuucaagcccgggacaagcgggagcccuaucaucaaucgagagggaaaggugguggggcuauacgggaacgggguugugaccaagaacggcggauacguguccggcaucgcccagacgaacgccgagccggacggccccacccccgaacuggaggaagagauguucaagaaacgcaaucucaccaucauggaccugcaucccgguagcggcaagacgcgcaaguauuugccagcgaucguucgggaggcgaucaagcgccgacuucgaacgcugauccuagccccaacccgggugguggccgcagagauggaggaggcgcucaaggggcugcccaucagguaccagaccaccgccacaaaguccgagcacaccggccgggagaucgucgaccucaugugccacgccaccuucaccaugcgccuccugagccccguccgggugccgaacuacaaccugaucaucauggacgaggcucauuucacggaccccgccuccaucgcugcacgcggguacaucagcacccgggucggcaugggcgaggccgccgcgaucuucaugacugccacuccacccgggacggccgacgccuucccccaguccaacgcccccauucaggacgaggaacgcgacauccccgagcgcagcuggaacuccggcaacgaauggaucacugacuucgcggggaagacggugugguuugugcccagcaucaaggccggcaacgacauugccaacugucucaggaagaacgggaagaagguaauccagcuguccagaaagaccuucgauacggaauaucagaaaaccaagcugaacgacugggacuucgugguuaccaccgauaucagugagaugggcgcgaacuuuaaggccgaccgggugaucgacccgcgccggugccuuaagcccgugauccugacggacggccccgagcgcguaauccuugcggggcccaugccggucaccgccgccagcgccgcccagcggcgcggccggguagggcgcaacccacagaaggaaaacgaucaguacaucuucaccggccagccccucaacaacgacgaggaccaugcucauuggaccgaggccaaaaugcugcuggacaacaucaacacccccgaggggaucaucccugcccucuucgagcccgagcgggagaaguccgccgcgaucgauggcgaguaccgacugaaaggcgagucccggaagacguucguggagcugaugcgacgcggugaccugcccgucuggcuggcccacaagguggccagcgagggcaucaaguacaccgaccgcaaguggugcuuugacgggcagcggaacaaucagauccuugaagaaaacauggacgucgaaaucuggaccaaggagggcgagaagaagaaacugcgcccacgcuggcuggacgcucgcacuuacuccgacccgcuggcacuaaaggaguucaaggaguucgccgccggcagaaaaagcaucgcccuggaccugguaacggaaaucggcagggugcccucccaucuugcucaccgcacgcggaacgcccuggauaacuugguaaugcugcauacgagcgagcacggcgggcgcgcguaccggcaugccguugaagaacugcccgagaccauggaaacgcugcuccugcugggccuuaugauccugcugaccgggggcgccaugcuuuuccugaucagugguaaggggaucggcaagaccuccauugggcugaucugcgugaucaccagcuccggcaugcucuggauggccgagauuccgcuucaauggaucgccagcgcgaucguccuggaguucuucaugauggugcuucugauccccgaacccgaaaagcagcgcacaccccaggacaaccaguuggccuacguggucaucgggauucucacccuggccgccaucauugccgcaaacgagaugggccuguuagaaaccaccaagcgggaccuggggauguccaaggagccgggggugguaagccccacguccuaccuggacgucgaccuccacccugcaagcgccuggacccuguacgccguggcgaccaccguaaucacgcccaugcugaggcacaccauagaaaacucgacggccaacguaagccucgccgccauugccaaccaggcgguggugcugaugggccuggacaaggguuggccgauauccaagauggaucucggcgucccccugcuggcccucgguugcuacucgcagguuaacccccugacccugacggccgcugugcuccuguugaucacccacuacgcaaucaucggccccggccuccaagccaaggcuacccgggaggcucagaagaggacggccgccggcauuaugaagaauccgaccguggacggcaucaugacuaucgaccuagaccccgugauauacgacaguaaguucgaaaaacaacugggccaggugaugcuccugguccugugcgcggugcagcuccugcugaugcggaccagcugggcucucugcgaggccuugacacuggccacgggcccuaucaccacccucugggagggcuccccagggaaauucuggaacacuacgaucgcgguaagcauggccaacaucuuucguggguccuaccuggccggugccggccuggccuucagcaucaugaaguccgucgggaccggcaagcggggcaccgggagccagggugagacgcucggggaaaaguggaagaagaaguuaaaucaauuaagccggaaagacuuugaucucuacaagaagaguggcaucaccgaaguggauagaacugaggcgaaggaggggcugaagcgcggcgagaucacccaccacgccgugagccggggaucggccaaacugcagugguucgucgagaggaacauggugaucccggaagggcgggugaucgaccucggcugcgggcgcggcggauggagcuaccacugcgccggccucaagaaaguaacggaggugcggggcuacacaaaaggcgggcccggucacgaggagcccgugcccauguccacguacggcuggaacaucgucaaacuuaugagcggaaaggacguguucuaccucccgcccgagaagugcgacacccugcuaugcgacaucggcgaauccucucccucccccacaguggaggagagucgcaccauccgcguccugaagaugguggagccguggcucaagaacaaccaguucugcaucaaggugcuaaacccauacaugcccacggucauagagcaccuggagcggcuccagcgcaagcacggcggcaugcuagugcggaacccccugucccgcaacucuacccacgagauguacuggauauccaacggcaccgggaacaucguggccagcgucaacaugguguccaggcuccugcugaaccgcuucaccaugacgcacagacgcccgaccaucgagaaggacguggaccucggggcgggcacccggcacgucaacgccgagccagagacccccaacauggacgucauaggggagcgcaucaagcggaucaaggaggaacacaacagcacuuggcacuacgacgacgagaaccccuauaagacuugggccuaccacggaucguacgaggucaaggccaccgggagcgccuccuccaugaucaauggcgucgucaagcugcugaccaagcccugggacgucgugccaauggugacgcagauggcgaugacugacacgacccccuucgggcagcagcgcgucuucaaggagaagguggauacgcggaccccgcgcucgaugcccgguacgcggcgcgugaugggcaucaccgccgaguggcuguggcggacgcuggggcgcaacaaaaagccccguuuaugcacccgugaggaguucaccaagaagguccggaccaacgcugccaugggcgcgguguucacggaggagaaccagugggauuccgcuaaggccgccguggaggacgaggacuucuggaagcucguagauagagagcgcgagcugcacaagcuggggaagugcggcagcugcguguauaacaugauggggaagagggagaagaagcucggugaguucggcaaggccaaggggucccgcgcgaucugguacauguggcugggcgcccgguaccuggaguucgaggcgcucggguuucugaacgaggaccacugguucagccgagagaacuccuacagcggaguggagggggaaggacugcacaagcucggauacauccugcgggacaucuccaagauccccggcggcgccauguacgccgacgacaccgcggggugggauacucggaucaccgaggacgaccugcacaacgaggagaagaucacucagcagauggacccggaacaucggcagcucgccaacgcuaucuucaagcugaccuaucagaacaaagucgucaaggugcagcgaccaaccccgaccggcaccgucauggacaucaucucccggaaggaccagcgcggguccggccagguuggcacguacggacuuaacaccuuuaccaacauggaggcccagcucauccggcagauggagggcgaaggggugcugaguaaggccgaccuggagaacccccaccucccggagaagaagauaacccaguggcuggagacgaaaggcgucgaacgccugaagagaauggcgaucuccggcgacgacuguguggugaagcccauagacgaccgauucgccaacgcccucuuagcacugaaugacauggggaagguccggaaggauaucccccaauggcagcccuccaagggcuggcacgacuggcaacaggugccuuucugcucccaucauuuucacgagcucaucaugaaagacggacgcaaacugguggucccgugccggccgcaggacgagcugaucggcagagcccggaucagccagggggcagggugguccuuaaaggagaccgccuguuuagguaaggcuuaugcccagauguggagccugauguauuuccaccgccgugaccuacgccuggcguccaaugccaucugcagcgccgugcccgugcauugggucccgaccuccaggaccacgugguccauccaugcccaccaccaguggaugacgaccgacgacaugcuaacaguguggaaccggguguggaucgaggacaaccccuggauggaggacaagacccccguaaccaccugggagaacgugcccuaccucgggaagcgcgaggaccaguggugcgguucgcugaucggauugaccagucgggccacgugggcgcagaacaucccuaccgccauccagcagguccgcagcuugaucggcaaugaggaguuccucgacuacaugccguccaugaagcgguucagaaaggaagaagagucggagggggccaucugguaa

SEQ ID NO: 25846 - RNA, 9873 nt, Artificial Sequence
  derived and/or modified CDS sequence (opt11) from DENV-3__JF920398__SS-prME
accagccucugccuuaugaugauacugccggccgcccuggcguuucaccucacaagccgagacggggagccccggaugauuguugggaagaacgagcgggggaagucacugcuguucaagaccgccucugggaucaacaugugcaccuuaauagccauggaccugggggagaugugcgacgacaccguaaccuacaaaugcccccauaucaccgaagucgagccggaggauaucgauugcuggugcaaccugaccagcaccuggguaacguacggaacgugcaaccaagcuggcgagcaccgacgcgauaaacggucgguggcccuugcgccccacguggguaugggucuggacacccgcacccagaccuggauguccgccgagggggccuggcgacaggucgaaaaggucgagacgugggcccugcgacacccaggguucacaauccuagcgcuguuccuggcccacuauauuggcaccuccuugacccagaaggucgugaucuucaucuuacugauguuggucacgccgaguaugaccaugaggugcguggggguuggcaaccgcgacuucguugaaggccucucaggcgccaccuggguagauguuguacuggaacauggagggugugugaccacgauggccaagaacaagccuacccucgacaucgagcugcagaagaccgaggcgacccagcucgcgacguuacggaagcugugcaucgaaggaaagauuacgaauaucaccaccgacagccgcugcccgacucaaggcgaagcaacccugccggaggaacaggaccagaacuauguuugcaagcauacguaugucgaccguggauggggcaacgggugcgggcuauucgguaagggcucccuggugaccugcgcgaaauuccagugcuuagagcccauagagggcaaggugguccaguaugagaaccuuaaguacacggugauuaucacggugcacaccggggaccaacaucaggucggcaacgagacacaagggguuacggcggagaucaccccgcaggcuagcaccaccgaagcaauccugccugaauauggcaccuugggacuugagugcucccccagaacgggacuggacuucaacgagaugauacuacuaaccaugaaaaacaaagccuggaugguccaccggcaaugguucuucgaucugccccugccguggacguccggcgcgaccaccgagacacccaccuggaauaggaaggaacucuuggugaccuucaagaacgcccacgcaaagaagcaggaggugguggugcugggaucgcaggagggggcgaugcauaccgcacugaccggggccaccgaaauccagaauucagguggaaccaguaucuucgccggccaccugaaaugucgguuaaagauggacaagcucgagcucaagggcaugucuuaugccaugugcacgaacacguucgugcugaagaaggaggucagcgagacgcaacauggcaccauccucaucaagguggaguauaagggcgaggacguuccgugcaaaauucccuucagcacggaggacgggcaaggcaaagcgcacaacgggcgcuugaucaccgcuaacccggucgucaccaagaaggaggagcccgugaacauagaggccgagccgcccuuuggcgagagcaacaucgucaucggcauuggcgacaacgcgcugaaaaucaacugguacaagaaaggcucgagcaucgggaagauguucgaggcgacagcccggggagcacgcaggauggccauccugggcgacacggccugggauuucggcuccgugggcgggguauugaacagccuggggaagaugguccaccagaucuucgggucggcguauaccgcccuuuucagcgggguguccugggugaugaagaucggcaucgggguacuccugaccuggauaggccuaaauagcaagaauaccucaaugagcuuuucguguauugccaucgggaucaucacucuuuacuuaggcgccguggugcaggcagacaugggguguguuauuaacuggaagggcaaggagcugaagugcggcucagggaucuucgugaccaacgaggugcacaccuggaccgagcaauacaaguuccaggcggacucaccaaaacgccuugccacggccaucgccggcgcuugggagaacggggucugcggcauacgaaguaccacacguauggagaauuuacuguggaagcagauugcgaacgagcuuaauuauauccuuugggagaacaacaucaagcuuaccgucguagucggggacaucaucggcguccucgagcagggcaaaaggacgcugacgccucagccgauggagcuuaaguauaguuggaagaccugggguaaggccaagauagugaccgccgagacacaaaacuccuccuucaucaucgacggcccgaacacccccgagugccccagcgucuccagagccuggaacgugugggagguugaagacuauggauucggcgucuuuaccaccaauauuuggcucaagcuaagggagguguacacacaacugugugaccaccgccucauguccgcggccgugaaggacgaaagggcgguccacgccgacauggguuauuggaucgaaagccaaaagaacgggucauggaagcuggaaaaagccucauugaucgaggugaagacgugcacauggccgaagagucacaccauuuggagcaaugggguccucgaguccgacaugaucauucccaagucacuugcggggcccaucucacaacacaaccaccggccaggcuaccacacccagacggcgggccccuggcaccugggcaagcucgagcuggacuucaacuacugcgaaggcaccacagucguuaucaccgaaaacugcgggacgcgcggccccagccugaggacgacuacaguaagcgggaaacucauacaugaauggugcugccgaagcugcacgcugcccccacuucgguacaugggggaggacgggugcugguacggcauggagauccggcccaucucggagaaggaggagaacauggucaagucgcugguguccgccggaagugguaagguggacaacuucacaaugggcguccugugccuugccauacuuuuugaggaaguaaugagagggaaguucggcaagaagcacaugaucgccggcguguuccugaccuucgucuuacugcugucaggccagaucaccuggcgcgacauggcgcacacgcugaucaugauaggcucaaacgccagugaucggaugggcauggguguuaccuaucuggcccuaauugccaccuucaagauccagcccuuucuggccuugggguucuuccugcgcaagcugaccucucgggagaaccuccuacugggggugggucuggccauggcgacgacucugcagcuccccgaggacauugagcagauggcuaacgggaucgcccucggcuuaauggcccuuaagcuuauuacgcaguucgagacguaucagcucuggacggcucugaucucacuuaccugcuccaauaccaucuucacccugacugucgccuggagaacugccacccugauuuuagccggggugagucuacucccugugugccaauccagcucuaugcggaagaccgacugguugccgauggcugucgccgcgauggggguuccgccccucccgcuguucauuuucagccugaaggacacccugaaacgccgcuccuggccucugaacgaggggguaauggccguaggucucguaucuauacuugccuccagccugcuccggaacgacgucccgauggcgggccccuuaguagccgggggcuugcucauugccugcuacguuaucaccgggaccagugcagaccugaccgucgaaaaagcagcggacaucaccugggaggaggaggccgagcagacaggcgugucccacaaccugaugaucacugucgaugacgaugggacuaugcgcaucaaggacgacgagaccgaaaauauccucacgguccuacugaagacagccuuauugaucguuuccggcauuuucccauacagcaucccggccacccuucugguguggcacacauggcagaagcagacgcaacggaguggcguccugugggacgugcccagcccgccggagacacagaaagccgagcuggaggaagggguguaccgcaucaagcagcagggcauauucgggaagacccaggucgggguaggagugcaaaaggagggcguguuccacaccauguggcacgugacacggggcgcgguucucaccuacaacgggaagagacuggagcccaacugggcguccgucaagaaggaccugauuagcuauggggggggauggaggcucuccgcccaguggcagaagggggaggagguccaggugauugcaguagaacccggcaaaaaccccaagaacuuucagaccaugccgggcaccuuccaaaccacuaccggggagaucggcgcuauagcgcuugacuucaagccggggacgagcggcagucccauuaucaaccgcgagggcaagguagugggucuguacggcaauggggucgugacgaagaacggagguuacguguccggcaucgcucagaccaacgcugaaccggaugguccuaccccugagcuggaggaggagauguuuaagaagaggaaccucaccaucauggaccugcaccccgguagcggaaaaacccgcaaauaccugccggccaucguccgggaggcaauaaagcgcaggcugcgcacccuaauccuagcccccacacgggugguagcggccgagauggaggaggcccucaaagggcugcccauccgcuaccaaaccacggcuaccaaaucugagcacacgggccgggagaucgucgaucucaugugccacgcaacguuuacgaugcgcuuauugagcccugugcggguccccaacuacaaccugauaaucauggacgaagcccacuucaccgaccccgccucuauagccgcacgaggcuacaucagcacccgggucgguaugggcgaggcagcagccaucuucaugaccgcgacccccccagggacugcggacgccuucccgcagucuaacgccccgauacaggacgaggaacgcgacauccccgaacgcagcuggaacuccggcaacgaauggaucacugauuuugccgggaagacgguaugguucgugcccaguauuaaggcgggcaacgauaucgccaacugccuccggaagaacggcaagaaggucauucaguuaucccgcaaaacuuucgauacggaguaucaaaaaaccaagcugaacgacugggacuucgugguaaccacagacaucagcgaaaugggagcgaacuucaaggccgaccgggucaucgacccgcguagaugcuuaaagcccguaauuuuaaccgacggccccgagcgcguuauucuagccggucccaugccggucacugcggcguccgcagcccagcggcgcggacgggugggacguaacccgcagaaggagaacgaccaguacauauucaccggccagccccucaacaacgacgaggaccacgcccacuggaccgaggcuaaaaugcuucucgacaacaucaacacgcccgaggggaucaucccggccuuguucgagcccgagcgggaaaaaagugccgccaucgauggcgaguaccgccuuaagggggagagucggaaaaccuucguggaacugaugcgccgcggcgacuuacccguguggcuggcgcacaagguggccagcgagggcauuaaguacaccgaccgaaagugguguuuugaugggcagcguaacaaccagauccuggaggaaaacauggacguugagaucuggaccaaggagggcgagaagaaaaagcuaagaccgcgguggcuggacgcccgcacguacuccgauccgcuggcccucaaggaguucaaagaauucgccgcgggcagaaagucgaucgcccuggaccuaguuacugaaauaggacgggugcccucccaucuugcccaccggacccggaacgccuuagauaaccuggugaugcuccacaccagcgagcacggaggccgcgcuuaccggcacgcuguggaggaacugcccgaaacuauggaaacccugcuccuacugggacucaugauccuguugaccgggggcgccaugcuauuccuuaucagcgggaaagggaucggcaagaccuccaucgggcuuaucugcguaaucgcaucuuccggcaugcucuggauggccgagaucccgcuccaauggaucgccucagcgauaguccuggaguucuuuaugauggugcuccugauaccggagccugagaagcaacgcacgccucaggacaaccagcuggccuacguggucauaggcauccucaccuuggcugccaucaucgcagcgaacgagaugggccuccuagagacaacuaagcgagaccugggaaugucgaaggaaccggggguggugucacccacuuccuaccuggauguggaccuccaucccgccagcgccuggacccuguacgccguggcgacuaccgugaucacgccaaugcugcgccacacuaucgagaauagcacggcgaacgucagccuggccgcuaucgcgaaccaggcaguggugcugaugggcuuggauaaaggcuggccgaucuccaaaauggaccucggcgucccacugcuugcccuagggugcuacagccaggugaacccccugacccugacggcggcugugcugcugcugaucacccauuacgccaucaucgggcccggccuccaggcuaaggccacccgcgaggcacaaaagcgaaccgccgcaggcauaaugaaaaaccccacugucgacggcauuaugaccaucgacuuggaccccgugauuuacgacagcaaguucgagaagcagcugggccaggucaugcuacucgucuugugugcagugcagcuccuucugaugagaaccagcugggcucucugcgaggcucugacacuggccaccggccccaucacuacccucugggagggcucacccgggaaauucuggaacaccacgaucgcgguuaguauggccaacaucuuccguggauccuaccuggcgggggcuggccuagcauuuagcauuaugaaauccgucgggaccggcaagcgcggcaccgggagccagggcgagacccucggggagaaguggaagaagaaguugaaccagcugagccgcaaggacuucgaccuguauaaaaaguccgggaucacagagguggaucggacggaagcaaaggaggggcugaagcgcggcgagauaacgcaccaugccgugucccggggcuccgcaaagcugcagugguucguugagcgcaacauggugaucccggaaggucggguuaucgauuuaggcugcggacgcggaggguggaguuacuauugcgcgggcuuaaagaaggucaccgaggugcggggcuacaccaaaggcgggccugggcacgaggaaccggugccuauguccacguacggauggaacauugucaagcugaugagcggaaaggacguguucuaccucccgcccgagaaaugcgacacccugcugugcgacaucggcgaauccucgcccucccccaccguggaagagagcaggacaauacgugucuugaagaugguggaaccguggcucaagaacaaccaguucuguaucaagguguuaaaccccuauaugcccaccgucauugagcaccucgaacggcuacagcguaagcacggagguaugcuggugagaaacccucugucccggaacagcacucacgagauguacuggauaucaaacggcacagggaacaucguggccagcguuaauauggugagucggcuccuguugaaccgcuucacuaugacgcaccgacgcccaaccauagagaaggaugucgaccuuggcgcagguacucggcacgucaacgccgaacccgagaccccgaacauggacguuauaggggaacgcaucaagcggaucaaagaggagcacaauuccacguggcacuacgacgaugagaaccccuacaagaccugggcauaccacggcuccuacgaggugaaggccaccgggucagccuccagcaugaucaacggcguagugaagcugcugaccaagcccugggacguugugcccauggugacgcaaauggcuaugacagacacgacccccuucgggcagcagcgcgucuucaaggagaagguggacacacguaccccgcgcucaaugcccgguacacggcgcgugaugggcauaacugcagaguggcucuggcguacgcuggggagaaauaagaagccccgucuguguacccgugaggaguucacaaaaaagguccgcaccaacgccgccaugggcgcgguauuuaccgaagagaaucagugggacuccgccaaggcugccguagaggacgaggauuuuuggaagcucgucgaccgggagcgcgagcuccacaagcuggggaaaugcgggagcugcguguacaacaugauggggaagcgggagaagaagcucggcgaguucggcaaggccaaggggucacgcgcaaucugguauaugugguugggcgcccgguaucuagaguucgaggcccuaggguuccuuaacgaggaccacugguucagccgcgagaacuccuacagcggcguggagggggagggccuucacaaacucggguacauucugagagauaucucaaagauucccgggggcgccauguaugccgaugacaccgcggggugggacacucgcaucaccgaagacgaccugcacaacgaagagaaaaucacgcaacagauggacccagagcaccgucagcucgccaaugccaucuucaagcucaccuaccagaauaagguggugaaggugcagcgcccaaccccuacgggcacugucauggacauuaucucaaggaaggaucaacgcggcuccggacaaguggguacguacggccugaacaccuucaccaauauggaggcccaacucauccggcaaauggagggcgagggggugcugaguaaggccgaccuggagaacccccaccugccggagaagaagaucacccaguggcuggagacgaagggcguggagcgcuuaaagcgcauggcgaucucuggcgacgauugcguggugaaacccaucgaugaccgcuucgcaaacgcccugcuggcccuuaacgauaugggcaagguccgcaaagacaucccacaguggcaaccgagcaaaggcuggcacgauuggcagcaggucccguucugcucccaucauuuccaugaacucaucaugaaagacgggcguaagcuggugguccccugccgcccgcaggaugaacucauagggcgcgcccggaucucacagggagcgggcuggucccucaaggagaccgccugccuuggaaaggcauacgcccagauguggagccugauguacuuccaccgccgggaccuucggcuggcguccaacgccaucugcucugcagugcccguucacugggucccgacgagucgcaccacguggagcauccacgcccaccaccaauggaugacuaccgaggacaugcuuaccguguggaaccgggucuggauugaagauaaccccuggauggaagacaagacuccugucacgaccugggagaacgugcccuaccucgggaaacgcgaagaucaaugguguggcagccucauugggcucaccagccgggccacgugggcgcagaacaucccaaccgcaauccagcaggucaggucacuuaucggaaacgaagaguucuuagauuauaugcccucaaugaagcgguuccgcaaggaggaagaaagcgaaggggccauuugguga

SEQ ID NO: 25847 - RNA, 9873 nt, Artificial Sequence
  derived and/or modified CDS sequence (opt11) from DENV-3__JF920402__SS-prME
acuucccucuguuugaugaugauacugccggcagcacuagcuuuccaccugaccucgcgcgacggggaacccaggaugaucgucggcaaaaacgaaagaggaaaaaguuugcuuuucaaaacugcaucgggaauaaacaugugcacccugauugcuauggaccuuggcgaaaugugugaugauaccguaaccuacaaaugcccucauaucaccgaagucgaaccggaagacaucgacugcuggugcaaccuaacaaguacaugggucacauauggcacgugcaaccaagcaggagaacacagacgagacaaacgguccguagcuuuggcgccucacguggguauggggcuugacacgcgcacacaaacuuggauguccgcagaaggagccuggcgacaagucgaaaagguagaaaccugggcacuacggcauccgggcuuuaccauauuagcauuguuucuagcccacuacaucggaaccagccucacgcaaaaaguugucaucuuuauucuccuaaugcucguaacucccucaaugacaaugcggugcguugggguugggaaccgagacuucguugaaggccugagcggagcaacgugggucgacgugguccucgaacacggaggaugcgugacaacgauggccaaaaacaaaccgacacuagacaucgaauugcagaaaacagaagcaacacagcuagccacucuacgcaaguuguguauugaaggcaaaaucacaaauaucacaaccgacucacggugccccacacaaggcgaggccacccuacccgaggagcaagaccaaaacuacgugugcaagcacaccuacguagaccgcgguuggggcaauggauguggguuauucgggaagggaagccuagugaccugcgcgaaauuucaauguuuagagccgauagagggcaaaguuguucaacaugagaaccuaaaauauaccgugaucauaacaguacacaccggcgaccaacaucaaguagguaaugaaacccaagguguuaccgcagaaauaacgccccaggccagcacaacggaagcgauacuacccgaguacggaaccuuaggcuuagaguguaguccccgaacagggcuagacuucaacgaaaugauacuauuaaccaugaaaaacaaagcauggaugguccacaggcaaugguucuucgaccuaccucuaccguggacaucuggagccacgaccgagacccccacguggaaucggaaagagcugcuaguuacauucaaaaacgcccacgccaagaaacaagaaguagucguacuugggucccaagaaggcgcaaugcacaccgcgcugacaggcgccacggagauucagaacucuggcggaacuucuaucuucgcaggccaucuaaaaugucgucuaaagauggacaaacuggaacugaagggcaugagcuacgcuaugugcacgaauacguucgugcucaagaaagaaguuucagaaacccagcacggaacgaucuugaucaaaguggaguauaaaggcgaagacgucccuuguaaaauaccauucaguacagaagacggccaaggaaaggcccacaacggaagguuaauaacggccaacccaguggucacaaagaaagaagaaccaguaaacauugaagcagaaccacccuuuggagagagcaacauaguuaucgguauaggggauaacgcccuuaaaauuaacugguacaagaaagggucaagcauaggcaaaauguucgaggcgacagcacgaggugccaggcggauggcaauacucggagacacagccugggacuucgguagcguagggggaguccugaacucccucggaaaaaugguccaucagauauucggaucugccuacacugcccuauucagcgguguuaguuggguaaugaaaaucgguauaggaguacuguuaacguggauaggacugaauaguaagaacacaucgaugagcuuuucauguaucgcgauaggcauuauaacauuguacuuaggagccguaguacaagccgauaugggcugcguaauaaacuggaaagggaaggaacuaaaaugcgggagcggcauuuucgucacaaacgaaguucacacuuggacggaacaauauaaauuccaggccgacucaccaaaaagacucgcuacugcaauagcgggcgccugggaaaacggcgugugcggaauuaggucaacaacgcgaauggaaaaucugcuuuggaaacaaaucgcaaacgagcucaauuacauccucugggaaaacaacauaaaacuaacaguagucguaggagacauuauagguguacuugagcaagggaagaggacacucaccccucaaccaauggaacugaaauacucguggaagaccuggggaaaagccaagauagugacagcagaaacccaaaacucuuccuucaucauugacggcccgaacacaccagagugccccucaguaucccgagcauggaauguaugggaaguugaagacuacgguuuugggguauucacuaccaacauauggcucaaacuaagggagguauauacgcaacugugcgaccauagacucaugagcgcggccguaaaggacgaaagggcaguacaugcggacaugggauacuggaucgaaagccagaaaaacgggagcuggaaacucgaaaaggcgucauuaauagaggucaagacguguacguggccuaaaucccacacgcucugguccaacggaguucuugagucugauaugauaaucccaaagucacuugcugggccaauuagccagcacaaccacagaccgggcuaccacacccagacggcagggcccuggcaucugggaaagcucgaauuagauuuuaacuacugcgaaggcacaacagucgucaucacagaaaacugcggggcaagagguccgagccuacggaccacgacaguaucugguaagcuaauacacgaauggugcuguagaagcugcacacuuccgccgcuaagauacaugggugaagacggguguugguauggcauggaaauaaggccuauaagcgagaaggaagaaaacaugguaaagucgcucguaucagccggcagcgggaaaguggacaacuucacuaugggcguccugugccucgcuauacucuucgaagaggucaugaggggcaaauucggcaaaaagcauaugaucgcaggagucuuuuucacuuucguccuacuucucagcggccagauaacguggcgggacauggcgcacacccuaauaaugaucgguagcaacgcaagcgacagaaugggcaugggagugacauaucuagcacucaucgccacuuucaagauacagccauuucuagcacugggguucuuccucagaaaacuaaccagcagggagaaccuccugcuaggcguaggauuggccauggcgaccacgcugcaacuacccgaagauaucgaacagauggccaacggcaucgcccucgggcucauggcucucaaacuuauaacgcaguucgagaucuaccaacucuggaccgcgcugaucagccuaacaugcaguaacaccauauucacccuuacugucgcuuggagaacggcgacucugauacuagccgggguaucccugcugccgaugugccaaaguucauccaugcgaaaaacagacuggcuuccgauggccgucgcagcaaugggagucccuccguugccacuauucauauucucgcuuaaggacacacuuaaacgaagaucauggccccucaacgaaggaguuauggcaguagggcucguaagcauauuagccaguagccuacugcgcaacgacguaccaauggccggaccgcuggucgccggugggcuacugauagcgugcuauguuauaaccggaacuucagcagaucugaccguggagaaggccgccgacauuaccugggaggaagaggcagagcagacuggugugucucacaaccugaugauaaccgucgaugaugacgggacaaugagaauaaaagacgacgagaccgaaaacauacugacgguacuccucaaaacagcguuacugauagugagcggcaucuucccguacucaauaccagcgacguuauuaguauggcacaccuggcaaaagcaaacgcagagaucaggggugcuaugggacguacccagcccgcccgagacccaaaaggcagaauuagaggaaggcgucuacagaauuaagcaacaaggaauauuugguaaaacccagguagggguugguguccaaaaagaaggagucuuccacacgauguggcacgucacuagaggcgcagugcuaacuuacaacgggaagcggcuagaaccaaauugggcaucaguaaagaaagauuuaaucuccuacggaggaggguggcggcucucagcccaguggcaaaagggggaagagguacaagugaucgcaguggaacccgggaaaaacccgaaaaacuuccagacaaugccaggaacguuccagacaacgaccggagagaucggagccauugcucuggauuucaagccaggaacaagugggagcccgaucaucaauagagaagguaaggucgucggccuguaugggaacgggguagucacgaaaaacgguggguacguguccggaauugcccagaccaacgcugaaccggauggccccacucccgaacuugaagaagagauguucaaaaagagaaaccuaacuauaauggaccuucacccggguucggguaaaacaagaaaauaucucccggcgaucguccgggaagccaucaaacgccgcuugagaacacugauccucgcgccgacacgugugguggcugcggaaauggaagaagcucugaaggggcugccgauucgguaccaaacaacugcaacaaaauccgaacauaccggacgcgagaucguggaccugaugugccacgcaacguuuaccaugagacuacuaucaccgguacguguacccaauuacaaccuaauuaucauggacgaagcccacuucaccgacccagccucgauagcggcgagaggcuauaucucaacccggguaggaaugggagaagccgcggccauuuuuaugacugccacgccuccgggaacugcagacgcguuuccccagagcaaugcaccaauacaagacgaggaacgagacauucccgaacgguccuggaacuccggaaacgaguggaucaccgacuucgcuggcaaaaccgucugguuugucccaagcaucaaagcggggaacgacauagccaacugccucaggaagaauggaaagaaggucauucaacuguccagaaagacauucgacaccgaauaccagaaaacaaaacugaacgauugggacuuuguaguaacaaccgacauuagcgaaaugggggcgaacuucaaggcugacagagucaucgacccacgacguugcuugaaaccaguaauauugacugauggccccgaacgagugauacucgcgggucccaugcccguaacagcggccucggcagcucagagacgcggccgggugggcaggaacccgcaaaaggaaaaugaccaauacauauuuacaggacaaccccugaauaacgacgaagaucacgcacauuggaccgaagccaagaugcuucucgacaauauaaauaccccagaagguaucauuccugcguuauucgaaccugaacgagagaaaagcgcagccaucgacggggaauaccgucuaaaaggggaauccagaaagaccuuuguugaacugaugcgccgaggcgaccugccggugugguuggcgcacaaaguagcguccgagggcauaaaguacacggaccgcaaauggugcuucgacggccagcgcaacaaucaaauauuggaagagaauauggacguagagauuuggacgaaagaaggcgagaaaaagaagcuccguccuagguggcucgaugccaggacguacagcgacccacuggcccugaaggaguucaaagaguucgccgcuggcagaaaauccauugcacucgaccugguaaccgagaucggacgcgucccaagccaccuggcacaccgcacccguaaugcccucgacaaccuaguuaugcugcacacaagcgaacacgggggcagagcauaccgacaugcaguagaagaacucccagaaacaauggaaacccuccugcugcuuggccucaugaucuugcuaacgggcggcgcuaugcucuuucuaauaagcggaaaaggaauaggaaagacaagcaucggacucaucugcguaaucgcuucaaguggaaugcuguggauggccgagaucccguugcaguggaucgccuccgccaucguacuagaguucuuuaugaugguacuguuaaucccggaaccggagaaacagcgaacaccacaggacaaccagcuagcguacguagugauagggauccuaacacuugcggccauuauagcagccaacgaaaugggccugcuggagacgacaaaacgcgacuuaggcaugaguaaagaaccgggaguuguaucgcccacgucauaccucgauguagaccuccaucccgcaagugccuggacgcucuacgccguggccacaacggucaucacgccuaugcuucgacacacaauagagaacaguaccgcgaaugucagcuuggcggcgaucgcuaaucaagccguggucuuaaugggacucgacaagggcuggcccauuucaaagauggacuuaggcgugccgcuccuagcccuggguuguuacagucaggucaauccacugacgcuaacagcggccguccuccuucuaauaacgcauuacgccaucaucggaccgggacuccaggcaaaagccaccagagaggcccagaaaaggacggcagccggcaucaugaagaacccgaccguagaugguaucaugacuauugauuuagacccgguaauauacgauaguaaguucgagaaacagcuuggacaagucaugcuguugguccucugcgugguacagcuacugcucaugaggaccucaugggcacucugcgaggccuugacgcucgcaaccggccccaucacaacacuuugggaagguagcccagggaaauucuggaacaccaccauugcugugagcauggcaaacauauuccgaggcagcuaccucgccggugcgggacuagcguuuagcaucaugaaaaguguaggcacagggaagagaggcacugggucccaaggcgagacccucggggagaaauggaaaaagaaauuaaaccaacugucuagaaaggacuuugaccucuacaagaaaaguggaauaacagaagucgaccgaacagaagccaaagaaggacugaaacgaggcgagauaacacaucaugcagucucccguggcagcgcaaagcuacaaugguucgucgaacgcaauauggucauacccgaaggacgggucauagaccugggcugcgggcggggaggcuggagcuauuacugugcaggacucaagaagguuaccgaaguucggggguacacgaagggcgggcccgggcacgaagaacccguuccgaugaguacguacggcuggaacaucgucaaacucaugagcgguaaagacgucuucuaccuacccccagagaagugcgauacacuccucugcgacauaggcgaauccagccccaguccaaccguagaagaaucaaggacaaucagggugcucaagauggucgagccuuggcucaagaauaaccaauucugcaucaaaguccugaaccccuacaugccuacaguaaucgagcaccuagagaggcuccaacgcaaacacgggggaaugcuugugcgcaacccccucagcaggaacuccacucacgagauguauuggauaucaaacggaacugggaauaucguggcuagcguaaacaugguuagccgacugcuacuaaacagauuuacgaugacgcauagacgccccaccauugagaaggauguggacuugggggcggguacccgccacgucaacgccgagccggagacuccaaacauggacguaauaggagagagaauaaaaaggaucaaggaggaacauaacucaaccuggcauuacgacgacgagaacccauauaaaaccugggcuuaccacggaaguuaugaagucaaggcgaccggaagcgcguccagcaugaucaauggcgugguaaaacuacugaccaaacccugggaugucguucccauggucacccaaauggcaaugacggacacuaccccuuucggacaacaacgugucuuuaaagaaaaggucgacacccggacgccgagguccaugccaggcacccgacgaguaauggguauaacggccgaguggcucuggcgcacacucggaagaaacaagaagccgagacugugcacaagagaagaauuuacaaagaaaguacggacuaacgcagccaugggagcagucuucacugaagagaaucaaugggacuccgcuaaagcugcgguggaagaugaagacuucuggaagcucguagaucgagagcgcgaacuccacaagcucggcaagugcggaucaugcgucuacaacaugaugggcaagcgcgaaaagaagcucggggaguucggaaaagcgaaaggaagucgggcgauaugguauauguggcucggggcuagauaucucgaguucgaagcacugggcuucuugaacgaggaucacugguucucacgcgaaaacucauacuccggggucgagggagaaggccuccauaaacuuggauacauccuccgagacauuagcaaaauaccaggaggagccauguacgcugacgauacagcagguugggacacccgcaucaccgaagacgaucuacacaacgaagagaagauuacgcaacaaauggacccagagcaucgacagcucgccaacgccaucuucaaguuaacguaucaaaauaagguuguaaaaguacagcggccaacccccacgggaaccguaauggacauaaucagccggaaagaccagcgcggcucuggccaagucgggacguacggacuaaacaccuucaccaacauggaggcucaauuaauacgacagauggaaggcgaagggguacucagcaaagcugaccuagaaaacccccaccucccggagaagaagauaacccaaugguuagagaccaaaggagucgagcgacugaaacgaauggcaauuucgggugacgacugcguagugaaaccgaucgacgauagguucgcaaacgcccuccuggcgcugaacgacauggggaagguaagaaaggauaucccgcaguggcagccuucgaaaggguggcacgacuggcaacaggugccguucugcagccaccacuuccacgagcucaucaugaaagacggaagaaaacuugucguaccaugucggccgcaggacgagcugauaggacgggcuaggauaucgcaaggagcgggcuggagucugaaagaaaccgcaugccuugggaaagcguacgcucaaauguggucucugauguacuuccacagacgcgaccuccgacuagcauccaacgcgauauguucagcuguaccaguccauuggguaccgacaagccgaaccaccugguccauacacgcucaucaccaauggaugaccaccgaggacauguugaccguguggaaccgagucuggauugaagacaauccauggauggaggacaagacgcccgugacuacuugggaaaaugucccguaccugggcaaacgcgaagaccaauggugugguagccucauugguuuaacaucacgagcuacaugggcccagaacauaccgacggcaauacaacaggugagaagucuaaucgggaacgaagaguuccucgacuacaugccgucuaugaaaagauucagaaaggaagaggaauccgaaggagcgaucugguaa

SEQ ID NO: 25848 - RNA, 9873 nt, Artificial Sequence
  derived and/or modified CDS sequence (opt11) from DENV-3__JF937652__SS-prME
accagucucugccucaugaugauccugcccgcugccuuggcguuccaccucacuagccgggacggcgaaccccggaugaucguggguaagaaugaacgagggaaaaguuuacuguucaagaccgccuccgggaucaacaugugcacuuuaaucgccauggauuugggggaaaugugcgacaacacggugaccuacaaaugcccccacauaaccgaggucgagcccgaagauaucgacuguugguguaaccugaccuccaccugggugacuuacgggacgugcaaccaggccggcgagcaccggcgggacaagcgguccguggccuuggcgccccauguagggauggggcuggauacucgcacccagaccuggaugucagccgaaggcgccuggcggcaagucgagaagguagaaaccugggcacugagacaccccggguucaccauacucgcgcuuuuucuggcccacuacaucgggacuuccuugacucagaagguaguuaucuucauccugcuuaugcuggucacuccgagcaugacuaugcggugcgucgggguggggaaccgcgauuucgucgaggggcuauccggcgcaacguggguggacguaguccuugagcacggcgggugcguaaccaccauggccaagaacaagcccacccucgacaucgagcuccagaagacggaggcgacgcagcuggcgacgcuccggaaguugugcaucgagggcaaaaucaccaacauuaccaccgacucacgcugcccuacgcagggggaggccacccugcccgaggaacaggaccagaacuauguaugcaaacacaccuacgucgaccgggggugggggaacgggugcggccuuuucgggaaaggcuccuuagugaccugugccaaguuucaaugccuggagccuauagaggguaagguuguacaguaugagaaccucaaauauacggugaucaucaccgugcacacgggggaccaacaccaggucggaaacgagacccagggggugaccgccgagaucacgccccaggccagcaccaccgaggcgguccugcccgaguacggcacccugggacucgaauguuccccgcguacgggccucgauuuuaaugagaugauucugcugaccaugaagaacaaggcauggauggugcaccggcagugguuuuucgaccugccgcuaccauggaccucuggagcuaccacggagacacccacguggaaccgcaaggaguugcuggugaccuucaagaacgcccacgcaaagaagcaagaggucguggugcucgggucccaagagggggcaaugcacacggcccucacuggggccaccgagauccagaacagcggcgggaccucuaucuucgcuggccaccugaagugccgccugaaaauggacaagcuggagcuaaagggcaugagcuaugccaugugcacgaauacuuucguccugaagaaggagguguccgagacccagcacgggacuauacucaucaagguggaguacaagggcgaggacguaccgugcaagauacccuucucuacggaggacgggcagggcaaggcucauaacggacgcuugaucaccgccaaccccguggugaccaagaaggaggaguuggucaacaucgaggccgagcccccguucggggagagcaacaucgugaucggcauuggggauaacgcacugaagaucaacugguacaagaaggguuccagcauugggaagauguucgaggcgaccgcccgaggcgcccgccggauggccauucucggcgacacagccugggacuucggguccgugggcgggguccuaaauucacucggcaagauggugcaccaaaucuucggcagcgcguacaccgccuuauuuagcggcguguccuggguaaugaagaucggcaucgggguacugcuuaccuggaucggccucaauagcaaaaacaccucaaugagcuucuccugcauagccaucggcaucaucacgcuguacuuaggcgccgugguccaggcugacaugggaugcguuaucaacuggaaaggcaaggagcuuaagugcggcucggggaucuucgugacuaacgagguccacaccuggaccgagcaguacaaguuccaggcggacucgcccaagcgccuggcgacggccauugcuggcgcaugggagaacggggugugcggaauacgcagcaccacuagaauggagaaccugcucuggaagcagaucgcgaacgaguugaacuauauccugugggagaacaacauaaagcucaccguggucgugggggacaucaucgggguacucgaacaggggaagcgcacgcugacuccgcagcccauggagcucaaguauaguuggaagaccugggguaaagccaaaaucguaaccgccgagacgcagaacucguccuucauaaucgacgggccgaacacaccggaaugcccgagcgugucccgggccuggaacgugugggaggucgaggacuacggguucggcguguucaccaccaacaucugguugaaacugcgcgaaguguacacccagcucugugaccaccggcugaugucggcggccgugaaggaugaacgcgcagugcaugccgacaugggcuacuggaucgaaagccagaagaacggguccuggaaguuagaaaaagcuagcuuaaucgaggugaagaccugcaccuggccgaagucccacacccuguggagcaacggcguccuggagucagacaugaucauccccaagucccucgcggggccaaucucccagcacaacuaccggcccggcuaccacacgcaaacggccgggccguggcaccuggguaagcuagagcucgacuuuaacuacugcgaaggcaccacaguggugaucacugagaacugugggacgcgaggccccagccugcggacgaccaccgucuccgggaagcugauccacgaguggugcugucgcagcugcacgcuuccgccccuacgguacaugggcgaggacggaugcugguacggcauggagauucgaccgaucuccgagaaggaggagaacaugguuaagucuuuaguauccgccggcuccggaaaggucgacaauuucaccaugggcguguugugccuggccauacuguucgaggaagugaugagagguaaguugggcaagaagcacaugaucgcgggaguauucuuuacguucgugcugcugcucuccggccagaucaccuggcgugauauggcgcacacgcugauuaugauaggcagcaacgccuccgaccggauggguaugggcgugaccuaccuggcucucauagccacuuucaagauccagcccuuccuggcccuuggguucuuccucagaaagcugaccagccgggagaaucuucuacugggcgucggcuuagcgauggccacuacccuccagcugcccgaggacaucgagcaaauggcaaacgggaucgcccugggccucauggcgcugaagcugaucacccaguucgagaccuaccagcucuggacugcccugaucucguugaccugcuccaacaccaucuucacgcucacgguggccuggagaacggcgacacugauccuggccggagucagccuucugcccgugugccaguccagcuccaugcgcaagaccgacuggcugccgauggcaguggcggcaaugggcguuccaccccuuccccuguucaucuucggccugaaagacacgcucaagcgccgcagcuggccgcugaacgagggcgugauggccgugggccuagucuccauacuggcuagcucccugcugcggaaugacgugccuauggcggggccgcucguggcaggagggcuguugaucgccugcuacgucaucaccggcacaucugccgaccuuaccguggagaaagccgcggauaucacgugggaggaagaagcagagcagaccggagugucccacaaccugaugaucaccgucgacgacgacggcaccaugcgcaucaaggacgacgaaacugaaaacauccugaccgugcuguuaaagaccgcgcugcucaucgugagcggcauauucccauauuccaucccagccacccugcuggucuggcacaccuggcagaagcagacgcagaggagcgguguccucugggacguuccuagcccgcccgaaacccaaaaggcagaguuggaggagggcguauaucgcauaaagcagcaggggaucuuuggcaagacccagguggggguaggaguacagaaggaggguguauuccacacgauguggcacgugacgcgcggggcggucuuaaccuauaauggcaaacgccuugagccgaacugggccagcgugaaaaaggaccugauauccuacggaggaggguggaggcuuagcgcccaguggcagaagggcgaggaggugcaagucauugccguggaacccggcaaaaacccuaagaacuuccaaacuaugcccgggaccuuccaaacgaccacaggggagaucggggcgaucgcccuggacuuuaagccgggcaccuccggcagccccaucaucaaccgcgaggggaagguggucggccucuaugggaacgggguaguuacaaagaacgggggcuacgucagcggaaucgcccagaccaacgccgagcccgaugggccgaccccagagcuggaggaggagauguucaagaagcguaaccugaccauaauggacuuacaccccggcuccgggaagacgcgcaaguaccuacccgccaucgugcgggaggcgaucaaacgccgccugcgcaccuugauccuggcuccuacccgcguggucgcggcggaaauggaggaggcccugaaaggcuugcccauaagguaccagaccacagcgacgaaaagcgagcauaccggacgggaaaucguggacuuaaugugucacgccaccuucaccaugcgucuccuaucccccguacgggucccaaacuacaaccugaucauuauggaugaagcgcauuucacggacccggcgucaauugccgcgcgcggcuacauuuccacccgggugggcaugggcgaggcugccgccaucuuuaugaccgcgacgccgcccggcaccgccgacgcuuucccacagucuaacgcuccgauccaggacgaagaaaaggacauucccgagcgcuccuggaacucaggcaacgaguggaucaccgauuucgcuggcaagaccguuugguucgucccauccaucaaagcggggaacgacaucgcgaacugccugagaaagaacggcaaaaaggugauacagcucucccggaagacauucgacaccgaauaccagaagaccaaacugaacgacugggauuucguggucaccacugauaucuccgagaugggcgcgaacuucaaggccgaccgcgugaucgacccgcggcgcugccugaagccggugauccucaccgacggacccgagcgcgucauccuagccggccccaugcccgugaccgcggccagcgccgcccagcgccgggggagaguggggagaaacccgcagaaggagaacgaccaguacaucuucaccgggcagccccugaacaacgacgaggaccacgcucacuggaccgaggcgaagauguuacuggacaacaucaacacgcccgaagguauuauucccgcccuguucgaaccggagcgcgagaaguccgccgccaucgacggugaguaccggcucaagggggagagccgcaagaccuucgucgagcugaugcggcgcggcgauuuaccuguguggcucgcgcacaaggucgccuccgaagggaucaaguacaccgaccggaaauggugcuucgacggccagcgcaacaaccagauacuggaggagaacauggacguggagaucuggaccaaagagggcgagaagaagaagcugcggccccgcugguuggacgcccggacguacagcgaucccuuggcccugaaggaguucaaggaguucgccgcggggcgcaaguccaucgcccucgaccuggugaccgagaucggccgcgucccaagccaccuggcccaccggaccaggaacgccuuagauaaccuggugaugcugcacacguccgagcacgggggccgggccuaccgccaugcgguggaggagcuccccgagacgauggagacccuacuacuccuggggcugaugaucuugcugaccggcggcgccaugcuguuccucaucagcgggaagggcaucgggaagaccagcaucggccuaauaugcguaauagcaagcagugggauguuauggauggccgagaucccccuccaguggauugcgagcgcuaucguccuagaguucuucaugaugguguuacucauccccgaacccgaaaagcagcggacgccccaggacaaccagcuggcguaugucgugaucggcaucuuaacccucgcugccaucaucgccgcgaacgagaugggucugcuugagaccaccaaaagagaccucggcaugucgaaggagccuggugugguguccccaacgucauaccuggacguggaccugcaccccgcguccgcauggaccuuguacgcuguggcgacgaccgucaucacacccaugcugagacacaccaucgaaaacagcacugcaaacgugucucuggccgccaucgcgaaccaggcggugguccuuaugggguuggacaaaggcuggccaaucagcaagauggaccuuggggucccgcuccuggcccugggaugcuauucccagguaaaccccuugacccugacggccgccgugcugcuccugaucacccacuaugccaucaucggaccuggguugcaggcgaaagccacgcgggaagcccagaagcggaccgccgccggcaucaugaagaauccaaccguugacgggaucaugaccaucgaccucgacccggugaucuacgacucaaaguucgagaagcagcugggccaggucaugcuucucgugcucugcgcgguucagcugcuccugaugcgcaccagcugggcccugugcgaggcgcucacccuggcaacgggccccaucaccacccugugggaggggagccccggcaaguucuggaacaccacgaucgcggucuccauggcuaacaucuuucgcgggagcuaccucgccggagccggacuggccuucuccaucaugaagucugugggcaccggaaagcgcggcaccggcucccaaggggagacccugggcgagaaguggaagaagaaacuuaaccaacucagcaggaaggauuucgaccuauacaagaaguccgggauaaccgagguggaccgcacggaggcaaaggagggcuugaagcguggcgagaucacccaccacgccgucucccgcggcagugccaagcugcagugguucguggagcggaacauggugauccccgagggccgcguaauugaccugggauguggccgugggggcuggucauauuacugcgcaggccucaagaaggugaccgagguucgcggguacacuaagggcgggccggggcaugaggagccaguccccaugagcacguacggguggaacauugugaaacugauguccggcaaggacguauucuaccuaccacccgaaaagugcgacacacugcucugcgacauuggggagagcucccccucacccacggucgaggagucccgaacuauccgcguacugaagaugguggagcccuggcucaaaaauaaccaauucuguauuaagguccuaaacccguacaugcccacggugaucgagcacuuggagcgccugcagcggaaacacgggggcaugcuagugcgcaauccgcugagccgaaacuccacacaugagauguacuggauaagcaacgggaccggcaacauagucgccuccgugaacaugguguccagacuguuacugaaccgauucacaaugacccacagacggcccacgaucgagaaggacgucgaucuaggcgccgggacccggcacgucaacgccgagccggagaccccuaacauggauguuaucggcgagcggauaaagagaaucaaggaggagcacaacuccacguggcauuacgacgacgagaaucccuacaagaccugggccuaccaugguucguacgaggucaaggccaccggcuccgccagcuccaugauaaacggcgucgucaagcuccuaacaaaaccuugggacgucgugcccauggucacccagauggccaugaccgacaccacgcccuucggccagcagcgcguguuuaaggagaagguggacacgcgcacgccccguagcaugccgggcacacgccggguuaugggaauaaccgccgaguggcuguggcgaacacucggccggaacaaaaagccccgcuugugcacccgcgaggaguucacuaagaaggugcguacaaacgccgccaugggggcuguguuuacggaggagaaccaaugggauagcgcgaaagccgccgucgaagacgaggacuucuggaagcugguggaucgcgaacgggaacuccauaagcugggaaagugcggguccugcguguauaacaugaugggcaagcgcgagaagaaacugggcgaguucgggaaagcuaaaggcagccgggcgaucugguacauguggcucggggcccgcuaucucgaguucgaggcccugggcuuccucaacgaggaccacugguucucacgagagaacucguacuccggaguagaaggcgagggccugcacaaacugggguacauccuccgcgacauuucuaagauaccugggggugcaauguacgccgacgauaccgcgggcugggauacacggaucaccgaggacgaccugcauaacgaggagaaaauaacacagcagauggaccccgagcacagacaguuggcaaaugccauauucaagcugacguaccagaacaagguggugaaaguccaaagaccgacaccgacaggcaccguuauggacaucaucucccgaaaggaccagcgaggcagcggccagguggggacguacggucugaauacauucaccaacaugggggcccagcugauccggcaaauggagggugagggcguccucuccaaggcagacuuagagaauccccaccucccggagaagaagaucacccaguggcucgagacgaagggcguggagcggcucaagcgcauggcgaucuccggcgacgacuguguggucaaaccgaucgaugacagguucgccaaugcucugcucgcccugaacgacauggggaaggugcgaaaggacaucccccaauggcagcccuccaaggguuggcacgacuggcagcaagucccguucugcagccaccauuuccacgagcugauaaugaaggacgggcggaagcucguugugccgugccggccccaagacgagcugaucggccgggcacgcauuucccagggcgcaggguggagccugaaggaaaccgccugccucggcaaggcguaugcccagauguggucccugauguacuuccaucggcgcgaccugcgacucgcgucaaacgccaucugcuccgcagugcccguccacugggugcccaccagcaggaccaccugguccauccacgcccaucaucaguggaugacuaccgaggacaugcugacaguguggaacagagucuggaucgaggacaacccuuggauggaggacaagacacccgucaccacgugggagaacgugcccuaccuggggaaacgggaggaccaguggugcggcagcuugauugggcuaaccagccgcgcuacgugggcgcagaacaucccuaccgcgauccagcagguccggagucugaucgguaacgaggaguuucucgauuacaugccguccaugaagcgcuuccggaaggaagaggaguccgagggcgccaucugguga

SEQ ID NO: 25849 - RNA, 9873 nt, Artificial Sequence
  derived and/or modified CDS sequence (opt11) from DENV-3__JF920404__SS-prME
accucgcuguguuuaaugaugauccugcccgccgcccuggcguuucaccucacaagccgggacggggagccccggaugaucgugggaaagaacgaacggggcaaaagccugcucuucaagaccgccagcgguaucaacaugugcacccuaaucgccauggaccugggcgagaugugcgacgacaccgugaccuauaagugcccccacaucaccgaggucgagcccgaagacaucgacugcuggugcaaccugaccagcaccugggugaccuacggaacgugcaaucaggcuggcgagcaccggcgcgacaagcggucuguggcccucgcgccgcacguagguauggggcuggacacccgcacccagaccuggaugagcgcagagggcgcguggcgucagguggagaagguggagacgugggcccugagacacccgggguucacuauucucgcgcuguuucuggcacacuacaucggcacuucccucacucagaagguggugaucuucauucugcugaugcucgucacucccagcaugaccaugcgcugcguggggguuggcaaccgggacuuugucgaaggacuguccggggccacuuggguggacgugguccuggagcacggcggaugcgugaccacgauggccaaaaauaagcccaccuuggacauagaacugcagaagaccgaagccacccagcuggccacucuccgaaaacugugcaucgagggcaagaucaccaacauaaccaccgacagccgcugcccgacgcaaggcgaggcgacucuaccggaggagcaggaccagaacuacgugugcaagcacacauacgucgaccggggguggggcaacgguugcgggcucuucgggaaaggcucccuggugacuugcgccaaguuccagugccucgagcccauagagggaaaaguaguccaguaugaaaaccucaaguacacggugaucaucaccgugcacaccggggaccagcaccaggucggcaacgagacccaaggggugacggccgagaucacgccccaggccagcaccaccgaagcgauccugcccgaguauggcacacuggggcucgagugcuccccgcgcacgggccuggacuucaaugagaugauucuacucacaaugaagaacaaggcauggaugguccacaggcagugguucuucgaccugccccugcccuggacaagcggcgccaccacggaaacccccaccuggaacagaaaagaacuucucgugacuuucaaaaacgcccacgccaagaagcaggagguggucgugcuggggucccaggagggcgcgaugcacacggcacucaccggugccacagagauacagaacagcggcgggaccuccauauuugccggccaccuaaagugccgucugaagauggacaagcucgagcugaagggcaugagcuacgccaugugcacgaacgcguucgugcuuaagaaggaagucuccgaaacccagcauggcaccauccucaucaagguagaguacaagggcgaggacgugccguguaagauaccuuucagcaccgaagaugggcagggcaaggcccauaacggccgccugaucacggccaaccccgucgugaccaagaaggaggagcccgugaacaucgaagccgagccgcccuuuggcgagagcaacaucgucaucggcauuggggacaacgcgcugaagauaaacugguacaagaagggcuccagcaucgggaagauguuugaggccacugcgcggggcgccagacggauggccauucugggggacaccgcgugggacuucgggucggugggaggggugcucaauuccuuaggcaagaugguccaccagaucuucgguucggccuacacagcccuguuuucuggcguuuccuggguaaugaagauuggcaucgggguccuccugaccuggaucggccugaacagcaagaacaccuccaugagcuucuccugcaucgcgaucgguaucaucacccucuaccugggggccguagugcaggcggacauggggugcgucaucaacuggaagggaaaagagcugaagugcggcucugggaucuuugugacgaacgagguucacaccuggaccgagcaguacaaguuucaggcggacucccccaagcgccucgccaccgccaucgccggcgcuugggaaaacggagucugcggaauccgcagcacgacccggauggagaaccugcuguggaagcagaucgccaacgagcuuaacuacauccugugggagaacaacaucaaacucaccgugguuguaggggauaucaucggcguguuggagcagggcaagcgcacucugacgccgcagccgauggagcugaaguacuccuggaagaccugggggaaggccaagaucgugaccgccgagacacaaaacuccuccuuuaucauagacggacccaacacgccggaguguccaagcgucucccgggcguggaacgugugggaaguugaggacuacggguucggggucuucaccaccaacaucuggcucaaacugcgcgaggucuauacucaguugugcgaucaccggcucaugagcgccgccgugaaggacgagcgcgccguccacgccgacaugggcuacuggaucgagagccagaagaacggguccuggaagcuggagaaggcgagccugaucgaggugaagaccugcacguggccgaaaucacacacccucuggagcaacggcgugcucgagagcgacaugaucauucccaagagccuggccgggccuaucagucagcacaaccaccggccgggcuaccacacccagaccgccgguccauggcaccuuggaaagcuggaacuggacuuuaacuacugcgagggcacgaccgucgugaucaccgagaacuguggcacccgcggucccagccuccgcacgaccaccguguccgggaagcuaauccaugaguggugcugucgcagcuguacccuucccccccuccgguacaugggcgaggacgggugcugguacggcauggagauccgccccauaucugagaaggaggagaacauggucaagucccugguguccgccggcagcgguaagguagacaauuucacgaugggaguccugugccucgcgaucuuauuugaagaggugaugcgggggaaguucggcaagaaacauaugaucgcggggguguucuucaccuucguccuacuccuguccggccagauaaccuggcgggacauggcccauacccuaaucaugaucggcagcaacgccagugaccggauggggaugggugugaccuacuuagcccugauugccacauuuaagauccagccguucuuagcacucggguucuuccuucgcaagcugaccagccgggaaaauuugcugcugggcgugggccucgccauggcuaccacgcugcaacugcccgaggacauagagcagauggcgaacgggaucgcccucggccugauggcccugaagcucaucacccaguucgagaccuaccagcuuuggaccgcccuaaucucucucacaugcagcaacaccaucuuuacccugaccguugccuggagaacggcgacgcuaauccucgcuggggugagccugcugccggucugccagucgagcuccaugcggaagaccgacuggcuacccauggccguugccgccaugggcgugccuccccucccgcucuucaucuucgguuuaaaggacacccuuaagcgccguagcuggccccugaacgaggggguaauggccgugggccucguguccauucuggcgucuucccuacuccguaacgacgugcccauggccggcccccugguggccggcgggcugcucaucgcuugcuacgugaucacgggcaccucggccgaccugaccgucgagaaggcggcggacauuacaugggaggagggggccgagcaaacgggggugagucacaacuuaaugaucaccguggacgacgacggaaccaugcggaucaaagaugaugagaccgagaacauccucaccgugcuauuaaagacggcacuccuaaucgugagcgggaucuucccguacuccauucccgcgacccugcucguguggcacacguggcagaagcagacccaacggagcggcguccugugggacgugccaucuccgcccgagacacagaaggcggagcuggaggagggcguuuaccgcaucaagcagcagggcaucuucgggaagacccaggugggcgugggcguacagaaggaggggguauuccauaccauguggcacgugacccggggcgccguguuaacguacaacgggaaacgccuggagcccaacugggccagcgucaagaaggaccugaucucguauggcgggggcuggcggcucagcgcccaauggcagaagggcgaggagguccagguaaucgcuguggagcccgggaagaaccccaagaacuuccagaccaugccgggaaccuuccagacaacgaccggggagaucggcgcaaucgcccuggacuucaagcccggcaccagcgggagccccaucaucaaccgcgaaggcaaggugguggggcuguauggcaacgggguagugaccaagaacggcggcuacgugagcgggaucgcccagacgaacgccgaaccggacggccccaccccggagcuggaagaagaaauguucaagaagaggaaccucaccaucauggaccugcaccccggguccggcaagacccgcaaauaccugccggcgaucguccgggaggccaucaagcgccggcuccggacacuuauccuggcccccacccggguuguggccgcagagauggaggaggcgcucaaggggcugcccauccgcuaccagaccaccgcgaccaaauccgagcacaccggucgugagauuguagaccugaugugccacgccaccuucaccaugcgccuccugucccccguacggguccccaacuacaaccugaucaucauggacgaggcccacuucacggaccccgccagcauagcugcccgcggauauaucuccacgcgggucgggaugggcgaggcagccgcgaucuucaugaccgccacgcccccugggacggccgacgcguucccgcagagcaacgcacccauccaggacgaggagcgcgacauuccggaacgcuccuggaacagcggcaacgaguggaucaccgacuucgcgggaaagaccgugugguucguccccuccaucaaagcuggcaacgacaucgcgaacugccuccggaagaacggcaagaaggucauccagcugucacguaagacguuugauacggaguaucagaagaccaagcugaacgauugggacuucguggugacaaccgacaucuccgagaugggggccaauuucaaagccgacaggguaauugacccgaggcgcugccucaagcccgugauccugacugacgggcccgaacgcgugauccuggcagggccgaugccggucaccgccgccagcgccgcucagcggcgaggucggguggggcgcaacccccaaaaggagaacgaccaguauaucuucaccggccagccucucaacaacgacgaagaccacgcccacuggacagaagccaagaugcugcuggacaacaucaacacccccgagggcaucaucccggcccucuucgagcccgagcgggagaagagcgcggcaaucgauggcgaguaccgucugaagggagagagccgaaagacguucguugagcugaugcgccgcggggaccuccccgucuggcuggcccacaagguggcgucagagggcaucaaauacaccgaucgaaagugguguuucgacggccagcggaacaaccagauucuggaggagaacauggacguagagauuuggaccaaagagggggagaagaagaagcuccgcccccgguggcuggacgcccgcaccuacagcgacccgcuggcccucaaggaguucaaggaguucgcggccggucgcaagucuaucgcccuggaccuggugacggagaucgggagagugcccucacaccucgcccaucgcacccggaaugcuuuggacaacuuagucaugcuccauaccuccgagcacggcgggcgcgcguaccggcacgccguggaggagcugcccgagacaauggaaacgcugcuccuacugggccucaugauccugcugacgggcggugccaugcuguuccugaucucugguaagggaaucggaaagaccagcaucgggcugaucugcgugaucgccuccagcggcaugcucuggauggccgagaucccucugcaguggaucgcguccgcaaucgucuuagaauucuucaugauggugcuccugauccccgagcccgagaaacaacgcacaccccaggauaaccaacuggccuacguugucaucggcauccucacauuggccgccaucaucgcggccaacgagauggggcugcucgagaccaccaagcgggaccugggaaugagcaaggagcccgggguggugucccccaccagcuaccuggacgucgaccuccaccccgccuccgcauggacgcuguacgcugucgccaccacagugaucacccccaugcugcgccacacaaucgagaacagcaccgccaacgucucccuagccgcuaucgcgaaccaggccguagugcugaugggccuggacaaggguuggccgaucagcaagauggaucucggugugccccugcuagcccucggcugcuacucccaagugaaucccuuaacauugaccgccgcagugcuccugcugaucacgcacuacgcgaucaucgggcccggacuccaggccaaggcgacccgugaggcccagaagcgcaccgccgcggggauaaugaagaacccgacaguagacggcaucaugacgaucgaccuggaccccguaaucuacgauagcaaguucgaaaagcagcugggccaggugaugcuacuaguccugugcgccgugcagcuccugcuaaugcgaaccucuugggcccuuugcgaggcccuaacucucgcgaccgggcccaucacgacccucugggagggcagcccuggaaaauucuggaauaccaccaucgccgugucuauggccaacaucuuccgcggcagcuaccuggccggggccgguuuggcguucucgaucaugaaguccgugggcaccgguaagcgcggcaccggaucccagggcgagacccucggugagaaguggaagaagaagcugaaucagcugagccgcaaggacuuugaccucuacaagaaguccgggaucaccgaaguagaccgaacugaggccaaggagggccugaaacgcggcgaaaucacgcaccaugccgucucccggggcagcgccaaauuacagugguucguugagcgcaacauggucauuccggaggggagggugaucgaccucggcugcgggaggggcgguuggucguacuacugcgccgggcugaagaaggucaccgaggugcggggcuacaccaagggcgggcccggacacgaggaacccgugccgaugagcacauacggcuggaacaucgucaagcuaauguccggcaaggacguguucuaccucccgccugaaaaaugugacacucugcugugcgacaucggggagagcucucccagucccaccgucgaggagagucgcaccauccgcguccugaagaugguggagccguggcuuaaaaacaaucaguucugcaucaaggugcugaaccccuacaugcccacuguaaucgaacaccuagagcgguugcagcgcaagcacggcgggaugcuggugcgaaacccccugagccgcaacuccacgcacgagauguauuggaucagcaacggcaccggcaacaucguagcguccgucaacauggugagcaggcuccugcugaaucgcuucaccaugacccaccgacgcccgacgaucgagaaggacguggaccucggggccggcacccgacacgucaacgccgagcccgagacccccaacauggacgugaucggggagcgcaucaagcggaucaaagaggagcacaacuccaccuggcacuaugacgacgagaacccguauaagacgugggcuuaccauggcagcuaugaggugaaggccacuggguccgcgucaaguaugaucaacggcgucguuaaauuacugaccaagccaugggacgucgugccgaugguuacucagauggccaugacugacaccacccccuucggacaacagcgcgucuucaaggagaagguggacacccggacuccgcgcagcaugccggggacccggcgcgugaugggcauaaccgcagaguggcuauggcguacccuggggcgcaauaagaagccccggcuaugcacacgcgaggaguucaccaagaagguccgcacaaacgcugccaugggcgccguguuuacugaagagaaccagugggauagcgcgaaggccgccguagaagacgaggacuucuggaagcucgucgaccgggagagggaguuacacaagcuggggaagugcggcuccugcguguacaacaugaugggcaagcgggagaagaagcucggggaguucggcaaggcgaaagggagccgcgccaucugguacauguggcugggcgcacgcuaccuggaguuugaggcccucggguucuugaacgaggaccacugguucucccgcgagaacagcuacuccggcguggagggcgaggggcugcacaagcucggcuauauccugcgggacaucagcaagauccccgggggcgccauguacgcggacgauacggccggcugggacacucgcaucaccgaggacgaccugcacaacgaggagaagaucacacagcagauggacccugagcaccgucagcuagccaacgccaucuucaagcugacguaccaaaacaagguggugaaggugcagcgccccaccccaacugggaccgucauggauaucaucucccggaaggaccagcggggcagcggccaggugggcaccuaugggcugaacacguucacgaacauggaggcucagcucauccggcagauggagggcgagggcgugcuguccaaggcugacuuagagaauccccacuuacccgaaaagaagaucacccaguggcuggagacaaagggggucgagcgcuuaaagcggauggccauuagcggggaugacugcguugugaagcccaucgacgaccgcuucgccaacgcccuccuggcccugaacgacauggguaagguccggaaggacaucccccaguggcaacccuccaagggauggcacgacuggcagcaagucccguucugcagccaccacuuccacgagcucaucaugaaggacggucgcaagcuggugguccccugccggccccaggacgagcugaucggcagagcacggaucucccaaggagccggguggagccuuaaggagacagccugccuaggcaaggccuacgcgcagauguggucccugauguacuuccaccggcgcgaccuccggcuggccagcaaugccaucugcuccgccgugcccgugcacugggucccgaccagccgcacaaccugguccauccacgcccaccaccaguggaugacaaccgaggauaugcugaccguguggaaucggguguggauagaggacaaccccuggauggaggacaaaaccccggucacgaccugggagaacgugccauaccucgggaaaagggaagaccaguggugcggcagccugaucgggcuaacgaguagagcgaccugggcccagaacaucccuacugccauccagcagguacggucccucauaggcaacgaagaguuccuggacuauaugcccuccaugaaacgguuccgcaaggaggaggaguccgagggcgccauaugguaa

SEQ ID NO: 25850 - RNA, 9873 nt, Artificial Sequence
  derived and/or modified CDS sequence (opt11) from DENV-3__JF937641__SS-prME
acgagccucugccugaugaugauauugcccgcggcacuugccuuccacuuaacuucgcgugacggagaaccgcgaaugauuguaggcaaaaaugaaagaggaaaaagccuacucuucaaaacagcgagcgggauaaacaugugcacacugaucgcgauggaucuaggagaaaugugcgaugauaccgugacauauaaaugcccccacaucaccgaaguugaaccggaagacauagacugcuggugcaaccucacauccacguggguaaccuacggaacauguaaccaagcuggagaacaccgccgugauaaacgaagcguagcgcucgcgccccacguaggaaugggacuagacacaaggacgcaaaccuggaugagcgcagagggagccuggaggcaaguggaaaaagucgaaacuugggcacugagacacccaggauucaccauacucgcacucuuccuagcgcacuacauagggacaucgcuaacgcaaaaaguagucaucuucauacuccugaugcuaguaacacccuccaugacaaugcggugcguaggagugggaaacagagacuucguggaaggccuguccggggccacauggguagacgugguacucgagcacggcggcugcgucacaacgauggccaaaaacaaaccaacacuggacauagaguugcagaaaacggaggccacgcaguuggcgacgcuccggaaguuguguaucgaaggcaaaaucacgaauauaacaacugacagcagaugcccaacgcagggagaggcgacccugcccgaagaacaagaccagaacuacguaugcaaacacacguaugucgacagagguugggggaacgguuguggauuguucggcaaggguagcuuggugaccugugcgaaauuucaaugcuuggagccaauugaaggcaaaguaguucaguacgaaaaccugaaauacacgguaauaauaacagugcauaccggcgaccagcaccagguaggcaacgaaacgcaaggcgugaccgccgaaaucacaccccaagcaagcacaacagaagcaauacuucccgaguacgguacuuuaggccuggaguguucaccccgcacagggcuugacuucaaugagaugaucuuguuaacgaugaaaaacaaagcguggauggugcaccgccagugguucuucgaccugccacugccguggacgucaggagcuacuacggagacgccaacguggaaccgaaaagaauuauugguaacuuucaaaaacgcccaugcaaagaaacaagaaguggugguacuaggaagucaggagggggcgaugcauacagcacuaacgggcgcgaccgaaauacaaaacuccggugguacauccaucuucgccggacaucugaagugcagacucaaaauggacaaacuugagcuuaaaggaaugagcuacgccauguguaccaacgcguuuguccucaagaaagagguaagcgagacucagcacgguacgauuuuaauaaaggucgaguacaagggggaggacgugcccugcaaaaucccauucaguacagaggacggccaaggaaaagcgcacaacggccggcuuaucacugccaaccccgucguaacgaagaaagaagaaccugucaacaucgaagcggaaccgccguucggcgaauccaauauaguaauagggaucggcgauaaugcccuaaaaauaaauugguacaagaaaggaaguucaauagguaaaauguuugaggcaacugcaaggggagcucgcagaauggccauccucggagauacagcaugggacuuuggguccguuggcggaguacuaaacagccucggaaaaaugguccaucagauauucggaagcgcguacacugccuuauucucgggugugagcuggguaaugaaaauaggcaucggaguccuuuugacguggauaggauuaaauaguaaaaacacaagcaugaguuucucaugcauagcgauaggcauuauuacacuauaucucggagccgugguccaagcagacaugggguguguaauaaauuggaaaggaaaagaacuaaaaugcggcaguggcaucuuugucacgaacgagguccacacguggacugagcaguacaaauuucaagccgacucgccaaaacggcuagccaccgcuaucgccggggccugggaaaacggcguaugcggaauacgcaguacgacccgcauggaaaaucuccuguggaaacaaauagcgaacgaauuaaacuauauacuaugggaaaacaauauaaaacuuacgguagugguaggcgacauuauagggguacuagagcagggcaaacgcacccugacaccacaaccaauggaauuaaaauacaguuggaaaaccuggggaaaagccaagaucguuacagcugaaacacaaaauagcucauucauuaucgauggaccaaacacaccagaaugcccuaguguaucuagagccuggaacgucugggagguagaagacuacggguucggugucuucacgacgaacauuuggcuaaaacuccgggaaguuuacacucaacuaugugaccauaggcuaaugucggcagcaguaaaagacgagcgggcuguccacgcagacauggguuacuggaucgagagccaaaagaacggaagcuggaagcucgagaaggcuagccucaucgaaguaaagaccugcacauggccaaagucacauacucuguggucaaacgggguacuagagucggauaugaucauuccaaagucucuggcagggccaaucucgcagcacaaccaccgccccggcuaucacacgcagacggccggcccuuggcaccuagggaaacucgagcuugacuuuaauuacugugaggguacgaccguugucauaacugaaaacugcggcacuaggggaccgucccugagaacaacaacaguuuccgggaaacucauccaugaguggugcugucgcagcugcacuuuacccccacucagguauaugggugaagacggauguugguauggaauggagauccgaccgaucucagaaaaagaggaaaauauggucaagucccuaguuuccgcgggaagcgguaaagucgacaacuucacuaugggcgugcucugccucgccauccuguuugaagaagugaugcgcgggaaauuugggaagaaacacaugaucgcgggcgucuucuuuacauucguccuauugcugagcggacaaaucacguggagagacauggcgcacacacucauaaugaucggaagcaacgccucagaucgaaugggaaugggcguaacauaccuugcccuaaucgcaaccuucaaaauucaaccguuccucgcccuaggguuuuuccuaagaaaacugacgucgagagaaaaccuacuacuaggagugggacuggcuauggccacaacgcuacagcugccugaagacaucgagcagauggccaacggcauugcucucggacuaauggcccucaaacugaucacgcaguucgaaaccuaccagcucuggacagcacugauuagccucacguguuccaacacuauauucacgcucacggucgcuuggcgaaccgcaacucuaauccuggcaggcguuagucuccuaccgguaugccaauccuccuccaugcgcaagacggacugguuaccaauggccguagccgcgaugggggugccaccacuaccguuauucauauucggacuuaaggauacguuaaagcggcgaagcuggccgcugaacgaagggguaauggcuguaggguuaguaagcauccuagcgaguucccugcuacgcaacgaugucccaauggccgggccacucgucgccgggggucugcugaucgcuugcuaugucauaacggggaccagcgccgaccuaacagucgaaaaggcagcagacauaacaugggaagaagaggcggagcagacaggagugagccauaaccuaaugaucacgguagacgacgauggaacaaugcgaaucaaagacgacgagacggagaacauacucacagugcuacugaaaacagcucuacucauagugucaggcaucuuccccuacagcauaccagcgacccuguuaguguggcacacauggcaaaagcagacacaacgaaguggagucuuaugggacguaccguccccaccagaaacucaaaaggcggaauuagaggaagggguuuacagaauaaaacaacaaggaauuuuuggaaaaacccaagucgggguugggguccaaaaggaaggagucuuucauacuauguggcacgugacucgcggggcagugcucaccuauaacggcaagcgccuagagccgaauugggcgucaguuaagaaagaccugaucagcuacggaggggguuggagacucagugcacaauggcaaaagggggaggaaguccagguaauagcgguagaaccggggaagaacccaaagaacuuccaaacaaugcccggaaccuuccagacuacgacuggggagaucggggcaaucgcacuggacuucaagcccggcacaagcgguucacccaucauaaacagagaagggaaagugguaggccuguacgggaacggcguggucacgaaaaacggaggguauguuagcgguaucgcacaaaccaaugcugagccagauggucccacgcccgagcuagaagaggagauguucaagaaacgaaaccugaccauaauggaccugcacccaggcaguggaaaaacccgaaaauaucucccagccaucgucagagaagcgauuaaaagaagacugcgaacucugauacucgcaccaacacgggugguugcagcugaaauggaggaggcacucaaaggccuacccauccgauaccagaccacggccacgaagagugaacacaccggaagagagauaguugaccuaaugugccaugcuacauuuacgaugcggcugcuaucaccgguacgggugccaaacuauaaccucauaauuauggaugaggcucacuuuacagaccccgcaucaauagcggcacgagguuauauaucaacacgcgugggaaugggggaggcggcagcuaucuucaugacagcgaccccaccaggaaccgccgacgcauuuccacaaucuaacgcgcccauccaagacgaggagagggacauacccgaaaggagcuggaacucagggaacgaauggaucacagacuucgccggcaaaaccgugugguucgugcccucaauaaaagccggcaaugacauagcgaauugccucaggaaaaacggaaagaaggucauacaacugagccguaaaacguuugacacggaauaccagaaaaccaaacugaaugacugggacuucguaguuacgacagacaucucggagaugggagcaaacuucaaagccgaccggguaauagauccaaggcguugccucaaacccgugauacucaccgaugggcccgaacguguaauccuggcgggaccgaugccagugaccgcugccuccgcagcgcaacggagaggacgaguggggaggaauccgcaaaaggaaaacgaucaauacauauuuacaggacaaccuuuaaacaaugaugaagaccacgcacacuggacugaggcaaagaugcugcuagacaacauaaauaccccagaaggaauaauacccgcccucuucgaaccagagcgagagaaaagcgccgcaaucgauggcgaauaucgccucaaaggggagagucgcaaaacauucguagagcucaugagacgcggagauuuaccugucuggcucgcacacaagguagcaagcgaaggaauaaaauauaccgaucgaaaguggugcuucgacggccagcgaaauaaccagauauuagaggaaaacauggacgucgagaucuggaccaaggagggcgagaagaagaaacugcgaccgcguuggcuggaugccaggacauauucugacccacuggcacuaaaagaguucaaagaauuugcagcggggcgcaaauccauagcgcuagaucugguaaccgagauaggccgcguuccaucacaccuagcacaccguacgaggaacgcccuagauaaccucgugaugcuacacacaucagagcacggcggcagggcguacagacaugcaguagaagaacugcccgagacgauggaaacgcuacuccuccuuggacuaaugauacuacugaccggaggcgcgaugcucuuuuuaaucagcgggaaagggauaggaaagaccagcauaggcuuaauuuguguaauagcgagcagcgggaugcucuggauggccgaaauuccucuccaauggaucgcuuccgcgauaguucucgaguucuucaugaugguacuauugauaccagaacccgagaaacaacguacgccgcaagacaaccaacuugcuuacgucgucaucggcauacucacacucgcggcaaucaucgccgcaaacgaaaugggccuacucgaaacgacaaaaagggaccucggaaugaguaaagaacccggcguagugucaccgacuuccuaccuggacguugaccugcacccugccagcgcauggacacuauacgcaguggcaacaaccgugauaacgccaaugcugaggcacacgaucgaaaacagcacggcaaacguuagccucgcggccauagcaaaucaggcgguuguacuaaugggguuagacaaaggcuggcccaucuccaaaauggaucuaggcgucccguugcucgcacuugguugcuauagccaagugaauccccugacgcucaccgcagcugugcuacugcucauaacucacuacgccaucaucggcccgggacugcaggcgaaagcaacccgcgaagcccagaaaagaaccgccgccggcaucaugaagaauccgaccgucgaugggaucaugaccaucgaccuggacccuguuauuuacgacagcaaauucgaaaaacaauuaggccaagucaugcugcuaguacugugcgcgguacaacuguuguuaaugcgcacaucaugggcgcucugugaagcacugacguuggcuacgggcccgaucacgacucuaugggaaggcagcccgggaaaauucuggaacacgacaauagcaguaagcauggccaacaucuuucgcggcucauaccuggccggggcagggcuggcuuuuucuauuaugaagucgguaggaacaggcaaaagaggaacaggaucccaaggagaaacguugggagagaaauggaagaagaaacucaaccagcuaagccggaaagacuucgaccuguacaaaaagucuggaauaacagagguugaccguaccgaggccaaagaaggccugaaacggggcgaaaucacgcaccacgcuguuagccgcggaagugcuaagcuacaaugguucguggagcgcaauauggucauaccagaagguagagugaucgaucuagggugcgggcgugguggguggucauacuacugcgcgggacuaaagaaggucacagaaguaaggggauacacaaaaggcggccccggccacgaagaacccgugcccauguccacauacggcuggaacauagucaaacuaauguccggcaaagacgucuuuuacuuaccaccggagaagugcgauacucuccugugugacauaggggaaagcuccccgagcccgacuguagaagaaucacggacgauaagaguguuaaaaaugguagagccauggcucaaaaacaaucaauucugcaucaaggucuuaaacccuuacaugccgacaguuauagagcaccuggaaagacugcaaagaaagcacggcggcauguuagugagaaauccccuuagcaggaacucgacacacgaaauguacuggauaucaaauggaacaggaaacauaguagccagcguaaacauggucucucgccucuuauuaaacagguucacgaugacacacaggagaccuaccauagaaaaagauguagaccuaggcgccggcacacgccaugucaacgcggagcccgaaacaccaaauauggacguaauaggagaaagaaucaagcgcauaaaggaagaacauaacagcaccuggcacuacgacgacgaaaacccguacaagacaugggcauaucauggaagcuacgaagugaaagcgacaggaagcgcaagcaguaugauuaacggcguaguuaagcuccucacgaaacccugggacgucguaccgaugguaacgcaaauggccaugaccgacacgacgccguucggccagcagcgaguguuuaaagaaaaagucgacacccgaaccccucguucgaugccagguaccagacgcgucaugggaauaacagcagaauggcuauggcgcacacucgggcguaauaagaaaccacgccuaugcaccagagaggaguucaccaagaaaguacggacuaacgcagcgaugggggcagucuucacggaggagaaccaaugggacucagccaaagcagcagucgaggacgaggacuucuggaagcucgucgauagggaaagagaauuacauaagcuaggaaagugcggaucgugcguguauaacaugaugggcaagagggagaagaagcugggugaguucgggaaggcgaagggaagccgggccaucugguacauguggcuaggagcuagauaccuggaguucgaagcacugggauucuuaaacgaagaccacugguucagcagggaaaacagcuauucaggcguugaaggagagggacuacacaaguuaggcuacauacugcgugacaucucaaaaaucccagggggcgcuauguacgcggacgacacggcagguugggacacccgaaucacagaagacgacuuacauaacgaagagaaaauaacccaacaaauggacccggagcaccggcaacuggccaacgcgauauucaagcugaccuaccagaacaagguagucaaaguccagagaccuacaccaaccggcaccguaauggacauaaucucccgaaaggaucagagggggucaggacagguggggacguauggacuuaacacauucaccaacauggaagcccaacucauaagacaaauggaaggggaagggguacugaguaaggcggaccuagagaacccucauuuaccggagaagaaaaucacgcagugguuagaaaccaaagggguugaacgccuaaaacggauggccauuuccggcgacgacugcguaguuaagcccaucgaugaucgauuugccaaugcacuauuagcuuugaacgauaugggaaaaguaagaaaggacauuccgcaauggcaaccaucgaaggguuggcaugacuggcaacaggucccauucuguagccaccauuuccacgagcuuauuaugaaagauggccguaagcuaguaguacccugccggccccaagacgagcugaucggccgcgcacgaaucagucagggcgccggguggagucuuaaggagacugcgugucuaggaaaggcauacgcccaaauguggucacucauguacuuccaccgacgagaccuacgacuggccuccaaugcgaucugcucagcuguaccaguccacugggugcccaccucccggacgacauggucaauucacgcccaccaccaguggaugacgaccgaggacaugcucacaguguggaaccgcguguggaucgaggauaacccauggauggaagacaagacgccggugacaaccugggaaaacguccccuaccucggcaaaagagaagaccaguggugcggaucgcucaucggccuaacuagccgagcgaccugggcccaaaacauaccgaccgcuauccaacaggugagaucacuaauaggaaacgaagaguuccuagacuacaugcccuccaugaaaagguuucgcaaggaggaggaaucagaaggagccaucugguaa

SEQ ID NO: 25851 - RNA, 9873 nt, Artificial Sequence
  derived and/or modified CDS sequence (opt11) from DENV-3__JF920396__SS-prME
acgucauuaugccugaugaugauucuccccgccgcccuggcguuccaccucaccagcagagacggggaacccagaaugaucguugggaagaaugagcggggcaagagccugcuuuucaagaccgccuccgggaucaacauguguacgcucaucgccauggaucuuggcgaaaugugcgacgacaccguaaccuacaaaugcccccauaucaccgagguggagccugaggacauugauugcuggugcaaccucacgagcacuuggguuaccuacgggacgugcaaccaggccggugagcacaggcgcgacaagcgguccguugcacuggcaccccacguggggauggggcuggauacccgcacccagaccuggaugagcgccgagggcgccuggcgucagguugagaagguggagacgugggcacugcgccacccgggguucaccauccucgcgcuguuccuggcccacuacaucggcaccucccucacccagaagguggugauauucauccuucugaugcucgucacacccuccaugaccaugcggugcguggguguggggaaccgcgacuucgucgaaggccuguccggggccaccuggguugacgugguccuggagcacggcggcugcgugacaaccauggccaagaauaagcccacguuggacauugagcugcagaaaaccgaagccacacaacuggcgacgcuccggaagcuguguaucgaggggaaaaucaccaacaucaccaccgacagccgcugcccuacgcagggugaagcuacccugccggaggagcaggaucagaacuauguguguaagcacaccuacguggaccgggggugggggaacgggugcggacucuucgggaagggaucccuagugaccugcgccaaguuccagugccuggagcccauugagggcaaggugguccaguacgaaaaccucaaauacacggugaucaucaccgugcacaccggggaccagcaccaggucgguaaugagacgcagggggugacggccgagaucaccccucaggccucgaccaccgaggcgauucugcccgaguauggcacacuuggacucgaguguucuccucgcacgggacuggacuucaacgagaugauccugcucaccaugaaaaacaaggccuggauggugcaccggcagugguucuucgaccugccccuacccuggaccagcggggccaccacggagacccccaccuggaaccgcaaagagcuucuggugaccuucaagaacgcgcaugccaagaagcaggagguggucgugcuggggucccaggaaggcgcuaugcacacggcgcucacuggugcgaccgagauucagaacagcggcgggacauccaucuucgcuggccaccugaagugccgucugaagauggacaagcucgagcugaaaggaaugucguacgcaaugugcacgaauaccuucgugcugaaaaaggaggugucugagacccaacacgggacaauccucaucaagguggaguacaagggagaggaugugccgugcaaaauacccuucucuacggaggacgggcagggcaaggcccacaacggucgcuugauuaccgccaaccccguugugaccaagaaggaggagccggugaauaucgaggccgaaccacccuucggggagagcaacaucgucauugggaucggagacaacgcccugaagaucaauugguacaagaagggcuccaguaucgguaagauguucgaagcgaccgccaggggcgcccgucgaauggccauccuaggcgacacugccugggacuucggguccgugggcggggugcucaacagccugggcaagaugguccaccagauauucggguccgcauacaccgcacuguucagcggcguuuccugggugaugaagauuggcaucggggcccuccugaccuggaucggucugaacagcaagaacaccagcaugagcuucuccuguaucgccaucgggaucauuacgcucuaccugggcgccguagugcaggcagacaugggcugcguggucaacuggaaggggaaggagcugaagugcggcagcgggaucuucgugaccaaugaggugcacaccuggaccgagcaguacaaguuccaggccgauucccccaagcgccuagccaccgccaucgccggcgcgugggagaacggagucugcggcauucgcaguaccaccagaauggagaaccucuuauggaagcagaucgccaacgaauugaauuacauccugugggagaacaacauuaaacuuaccguggucgucggggacaucaucggcguccucgagcaaggcaagcgcacccugacgccgcagccgauggagcugaaguacuccuggaagaccugggggaaggccaagauuguaaccgcagagacgcagaacagcuccuucaucaucgauggccccaacaccccggaaugccccagcgucucacgggcguggaacgugugggagguugaggauuacggguucggggucuucaccacaaacaucuggcucaagcugcgcgagguauauacccagcugugcgaccaccggcucaugagugcggcugugaaggacgagcgcgccgugcacgccgacauggguuauuggaucgagucacaaaagaauggguccuggaagcuggagaaggccucguuaaucgaagugaagacgugcaccuggcccaagucgcacacucucuggagcaacggcgugcuggaauccgacaugaucauccccaagucucuggccggucccaucucccagcacaaucaccggcccggcuaccacacccagaccgccgggccauggcaucugggaaagcuggaauuggacuuuaacuacugcgaaggcacaaccgucgugaucaccgagaacugugggacacgcggcccgagucuccguaccaccaccguguccgggaagcugauccacgaguggugcugccgcagcugcacucugcccccgcuuagauacaugggcgaggacgggugcugguacggcauggaaauccgccccaucagcgagaaggaggaaaacaugguuaagagccuggugagcgcgggaagcgggaagguggauaacuucaccaugggcguacugugcuuagcgaucuuguucgaggaagugaugcggggaaaguucggcaagaagcauaugaucgcgggaguauuuuucaccuucguacuucuucuguccggacagaucaccuggcgcgacauggcgcacacgcucauuaugauaggcagcaacgccuccgaccggauggggaugggugugacauaucucgcguugaucgccaccuucaagauccagcccuuccucgcgcugggguucuuccugcgcaagcugaccagccgggagaaccuccuucugggcguaggccucgccauggcuacgacccugcaauugcccgaagauaucgagcaaauggccaaugggaucgcguugggucugauggccuuaaagcucaucacccaguucgaaacuuaccagcuguggaccgcccugaucagucugaccugcuccaacaccaucuucacccugacggucgcguggcgcaccgccacccugauacucgccggggugucacuguugccggucugccaauccucuagcaugcggaaaaccgauuggcucccgauggccguggcggccaugggagugccaccccuuccgcuguucaucuuuagccuaaaggauacgcugaagaggagaucuuggcccuuaaacgagggugucauggccgugggucucgugaguauucuggcguccucgcugcuccgcaacgacguccccauggccggcccccuuguggccgggggccugcuaaucgccugcuacgugaucaccgggaccuccgccgaccugacagucgagaaggcggccgauaucacgugggaagaggaggccgaacagaccggcgugagccacaacuuaaugauuaccguggaugacgacgggacgaugcgcaucaaagacgacgaaaccgagaauauacucacgguccuguugaagaccgcccuccucaucguaucaggcaucuucccguacucuauccccgcgaccuuacucguguggcauaccuggcagaagcagacgcagcgcuccggcguacugugggacgugccuucaccgccggaaacccagaaagcugagcuggaggaagggguguaccggauuaagcagcagggcauauucgggaaaacccaggucggugugggggugcagaaggaaggagucuuccacaccauguggcacguuacccgcggggccgugcuaaccuacaaugggaagcggcuggagcccaacugggccucggucaagaaggaccugaucaguuacggcgguggcuggcggcucucugcccaguggcagaaaggggaggagguccaggugaucgcagucgagcccggcaagaaccccaagaacuuccagaccaugccaggcacuuuccaaacgaccacuggugagaucggcgccaucgccuuagauuuuaaacccgggaccucgggcagccccaucaucaacagagagggcaagguaguggggcuguacggaaacggugucgugacgaagaauggcggguacguguccggcaucgcccagaccaacgcugagccggacggcccgaccccggagcuggaggaggagauguucaagaaacggaaccucaccaucauggaccugcacccggggagcggcaagacgcgcaaguaucugccggcgauaguccgggaggccaucaaacgccggcuccgcacgcugauccuggcccccacccgggucguggcagccgagauggaggaggcgcucaaggggcugccgaucagauaccagaccacagcuaccaaguccgagcacacugggagggagaucgucgaccugaugugccacgccacguucacgaugcgccuccugucaccaguccgggugccaaacuacaacuugaucauaauggacgaggcccacuucaccgauccugccuccaucgcugcccgcggguacaucaguacacggguugggaugggugaggcagccgcgauauucaugaccgccacgcccccagggaccgccgacgccuucccgcaguccaaugcccccauccaagacgaagaacgcgacauccccgagcgcagcuggaacuccggcaacgaguggaucaccgacuucgcggggaaaaccgugugguucgugcccaguaucaaggcaggcaaugacaucgccaacugucuucggaaaaacgggaagaaggugauccaacugagccgcaagacguuugauaccgaauaccagaagacaaagcugaacgacugggacuucguggugaccacugacauuagcgaaaugggcgcgaacuucaaggccgacagggucaucgacccgcgccggugccucaaacccgugauccugacggacggccccgagcgcgucauucuggcgggucccaugcccgucaccgccgcaucggccgcccagcggcgaggucggguugggaggaacccccaaaaagagaacgaucaguacaucuuuaccggccagccccucaacaacgacgaagaucacgcccacuggacggaggccaagaugcugcuggacaacauaaacacgcccgaagggaucauccccgcccuauucgagcccgagagagagaaguccgccgcgaucgacggggaguaccgccugaagggagagucccgcaagacauucguggagcugaugcgccgcggggaccucccagucuggcuggcccacaaaguagcuucagaggguaucaaguacaccgacaggaaaugguguuucgacggccagagaaacaaccagauucuggaggagaacauggacgucgagaucuggacgaaggaaggcgagaagaagaagcuacgcccccgguggcuggacgcccggacguacuccgauccgcuugcccucaaggaguuuaaagaguuugcugccggcaggaaaagcaucgcgcuggaccuggugaccgaaaucgggcggguacccagccaucuagcgcaccgcacccggaacgcccuggauaaccuugucaugcuacacacaagcgagcacggcgggcgcgcauaucggcacgccgucgaggagcuuccggagacgauggaaacccucuuacugcugggccucaugauacugcugacagggggcgcgaugcuguuccuaaucagcggcaaggggaucggcaagacguccaucgggcugaucugcgugauagcgagcuccgguaugcuguggauggccgaaaucccgcugcaguggaucgcgagcgccaucguccuggaguucuucaugaugguacuucucauccccgagcccgagaagcagagaacaccccaggacaaccaacuggcguacguggucaucgggauccucacccuggccgccauuauagcggcgaacgagaugggccugcuggagacgacgaagcgagaccugggcauguccaaggagccggggguggugagccccaccuccuaccuggacgucgaccuccacccugcuucggcuuggaccuuguacgcaguagcaaccaccguuauuacgcccauguuaagacauacuaucgagaacucuaccgccaacgucagccucgcggccaucgcgaaucaggccguaguacugaugggccuugacaagggguggccgaucucuaaaauggaccuuggugucccgcuacuggcccucggguguuacagccaggugaacccccugacucugacggccgccgugcuccugcugaucacccacuacgcgauaaucggccccggccuucaggcuaaggccacccgggaggcccaaaagcgcaccgccgcgggcaucaugaagaacccgacgguagauggcaucaugaccauagacuuagacccugugauauacgauuccaaguucgagaagcagcugggacaggugaugcuccugguccugugcgccguccagcuccucuugaugcgcaccagcugggcccucugcgaagcccugacccuggcuaccggacccaucaccacguuaugggagggcucacccgggaaguucuggaacacaacgaucgccguuucuauggcuaacaucuuccgcggcuccuaucuggccggagccggacuggccuucagcaucaugaaguccgucgggaccggcaagaggggcaccggaagccagggagagacccucggggagaaguggaagaagaaguuaaaucagcugagccguaaggacuucgaccucuacaagaaaucuggcaucaccgagguggaccggacggaagccaaagaggggcucaagaggggagagaucacgcaccaugcagugagccggggguccgccaagcugcagugguucgucgagaggaacaugguuauaccagaaggacgggugaucgaccucggaugcggacgcggcggguggagcuacuacugugccggacugaaaaagguaaccgaagugcggggcuauaccaagggcgggccggggcacgaagaacccgugcccauguccacguacggcuggaacaucgucaagcugaugagcgggaaggacguguucuaccuuccgcccgagaagugcgauacccuguuaugcgacaucggagagucgagccccucgcccacugucgaggagagccgcaccauccgcguucuaaagaugguggagccuugguugaaaaacaaccaauuuugcaucaagguccugaacccuuacaugccaacggucauagagcaccuggagcggcuccaacgcaagcacggcgggaugcugguucggaacccccugucucgcaacagcacccacgagauguacuggaucaguaacggcaccgggaacauaguggcgagcgucaacauggugucccggcuccugcugaaccgcuucaccaugacgcaccggaggccgaccaucgagaaggacguggaccucggagccggcacccggcacgucaacgccgaaccggagacgcccaacauggacgugaucggagagcgcaucaaacggaucaaggaagaacauaacucaaccuggcacuacgacgacgaaaacccguacaaaaccugggcauaccacggcuccuacgagguuaaagcgaccggaagcgcguccagcaugaucaacggcgucgugaagcugcugacuaagcccugggacgucgugcccauggugacgcagauggcuaugaccgacaccacccccuucgggcagcagcgcgucuucaaagagaagguugacacgcggacaccgcggagcaugcccggcaccagacgcgugaugggcauuacggccgaguggcucuggcggacccugggucgcaacaagaagccccgccuguguacccgcgaggaguucaccaagaagguccgcaccaacgccgcuaugggcgccguguucacggaggagaaccagugggacuccgcgaaggccgccguagaggacgaggacuuuuggaaacuugucgaccgggagcgagaacugcacaagcuggggaaguguggcucguguguguacaacaugauggggaagcgggagaaaaagcugggggaguucgguaaggcgaaggggucccgcgccaucugguacauguggcugggggccagauaucuggaguucgaggccuugggauuucugaacgaggaccacugguucagccgcgagaacuccuauagcgggguggagggggaaggucugcacaaguuaggcuacauccugcgggacaucucgaagaucccgggaggcgccauguacgcggacgauacugccgggugggacacccgcaucacugaagacgacuuacauaacgaggaaaagauuacucaacagauggacccggagcaccggcaguuagcaaacgcaaucuucaagcugaccuaccagaauaaggucgugaaggugcaacggcccacccccaccggcacggucauggacaucaucagccgaaaggaccaacgcggcuccggacaggugggaacguacgggcugaauacguucaccaacauggaggcccaacucauccggcagauggagggcgagggagugcugaguaaagcagaucucgagaacccccaccuccccgagaagaaaaucacccaguggcucgagacgaagggcguagaacgccugaagagaauggccaucuccggagacgacugcguggugaagcccaucgacgaccgcuucgcuaacgcccucuuggcccugaacgacauggggaagguccgaaaggacaucccccaguggcaacccagcaagggauggcacgauuggcagcaagucccuuucugcucccaccacuuccacgagcucaucaugaaggaugggcgcaagcucgugguccccugcaggccccaggacgagcugaucggccgcgcgcggaucucccagggggcgggcuggucccugaaggagaccgccugccugggcaaagcguacgcgcagauguggucacugauguacuuccacaggagagaccugcggcuggccuccaacgcgaucuguagcgccgugcccguucacugggucccgaccagccgcaccacguggagcauccacgcccaccaccaguggaugaccaccgaggacauguugacgguguggaaccggguuuggaucgaggacaaccccuggauggaggacaagacgcccgucacaaccugggaaaacgugcccuaccuggggaagcgcgaggaucaauggugcggaagccugaucggacuaacaucucgugcgacgugggcccagaauaucccgacugcuauccaacagguacgcagccucaucgguaacgaggaguuccuugacuacaugcccuccaugaagcguuuccguaaggaggaagagagcgagggcgcuaucugguga

SEQ ID NO: 25852 - RNA, 9873 nt, Artificial Sequence
  derived and/or modified CDS sequence (opt11) from DENV-3__JF920406__SS-prME
accagcuugugccucaugaugauacuucccgccgcccuggccuuccaucucaccagccgggacggggagccacggaugaucguggggaaaaacgagcggggcaagagccugcuuuuuaagacagccagcgggaucaauauguguacccucaucgccauggaccugggcgagaugugcgacgacacggugacauauaagugcccccacaucaccgaaguggagcccgaggacaucgacugcuggugcaaccugaccagcaccuggguaaccuacgggaccugcaaccaggcaggggagcaccggagggacaagcgguccguggcccucgcaccccacgugggcauggggcuggauacgaggacccaaacuuggaugagcgccgagggcgcauggcggcagguggaaaaaguggagacgugggcccugcgccacccgggguucaccauccucgcgcuguuccuggcacacuauaucggcacguccuugacacagaagguggugaucuucauccuucugaugcucgucacgcccuccaugacaaugcgcugcgugggggucgguaaucgcgacuuuguugaaggacuuuccggggccacauggguggacgucgugcuggaacauggcgggugcgugacaacgauggccaagaacaagcccacacucgacaucgagcugcagaagaccgaagccacccagcuggcgacgcuccguaagcucugcaucgagggcaagauuaccaauauaaccaccgacagccggugccccacgcagggcgaggccacacugccggaggagcaggaccagaacuacgugugcaagcauaccuacgucgacagagggugggguaacgguugcggguuguuugguaagggcucacuggugaccugcgccaaauuucaguguuuagaacccauugagggcaaggugguccaguacgagaaccucaaguacacggugaucaucaccgugcauaccggggaccagcaccaggucggcaacgagacccagggugugacggcugagaucacgccccaggccucaacaacggaggcgaucuuacccgaauacgguacccucggcuuggagugcuccccgcgcacggggcuggacuucaacgagaugauccugcucaccaugaagaacaaggccuggaugguacaccggcagugguucuucgaccuuccccuaccguggaccagcggugcuacuacggagacucccaccuggaacaggaaggagcuccuggugaccuuuaagaaugcccacgccaagaagcaggagguggucgugcuggggucccaagagggcgcgaugcacacggcacucacgggggcaaccgagauccagaacagcggcggcacuuccauauucgccggccaccugaagugccggcugaaaauggacaagcucgagcugaagggcaugagcuacgcgaugugcacgaacgcguucguucugaagaaggaggucuccgagacccagcacgggaccauucucaucaaaguggaguacaagggcgaggacgugccaugcaaaauacccuucagcaccgaggacgggcagggcaaggcccauaacggccgccugauaacggccaaccccguagugacaaagaaggaggagccagugaacaucgaggcggagccgcccuuuggggagucuaacaucgucaucggcaucggagacaacgcgcugaagaucaacugguacaagaagggcuccagcaucgguaaaauguucgaggcaaccgcucggggcgcccgccgaauggccauccugggagauacagcgugggauuucgggagugugggcgggguguugaacucacugggcaagaugguccaccaaaucuuugggucggccuacacggccuuauucucuggaguauccugggugaugaaaaucggcaucgggguucucuuaaccuggaucggccugaacagcaagaacaccuccaugagcuucuccuguaucgcaaucgggaucaucacccucuaccuuggcgcgguggugcaggcugacaugggcugcgucaucaacuggaagggcaaggagcugaagugcggcuccgggaucuucgugaccaacgagguccauaccuggacagagcaguacaaguuucaggccgacagccccaagcgucucgcaaccgccaucgccggcgcgugggagaacggggucuguggcauccgcagcacgacccggauggagaaccugcuguggaagcagaucgccaacgaguugaacuacauccucugggagaacaacaucaagcuaacgguaguggucggggauaucaucggcguccucgagcagggcaagcgcacccuaacgccccagccaauggagcugaaauacuccuggaagaccugggggaaggccaagaucguaaccgccgagacccagaacaguuccuucaucaucgacggccccaacacgcccgaaugccccagcgucucucgugcguggaacgugugggaaguugaggauuacggguucggagucuuuacuacaaacaucuggcucaaacuucgcgagguguacacccagcucugugaccaucggcucaugagcgcggccgugaaagaugagcgggccguccacgcagacaugggcuacuggauugagucccagaagaacgggucauggaaguuggagaaagcgagccugaucgaggugaagaccugcacguggccgaaaucccacacccuauggagcaauggcgugcuggaauccgacaugaucauccccaagagccucgcaggucccauuucccagcacaaccaccgcccgggauaccacacgcagacagcggggcccuggcaccucgggaaacuugaacuggacuucaacuacugugagggcacgaccgucgugaucaccgagaacugcgggacccgcggucccagccuccggacuaccaccgugagcggcaagcugauucaugagugguguugucgcucuugcacccugcccccguugcgcuacaugggcgaggacgggugcugguauggcauggagauacgcccaaucuccgagaaggaggagaacauggucaagagccuggucuccgccggcuccgggaagguggacaacuucacgaugggaguccugugucuggccauccuguucgaggaggugaugcgggggaaguucgguaaaaagcauaugaucgcagguguguucuucaccuucguccugcuuuuauccggccagauuaccuggcgagauauggcccauacccugaucaugaucggcagcaacgcgagcgaucggauggggaugggcgugacguacuuggcccucaucgccacauucgagauccagcccuuucuggcgcucgguuuuuuccugcgcaaguugaccagccgggagaaccuccugcugggcgugggccuugccauggcgaccacgcugcagcuacccgaggacaucgagcagauggcuaacgggauugcgcucggccuuauggcucucaagcucaucacacaguuugaaaccuaccagcuauggaccgcucugaucagccucaccuguucgaacaccauauucacccugaccguggccuggcgcacggccacccugauccucgcggggguaagccugcugccggugugccaauccagcuccaugcgcaaaacugacugguugcccauggccguggccgccaugggcgugccgccccucccgcuguucauuuucgggcucaaagauacacuaaaacgcagauccuggccccucaacgagggcgucauggcugugggcuuggucagcauacuggcgagcucacugcuccggaacgacguccccauggccggaccccugguggccgggggacugcugaucgcgugcuacgugaucacgggaaccucggccgaccugaccguggagaaggcggccgacauuaccugggaggaggaggccgagcagacggggguaucccacaaccuaaugauuaccguggacgacgacgggaccaugcgaauaaaggacgacgagaccgagaacauccucaccguucugcugaagacagcacuccugaucgugagcggcaucuuuccguacaguauccccgcaacccugcucguuuggcacacguggcaaaagcagacccagcggagcggcguucugugggacguaccgagcccgcccgagacacagaaggcggagcuggaggagggcguauaucgcaucaagcaacagggaaucuucggcaagacccaagugggggugggagugcagaaggagggcgucuuccacaccauguggcacgugacgcgcggagcuguacucacguacaacggcaagagacuggagccgaauugggccagcgucaagaaggaccugaucucauacggggguggguggcggcucagcgcccaguggcagaagggcgaggagguccaggugaucgccgucgaacccggcaagaaccccaagaacuuccagaccaugcccgggacguuccagaccacgaccggcgagaucggggcgaucgcccuggacuucaaaccuggcaccucgggcucacccaucauuaaucgcgaggggaaggugguuggcuuguacgggaacggcgucguaaccaagaauggcggcuaugugagcgggaucgcccagacgaacgccgagccggacgggcccaccccggagcuggaagaagagauguucaagaagcggaaccucaccaucauggaccugcaccccggcuccggcaagacccgcaaguaucugccggcaaucguccgggaggccaucaagcgccggcuccgcacccugauauuagcccccacccgggugguggcugccgagauggaagaggcgcucaagggccuccccauccgcuaccaaacgaccgccacgaaguccgagcacaccgggcgcgagaucguugaccugaugugucaugcgaccuucaccaugcggcuacugucacccguacggguaccgaacuacaaccugaucauaauggacgaagcccauuucacggaccccgcaucuaucgccgccaggggcuacaucucaacccgagucggcaugggagaagccgcugccaucuucaugaccgccaccccgcccggcacggcggacgccuucccacagagcaacgccccuauucaggaugaagagcgcgauauuccugagcguuccuggaauagcgggaacgaguggaucacggacuucgcuggcaaaacugugugguucgugccguccauaaaggccgggaaugacauagcgaacugccuccggaagaacggcaagaaggugauccagcugucgcgcaagaccuucgacacggaguaccagaagaccaagcucaaugacugggacuucgugguaaccacagacaucuccgagaugggcgccaacuucaaggcagacagaguuaucgacccgcgccgaugccucaagcccgucauucugacagacgggcccgaacgcgugauccuggcuggcccuaugccgguuacagccgccagcgccgcucaaagacgagggcggguggggcgcaacccccagaaagagaacgaccaguacauauucaccgggcagccccucaacaacgacgaagaccacgcgcacuggaccgaggccaaaaugcugcuugacaacaucaacacgcccgaggggauaaucccggcucucuucgaacccgagcgggagaaguccgccgcgaucgauggcgaguaccgccugaagggggagagccggaagacguucguggaguuaaugcgccguggcgaccucccgguuuggcuggcccauaagguggccagugaggggaucaaguacaccgaucgaaaguggugcuucgacgggcagcggaacaaccagauucuggaggagaauauggacguagagaucuggaccaaggagggcgagaaaaagaagcuccgaccucgguggcuggacgccaggacuuacagcgacccgcuggcccucaaggaguuuaaggaauucgcggcggggcgcaaguccauugcgcuggaccuggugacggagaucggccgagugccgagccaccuggcucaccgaacucggaaugcccuggacaaccuggucaugcuccacaccuccgagcacgggggccgagcguaucgccacgccguagaggaguuacccgagacgauggagacguugcucuuacuaggguugaugaucuugcuaaccggcggugccauguuauuccugaucagcgggaaggggauagggaagacaagcaucggucugauaugcguuauagcguccagcgggaugcucuggauggcggagaucccgcugcaauggauugcgagcgccaucguacuggaauucuucaugauggugcuccugaucccugagcccgaaaagcagcgcaccccccaggauaaccagcuggcauacgucgugaucggcauucucacccuggccgcuaucauugccgccaacgagaugggccugcucgagaccaccaaacgggaccugggaaugaguaaggagccaggaguugugucgcccacuagcuaccuggacguagaccuccaucccgccuccgccuggacccuguacgcgguggcuaccaccgugaucaccccaaugcugcgccacacgaucgagaauagcaccgcuaacguuucccucgccgcuauagcgaaccaggccguggugcucaugggccuggacaagggauggccgaucagcaaaauggaucugggggucccccugcuggcccugggcugcuacucccagguaaaccccuuaacccugaccgccgcuguccuccugcuuauuacgcacuacgcgaucaucggccccgggcuccaagccaaggccacgcgugaggcccagaaacgcacugccgcggguauaaugaaaaacccgaccgucgacgggauuaugacgaucgaccucgaccccgugaucuacgacagcaaguucgagaagcagcuggggcagguaaugcuacuggucuugugcgccgugcagcuccugcugaugcgcaccuccugggccuuaugcgaggccuuaacccuggcgaccggccccaucacgacccucugggaggggagcccgggcaaauucuggaauacaacaauagccguguccauggccaacaucuucagggggagcuaccuggccggcgccgggcuggcguucuccaucaugaaguccgucggcacgggcaaacgcgggaccgguucccagggugagacccucggcgaaaaauggaagaagaagcugaaucaacugagccgcaaggacuuugaccucuacaaaaaguccgggaucaccgaaguggaucgaaccgaagccaaggagggccugaagagaggcgagauuacgcaccacgccgugucgcgggggagcgccaaauugcagugguucguagagcgcaacauggugauaccggagggccgggugaucgaccucggcuguggccgagggggauggucauauuacugcgccggccugaagaaagucaccgagguccggggguacaccaagggcggaccgggccacgaggagcccgugcccaugagcaccuacggguggaacauagucaagcugauguccggcaaggauguguuuuaccucccgccagagaagugcgacacgcugcugugcgacaucggugaguccucccccagcccaaccguugaggagucccgcacgaucagaguccugaagaugguggagccguggcucaagaacaaccaguucugcauaaaagugcuaaacccguacaugcccaccgucaucgagcaccuggagcgacuccagcgcaagcaugggggcaugcugguucggaaccccuugagcagaaacucaacccacgagauguacuggaucagcaacgggaccggcaacaucguugcguccgucaacauggucagcaggcuccugcugaaccgcuucaccaugacccaucggcgcccgaccaucgagaaggacguggaucucggcgcagggacccggcacgugaaugccgagcccgagacccccaacauggaugugaucggcgagcgcauaaagcggaucaaggaggagcacaacagcaccuggcacuacgacgacgagaacccguacaaaacgugggccuaccacgggucguacgaggugaaggcaaccggcuccgcgagcuccaugaucaacggggucgugaagcugcugaccaagcccugggacgucgugccgaugguuacccagauggccaugacggacacaaccccauucggccagcaacgcgucuucaaggagaaaguggacacccggacgccgaggucgaugccagggacacggcgugugauggggauuacugccgaguggcucuggcggaccuugggcaggaacaagaagccgcggcugugcacgcgggaggaguucaccaagaagguucgcacaaacgccgcgaugggggccguguucaccgaggagaaccagugggacagugccaaggccgccguggaggacgaggacuucuggaagcucguugaccgagagcgggaacuccacaaacuggggaagugcgggagcugcguguacaacaugaugggcaagcgggagaagaagcucggugaguucgggaaggcgaaagggagccgcgccauuugguacauguggcugggcgcccgguaccuugaguucgaggcucucgguuuccugaaugaagaccacugguucucuagagagaacucauacuccgggguggaaggcgaaggacugcauaaacucggguacauccuccgggacaucagcaagauccccggcggggccauguacgcggacgauacggccggcugggacacucgaaucacggaagacgaccugcacaacgaggagaagaucacccagcagauggauccggaacaccggcagcucgccaacgccaucuucaaguuaacguaucaaaacaagguugugaaagugcagcgccccacccccacaggcacugucauggauaucaucucccggaaggaccagcgcggaagcggccagguggggaccuacggccugaauacauuuacaaacauggaagcccagcucauccggcagauggagggggagggcgugcuuuccaaagcggaccuggagaacccucaccuccccgagaagaagaucacccaguggcuugagaccaaaggcgucgaacgccugaagcggauggccaucagcggggaugacugcguggugaagccgaucgaugaccguuucgccaacgccuugcuggcccugaacgacaugggcaagguucggaaggacauaccccaauggcagcccagcaaagguuggcacgauuggcagcaggucccguucugcucccaccauuuccacgagcucauuaugaaagauggccgcaagcuggugguucccugcagaccccaggaugaauugaucgggcgagcgcggaucucgcaaggggcaggguggucacucaaagagacggcgugccuagggaaggccuacgcgcagauguggucccugauguauuuccaccgccgggaccuccgguuagccagcaacgccauuugcagcgccguucccgugcacuggguccccaccagccgcaccaccuggaguauccaugcccaccaccaguggaugacgaccgaggacaugcugacggucuggaaccggguuuggaucgaggacaaucccuggauggaggauaagacccccgucacgaccugggaaaacguuccguaccucgguaagcgcgaggaucaauggugcggcagccugaucggguugaccagccgggccacgugggcucagaacaucccgacagccauccagcaaguucggucgcucauugggaacgaggaguuccuggacuacaugcccagcaugaagagauuccggaaggaagaggaguccgagggagccauaugguga

SEQ ID NO: 25853 - RNA, 9873 nt, Artificial Sequence
  derived and/or modified CDS sequence (opt11) from DENV-3__JF920409__SS-prME
accagcuugugccucaugaugaucuuaccugccgcccuggcguuucaucucacaagccgagauggggagcccaggaugaucgucggcaagaacgagcggggcaagagccuacuguucaagaccgccuccgggaucaacauguguacccucaucgcgauggauuuaggcgagaugugcgacgacaccguuacauacaaauguccccacaucaccgagguggagcccgaggacauagacugcuggugcaaccugacaagcacuugggugacguacgggacguguaaccaggccggugagcaccggcgcgacaagcggucugucgcacucgcgccccauguggggauggggcuggacaccagaacacaaaccuggaugagugccgaaggggccuggcggcaggucgaaaagguggagacuugggcccugcgccacccggguuuuaccauccuugcccuguuccuugcccacuacauuggcaccucacucgcgcagaaggugguuaucuucauccuacugaugcucgucacaccaagcaugacgaugcggugcgugggggugggcaaccgagacuucgucgaggguuuguccggugcaaccuggguggacgugguacucgagcacggugggugcguuaccaccauggcgaaaaacaagcccacgcuagacaucgagcuacagaagacugaggcgacccagcucgccacccugcggaagcuguguauugagggcaagauuacgaacauuaccacggacagccggugccccacccagggcgaggcgacauuacccgaggagcaggaucagaacuauguuugcaagcauaccuacguggauaggggguggggcaacgggugcggucucuuugggaagggcucccuggugacuugcgccaaguuccagugcuuggaacccaucgaaggaaaggugguucaguaugagaaccuuaaguauacagugauuauaaccgugcacacgggggaccagcaucaggucgggaaugaaacucagggugugaccgccgagauaaccccccaagcgaguaccacagaggccauucuaccggaguacgguacacuggggcucgagugcucccccagaaccggccuggacuuuaacgaaaugauccugcucacgaugaagaauaaggccuggauggugcaucggcagugguuuuucgaccugccccuacccuggaccagcggcgcuacgaccgaaacucccaccuggaaccguaaggagcuauuggugaccuucaaaaaugcacacgccaagaagcaggagguggucgugcugggcagccaagagggggccaugcacacagcccucacgggggccacggagauccagaacagcggcgguaccuccauauucgcgggccacuuaaagugccgguugaaaauggacaagcucgagcugaaaggcaugagcuacgcuauguguacgaacacguuugugcugaaaaaagaggucuccgaaacgcaacacgggacgauccucauuaagguggaguauaagggcgaggacgucccguguaagauccccuuuagcacagaggacgggcagggcaaagcccacaacggccgacugaucacggcuaaccccgucgugacaaagaaggaagagccagugaacaucgaggccgagccccccuucggugagagcaacaucgucauuggcaucggagacaacgcccuuaagaucaacugguacaagaagggcucaagcaucggaaagauguucgaggcaaccgcccgaggcgcgcgcagaauggcuauccugggcgacacugcuugggacuuuggauccgugggcgggguucucaauagccugggaaagaugguccaccagauuuucgggagugccuacacggcucuguucucagguguauccuggguuaugaagaucggcauagggguccuccugaccuggaucgggcugaacucgaagaacacuuccaugaguuucuccugcauagcaaucggcaucauaacgcucuacuuaggcgccgucguacaggcggacaugggcugugugauuaacuggaagggcaaggagcuuaagugcggaagcgggaucuucguaacuaacgaggugcacaccuggaccgaacaguacaaguuccaagccgacucccccaagcgacucgcgaccgccaucgccggggccugggagaacggggucugcgggauccggagcacgacucggauggagaauuuacuguggaagcagaucgcaaacgaacugaacuacauucugugggagaacaauaucaagcuuacuguagucgucggcgacauaauaggcgugcucgagcagggcaagaggacccuuacgccgcaaccgauggagcugaaguauuccuggaagaccugggggaaggccaagauagugaccgcagaaacccagaacagcuccuucauuaucgacggcccgaacacgccugagugcccgucgguaucccgggccuggaacgugugggagguggaagacuauggguuugggguauucaccaccaacauuuggcugaagcugcgcgagguauacacccagcugugugaccaccggcugaugagcgccgcagugaaggacgagcgagccguccacgcagauauggguuacuggaucgagagccagaagaacggguccuggaaguuagaaaaggcgagccugauagaggugaagacaugcacguggccgaaaagucacacccucuggagcaacggggugcuggaguccgacaugaucaucccaaaaagccuggccgguccuaucucccaacauaaccaccggccggguuaccacacccagaccgccgggcccuggcaccucggcaagcuggaacuggacuucaacuacugcgaggggacgacggucgugauuaccgaaaacugugggacccgcggcccuagccucagaacgaccaccguguccgggaagcugauucacgaguggugcugccgcucguguacccugccaccucuccgguacaugggcgaggacggaugcugguacggcauggagauccgucccauuuccgagaaggaagagaacaugguuaagagccuuguguccgccgguagcgggaaaguggacaacuucacgaugggcguccugugccuggcgauucuguucgaagaagugaugcgggggaaguucggcaagaaacauaugauagcgggggccuucuucauguucgugcugcuacuguccggacaaaucaccuggcgggacauggcacacaccuuaauuaugaucgggagcaacgccucagaucggauggggaugggcgugaccuaccucgccuuaauugcgacguuuaagauccagcccuuccuagcucuuggguucuuccuccguaagcugaccagccgggaaaaccuccugcuuggcgugggccuggcaauggccacgacccugcaacuccccgaggacaucgagcagauggcuaacgggaucgcccucggccucauggccuuaaagcucaucacacaauucgagaccuaucagcuguggaccgcucuaaucagccugaccugcucgaacacgauauucaccuuaaccguggcuuggcgcacugcgacgcugauccuugccggggucagccugcugccagugugccaguccaguuccaugcggaagaccgacuggcuaccuauggcgguagccgccaugggagugccgccgcucccguuguuuaucuucucucucaaggacacccugaagcgcagguccuggccacugaaugaagggguuauggcggucggccucguguccauucuggccuccagccuacuccggaacgacgugccaauggccggccccuuaguagcugggggacuccuuaucgccugcuaugugaucacagggacgucugcagaccugaccguggagaaggcggccgauaucaccugggaggaggaggccgagcagacaggggucucacacaaucugaugauaacggucgacgacgacggcaccaugcgcaucaaggacgacgaguccgagaacauccuuaccgugcugcugaagaccgcccuccugauuguuagcggcaucuucccguacuccauccccgcgacccugcuaguguggcacacauggcaaaagcaaacccagcgguccggaguuuugugggauguccccuccccgcccgagacccagaaggccgagcucgaagaagggguguaucgcaucaaacagcaaggcaucuuugggaagacccaagugggcguagggguccagaaggagggcguauuccacacgauguggcacgugacccgcggggccguucucaccuauaacgggaagcgcuuggaacccaacugggcaagcgugaagaaggaccugaucuccuacggcgggggcuggcggcucuccgcgcaguggcagaagggugaagagguucaggugaucgccguagagcccgguaaaaaccccaagaacuuucagaccaugcccggcacguuccagacaaccaccggggagauuggcgcgauagcacuugacuucaagcccggcacgagcggcucccccaucaucaaucgcgagggcaaggucguggggcuguacggcaacgggguggugaccaagaacggcggguacgugagcggcauagcccagaccaaugccgagccggacggccccaccccggagcuggaggaagagauguuuaagaaacggaaccucacgauuauggaccugcaucccgggucgggcaagacacgcaaguaucugccggccaucgugcgggaggccaucaagcgcagacuccgaacucugaucuuggcccccacccgagucguagccgcugagauggaggaggcccugaaggggcugcccauccgguaccagacgaccgccaccaagagcgagcacacgggccgggagaucguggaccugaugugccacgccacguuuaccaugcgccuccugucccccguucggguccccaauuacaaccugaucaucauggacgaggcucacuucacggaccccgcgagcaucgcagcccgcgguuauaucucuacccgggugggcaugggugaggccgcugccauauuuaugacggccacaccgcccgggacagccgacgccuucccgcagagcaacgcgcccauccaggaugaggagagagacauaccagaacgcaguuggaacagcgguaacgaguggauaaccgacuucgcagggaaaacagucugguucgugcccuccaucaaggccggcaaugacaucgccaacugccuccgcaagaaugggaaaaaggugauccagcugagccgcaagaccuucgacaccgaguaccaaaagaccaaguugaacgacugggauuuugucgucacgaccgacaucuccgagaugggggcaaacuucaaggcggaccgggugaucgauccaagacggugccucaagcccgucaucuugacagauggccccgaacgagugauacuggccgggccuaugccagugaccgccgccagcgccgcgcagcggcgcggccgcgucggaagaaacccccagaaggagaacgaccaguauaucuuuacgggucagccccuaaacaacgacgaggaccacgcccacuggacugaggcaaaaaugcugcuggauaacauaaauaccccggaggggaucauacccgcccucuuugagcccgagcgggaaaagucugcugccaucgacggcgaauacaggcugaagggugaaucucggaagaccuuuguggaguugaugcgccgcggggacuuaccgguguggcucgcacacaagguugcauccgaggguaucaaguacacagaccgcaaguggugcuuugauggacaaaggaacaaccagaucuuggaggagaacauggacguggagaucuggacgaaggagggcgagaagaagaagcuccgcccccgguggcuugacgcuagaacuuacagcgacccgcuggcgcucaaggaguucaaggaguucgcagcgggccgcaagaguauugcccuugauuuggucaccgagauagggcgggugcccucgcaucuugcccauagaacccgaaacgcucuggauaaccuggugaugcugcacaccagcgagcacggcgggcgcgccuacagacaugccguugaggagcugccugaaacaauggaaacauuacugcugcuaggcuuaaugaucuuguugaccgggggcgccauguuguuccugauuuccggcaaggguaucggcaagacuaguaucggguuaaucugcgugauugcgucaagcggcaugcucuggauggcggagaucccguuacaguggaucgcguccgccaucgugcuggaauucuucaugauggucuugcugauucccgagccggagaagcaacguacaccccaggacaaccagcuggcguacguugugauugggauacucacacuagccgcgauaauagccgcaaacgaaaugggacugcucgaaacgacuaagcgggaccuggggaugagcaaggagccgggggucguaucucccaccagcuaccuggacguugacuuacaccccgccagugcguggacccuguacgcuguagccaccacgguaaucacccccaugcugcgccacaccaucgagaacagcaccgccaacgugagucuagccgcgaucgccaaccaggccgucguccuuaugggucuggacaaaggguggccgaucagcaagauggacuugggcgugccgcugcuggcccucgggugcuacagucaggucaacccacugacguugaccgccgcgguucuacugcucaucacccacuacgccaucaucggacccggacuccaggcaaaggcuacccgggaggcccagaagcgaacggcagcagguaucaugaagaacccuacgguggauggcaucaugaccaucgaucuagaccccgucaucuacgauagcaaauuugaaaaacagcucggccaagugaugcuccugguucugugugcgguccagcugcugcugaugaggaccuccugggcccucugcgaggcguugacccuagcgaccggccccaucaccacccuuugggaagggagccccgggaaauucuggaacacgaccaucgccgugucuauggcuaacaucuuccgagguucuuaccuugccggggcugggcuggcuuucuccaucaugaaauccgucgggacgggcaaacggggcaccggaagccagggcgagacgcucggugagaaauggaagaagaaguuaaaccaacugucucggaaggacuucgaccucuacaagaaguccggcaucacggaggucgaucggaccgaggccaaggaggggcugaagcgcggcgaaaucacgcaccacgccguuucccggggcagcgccaagcugcaaugguucguggagcgcaauauggucauuccggagggucgggugaucgaccucggcugcgggcgcggcggguggucguacuacugcgcgggccuaaagaaggucacagagguuagaggcuacacuaagggcgggcccggucacgaggagccugugcccaugagcaccuacggcuggaauaucgugaaguuaaugucugggaaagauguauucuaucucccgcccgagaagugcgacacccugcugugcgacaucggcgagucaucccccagcccgaccguagaagaaagucgcacgauccgcguauuaaagauggucgagccuuggcucaagaacaaccaguucugcaucaagguacuaaaccccuacaugcccacggugauugagcaccucgaacggcuccaacgcaagcacggcggaaugcuggugcggaacccccugagccguaauuccacacacgagauguauuggaucagcaacggcaccgggaauaucguggcguccguuaacauggucagccggcugcugcuaaaucgauucacgaugacacaccggcgcccgacaauugagaaggauguggaccucggugccggcacucggcaugugaacgccgaacccgaaacacccaacauggacguaaucggggagaggauaaagcggauuaaggaggagcauaacaguaccuggcacuacgaugacgaaaacccuuacaagacgugggccuaccacgguucuuaugaagugaaagcgaccgguuccgccagcucaaugaucaacggcguagucaaacugcugaccaaacccugggacgugguccccauggugacccagauggccaugaccgacaccacacccuucgggcagcaacgcguauuuaaagagaaggucgacacaagaaccccacgcuccaugcccggcacccggcgcguaauggggaucacggcggaauggcuauggaggacacuggguaggaacaaaaaaccccggcuaugcacccgugaggaguuuaccaagaaggugcgcacgaacgcggccaugggcgccgucuucaccgaggagaaccagugggacagcgccaaggccgcggucgaagacgaggacuucuggaagcucguagacagagagcgagagcugcacaagcuagggaagugcggcuccugcgucuauaacaugauggggaagagggaaaagaagcucggugaguucggcaaggccaaggggagccgugccaucugguacauguggcuuggcgcucgguaccuggaauucgaggcccuaggguuccuuaacgaggaccauugguucucccgcgaaaauagcuauucgggcguggagggggaaggccugcacaagcuuggcuacauccugcgugauaucagcaagauccccggaggcgcgauguacgccgacgacaccgcggguugggacacgcgcaucacggaagacgaucuccacaaugaggagaagauaacccaacagauggauccggagcaccggcagcuugccaacgcgaucuucaagcugaccuaccagaacaaagugguaaaggugcagaggccaaccccuacgggcaccgugauggacaucauaucucgcaaggaccagcgcggcagcggacaggucggcacuuauggccugaacaccuucacuaauauggaggcgcagcuuauacggcagauggagggcgaaggggugcugucgaaggccgaccuagagaauccccaccucccggagaagaagaucacgcaguggcuggagaccaagggcguggagcgccugaaacgcauggcgaucaguggcgacgauugcguagugaaacccaucgacgaccgcuucgccaacgcucucuuggcacugaacgacauggggaaggugcgcaaagacauaccccaauggcaaccguccaagggcuggcacgacuggcagcaggucccguucugcagccaccacuuucacgagcuaauaaugaaggacggacgcaagcugguaguccccugccggccucaagaugagcugauaggccgcgcccgcauaucccagggggcgggcuggucguugaaggaaaccgccugccucgguaaggcguacgcccagauguggagccugauguacuuccaccgccgcgaccuccggcuggccagcaacgcuaucugcuccgccguccccguacacugggugccgaccucgcgcaccaccuggagcauccaugcgcaccaucaguggaugaccaccgaggacaugcugaccguauggaaucggguguggaucgaggacaaccccuggauggaagacaagacccccgugaccacgugggagaacguccccuaccucggaaagcgcgaggaccaauggugcggcucccugaucgggcugaccagccgggccaccugggcucagaacaucccgaccgccauacagcagguacgcucccucaucggcaacgaggaguuccuagauuacaugcccagcaugaagcgguuccguaaggaagaggagucagagggagcgaucugguga

SEQ ID NO: 25854 - RNA, 9873 nt, Artificial Sequence
  derived and/or modified CDS sequence (opt11) from DENV-3__JF920408__SS-prME
accucucugugucucaugaugauccuacccgcagcccuggcguuccaccucaccagccgggauggugagccgcggaugauagucgggaagaacgaacgugggaagagccugcuguucaagacggccagcgggaucaacaugugcacccucaucgccauggaccugggcgaaaugugcgacgacacugugaccuacaagugcccgcacaucacugagguggagcccgaggacauugacuguuggugcaaccugaccagcacaugggugaccuacgggacgugcaaucaggccggcgagcaucggcgcgacaagcgauccguggcucuagcgccccacgugggcauggggcuggacaccaggacccaaaccuggaugagugcugagggcgccuggcgccagguggaaaaaguggagacuugggccuuacgacacccgggauucaccauccucgcccuguuccuggcccacuauauaggcaccuccuuaacccaaaagguagugaucuuuauccugcugaugcuagucacgccgagcaugaccaugcggugcgugggggugggcaaccgcgauuuuguggagggauuguccggggccaccuggguggacgugguccuggagcacggggggugugugaccaccauggccaaaaacaagcccacccuagacaucgagcuacagaagaccgaagccacucagcuugcgacgcuuaggaaguuaugcaucgaaggcaagauuaccaacaucacgaccgacagccgcugccccacccagggcgaggccacccugcccgaggagcaggaucagaacuacgucuguaagcacaccuacgucgaccggggguggggaaacgggugcgggcucuuugggaaaggcucccucgugaccugcgccaaauuccagugccuggaacccaucgagggcaaggugguccaguacgaaaaccuuaaauacacggucaucaucaccgugcacaccggggaccaacaccaggucgguaacgggacacagggcgugacggcagagauuacaccgcaagccucuaccaccgaggcgauacugcccgaguacgggacccugggccucgaaugcuccccgcgcacgggccuggacuucaacgaaaugauccugcuaacaaugaaaaauaaggcguggaugguccaucggcagugguucuucgaccugccgcugcccuggaccagcggggcgaccacggagacccccaccuggaaccgcaaggagcuccucgugaccuucaagaacgcccacgcaaaaaaacaagaggugguugugcugggaucucaggagggugcgaugcacacugcccucaccggcgccaccgagauacaaaauagcgggggaaccgguauauucgccggacaccuaaagugccggcuaaagauggacaagcucgagcugaagggcauguccuacgcgaugugcacgaacaccuuugugcugaagaaggaggucagcgagacccagcacggcaccauccucaucaagguggaguacaagggcgaggacguccccugcaagauccccuucaguacagaagacggccagggaaaagcucacaauggcagguuaauaaccgcuaaucccgucguuacgaagaaggaggaacccgugaacauagaggccgagccgccguuuggggaauccaacaucgucaucggcaucggggacaacgcccugaagauuaacugguacaagaagggcagcuccaucggcaagauguuugaggcaaccgcucgcggggcccgccggauggccauccugggcgauacggcuugggacuucggcagcgugggcgggguccugaacucccuggggaagaugguccaccagaucuuuggcucggcguacacugcccuguuuuccggggugaguugggugaugaagaucggcaucgggguccuccuaaccuggaucgggcuuaauuccaagaacaccuccauguccuucucguguaucgccaucgguaucaucacgcucuaucugggagcuguagugcaggcagauaugggcugcgucaucaauuggaaggggaaagaacucaaauguggcuccgggaucuucgucacgaacgaggugcacaccuggacugaacaguacaaguuucaggcggacucgcccaagcgccucgccacggccaucgccggggccugggaaaacggggucugcggcauccgcuccaccacccggauggaaaaccuguuauggaaacagaucgcgaaugaacucaacuacauccugugggagaacaauaucaaguuaaccgugguggucggcgauaucaucgggguacucgagcagggcaagcgcacacugacuccccagccgauggagcugaaguacagcuggaagaccuggggcaaggccaagaucgugaccgccgagacgcagaacuccaguuuuaucaucgacggccccaauacccccgagugccccuccgucagccgggccuggaacgugugggaagucgaggacuacggcuucggaguauucacuacaaacaucuggcucaagcugcgcgagguguacacccagcugugcgaccaccggcucauguccgcagccgugaaagacgagcgcgccguccacgccgacaugggcuacuggaucgagucgcagaaaaacgguagcuggaagcuagagaaggcgucccugaucgaggugaagacgugcacguggccuaagucccacacccuaugguccaacggcgugcuggagagcgacaugaucauccccaagucccuugcugggccaaucucccagcauaaccaccggccaggcuaccacacgcagacggccggccccuggcaccucgggaaacuggagcuugacuucaacuacugcgagggcaccaccguugugaucaccgagaacugcgggacgcgcggccccucacuccggacuaccacugugucagggaagcuaauccaugaguggugcugccgcuccugcacguuacccccgcucagguacaugggagaggacggcugcugguacgggauggaaauucgucccauuagcgagaaggaggagaacaugguuaagucccugguuucggccggcuccgggaaaguugacaauuucaccaugggcgucuuaugccucgccauccucuuugaagaagugaugcgcggcaaguucggcaagaagcacaugaucgccggcguguucuucaccuucguccuucuguugagcggccaaaucacguggcgcgacauggcucauacgcugaucaugaucggguccaacgccagugauaggaugggaaugggcgugacauaucucgcccugauugcuaccuucaagauacagcccuuccuugccuuaggcuucuucuugcgcaagcugaccuccagagagaaccuccugcuggggguagggcucgcgauggccacgacccugcagcugcccgaggacauagagcagauggcgaaugggauugcccucggccugauggcgcuaaaacucaucacacaguucgagacuuaccagcuguggacggcccugauuagccugaccugcagcaacaccauuuucacauugacggucgcuuggcguacagccacccucauccucgccggcgugucguuacuaccgguuugccagagcuccagcaugcggaagaccgacuggcucccaauggcgguggccgccaugggcgugccaccuuugccgcuguucauauucggccucaaggacacgcugaagaggcgcuccuggccccuuaacgaagggguuauggcggugggacucgugagcauccuagccagcucccugcuccggaacgacgucccgauggcgggaccucuaguggccggcgggcugcucaucgcuugcuacgugauaaccggcacuuccgccgaccugaccgucgagaaagcagcggacaucacgugggaggaggaggccgagcagacaggcgugagccacaaccugaugaucaccguggacgacgacggcaccaugcgcaucaaggaugacgagaccgagaauauccucacgguccugcugaaaaccgcccuacugaucguauccggcauuuucccguacagcauccccgcaacccugcuaguuuggcacacguggcagaagcagacgcagcgcucuggcguccugugggauguucccuccccgcccgagacacagaaggcugaauuggaggaggggguguaccgaaucaaacaacaggggauuuucggcaagacgcagguggguguaggugugcagaaggagggaguauuccauaccauguggcacguaacgcgcggcgcggugcucaccuacaacgguaagcgccuggagccaaacugggccuccgucaagaaagaccuuaucagcuacggcggcggcuggcgacuuuccgcccaauggcagaagggcgaggagguccaggucaucgccgucgaaccgggcaagaaccccaagaacuuccaaacgaugcccgggaccuuccagacgaccaccggcgagauuggcgcgauagcccuggauuucaagcccgggacgucuggcucacccaucaucaacagagaggggaagguggugggccuguacggaaauggugucgugacgaagaacggcggguacgugucugguaucgcgcagaccaacgccgagcccgacggacccacccccgaguuggaggaggagauguucaagaagcgaaaucugacgaucauggaccugcaccccggaagcgggaagacgcggaaguaccugccggccaucguucgggaggcgaucaagcgcagacuccgcacccugauccuggcgcccacccgggugguugccgcugagauggaggaggcacucaaaggccugcccauccgguaccagaccacagcuaccaagagcgagcacacgggccgggagaucgucgacuugaugugccacgccaccuucacgaugcgccuccugagccccgugcgggugccgaauuacaacuuaaucaucauggacgaggcucacuucaccgacccugccuccaucgccgcgcggggguacaucagcacccgggucggcaugggggaggccgccgcgaucuuuaugaccgcuacgccgcccggcaccgccgaugccuucccgcaauccaacgcgcccauucaggacgaggagcgcgacauccccgagcgcucuuggaacuccggcaacgaauggaucaccgacuucgccggaaaaaccgugugguucgugcccagcaucaaagccggaaacgacauugccaacugccuccggaagaacgggaagaaggucauccagcugucccgcaagacguucgacacggaauaucagaagaccaagcugaacgauugggauuucguagugaccacggacaucagcgagaugggcgccaacuuuaaggccgaccgugucaucgacccgcgacggugccucaagccagugauccuaaccgacgggcccgaaagggugauccuggccggacccaugccggucaccgcggcguccgccgcgcagcgccgugggaggguaggaagaaacccccagaaggaaaaugaccaguacaucuucacgggccagccccucaacaacgaugaggaccacgcccacuggaccgaggcaaagaugcuccuggauaacaucaauacgccugaggggauuaucccggcccucuucgagccugaaagagaaaaauccgcagccaucgacggugaguaccgcuuaaagggggaguccagaaagacuuucguggagcugaugcgccggggcgaccuccccguauggcuggcgcacaagguagccagugaggggaucaaguacacugaccguaaguggugcuucgacgggcagcggaacaaccaaauccuggaggagaacauggacgucgaaauuuggacgaaggagggcgagaagaagaagcuccgcccacgguggcuggacgcgcgcacguacucagacccgcuggcccucaaggaauuuaaagaguucgcugccgggcgcaagagcaucgcccuggaccuggugaccgagaucggacgggugcccagccaccucgcccaucggacacggaacgcccuggacaaucuggucaugcuccauaccagcgagcacgggggccgcgccuaccggcacgcgguggaggagcugccagagacgauggagacgcuacuccugcugggccugaugauccuccugaccggaggggccaugcuguuccugaucucggggaagggcauagggaagaccagcauaggccugaucugcguuauugccagcuccgguaugcucuggauggcagagauaccguugcaguggaucgcgagugcaaucguacuggaguucuucaugauggugcuacuaaucccggagccugagaagcagcgcacgccccaggauaaccaacuugcuuaugucgucaucgggauccucacguuggccgccaucaucgcagcgaacgaaaugggccuucuggagaccaccaagcgggaccucgggauguccaaggagccuggcgucgucagcccgacguccuaccuggacgucgaccuccaccccgccucggccuggaccuuauacgccguggcgaccacggugaucacgccaaugcugcgccacaccaucgagaacuccaccgcaaaugucucccucgccgccaucgccaaccaggcggugguacugauggggcuggacaaaggcuggccgaucuccaagauggaccucggcgucccccugcuagcccucggguguuacagccaggugaacccacucacgcugacggccgcggugcucuugcuaauuacacauuacgcuaucaucgguccugggcuccaagcgaaggccacacgagaggcccagaagcgcaccgccgccggcauuaugaagaacccgacggucgacgggaucaugaccaucgacuuagaccccgucaucuaugauuccaaauucgagaaacagcugggccaggugaugcuacugguacugugugcggugcagcuccugcuuaugcgaacuagcugggcccucugcgaggcccugacccuggccacgggcccgaucaccacccucugggaggggucccccggaaaauucuggaauaccacuauugcgguguccauggccaacaucuuccgcggcuccuaccuggccggcgccggcuuggcuuucagcaucaugaaguccgucgggaccgguaagcgggggacaggcagccaaggagagacccucggcgagaaguggaaaaagaagcugaaccagcuuagucgcaaggacuucgaccucuauaagaagucuggcaucacugagguggaccgcacugaggcgaaggaggggcugaagcgcggugagauaacacaccacgcagugagccgggggucggcaaaacugcagugguuugucgagcgcaacauggugauaccggagggccgggugaucgaccucggguguggacgcgguggguggagcuacuacugcgccggccugaagaaagucaccgaggugcggggauacaccaagggagggcccggccaugaggagcccguccccaugucuacguacggcuggaacaucgucaagcugaugucugggaaggacguguuuuaccuaccuccugagaagugcgacacccuucugugcgacaucggcgaauccagccccuccccaaccguggaggagucccgcacgauccgcgucuuaaaaaugguggagccuuggcugaagaacaaccaguucugcaucaaggugcugaaccccuacaugccuacggucauugaacaccuggagcgcuuacagagaaaacaugggggaauguuaguccggaacccccugucacgaaauagcacccacgagauguacuggaucuccaacgguaccgguaacauuguggcaucagucaacaugguaucccgacuccugcugaaccgcuucaccaugacgcaccggcgcccgaccaucgagaaagacguugaucuuggcgcggggacucggcacgucaaugccgagcccgagacccccaacauggaggugaucggcgagcgcaucaaacggaucaaggaggagcacaacagcacguggcacuacgacgacgagaacccguauaagaccugggccuaccacggcucauaugaggugaaggccaccggcagugcuucaagcaugaucaauggugucgugaagcugcugaccaagcccugggacgucgugccaauggugacacagauggcgaugaccgacaccaccccguucggacagcagcguguuuucaaagagaaaguggacacgcggaccccgcguuccaugcccggcacccgccgcgucauggggauaaccgccgaguggcucuggcgcacauugggcagaaauaagaaaccccgguuaugcacccgcgaggaguucaccaagaagguccgcacaaacgccgccaugggggcgguguucacggaggaaaaucagugggacagcgccaaagccgcaguggaggacgaggauuucuggaagcuggucgaucgggagcgcgagcugcacaagcucggcaagugcggcaguugcguuuacaacaugauggggaagcgcgagaagaagcucggugaguucgggaaggcuaagggcuccagggcgaucugguacauguggcugggggcacgguaccuggaguucgaggcccugggcuuccuaaacgaggaccacugguucagccgcgaaaacucguacagcggcguugagggggagggccugcacaaauuaggguacauccuucgggauaucaguaagauucccggaggggccauguacgccgaugacaccgcgggaugggacacccguaucaccgaagacgaccugcacaacgaggagaagaucacgcagcaaauggacccugagcaccggcagcucgccgacgcgauauucaagcugaccuaucagaacaaggucgugaaggugcagcgccccacccccacggggacagucauggacaucaucucaagaaaggaccagcgcggguccggccaggugggaacguauggccugaacaccuuuacuaacauggaggcccagcucauccggcagauggagggcgaaggcguucugagcaaggccgaccuugaaaacccccaccucccagaaaagaagauaacccaguggcuggagacgaagggcgucgaacggcugaagcguauggcgauuuccggggacgauugcguggugaagccuaucgacgaccgcuuugccaacgcacuccuggccuuaaacgacaugggaaagguccggaaggauauaccucaguggcagcccagcaagggguggcacgacuggcagcaggucccguucuguucccaccacuuucacgagcucaucaugaaggacggcaggaagcugguaguccccugccggccccaggacgaguugaucggccgcgcucggaucagccaaggggcgggcuggucgcucaaggaaaccgccugccugggaaaggccuacgcccagauguggucccugauguacuuccaccgcagggaccucagacuggcguccaacgccauuugcagcgccgugcccgugcacugggucccgaccucccgaaccaccuggagcauccacgcucaccaccaguggaugacaaccgaggacauguugaccgucuggaaccggguguggauugaggacaacccuuggauggaggacaagacgcccgucacuaccugggagaacgucccauaccucggcaagcgugaagaccaauggugcgggucgcugaucggccucacgagccgggccacgugggcucaaaacaucccaacggcuauccagcagguccgcagccucaucggcaacgaggaguuccuggacuacaugcccuccaugaagcgguuccguaaagaggaagaaucagagggggcgauaugguga

SEQ ID NO: 25855 - RNA, 9873 nt, Artificial Sequence
  derived and/or modified CDS sequence (opt11) from DENV-3__JF920397__SS-prME
accagucugugccucaugaugauucugccagcggcguuggccuuccaccucaccaguagagacggagaaccccguaugaucguggggaaaaacgagagaggcaagagcuuauuauucaagacugcguccggaaucaacaugugcacccuuaucgccauggaccugggggagaugugcgaugacaccgugaccuacaaaugcccccacauaaccgagguggaacccgaggacaucgacugcuggugcaaccuuacgucaacuugggugaccuacgggacauguaaucaagccggcgagcaccggcgugacaagagaucugucgcccuggcgccccacgugggaaugggccuggacacccgcacccagaccuggaugagcgccgagggcgccuggcgacagguugaaaaggucgagaccugggcccugcgacaccccggguucacgauccuagcuuuauuccuggcgcacuacaucggcaccucccuuacccaaaaaguggugauauucauccugcugauguuggucacgcccagcaugaccaugcggugcgugggaguggguaaccgagacuucgucgaagggcugagcggugccaccuggguagacguaguccucgaacacggcgggugcguuaccacuauggcaaagaauaagcccacccucgacauagagcugcagaagaccgaggccacccagcuggcgacgcuccggaagcugugcaucgaaggcaaaauuaccaacaucacgaccgacucccgcugucccacgcagggcgaggcgacacugccagaggagcaagaccagaauuacguaugcaagcacacauacguugaucgcggguggggcaacggcuguggccucuuugggaagggcucccuggugacaugugcuaaguuccaaugcuuagagcccaucgaggggaaggucguacagcacgaaaaccucaaguacacuguaaucauuaccguccacaccggggaucaacaccaagucggcaacgaaacacagggggugaccgccgagauuacgccucaggccucaacuacagaggcgauccugccagaguacggcacccuaggguuggagugcuccccacgcacuggccuggacuuuaacgaaaugauccugcugaccaugaagaacaaggccuggaugguccaccggcagugguucuucgaccugccccugcccuggaccucgggugccacuacggagaccccuaccuggaaucgaaaggaccuucucguuaccuucaaaaaugcucacgccaaaaagcaggaggugguggugcuggggagucaagagggagcgaugcauaccgcccugaccggagccaccgagauacagaacuccggagggaccuccauauucgccggccaccugaaaugucgccugaaaauggacaaguuagaacugaagggcaugaguuacgccaugugcacgaacacauucgugcugaagaaggagguuuccgagacccagcacgguacgauccugaucaagguggaguacaagggugaggacguaccauguaaaauccccuucucgacggaggaugggcagggcaaggcgcacaacggucgacugauuaccgccaaccccgucguaaccaagaaggaggagccagucaauaucgaggccgaaccgcccuucggagagaguaacaucgugaucggcaucggggacaacgccuuaaagaucaacugguacaagaagggcuccagcaucgggaagauguucgaggcgacagcucgcggggcccgccggauggccaucuugggugacacggccugggacuuuggauccgugggcggcgugcucaacucccuuggcaagauggugcaccagaucuucgggucugcguacaccgcuuuauuuucgggcgucucaugggugaugaagauugggaucggagugcucuuaaccuggaucggacuaaauagcaagaacaccucaaugagcuucuccuguaucgcgaucgguauaaucacgcucuaccugggcgcuguagugcaggcggacauggggugugucaucaacuggaaggguaaggagcuaaagugcggcucaggcauuuucgugaccaacgaggugcacaccuggaccgagcaauacaaguuccaggcggauuccccaaagcgccucgccacagccaucgcgggcgcaugggagaaugggguaugcgggauccgcuccacgacgcggauggagaauuuacuuuggaaacagaucgcgaaugaacucaacuacauccugugggagaacaacauuaagcugacgguaguggucggggacaucaucggcgugcucgagcagggcaagagaacgcucacgccccagccgauggaacucaaauauuccuggaagacgugggguaaggcaaaaaucgugaccgccgagacacagaacucaagcuuuauaauugacggcccgaacacacccgaaugccccagcgucucccgggccuggaacgugugggagguggaggacuacggauucggcgucuucacuacgaacaucugguuaaaacuccgcgagguguacacccagcugugcgaccaucggcucaugagcgcggccguaaaggaugaacgcgccguccaugccgauaugggauauuggaucgaaagccaaaagaauggguccuggaagcuugagaaagccagccugaucgagguuaagacgugcaccuggccgaaaucccacacccucuggagcaacggcguccuggagagcgacaugauaauccccaagagccuggcggggcccaucucccagcauaaccaccguccgggcuaccacacgcagacugccggacccuggcaccucggcaagcuggagcuggacuucaacuacugcgagggcaccaccgucgugaucacugagaacugcggaacgcgcgggcccagucuccggaccaccaccgucuccgggaagcugauucacgagugguguugucgaagcugcacgcuucccccacuuagauacaugggggaggacggcugcugguauggcauggagauccgccccauuuccgagaaggaagagaacauggugaagagucuuguauccgccggcuccgggaaggucgacaacuucaccaugggcgucuugugccucgccauuuuauuugaggaggucaugcgagggaaguucgggaaaaaacacaugauugccggaguauucuucacguucguacugcuccugucuggccagaucaccuggagggacauggcgcauacgcugaucaugaucggcagcaaugccagugaccggauggggaugggcgugacauaucucgcccugauagccaccuucaaaauccagcccuuccuggcccuuggguucuuucuucgcaagcuaaccagcagagagaaccuccuguugggcguaggccucgcgauggccacgacccugcaguuaccagaggacaucgagcagauggcgaacgggauagcccucggccugauggcgcuuaagcuuaucacccaguucgagauuuaccagcuguggacagcccugaucagcuuaacgugcuccaacacuaucuucacccugaccgucgccuggcgaacugcuacccugauucucgccggggugucgcuguuaccgaugugccaguccagcaguaugcggaagaccgacuggcucccuauggcagucgccgccaugggcgugccgccccuuccacuguuuauauuuagccucaaggacacccugaagcgccgcuccuggccgcuaaacgagggggugauggcagucggucuugugucaaucuuagccaguaguuugcuacgaaaugacgugcccauggcgggccccuuagucgccgguggguuacucaucgccugcuauguuaucacggggacauccgccgaccugaccguggagaaggccgcugacauuaccugggaagaggaggccgagcagacgggcgucagccauaaccugaugauuaccguagacgacgaugggaccaugagaaucaaggacgacgagaccgaaaacauccucaccgugcugcucaagaccgccuugcugaucgucagcggcaucuucccguauagcauaccugcaacccuucuuguauggcauaccuggcagaaacagacccaacgguccggggugcugugggacgucccaagcccuccugagacucagaaggccgaguuagaggagggaguguaucguaucaagcaacagggcauuuucgggaagacccaggugggagucggggugcaaaaagaagggguguuccauacaauguggcacgucacacggggcgcggugcucaccuauaauggcaaacgccuggagccaaacugggccucggugaagaaggacuugaucuccuauggcgggggguggcggcucuccacccaguggcagaagggggaggaagugcaggugaucgccguggagcccggcaagaacccuaagaacuuccagaccaugccgggcaccuuccagacgaccaccggggagauaggugccaucgcguuagauuucaagcccgguaccucuggcagccccaucauaaaccgcgagggaaaggucguuggacuguacggcaacggaguggucacgaagaacggcggguacguguccggaaucgcccaaaccaacgcggagccugacggccccaccccugagcuggaggaggaaauguucaaaaaacggaaccucacuauaauggaccugcaccccgggaguggcaaaacgcggaaguaccugccggccauugugcgggaggcaaucaagcgcagauuaagaaccuuaaucuuagcccccacccgggucguagccgccgagauggaggaggcgcucaaggggcuccccauccgcuaccagaccacggcgaccaagagcgagcauacgggccgggagaucguggaccugaugugccacgcaaccuuuacuaugcgacuccugagcccaguccgggugccgaacuacaaccugaucaucauggacgaggcccauuucaccgaucccgccucuauugcagcccgcggauacaucucuacccgugucggcaugggcgaggcggccgccaucuucaugaccgccacgccgccugguacggcagaugcguucccccagagcaaugccccaauucaggacgaagaacgggacauacccgagagaagcuggaacuccggaaacgaguggaucacagacuucgccgggaagaccgucugguucgugcccagcaucaaggcuggcaacgacaucgcgaacugccuacggaagaacgggaagaaaguuauccagcugucccgcaagacauucgacaccgaguaccagaagaccaaauugaacgacugggauuuugucgugaccacggacaucagcgaaaugggcgcgaacuuuaaagccgaccgagugaucgacccgaggcgaugccucaaacccgucauccuuaccgauggcccggagcgcguaauccuugccgggccuaugccggugaccgccgcauccgccgcacagcggcgaggcaggguaggccggaauccucagaaagagaaugaccaguacaucuucacuggccagccccucaacaacgacgaggaccacgcccacuggaccgaagccaaaaugcuguuggacaacaucaacacgcccgaggggaucaucccggcccucuucgaacccgagagagaaaaauccgccgcgauagacggcgaauaccgccugaagggcgagucccggaagacguucguagagcugaugagacgcggggaucuacccgugugguuggcccacaaggucgcgagcgagggcaucaaauacaccgaccgcaaguggugcuucgacgggcagcggaacaaccaaauccuggaggagaauauggacguagagaucuggaccaaggagggcgagaagaagaagcuucgacccagauggcuggaugcccguaccuacagcgauccacuggcccucaaggaguucaaggaguucgcugccggcagaaagucgaucgcgcuggaucuggucacagagaucggcaggguaccuucccaccuugcccauaggacgcggaaugcccuggacaaucuggugaugcuacauacaagcgagcacggcgggcgcgcguaucggcacgcaguugaggagcugcccgaaacgauggagacucugcuccuucugggccuuaugauccugcuaaccgggggcgcgaugcuguuuuuaauuagcggaaaggggaucgggaagacauccaucgggcuuaucugcgugaucgccagcaguggcaugcucuggauggcugaaaucccgcugcaguggaucgcuucggccaucgugcuggaguucuucaugaugguccuccugauaccagagccggaaaaacagcgcacgccccaggacaaccaguuagcguacguugugauagggauccuuaccuuagccgcaaucaucgccgccaacgaaaugggccuccuagagaccaccaagcgggaccuaggcauguccaaggagccgggugucgugaguccgacgucguaucuggauguggaccuccaucccgcuagcgccuggacucuauacgccgucgcgaccacuguuaucacgcccaugcugcgccacacuauagagaacucgacagcgaacgucucgcucgccgcuaucgcaaaccaggccgucgugcuaaugggcuuggacaaggguuggccgaucuccaagauggaucucggugugccccugcuggcgcuggggugcuacagccaggugaacccacugacucucacugccgccgugcugcuacugaucacccacuacgccauaaucggccccggcuugcaggccaaggcgacacgagaggcccagaagcgcaccgccgccgggaucaugaaaaacccgacuguggacggcaucaugacaauagaccuggaccccguaaucuacgacucuaaauucgagaaacagcuggggcagguaaugcuccuuguguugugcgucgugcaacuacugcucaugcggacuagcugggcccucugugaggcguugacccuggcaacgggacccaucaccacccucugggagggcucaccagggaaguucuggaacaccacuaucgccgucaguauggccaauaucuuccgcggauccuaccuggcgggggccggccuagccuucuccaucaugaaguccgucgguaccggcaagcgggggaccggcagccaaggcgagacuuugggcgagaaguggaagaagaaacuuaaccagcugucacgcaaggacuucgaccucuacaagaaguccggcauaaccgagguugaccggacggaggccaaggaggggcucaagcgcggcgagauaacccaucaugccguaucgcggggauccgcgaaguugcagugguucgucgagcguaauauggugauaccggaggggcgggugauagaccucggcugcgggcggggcggguggagcuauuauugcgccggauuaaagaaagucaccgaagugcgcggcuacaccaagggcgggcccgggcacgaagaacccgugcccauguccacguacggauggaacaucgucaaacuaaugagcgguaaggacguguucuaucucccucccgagaagugcgacacacugcuaugcgacaucggcgaguccagccccaguccgaccguggaggaaagccgcaccauacgcguacugaagaugguggaaccguggcucaaaaauaaccaguucuguaucaaggugcugaaccccuauaugcccacggugauagaacauuuagagcgucuucaacgcaagcacggggggaugcuagugcgcaauccgcucucccgcaauagcacccaugagauguacuggauuuccaacggcacggggaacaucguggccucaguuaacauggugucccggcuacuucucaaccgcuucaccaugacucaccgacgcccuacaaucgagaaggauguggauuugggcgccggcacucggcacgucaacgccgagcccgagaccccaaauauggacgugauuggggaaagaauuaagcggaucaaggaggagcacaacucaacguggcacuacgaugacgagaacccauauaagaccugggcuuaccacggcuccuacgaggugaaggccaccggguccgcguccucuaugaucaauggcguugugaaacugcugaccaagcccugggacgucgugccuauggucacucagauggccaugacggacacgacccccuucgggcagcagcgcguguucaaggaaaaggucgauacacgaacgccgcgcagcaugccaggcacacggagggugaugggcaucaccgccgaauggcucuggcguacgcuggggcggaacaagaagccucgacugugcacaagagaggaguucacgaaaaagguaaggacgaacgcggccaugggugccguguucacggaggaaaaccagugggacuccgcaaaggcagccguggaggacgaggacuuuuggaagcucgucgaucgggagcgugagcuacacaagcuggggaagugcggaaguugcguguacaacaugauggggaagcgggaaaagaagcucggagaguucgggaaggccaaggggucucgcgcgaucugguacauguggcugggcgccagauaccuggaguucgaggcgcucggguuucuuaacgaggaccacugguucagccgcgagaacuccuacagcggcguggagggugaaggccugcacaaacugggcuacaucuuacgggacauauccaagauacccgggggcgccauguacgcagacgacacugccgggugggacaccaggaucacagaggacgacuugcacaacgaggagaaaaucacgcagcagauggaccccgagcaccggcagcucgcuaaugcgauauucaagcucaccuaucagaacaaggucguaaagguacagcgccccacccccaccggcaccgucauggacaucaucagccggaaggaccagcgcggcuccggccaagugggaacauauggguugaauaccuucaccaacauggaagcccaguuaauccggcagauggagggcgaggggguucugagcaaggcggaccuagagaacccccaccuaccagagaagaagauaacccaguggcuggagacgaagggagucgagagacucaagcggauggccaucuccggcgacgacugcguggugaaaccuaucgacgaccgcuucgcgaacgcgcuccuagcccugaacgacauggggaaaguccgaaaggacaucccccaguggcagcccagcaagggguggcacgacuggcagcaggucccguucugcucccaccacuuucaugagcucaucaugaaggacgggcguaagcuggugguaccguguaggccccaggaugaacuaaucgggcgagcacggaucagccagggagcaggauggucccugaaagaaacggcgugccucggcaaggcguacgcucagauguggagccugauguacuuccaucgucgagaucuccggcuggccucaaacgccaucugcagcgcgguuccagugcauugggucccgacaucacgcaccacauggucuauccaugcccaccaucaauggaugaccaccgaagauaugcugaccguuuggaaccggguguggaucgaggacaaccccuggauggaagacaagacucccgugaccacuugggagaaugugcccuaccucgggaagcgcgaggaccaauggugcggaagccugaucggauuaaccucccgggcuacuugggcccagaacauaccgaccgcaauccagcaaguccguucgcuuaucggcaaugaggaguuccucgacuacaugccuuccaugaaacgguuucgcaaagaggaggagagcgagggagcgauuugguag

SEQ ID NO: 25856 - RNA, 9873 nt, Artificial Sequence
  derived and/or modified CDS sequence (opt11) from DENV-3__JN093513__SS-prME
accagccucugccucaugaugauccuuccugcggcccucgcguuccaccucaccagccgggauggcgagccccggaugaucguggggaagaacgaacgcggcaagagccuccuguuuaagacggcaucagggaucaacaugugcacccucaucgcaauggacuugggcgaaaugugcgacgacaccgugaccuacaaaugcccccacaucaccgaaguggaacccgaggacaucgacugcuggugcaaccugaccagcaccugggugaccuacgggacgugcaaccaggccggcgaacacagacgcgauaagcgguccgucgcccuggcgccccacgugggcaugggacuggacacucgcacccagaccuggaugucugccgagggagccuggcgccagguggaaaagguggagacgugggcucuacgccacccgggguucacuauccucgcgcuguuccuugcccacuauaucggcaccucccucacccagaagguggugaucuucauucugcugaugcucgucacacccagcaugacaaugcgaugcgugggggugggaaaccgcgacuucgucgaaggccuguccggggcgaccuggguggacgugguccucgaacauggugggugcgugaccacgauggcaaaaaacaagcccacgcucgacauagagcugcaaaagaccgaggccacccaauuagcgacacuucggaagcugugcaucgagggcaagaucaccaacaucaccacugauagcagaugccccacccagggcgaggcuacucugccggaggagcaagaccagaacuacgugugcaagcacaccuacguugaccggggguggggcaacggaugcggucucuucgggaaaggaucgcuggugaccugcgcaaaguuucagugcuuagagcccaucgagggcaaagugguccagcacgagaaucuaaaguacacggugauuaucacaguccacacaggggaccagcaccaggucggcaacgagacgcagggggugacagccgagaucacgccucaggcaagcaccaccgaggcgauccugcccgaguacggcaccuuagggcuugaguguuccccacgcacgggccuggacuucaacgagaugauucuccucaccaugaagaauaaggccuggaugguccaccggcagugguucuucgaccugccgcugccauggaccagcggcgccacuacggagacccccaccuggaaccgcaaggagcuccuggugacguucaagaaugcgcaugccaagaagcaagaaguggucgugcugggcucccaggagggugcgaugcacacagcacucacuggggccaccgagauccagaacaguggcgggaccuccaucuucgccggccaccugaaaugccgccugaagauggauaagcucgagcugaagggcaugagcuacgccaugugcacgaacacuuucgugcugaaaaaggagguuuccgagacacaacacgggaccauuuuaaucaaggucgaguacaagggagaggacgugccgugcaaaauccccuucagcacggaggacgggcagggcaaggcgcacaacggccgccuuaucaccgccaaccccgucgucaccaagaaggaggagcccguuaacaucgaggccgagccgcccuucggggaaagcaacaucgucaucggcaucggcgacaacgcccugaaaaucaacugguacaagaagggcuccucgauagggaaaauguucgaggcgacagcccggggcgcucgacguauggccauccugggggauacggccugggacuucggguccgugggcgggguguugaacucccuggguaagaugguacaccaaaucuucggguccgccuauaccgcccuauucagcggcguguccugggugaugaagaucggcaucgggguccuccugaccuggaucggucugaacagcaagaacaccuccaugagcuucuccugcaucgccaucgggaucauaacgcucuaccugggugccguggugcaggccgacauggggugcgugauuaacuggaagggcaaagagcugaagugcggaagcgggaucuuuguuaccaacgaagugcacacguggacagagcaguacaaguuccaggcggacucccccaagcggcucgccacugccaucgccggcgccugggagaacgguguaugcggcauccgcagcaccacccggauggagaaccuguuguggaaacagaucgcgaacgagcucaauuacauccugugggagaacaacaucaaacugaccgugguugucggggacaucaucggcgugcuagagcagggcaagcgcacacuaacgccccagccgauggagcugaaguacuccuggaagacgugggggaaagccaagauugugaccgcggagacucagaacagcuccuucaucaucgauggccccaacacgcccgagugccccagcguuagccgggccuggaacgugugggaaguggaagacuauggguuugguguauucaccaccaacauuuggcucaaacugcgcgagguguacacacagcuuugcgaccaccggcucaugagcgcggccguaaaggacgagcgcgccguucaugcugauaugggcuacuggaucgagagucagaagaacggguccuggaagcuagaaaaggcuucacugauugaggugaaaacuuguaccuggccgaaaucccacacccucuggagcaacggcguucuggagucagauaugauuaucccuaagagccuggcggggcccaucucgcagcacaaccaccggccgggcuaucacacccaaacggcgggcccguggcaccucggcaaguuagaguuagacuucaacuacugcgagggcaccaccgucgucaucaccgagaacugugggacacgggggccuagccuccggaccaccacgguauccggcaagcugauccacgaauggugcugccguagcuguacguuacccccgcuccgguacaugggcgaggacgggugcugguacggcauggaaauacgccccaucuccgagaaggaggaaaacauggugaagucacugguguccgcuggcagcgggaaggucgacaacuuuaccauggggguccugugucuagccauucuguucgaggaggugaugcgggggaaguucggcaagaagcacaugaucgcagguguguucuucaccuucguccuacuccuguccggccagaucaccuggcgcgacauggcgcacacgcugaucaugaucgggagcaacaccuccgaccguauggggaugggggugacguaccucgcccucaucgcaaccuucaagauucagcccuuccuggcccucggauuuuuccugcgcaagcugacgagccgagagaaccuucugcugggcgugggccucgccauggccacgacccugcagcuaccggaggacaucgagcagauggcaaacggcaucgccuuaggccugauggcccuuaaguugaucacccaguucgagaucuaccagcuguggacggcgcugaucagcuugaccugcucgaacacuauuuuuacccugacugucgcguggcgcacggccacccuaauccucgccggggugucacugcuuccggucugccaauccucuuccaugcggaagaccgauuggcugcccauggccguugcggccaugggcguuccgccccucccgcuguucaucuucggacugaaggacacgcugaagcgccgcagcuggccccugaacgagggaguaauggccguggggcugguguccauucucgccaguucguugcuccggaacgacguccccauggccgggccacuuguggcgggcgggcugcucauugccugcuacgugaucaccggcaccagcgccgaccugacugucgaaaaggcagcggacaucacgugggaggaagaggcggaacagaccggggugucgcacaaucugaugauaaccguggacgacgacggaaccaugaggaucaaggaugacgagaccgagaacauucucacgguccugcucaagaccgcccuccugaucgugagcggaauauuuccguauuccauccccgccacgcugcucguguggcacaccuggcagaaacagacgcagcggucugggguccuuugggacgugcccagcccgcccgaaacccagaaggcagagcuugaagagggcguguaccgcaucaagcagcaggggaucuucggcaagacccaggucggggugggagugcaaaaggaagggguguuccacaccauguggcacguaacgaggggugcggugcucaccuauaacggcaagcggcuggagcccaacugggcgagcgucaagaaagaucucaucucauaugggggcggguggcggcucucagcccaguggcagaagggcgaggagguccaagugaucgccgucgagcccggcaagaaccccaaaaacuuccaaaccaugcccggcaccuuucagacgaccacuggcgagaucggggccaucgcgcuggacuucaaacccggcaccuccggcagccccaucauaaaccgcgaagguaagguggugggccuguacgggaacggcguagugacgaagaacgggggcuauguuagcggaaucgcccagaccaacgccgagccagacggccccacuccagaguuggaggaggagauguucaagaagagaaacuugacgaucauggaccugcaccccggcuccgggaagacgcgcaaguaccuuccggcaaucguacgggaagccaucaaacgccgguugcgcacccugauccuggcgcccacccgggugguggccgccgagauggaggaggcccucaagggccugcccauccguuaccaaacuacggccacuaagagcgagcacaccgggcgagaaaucgucgaccugaugugccacgcaaccuucacaaugcggcuccugucccccgugaggguaccaaacuacaaccugaucaucauggacgaggcgcacuucacggaucccgccucgaucgccgcccgcggcuauauaucgacccgggucggaaugggggaggcagcugccaucuucaugacggccaccccucccggcaccgcggacgcauucccgcagagcaacgcccccauccaggacgaggagcgcgacauccccgagcgcuccuggaacagcgggaacgaguggaucacagacuuugccggcaagaccgucugguuuguucccucuaucaaggccgggaacgauaucgcgaacugccucaggaagaacggcaagaaggucauccagcugagccgcaagacuuuugacacagaguaccagaagaccaaguugaacgacugggacuucguggucaccacagacauaucugagaugggagccaacuuuaaggccgaccgggucaucgacccgcgccggugucucaagcccguaauacugacugacgggcccgaacgcguuaucuuagccggccccaugccugucaccgccgcgagcgccgcccagcggcgugggcgggugggccgcaacccccagaaagagaacgaccaguacaucuucaccgggcagccccucaacaacgacgaggaucacgcccacuggacugaggccaagaugcugcuggacaacaucaacacgccggagggcauaauuccggcucucuucgagcccgaacgagagaaguccgcggccaucgacggcgaguaccgcuuaaaaggggaaagccggaagaccuuugucgagcugaugcgccggggggaccuucccgucuggcucgcccacaagguggcguccgaggggaucaaguacaccgaccgcaagugguguuucgacggccagagaaacaaccagauccuggaggagaacauggacgucgaaaucuggaccaaagagggcgagaagaagaagcuccgcccccgguggcuggacgcucgcacguacagcgacccgcuggcccucaaggaguucaaggaguucgccgccgggcgaaaguccaucgcccuggaccuggugaccgagauuggaagggugcccagccaccucgcccacagaacccggaaugcccuggacaaccucgucaugcuccacacuuccgagcacgggggacgcgccuaucggcacgccguggaagaacuucccgagacaauggagacucugcuccugcuggggcucaugauccugcugacuggcggcgcgaugcuguuccugaucagcgggaagggcaucgggaagacuagcaucggccucaucugcgugaucgcguccagcgggaugcucuggauggccgaaaucccgcugcaguggaucgccucggccaucguccuggaguuuuuuaugauggugcuccugauccccgagcccgagaagcagcgcacgccccaggacaaccagcuggcguacguggucaucggcauccucacccuggccgccaucaucgccgccaacgagaugggccugcucgagaccacgaagcgggacuuggggaugagcaaggagccgggcguggucuccccgaccagcuaccuggacgucgaccuacaccccgcguccgccuggacccucuacgccguggcuaccaccgugaucacgccuaugcugcgacacacuaucgagaacagcacugcgaacgucucccucgccgccaucgccaaccaggccgugguauugauggggcuggacaaggguuggccgaucucuaaaauggaccuuggugucccccugcuagcgcucggcugcuacucccaggugaaccccuuaacucugacggccgccgugcucuuacugaucacccacuacgccaucaucgggcccgggcuccaggccaaggcgacccgggaggcccagaagcggaccgccgcaggcaucaugaagaacccgacggucgacgggaucaugaccauagaccuugaucccgugaucuacgacucuaaguucgagaagcagcugggacagguuaugcuccugguccugugugccguccagcuccuucugaugcggaccuccugggcuuugugugaggcccugaccuuggcgacgggucccaucacgaccuuaugggaggguagccccgggaaguucuggaacaccacaaucgccgugucaauggcgaacaucuuccgcgggucauaccuggccggcgccggccuggccuucuccaucaugaaguccgucggcacggggaagcgggggaccggcagccagggggagacccucggugagaaguggaagaagaagcugaaccaacugagccgcaaggauuucgaccucuacaagaaguccgggaucaccgagguggaccggacggaggccaaggagggccugaagcgcggcgagaucacccaccacgcggugucccgagggagugccaagcugcagugguucgucgaacgcaauauggugaucccggagggucgggugauagaccucggguguggccgcgggggaugguccuacuacugugccgggcucaagaaggucaccgaggugcgcggguacaccaagggcgggcccggccacgaggagcccgugcccaugagcacguacggguggaacaucgucaaguuaauguccggcaaggacguguucuaccucccacccgagaagugugacacccugcugugcgacaucggcgagagcucccccagccccaccgucgaggagucccgcaccauccgcguccugaaaaugguggagccguggcucaaaaacaaucaguucugcaucaaaguccugaaucccuacaugcccacggugaucgagcaccucgaaaggcuccagcgcaagcaugggggcaugcuggugcggaaucccuuaucacgcaauuccacccacgagauguacuggaucagcaauggcaccggcaacauuguggccuccgucaacauggugucccggcuccugcugaaccgauuuaccaugacucaccgucgcccgacgaucgagaaggacguggaucucggcgccgggacccggcacguuaacgcggagcccgagacccccaacauggacgugaucggcgagcguaucaagcggauaaaggaggaacacaacucgacguggcacuacgacgaugaaaacccguacaagacgugggccuaccacggaagcuacgagguaaaggccaccggcucggccagcuccaugauaaacggggucgugaagcuguugaccaagccaugggacgucgugccaauggugacacagauggccaugaccgacaccaccccuuucggccagcagcgcgucuucaaggagaagguggacacgcggaccccacgcuccaugcccggaacuaggcgcgugauggguaucaccgcggaguggcucuggcggacgcugggccgcaacaagaagccccggcugugcacccgcgaggaguucacaaagaagguccgcaccaacgccgccaugggugccgucuucacggaggagaaucagugggacagcgcgaaggccgccguggaggacgaggacuucuggaagcucgucgaccgggagcgcgagcugcacaagcugggcaaaugcggguccugcguguacaacaugaugggcaagcgggaaaagaagcugggcgaguucgggaaggccaagggcagcagggccaucugguauauguggcugggggcgcgguaccuggaguucgaggcccucggcuuccucaacgaggaccacugguucucccgcgagaacagcuacagugguguggagggagagggccugcacaagcucggguacauucuccgggauaucagcaagauccccggcggcgcgauguacgccgacgacacugccggcugggacacucgaaucaccgaggaugaccugcacaacgaggagaagaucacgcagcaaauggacccagaacaccgacagcuggcgaacgccauauucaaauugaccuaccagaauaaagucgugaaagugcaacgccccacccccaccgggaccguaauggauaucaucucccgcaaagaccagcgcgggucgggccagguggggacguacggccugaacacuuucaccaauauggaggcccagcucauccggcagauggagggugaaggaguguugucuaaggccgacuuagagaacccccaccugccggagaaaaaaaucacccaauggcuggagacgaagggcguugagcgccugaagcggauggccaucagcggggacgacugcguggugaagccaaucgacgacagauucgcuaaugcccuccuggcccugaacgacaugggcaaagugcggaaggacaucccccaguggcagcccucuaagggguggcacgacuggcagcaggucccauuuugcagccaccacuuccacgaacucaucaugaaagauggccgcaagcuggugguccccugccggccccaggacgaacugaucgggcgcgcacggaucucccaaggggccggcuggucucucaaggagaccgcgugccuggggaaggccuacgcccagaugugguccuuaauguacuuccaccgucgugaccuccggcuggccagcaaugcgaucugcuccgccguccccguacacugggucccgaccagccguaccacgugguccauccaugcccaccaccaauggaugaccacggaggacaugcugacgguguggaaccggguguggaucgaggacaaccccuggauggaggacaaaacgcccguuaccaccugggagaacguucccuaccucggcaagcgcgaagaccaguggugcgggucacugaucggccugacaagcagagcuacgugggcucagaacaucccgaccgcgauucagcagguccgcucccuuauaggaaaugaggaguuccuggauuacaugcccagcaugaagcgguuccgcaaagaggaagaguccgagggcgcuauuugguga

SEQ ID NO: 25857 - RNA, 9873 nt, Artificial Sequence
  derived and/or modified CDS sequence (opt11) from DENV-3__JF937624__SS-prME
accagccuaugccucaugaugauccugcccgccgcccuagcguuccaucucaccagcagagacggcgaaccccggaugaucguggggaagaacgagagaggcaagagccuguuguucaagacugccagcgggaucaacaugugcacccucaucgcgauggaccugggagagaugugcgacgauaccguuaccuauaaaugcccacacaucaccgagguggagcccgaggacaucgacugcuggugcaaccugaccagcaccuggguuaccuacgggacuugcaaccaggccggcgagcaccggcgcgacaagcgguccguugcccucgcgccccacgugggcauggggcuggacacucgcacccagaccuggaugagcgcggagggcgccuggcgccaaguggagaagguggaaacaugggcgcugcgccauccgggguucacuaucuuagcccuguuccuggcccacuacaucgguacuucccucacucagaaaguggugaucuuuauccugcugaugcucguuacgccgagcaugacgaugcgaugcgucggggugggcaaucgcgacuucguggagggccugagcggggccaccuggguggacgugguacuggagcauggagggugugugacgacgauggccaagaacaagccuaccuuggacaucgaacugcagaagaccgaggccacacagcuggcuacgcuccggaagcugugcauugaggguaagaucaccaacaucaccaccgacucucgcugccccacgcagggcgaggcuacccugccggaggagcaggaccagaacuacgugugcaaacacaccuacgucgacagaggguggggaaacgggugcggucucuucgggaaaggcuccuuaguuaccugcgccaaguuccagugccuggagccgaucgagggcaaggugguccaguacgagaaccucaaguacacgguuauuaucaccguucauaccggggaccagcaucaagucggcaaugaaacccagggggugacagccgagaucacaccccaagccucuaccaccgaggcaauccugcccgaauaugguacguuggguuuagagugcucgccgcgcacgggccuggauuucaacgagaugauccugcucaccaugaagaacaaggcuuggaugguccaccggcagugguucuucgaccugccccuaccguggaccagcggcgccaccacggagaccccuaccuggaaccgcaaagagcuccuggugacauucaagaacgcccacgccaagaagcaggaggucguggugcugggaucccaggaaggcgcaaugcacacggcccuuaccggggccacugagauccaaaauagcggcggaacuuccaucuucgccgggcacuuaaaaugccggcugaagauggacaaguuagagcuuaagggcaugagcuacgcuaugugcacgaauaccuucguguugaagaaagaggucucugagacccaacaugggaccauucucauaaagguggaguacaagggcgaggacgugccguguaaaauaccauuuucgacggaggacgggcagggaaaagcgcacaacggcagacugaucaccgccaaccccgucgucacuaagaaggaggagcccgugaacauugaggcagagccgcccuucggggagagcaacauagucaucgggaucggggacaacgcccugaagaucaacugguacaagaagggcagcagcaucgggaaaauguucgaggcaaccgcccggggugcccggcggauggcaauacuuggcgacaccgccugggacuucgggagugugggugguguccucaacagccucggcaagaugguccaccagaucuucgggucagccuacacggcccuguucucuggcgugagcuggguuaugaagaucgguauuggaguccuacugaccuggauuggccugaauucuaaaaacacguccaugagcuuuucguguaucgccaucggaaucaucacucucuacuuaggagccgugguccaggcugacauggggugcgucaucaacuggaagggaaaggagcuaaaguguggcagcgggauuuucgucaccaacgaggugcacacauggaccgaacaguacaaguuccaggcggauucccccaagcgccuagccaccgccaucgccggcgcaugggagaacggggucugcggcauucggucgaccacccggauggagaaccugcuuuggaagcaaauagcgaacgagcucaacuacauccugugggagaacaacauuaagcugaccgugguggucggggacauaaucggaguucucgagcaggguaagcgcacgcuaacuccacagccgauggaguuaaaguacuccuggaagaccugggggaaggccaagauugucacugccgaaacgcagaacucguccuuuaucauagauggcccuaacacccccgagugccccagcguaucccgggccuggaacguuugggagguggaggauuacggauuuggcgucuucaccacaaacaucuggcuaaaguugcgcgaaguguacacacagcugugcgaccacagguugaugagcgcggccgugaaggacgagcgcgccguccacgccgauauggguuacuggaucgagucucagaagaacgggucguggaagcuggagaaggcgucuuuaauugaggugaaaacgugcaccuggccuaagucccauacgcucuggaguaacggcgugcuagaguccgacaugaucauaccuaagucucuggcggggccuaucucccagcacaaccaccgcccgggcuaucacacccaaacggccgggcccuggcaccucggcaagcuugagcuugacuucaacuauugcgagggcacaaccgucgugaucaccgaaaacugcgguacccgcggcccgagccuccggacaaccaccguguccgggaagcugauccacgagugguguugccgcuccugcacgcuucccccgcuccgguacaugggggaagacggguguugguacggcauggagauccgccccaucuccgagaaggaggagaacauggugaagagccugguguccgcgggcagcgggaagguugacaacuucacuaugggcgugcuaugcuuagcgauucuguuugaagaagugaugagaggcaaguucggcaagaagcacaugauugcugggguguucuucacguuuguccuacucuugucaggacagaucacuuggcgggacauggcgcacacgcugaucaugaucggcagcaaugccuccgaccggaugggcaugggcgugacauaccucgcgcugauugcgaccuucaagauacaacccuuccuggcccucggguucuuccugcgcaagcugaccuccagggagaaucuccugcugggcgugggccucgcgauggccacgacgcuacagcugcccgaggacaucgagcagauggcgaacgggaucgcccucggucuaauggcgcucaagcucaucacccaauucgagacguaccagcuguggacggcccugaucagccugacaugcuccaacaccaucuucaccuuaacggucgccuggcgcacugccacccugauccuugccggggugagccugcugccuguaugccaguccagcucaaugcggaagacugacuggcucccuauggcgguggccgccaugggugugccgccccugccacucuuuaucuucgggcuuaaggacacgcugaagcgccgcagcuggccucugaacgagggggugauggccgugggccuaguuaguauacuugccucgagucugcuacggaaugacgucccuauggcgggaccucuaguagccggagggcugcucaucgccugcuacgugaucacgggaaccagcgcagaccugacaguugagaaagccgcagacaucacgugggaggaggaggccgagcagaccggggugucccacaaucugaugauuaccguggacgacgauggcaccaugcgcauuaaggaugacgagacugagaacauucucacggucuugcugaagaccgcccuccugaucgugagcgggauuuuuccuuacaguauccccgccacccugcucguauggcacaccuggcagaagcaaacccagcggaguggaguccugugggacgugcccagcccgccagagacccagaaagccgagcuggaggaaggcguguaccgcaucaagcagcaggguaucuucgguaagacgcaggucggggugggcguacagaaggagggcgucuuccacacaauguggcauguuacgcguggugcggugcucaccuacaacggcaagagacuggagccuaacugggccucagucaagaaggacuugaucaguuauggggguggcuggcgccucagcgcacaauggcagaagggcgaggaagugcaagugauagcugucgagcccgguaagaaccccaagaauuuccagacuaugcccggcaccuuucagacgaucaccggcgagaucggcgcgaucgcccuggacuucaagcccggcaccuccggcagccccauuauuaaccgcgaggggaagguagugggcuuguacgggaauggcgucgugaccaaaaacgggggcuaugugucagggaucgcccagacuaacgcggagccggacgggcccacccccgagcuggaggaggagauguucaagaagcggaaccuuaccaucauggaccugcaccccggcucugggaagaccaggaaguaccuaccggcaaucgugcgugaggcaaucaaaagacggcuccgcacguugauccuggcucccacccgggugguggccgccgaaauggaggaggcccucaagggccugccuauccgcuaccagacuaccgcgaccaaguccgagcacacggggcgggagaucgucgaccugaugugccaugccaccuuuaccaugcgccuccugucccccgugcgggugccgaacuauaaucugaucaucauggacgaagcccacuucacggaccccgccagcaucgccgcgcgcgguuacaucucgacccggguuggcaugggggaggccgcggccaucuucaugaccgcuacgccgcccgguacggccgacgccuucccgcagagcaacgcccccauccaggacgaagagcgcgacauccccgagcgcuccuggaauagcgggaacgaguggauaaccgacuuugccggcaagaccgugugguucgugcccuccaucaaggcggggaacgacauugcaaacugcuugcggaagaacggcaagaaagucauccagcugagccgcaaaaccuuugacacggaguaccagaagacgaaacugaacgacugggauuuuguagugaccaccgacaucagugagaugggcgccaacuuuaaggccgaccgggucaucgacccgcgccggugccucaagccggugauccugacggacgggcccgagcgcgugauacuggccggccccaugccggucaccgcggccagcgcagcccagcgccgggggcgaguaggccgcaauccccagaaggagaacgaccaguacaucuucaccgggcaaccgcucaacaacgacgaggaccacgcccacuggacagaggcgaagaugcuucuggacaacauaaacacucccgagggcaucaucccagcccucuucgagcccgagcgggaaaaaucagccgccaucgacggagaauaccgccugaagggggagucuaggaagacguucguggagcugaugcgccggggcgaccuccccgucuggcuggcgcacaagguggccuccgaagggaucaaguauaccgaccgcaaaugguguuucgacggccagcgcaacaaccagauccuggaggagaacauggacgucgagaucuggacuaaggagggcgagaagaagaaacuccggccccgguggcuggacgcccgcacauacagcgacccgcuggcguuaaaggaguucaaggaguucgccgcggggcggaaguccaucgcccuggaccuggucacggagaucggacgggugcccagucaccucgcccaccgcacccggaacgcccuggacaaccugguaaugcuccacaccuccgagcaugguggccgcgccuaccggcacgcaguggaggaguuacccgagaccauggagacgcugcuacugcuggggcucaugaucuuauuaaccggaggcgcuaugcuguuccugauuagcggaaagggcauuggaaagacuagcauaggacugauuugcguaaucgccuccucggggaugcucuggauggccgagaucccgcugcaguggauagcuuccgcuaucguucuagaguucuucaugaugguacuccugauccccgagcccgagaagcagcgcacgccccaggacaaucagcuggcuuacguagucaucggcauccucacgcuggccgccaucaucgccgcgaacgaaaugggccugcucgaaaccaccaagcgggacuuagguaugagcaaggagccgggcguggugucccccacuagcuaccuggacgucgaccuacaccccgccucggccuggacacuguacgccguggcgacgacugugaucacccccauguuacgccacacuaucgagaauagcaccgccaacgugucccucgccgccauagccaaccaggcugugguacugauggggcuugacaagggcuggccgaucagcaaaauggaucucggggucccccugcuggcucuuggcugcuacucccagguaaacccccugacccugaccgccgccgugcuccugcugauaacucacuacgccaucaucgguccggggcuccaggcgaaggccacccgggaggcccagaagagaaccgccgccggcaucaugaagaacccgaccguugacgggauuaugacgauagaccuugaccccgugauauacgacagcaaguuugaaaagcagcugggccagguaaugcuacuuguccugugugcggugcagcuccugcugaugcggaccaguugggcccucugcgaggcucugacguuggcaaccggacccaucacgacccucugggaggggagcccagguaaguucuggaacaccacaaucgcgguguccauggcuaacauauuccgcggguccuaccucgccggagcagggcuggccuuuuccaucaugaaguccgucggcacgggcaagcgggggacgggcucccagggggagacccucggcgagaaauggaagaagaaacuaaaccaacugagccgcaaagauuuugaucucuacaagaaguccgggauaacugagguggaucgaacugaagcgaaggagggccuaaagaggggcgagauaacucaucacgccgugucccgggguagcgcuaagcugcagugguucgucgagcguaacauggugaucccggagggccgagugaucgaccucgggugcggaagaggggguugguccuacuacugcgcaggccugaagaagguuacagagguacggggguauacuaagggggggcccggccacgaggaacccgugcccaugagcacuuacggguggaacaucgucaagcuuaugaguggcaaagacguguucuaucucccuccggagaagugcgacacgcuguugugugacaucggcgagucgucccccucacccaccguggaggaaucccgcaccauccgcguccugaagaugguggagccguggcucaagaacaaccaguuuuguaucaagguguuaaacccuuauaugccuaccgugaucgagcaccuggagagauuacaacgcaagcacgggggcaugcugguccggaacccccuaagccgcaacuccacgcaugagauguacuggaucucuaacgguaccggcaauaucgucgcaagugugaauauggugagccggcugcugcugaacagguucaccaugacccaccgccgcccgacgaucgagaaggacguggaccucggcgcggggacccgacaugucaacgcugaacccgagacucccaacauggacgugaucggcgagcgaaucaaaaggaucaaggaggagcacaacuccaccuggcacuacgacgacgagaacccguacaagacgugggccuaccacggcagcuacgaggugaaggccaccgguuccgcaagcuccaugaucaacggggucgugaagcugcuaacaaagcccugggaugucguacccauggucacccagauggcaaugacggacaccacccccuuuggucagcagcgcguauucaaggaaaagguggacacccgcacgccgcgcagcaugcccggcacccggagaauuauggggauuaccgccgaauggcucuggcgcacccucggccgcaacaagaagcccaggcuguguacgcgagaggaauucaccaagaaggugcgcacgaacgccgccaugggggcgguguucaccgaggagaaccaaugggacagcgccaaggccgcgguggaagacgaggacuuuuggaagcucguugaccgggagcgugagcugcauaagcugggaaagugcgggucuugugucuauaacaugaugggcaagcgggagaagaagcucggagaauuugggaaggccaagggcagccgcgcuaucugguacaugugguugggggcaagauaucuggaguucgaggcucucggauuccugaacgaagaccacugguucucccgcgagaauagcuacucggguguggagggagaaggccuucacaagcucggguauauucugagagacaucagcaagauucccgguggggccauguacgcugacgacacggcgggcugggacacccgcaucaccgaggacgaucugcacaacgaggagaagaucacccagcagauggacccggagcaccggcagcucgccaacgccauauucaagcugacguaucagaauaagguggucaaagugcagcgacccacccccaccggcaccgugauggacaucaucucccggaaggaccagcgcggguccggccaggucgggaccuacggccugaacacguucacuaacauggaggcccagcucauccgucagauggagggggagggcgugcucuccaaggccgaccuggagaacccucaccucccagaaaagaagaucacccaguggcuggagacuaagggcguggagcgauugaagcggauggcgaucagcggggacgacugcguugugaaacccaucgacgacagauucgccaacgcccuucuagcccuaaacgauaugggcaaggugcgaaaggacaucccccaauggcaacccuccaagggguggcacgacuggcagcaagucccguucugcucacaucacuuccacgaguuaaucaugaaggacggccgcaagcuaguaguucccugucggccccaggacgagcuuauagggcgcgcccggaucucccaaggcgcgggcuggagccugaaggagacagcuugccugggcaaggccuacgcccaaauguggucgcugauguacuuccauaggcgcgacuuacggcuggcgagcaaugcaauaugcucagccguuccagugcacugggugcccacgagccgcacaacuuggucuauccacgcccaccaccaguggaugacaacugaggauaugcugaccgucuggaacagaguguggaucgaggauaacccauggauggaagacaaaacccccgucacgaccugggagaacguccccuaccucggaaaacgcgaggaccaguggugcgggagccugauuggccugacgagccgggccaccugggcgcaaaauauuccgaccgccauccagcagguucgcagccucauagggaacgaggaauuccuggacuacaugccguccaugaagcguuuuagaaaggaagaggaguccgagggcgcaauuugguga

SEQ ID NO: 25858 - RNA, 9873 nt, Artificial Sequence
  derived and/or modified CDS sequence (opt11) from DENV-3__JN000938__SS-prME
accagccucugcuugaugaugauccuucccgcagccuuagccuuccaccucacaagccgggauggggagcccagaaugaucguggggaaaaacgagcggggcaagucucugcuguucaagacagccagcgggaucaacaugugcaccuugaucgccauggaucugggagagaugugcgacgacacggugacauauaaaugcccccauaucaccgagguggagcccgaggacaucgauugcuggugcaaccugaccagcaccugggucacauacgggacaugcaaucaagccggcgagcaccggcgcgacaagagauccguugcccucgcuccccacguuggcauggggcuggacacacgcacacagacguggaugagcgccgagggcgcguggcgccaaguggagaagguggagacgugggcgcugcgucacccgggguucaccauccuugcguuauuccuggcacacuacaucgguaccucgcucacccagaagguggugauuuucauccuccuuaugcuaguuacgccuagcaugacgaugaggugcgucggggugggcaaccgcgacuuugucgagggccuuuccggggcaaccuggguggaugucguccuggagcacggcgggugcgugaccacgauggccaagaauaaaccuacccucgacaucgaacugcaaaagaccgaagcaacccagcuggcaaccuuacggaagcuguguaucgagggcaaaaucaccaacaucacuaccgauagucgaugccccacgcagggcgaagccacccugccugaggagcaggaccagaacuacgucugcaagcacaccuacguagaccguggguggggcaacgggugcggccuuuucggcaaaggcucccucgugaccugcgccaaguuccagugucuggagcccaucgaaggcaaggugguccaguacgaaaaucucaaguauacagugaucauuaccgugcacaccggggaucagcaccagguuggcaacgagacccagggagugacggcugagaucacgccccaggccucuaccaccgaagcaauccugccagaguauggaacgcuggggcucgaaugcuccccgcgcacgggcuuggacuucaaugaaaugaucuuacugaccaugaaaaacaaggccuggauggugcaccggcagugguuuuucgaccuaccccugcccuggaccagcggcgccaccaccgagacccccacguggaaccgcaaagagcuccuggugaccuuuaagaacgcccacgcgaagaagcaggagguggucgugcugggcucucaggagggcgcaaugcacacugcccugaccggggcuaccgagauccagaacaguggcgguaccucuaucuucgccggucaccucaagugccggcugaagauggacaagcucgagcugaagggcaugagcuaugccauguguacuaacacguucguccugaaaaaagaggucuccgagacccagcaugguacuauccucauaaagguggaauauaagggcgaggacgugccgugcaaaauccccuucucuaccgaggacgggcaggggaaggcgcacaacggcaggcugaucaccgcgaaccccguggugaccaagaaggaagagccggugaacaucgaggccgagccgcccuucggggagagcaacaucgucauuggcauuggggacaacgcccugaagaucaacugguacaagaaggguuccagcauugggaagauguucgaggcgaccgccaggggcgcccgccggauggcuaucuugggcgacacggcuugggauuucggguccgugggcgggguccucaacagucuggggaagaugguucaccagauauuugggucugcguacaccgcccuguucagcggaguauccugggugaugaagaucggcauuggggugcuccuaaccuggaucggcuugaacagcaagaauaccaguaugagcuuuuccuguaucgcuauagggaucauaacgcucuaccugggcgccguagugcaggcggacauggggugcgucaucaacuggaagggcaaggagcugaagugcgggagugggauuuucguuaccaaugaagugcacacauggaccgagcaauauaaguuccaagcggacucccccaagcgccuggccacggcaaucgcuggagccugggagaauggggucugcggaauucgcagcaccacgcggauggagaaccugcuguggaaacagaucgcuaacgaguugaacuacauacugugggaaaacaacaucaagcucacugugguagugggggauauaauuggcgugcucgagcagggcaagaggacucugacgccacaaccgauggagcugaaguacucguggaagacaugggggaaggccaagaucgugaccgccgagacgcagaacuccuccuucauaaucgacggcccgaacacucccgaaugccccagugucucccgggccuggaacgugugggagguggaagacuacggguucggcguauucaccaccaacaucuggcucaagcugcgcgagguguacacccagcugugcgaccaccgccucaugagcgcggcggugaaggacgaacgcgcaguccacgccgacaugggcuacuggaucgagagccagaagaacggguccuggaagcuggagaaggccagcuugaucgaggugaagacaugcaccuggcccaaaucccauacccuauggucaaauggcgugcuggaguccgacaugaucaucccaaagagccuggcggggcccaucucccagcacaaccaccggccgggguaucauacccaaacugccgggcccuggcaccucggcaagcucgagcuugauuucaacuacugcgaaggcaccaccgucguaaucaccgaaaacugcgggacgcgcggcccaagccuccggaccaccaccguguccgggaagcugauccacgaauggugcugccgcucuugcacgcugcccccgcuccguuacaugggcgaggacggcugcugguacggcauggagauccgccccuucuccgaaaaggaagagaacauggucaaaucacugguauccgccggcgggggcaagguggauaacuucacgauggggguccugugucucgcuauccuuuucgaggaggugaugcggggcaaguucggcaagaaacacaugaucgcuggcguuuucuuuaccuucguccuacuccugagcggccagaucaccuggcgggacauggcgcauacgcugaucaugauagguaguaaugccagcgaccggaugggcaugggggugacuuaucucgcccuuaucgccaccuucaagauucagcccuuucuggcacucggcuuuuucuugagaaagcugaccagccgggagaaccugcuccugggcguggggcucgcuauggcuacgacauugcagcugcccgaggauaucgagcagauggccaacgggaucgcccucgggcucauggcgcugaaguuaauaacccaguucgagaccuaccagcuguggacugcccugaucucgcugaccugcagcaacaccauauucacucugacggucgcguggcgcaccgccacccugauccuugccggcguguccuuacugcccgucugccagagcuccagcaugagaaagacggacuggcucccuauggcuguggccgcuaugggugucccgccccucccgcuguucauauucggcuuaaaggacacucugaagcgacgauccuggccccuuaacgaaggagugauggccguugggcuggugucuauccuggcuuccagccugcuccggaacgauguccccauggcuggcccguugguggcuggaggccuucucauugcgugcuacguuauuaccgggaccuccgccgaccugaccgucgagaaggccgcugacaucacgugggaagaagaagccgaacagaccggcguuagccacaacuugaugaucacgguggacgacgacgguacgaugcgcaucaaggacgacgagaccgagaacauacucaccguccuguuaaagaccgcccuccucaucguguccgggauauucccguacagcaucccggccacccugcucguguggcacacauggcagaagcaaacgcagcguucuggcguucuuugggauguacccagcccgccagagacccagaaagcagagcuggaggaggggguguaccgcauaaagcagcagggcaucuucgggaagacacaagucggaguggguguccagaaggagggugucuuccacaccauguggcaugugacgcggggcgcggugcucacguacaacgggaagcgccuggagcccaacugggcgagcgugaagaaggaucuaaucagcuacggcgggggcuggcgacucucugcccaauggcaaaagggggaggagguacaagugaucgccgucgagcccgggaagaaccccaagaacuuccagaccaugccagggaccuuucaaacgacuaccggcgaaaucggcgcgaucgcacuagacuuuaagcccggcacuagcgggaguccaauaaucaaucgcgaaggcaaggugguggggcuguacggcaacggggucgugaccaagaaugguggcuaugugagcgggaucgcccagaccaacgccgagccggauggccccacacccgagcucgaggaggagauguucaaaaagcgcaaucucacaaucauggaccugcaccccggguccggcaagacgcgcaaguauuugccggccaucguacgggaggcuaucaagcgccgccuccgcacccuaauccuggccccaacccgggugguggcggcugaaauggaggaagcacucaagggucugccaauccgcuaucaaaccacggccaccaaauccgagcacaccggccgggagaucgucgaucuaaugugucacgccacuuucacuaugcgccuccugagccccgugcggguaccgaacuacaaccugauaaucauggacgaggcacauuucaccgacccagccucaaucgccgcgcgcgguuacaucagcacccggguggggaugggugaggcggccgcuaucuucaugaccgcgaccccgccuggaaccgccgacgccuucccgcaaaguaacgcccccauccaagacgaagagcgcgacauacccgaacgaagcuggaauucuggcaaugaguggaucaccgauuucgccgggaagacugugugguucgugcccucaaucaaggcgggcaacgauauagcaaacugucuccgaaagaacggaaagaaggugauccagcuguccagaaagacguucgacaccgaguaccaaaagaccaagcugaaugacugggacuucguggugaccacggauaucucagagaugggggccaacuucaaggcugaccgggucauagacccucgccguugccuuaagcccgugaucuuaaccgacggcccagagcgggugauccuggccggccccaugccggucaccgcggccuccgccgcccagcggcgcggccgggugggacguaacccccagaaggagaacgaccaguacauauucaccggccagccccugaacaacgacgaggaucacgcccauuggaccgaggcgaagaugcuucuggacaacaucaacacgccagagggcauuaucccggcccuuuuugagcccgagagagagaaauccgccgccaucgauggggaguaccgccugaagggcgagucccggaagaccuucguggagcugaugcgccgcggggaccuccccguguggcuggcgcacaagguggccagcgagggcaucaaguacacggaccgcaaguggugcuuugacggccagcgaaauaaccagauccuggaggagaacauggacgucgaaaucuggaccaaggagggggagaagaagaagcugcgcccccgguggcuagacgcccgcacuuacucggacccccuggcgcuuaaggaguuuaaggaauucgccgcgggccgaaaaagcaucgcacuggaucucguuaccgaaaucggccgcgugccgucccaccucgcccaccggacccgaaacgcccuugacaaucuggugaugcuccacacuagcgaacacggcggaagggccuaccgucacgcgguggaagagcugccugagaccauggagacccuguuacugcugggccucaugauccuacugacgggcggcgccaugcuguuuuuaaucuccgggaagggcauugguaagaccagcauagggcugauaugugugaucgccuccucugguaugcuguggauggccgaaauuccccuacaguggaucgccagcgccaucgucuuggaguucuucaugauggugcuacugauccccgagccagagaagcagagaacgccccaggacaaucaauuggccuacguggucaucggcauccucacccucgcugccaucaucgcugcuaacgagaugggacugcuagagaccaccaaaagagaccuggggauguccaaggaaccgggcguugugucaccuacuuccuaccuugaugucgaccuccacccggccucugccuggacucucuacgccguggcgacgacagugaucacgccuaugcugcgccacacgauugagaacuccaccgccaacgucagccucgccgccauagccaaccaggcaguggugcugaugggucuugacaagggguggccgaucuccaagauggaccucgggguaccccucuuagcacucgguugcuacagccaagugaauccacugacccucacggccgcagugcuccugcugaucacucauuacgccaucaucggaccuggccuccaggcuaaggccacccgggaagcgcagaaacgcaccgccgccgggauaaugaagaaccccacggucgacggcaucaugaccaucgaucuggaccccgugaucuacgacucuaaauuugagaagcagcuggggcaggugaugcuccuaguccugugugcggugcagcuccuucugaugcggaccagcugggcccucugcgaggcccugacucuggcaaccggacccaucaccacccucugggaggguucccccggcaaguucuggaacaccacgaucgccgucagcauggcaaacaucuucaggggcuccuaccuggcuggggccggccuggccuuuagcauuaugaaguccguuggcaccggcaagcgaggcaccgguagccagggggagacccucggggagaaguggaagaaaaaacugaaccagcuuucaaggaaggacuucgaccucuacaagaagucagggaucacggagguggaccggacggaagcgaaagagggccugaagcgcggagagauaacccaucacgccgugagucgcggcuccgcuaagcuacagugguucguggagagaaauauggugaucccggagggacgggucauugaccucggcugugggcggggcggguggagcuacuacugcgccgggcugaaaaaggucacagaggugcggggauacaccaagggagggcccgggcacgaggagcccgugcccauguccacguauggcuggaacauagucaagcugaugucgggcaaagacguguucuacuugccacccgagaaaugcgacacccuucugugcgacaucggggaguccucgcccuccccuaccguggaggaaagcagaaccauucggguccucaagaugguugagccauggcucaagaacaaccaguucugcaucaagguucugaaccccuacaugcccacggucauagagcaccuggagcggcuccagcgcaagcauggaggaaugcuggugcggaauccccugucccgcaacuccacucaugagauguacuggaucucuaauggcaccggcaacaucguggccagcguaaacauggugucccggcuccuacugaaccgauuuaccaugacgcaucggaggccgacuauagagaaggauguggaccucggggcggguaccaggcaugucaacgccgagcccgagacccccaacauggacgugaucggggagagaaucaagcggaucaaggaggagcacaacagcacuuggcacuacgaugacgagaacccuuacaagaccugggcuuaccacggcuccuacgaggugaaggccacuggcagugccucaagcaugaucaacggggucgugaagcugcugacuaaacccugggacguuguacccauggugacgcagauggcgaugaccgacaccacacccuucggccaacagcgcgucuuuaaggaaaagguggacacgaggacgccgcgcagcaugccggguacacggagggucaugggaaucaccgcagaauggcucuggaggacacucgguagaaacaagaaaccccggcugugcacgcgcgaagaguucacgaagaaagugcgaaccaacgccgcgaugggcgcgguguucacugaggagaaucagugggacagcgcaaaggccgcaguggaggaugaggacuuuuggaagcuggucgaccgggagcgagaauuacacaaguuggggaaaugcggcagcugcguguacaauaugauggguaaacgcgaaaagaagcucggggaguucggcaaggcuaagggcuccagggcgauaugguauaugugguugggcgcccgguaccuggaguuugaggcccucggguuucucaacgaggaucacugguuuagccgcgagaauuccuacagcggcgucgaaggcgaagggcugcacaagcucggguacauccugcgggacauauccaagauaccggguggcgccauguaugccgacgacacagcgggcugggacacgaggaucaccgaggacgaucugcauaacgaggagaaaauaacgcagcagauggacccggaacaccggcaguuagcuaacgcaauauuuaagcugaccuaucagaacaaggucguuaagguacagcgucccacccccacggggaccgugauggauaucauaucucggaaggaccagcgggguuccggccaagucggcaccuacgguuuaaacaccuuuaccaacauggaggcccagcucauccgacagauggagggcgagggugugcuaucgaaggccgacuuggagaacccccaccuaccggagaaaaagauaacccaauggcuggagacuaaggggguagagcgccugaagcggauggcgauauccggggacgacugcgucgugaagccuauagaugaccgcuuugcaaacgcgcuccuggcauugaacgacauggggaagguccggaaggacaucccccaguggcagcccucgaaaggcuggcaugacuggcagcaggucccguuuugcucccaccacuuccacgaacucaucaugaaggacggaaggaaacucgugguacccuguagaccucaggaugagcugauuggccgcgcccggauuagccagggugcaggguggagucucaaggagaccgccugccugggcaaggccuacgcucagauguggucuuuaauguauuuccaccgccgugaucugcggcucgcgucuaacgcuaucugcucagccgugcccguacacugggugccuacaucccggaccacguggagcauccaugcacaccaccaauggaugacaaccgaggacaugcucaccgucuggaaccggguguggaucgaggauaacccguggauggaggacaaaacgcccgucaccaccugggagaacgugccguaccucggcaagcgcgaggaccaauggugcggcucccucauagggcugaccagccgcgccacuugggcgcagaacaucccgaccgccauccagcaggugagguccuugauagggaacgaggaauuucuggauuacaugccuagcaugaagcguuuucgcaaggaggaagagagcgagggagccaucugguga

SEQ ID NO: 25859 - RNA, 9873 nt, Artificial Sequence
  derived and/or modified CDS sequence (opt11) from DENV-3__JN093515__SS-prME
accagccugugccucaugaugauacugccggccgcauuagcguuucacuuaacuagccgggacggggaaccucggaugauagugggcaagaaugagcggggcaagagccuucucuucaagaccgccagugggaucaacaugugcacccucauagccauggaccugggagagaugugcgacgacaccguuaccuacaaaugcccucauaucaccgagguagaaccggaggacauagauugcugguguaaucuaaccuccaccuggguuacguacgggaccugcaaccaggccggugaacaccggcgcgacaagcgcucgguggcacuugcuccccacguggggaugggccucgauaccagaacgcagaccuggaugucagccgagggggcguggcgccaaguagagaagguggagacuugggccuugagacacccgggguucacuauccucgcgcuguuucuggcccauuacaucgggacgucccugacacagaagguaguaaucuucauccugcugauguugguaacgcccuccaugacaaugagaugcguggggguaggcaauagggacuucgucgaagggcuaaguggggccacguggguggacgugguccuggaacacggagggugcgugacuacgauggcgaagaacaagcccacccuagauaucgaguuacagaagaccgaggccacccagcucgcuacgcuccggaaacugugcaucgaaggcaagaucacgaacauuacuaccgacagcagaugccccacucagggcgaagccacuuugccggaggagcaggaccagaacuauguaugcaagcacacauauguagacagaggguggggaaacgggugcggccucuucggcaaaggcucccuugugacaugugccaaauuccaaugccuggagcccaucgaaggcaagguugugcaacacgagaaccuuaaguacaccguuaucaucacaguacacacaggggaucagcaccaagucggcaacgagacacagggggugaccgccgagaucacgccucaggccucuacaacggaggcgaucuuacccgaguacggcacucuagggcuagagugcagcccacgcacuggccuggacuucaacgagaugauccuguuaacuaugaagaacaaggccuggaugguucauagacaaugguucuuugaccugccccugccauggaccucgggugccaccacggagacgcccaccuggaacaggaaagaguugcuagugacguucaagaacgcccacgcgaaaaagcaggagguggucguguuggggucacaagagggcgcgaugcauaccgcccuuaccggcgcgaccgagauccagaacagcggcggcacgaguaucuucgcgggacaccuaaagugccgguugaaaauggacaaacuggagcuaaagggcauguccuacgcaaugugcacgaacaccuucgugcuuaagaaagaggucagugagacgcagcacgggaccauccucaucaagguggaauacaagggcgaagacgugccuugcaagauccccuucagcacggaggacgggcaaggcaaggcgcacaacggacgacuaaucaccgccaaccccgucguuaccaagcgugaagaaccugugaacauagaggcggagccgccguucggagaaucuaauaucguuauuggcaucggcgacaacgcacucaaaaucaauugguauaagaaggggucuuccaucggcaagauguucgaggcgacagcccggggcgcucggcggauggcuauccugggcgacacggcuugggacuuuggaagcguaggaggggugcuuaauagccugggaaagaugguccaccaaaucuucggcuccgcauacaccgcacuguucucaggagugucuugggugaugaagauaggcaucgguguucuccugaccuggaucgggcugaauagcaagaacaccucuaugagcuucucaugcaucgccaucgggaucaucacgcuuuaccugggcgccguggugcaagccgacauggguugugucauaaacuggaaggggaaagagcugaagugcggcucgggaaucuucgugaccaacgaagugcauacuuggaccgagcaguacaaauuccaagcggacagcccgaagcgccucgcgacggccauugcuggcgccugggaaaacggggucugcggcauucgcagcacaacccggauggagaaucugcuguggaaacagaucgccaacgagcugaacuacauccuaugggagaacaacaucaagcugaccgugguagugggggacaucaucgguguacucgagcagggcaagagaacgcugacgccgcaaccuauggagcugaaguacucauggaagacguggggcaaggcgaagaucguuacugcugagacacagaacagcuccuuuaucauagacgggcccaacacccccgagugcccuucggucucccgcgccuggaacgucugggagguagaggacuauggguucggcguauuuaccaccaauaucuggcuuaaacugcgagagguguacacucagcugugcgaccaucgccuaaugucugcugccgucaaggacgaacgagcgguucacgccgacaugggcuauuggauagagucacagaagaaugggagcuggaagcuggagaaagccucgcugaucgaggucaagacguguaccuggccuaaaucucacacccuauggagcaacgggguacuggaaagugauaugauaauuccaaaaagccuggccgggcccauaagccagcauaaccaucgccccggcuaccauacccagacugccgggcccuggcacuuaggaaagcuggagcuggauuucaacuacugugaaggaaccaccgucguuaucaccgagaauugcgguacgcggggcccuucauuaagaaccaccaccguguccgggaaguuaauccacgaguggugcuguagaucgugcaccuugccaccgcuccgcuauaugggcgaggacgguugcugguacggcauggagauccggcccauuuccgagaaggaggaaaacaugguuaagucgcugguuucggccgguucggggaaagucgauaacuucaccaugggcguccugugucucgccauccuguucgaggaggugaugcgcggaaaguucgguaaaaagcauaugauugccgggguguucuucacauucguccuguuguuauccggacaaaucaccuggcgggacauggcacacacccuaaucaugaucggaucuaacgccuccgaccgcauggguauggggguaaccuaucuagccuugaucgcgacauucaagauccagcccuuuuuggcucuuggguucuuucugcggaaacucaccagccgcgaaaaccuccuccuggguguaggucuagcgauggccacgacccuucagcugcccgaggacauugagcaaauggccaaugguaucgcccucggccuuauggcgcucaagcucaucacccaguuugaaaucuaccagcuguggacugcccugauuagccucacaugcucuaacacaaucuucacucuaacugucgcuuggcggacggccacguuaauacuggccggggugucccugcugccgaugugccaguccagcuccaugagaaaaacugacuggcuccccauggcgguugccgccaugggcgugccgccccucccccuguucauuuucucgcuaaaggacacccugaagcggagguccuggccuuugaacgaaggcgugauggccguaggccucgugagcauccuugccagcaguuugcuccgcaacgacgugcccauggcuggccccuuagucgccgggggccuccucauugccugcuacgugaucacgggaaccucggccgaccuuaccguggagaaagccgcagacaucaccugggaagaggaggcagagcagacaggcgucagccacaacuuaaugaucaccguggacgacgaugguaccaugcgcauaaaggacgacgaaaccgaaaacauacugacggugcugcucaagaccgcacuccugaucgucuccggaaucuuuccuuacucuaucccagccacucugcuaguuuggcacaccuggcaaaaacaaacacaaagauccggcgugcugugggauguccccucgccgccggagacgcagaaagccgagcuggaggaagguguguaccgaaucaagcagcagggaaucuucgggaagacacaggugggcguuggagugcagaaggaaggaguguuccacaccauguggcaugucacgcgcggcgccguccugacguauaacggcaagcggcuggaacccaacugggcguccgugaagaaggacuugauuagcuacggcgggggcuggagacucagugcccaguggcagaaaggggaggagguccaggugauugccguagagccagguaagaaccccaaaaacuuccagaccaugcccgguacauuccaaaccacgaccggggaaaucggcgcgauugcccucgacuuuaagcccgggacgagcggcagccccaucaucaaccgggagggcaaggucguggggcuauauggcaacggggugguaacuaaaaacgguggcuacguguccggcaucgcccaaacgaaugccgagccggacgggcccacuccagaguuagaagaagagauguucaaaaagcggaaccucacaaucauggaucuccaccccgggucugguaaaacccggaaguaucugcccgccaucguacgcgaggcgauuaagcgccgcuuaaggacccugauccuggccccaacgcgcgucguugccgcggagauggaggaggcgcucaaagggcugcccauccgguaccagacuacugcaacgaaguccgagcacacaggccgcgaaaucguggaccugaugugccaugccaccuucaccaugcggcuccugagccccguccgcguccccaauuacaaccugaucaucauggacgaagcccacuucacggaccccgcauccaucgccgcgcgcggcuacaucucgacucgcgugggcaugggcgaggccgccgccaucuuuaugaccgcgacgcccccagggacugcugacgcuuucccgcaaagcaacgcuccaauccaagacgaagaacgcgauauacccgagcguagcuggaauagcgggaacgaguggaucaccgacuucgcuggaaaaaccgucugguucgugccgaguaucaaggcggggaacgauaucgcaaacugccuucgcaagaacgggaagaaaguaauccagcucucccgcaaaaccuucgacacggaguaccagaaaaccaagcuaaacgauugggacuucguggugacuaccgauaucuccgagaugggagcaaacuucaaggccgaucgcgugaucgauccuagacgaugccucaagccugucauacugacggacggccccgagcggguuaucuuggcagggccuaugccggucaccgcggccucagccgcacagcgucgggggcgcgugggucggaacccucaaaaggagaacgaccaguauauauucaccggccagccauugaacaacgacgaggaccacgcccacuggacagaagcgaagaugcugcuggacaacaucaacacaccggaggggauaaucccggcccuguucgaacccgagcgcgagaagagugcugcaaucgauggagaguaccgacugaaaggcgagucccggaaaacuuuugucgaauugaugcggagaggggaucugcccguguggcuggcgcauaaagucgcuagcgaaggcaucaaauacaccgaccgaaaguggugcuucgacgggcaacgcaacaaucagauacuggaggagaacauggacguggaaauauggaccaaggagggagagaagaagaaacuuaggccucgauggcucgaugcgcguaccuacucggacccucuugcccucaaagaauuuaaagaguucgcggcgggccgcaagagcauagccuuggaccuugucacggagauaggacgcgugccgucccacuuagcgcaccggacccgcaacgcucuggacaaccugguaaugcuccacaccagcgagcacggugggcgugccuaccgacacgcggucgaggaguuacccgagaccauggagacguuacuccugcugggccucaugauccugcugaccgggggcgccauguuguuccugaucuccggcaaggggauuggcaaaacauccaucggucuuaucugcgucauagcguccuccggaaugcucuggauggccgagauuccacugcaguggaucgccuccgcgaucgugcuggaguucuucaugaugguccuccugauccccgagccggagaagcaacgcacaccccaggacaaccagcuggccuacguagugaucggaauacucacgcuugcugcaauaauugccgcgaaugagauggggcuguuagaaaccaccaaacgcgaucuggguauguccaaagaaccggggguuguuagucccacaaguuaccucgacgucgaucuccaccccgcuagcgccuggacacuguaugcuguagcgaccaccgucaucacgcccaugcugaggcacacgauagagaacucgaccgcuaaugugucgcuggccgccauagccaaucaagcggucguucuuaugggcuuagauaaaggguggccgaucucgaagauggaccucggugucccccugcuugcauuaggaugcuacagccaggucaacccgcugacgcucacugccgcggugcuacuguugaucacccacuacgccauuaucggucccgggcuacaagccaaggccacuagggaggcacagaagcggaccgcugccggcauaaugaagaacccaaccgucgaugggaucaugacgauugacuuagaccccgucaucuacgacagcaaguucgagaagcagcugggccagguaaugcugcucgugcugugcgucgugcagcuccugcugaugcguacgagcugggcgcucugcgaagcauuaacucuggcuaccggccccauaaccacccuuugggaagguucucccggaaaguucuggaauaccaccaucgccgucucgauggcgaacaucuucagagguagcuaccucgccggcgccggccuggccuuuaguaucaugaagagugucgggacgggaaagagaggcaccggcagccaaggcgaaacauuaggggaaaaguggaagaagaaacugaaucagcugucaagaaaggacuucgaccucuacaagaagucaggcaucaccgaaguggaccgcaccgaagccaaagagggguuaaaacggggugagauaacacaccaugcgguuagucggggcuccgcuaagcuccagugguucguugagaggaacaugguaauaccagagggucgagugaucgacuuaggcugcgggcggggcggguggaguuacuacugcgcgggcuuaaagaaaguuaccgaggugcgaggcuacacaaagggcgggcccgggcacgaggagcccgugcccaugucaaccuauggcuggaacaucgucaaacuuaugagcggcaaggacguguucuaccucccgccagagaaaugugacacguugcugugcgauaucggagaguccucacccucuccgaccguggaagagucccggaccaucagaguccugaagaugguggagccauggcuaaagaauaaccaguucuguauuaagguacugaaccccuacaugcccaccgugauugagcacuuagagcgccuccagaggaagcacggcggcaugcuggugcgcaacccccuuucccgaaacagcacgcacgaaauguauuggaucagcaacgguacugggaacaucguggccucugucaacauggucucccgccuccuguugaauagauuuaccaugacccaucgccgaccgacgauugagaaggacguggaccucggcgccggaaccagacacgucaaugcggagcccgaaacccccaauauggacaucaucggugaacggauaaagcgcauuaaggaggaacacaacucaaccuggcacuacgacgacgagaauccguacaaaacuugggccuaccacggcuccuacgaagugaaggcuaccgggucagccagcagcaugaucaauggagucguaaaguuacugaccaagccgugggauguaguacccauggugacccagauggccaugacggacacaaccccguuuggccagcagaggguguucaaggagaagguugacacucgcacgcccagguccaugcccggcacccgccgggugaugggcauaacggcggaguggcuuuggcgcacccuagggcggaacaaaaagccccgccugugcacgagagaggaguucaccaagaaagugaggaccaacgccgcuaugggcgcugucuucacugaagagaaccagugggauagugcaaaggccgcaguggaggaugaagacuucuggaaacuugucaaccgcgagcgagagcuccacaagcuggguaaaugcggcucgugcguuuauaacaugauggggaagagagaaaagaaacuuggugaguucgguaaggccaaggggagucgggcgaucugguacauguggcugggugcgcgcuaccuggaauuugaagcccucggguuuuuaaacgaggaucacugguucucacgggagaacuccuacucggguguagaaggggagggccugcacaaacucggcuacauccuccgcgacauaaguaagaucccuggcggugcuauguacgccgacgauacggcugggugggacaccagaauuaccgaggacgaucugcacaacgaggagaagaucacacagcagauggacccggagcaccgccaguuggcgaacgccaucuucaaacuaacguaucaaaauaagguggucaaagugcagcggccaaccccuaccggaacaguuauggacaucauaucacgcaaagaccagcggggcaguggucaagucggcaccuacgggcugaauacuuucaccaauauggaggcccaacucauccgccaaauggagggugaagggguccuuaguaaagccgaccuggagaauccacaccucccggaaaagaagauuacccaauggcuggagacaaaagggguggagcggcugaagcgcauggcuaucuccggcgacgauugcgucgucaagccgaucgacgaccgguucgccaacgcacucuuagccuugaacgacaugggcaaggugcgcaaggacaucccccaguggcaaccuagcaaaggcuggcacgauuggcagcaggucccguucugcucccaucacuuccacgaacucauuaugaaggaugggcggaaguuaguugugcccugccgcccgcaggacgagcucauaggccgcgccaggauuagccaaggggcaggcuggucccucaaggaaacugcgugccuuggcaaggccuaugcccaaauguggagcuugauguacuuccaucgccgggacuuacgguuagcuuccaacgccaucugcucugcuguuccugugcacugggugccgaccuccagaacuaccuggucuauacacgcccaccaccaguggaugacgaccgaggauaugcugaccguauggaaucgaguuuggauagaagacaacccauggauggaggacaaaacucccgugacgacuugggagaacgugcccuauuuggguaaacgggaagaucaguggugcggcagccuaaucggcuuaacguccagggcuaccugggcucagaacauccccacggcgauccagcaaguucggagcuugaucgggaacgaggaguuccuagacuauaugcccucaaugaaacgcuuccggaaggaagaggagucugagggagcgauaugguag

SEQ ID NO: 25860 - RNA, 9873 nt, Artificial Sequence
  derived and/or modified CDS sequence (opt11) from DENV-3__JF937646__SS-prME
accagccugugccucaugaugauccugcccgccgcccuagcguuucaccucacgagccgggacggcgagccgcggaugaucguugggaaaaacgagagggguaaaagccugcuauuuaagaccgccagcgggauuaacaugugcacccucauagccauggaccuuggcgagaugugcgacgacaccgugaccuacaaaugcccccacaucaccgaaguagagccagaggacaucgacugcuggugcaaucuaaccagcacgugggugaccuacgggacguguaaccaggcgggggagcaucggcgcgauaagcgguccguggcccuugcgccccacgugggcauggggcuggacacccgcacccagaccuggaugagcgcggaaggcgcuuggagacagguggagaagguagagacgugggcccugcgacacccuggguucaccauccucgcucuguucuuggcccauuacaucgguaccucccuaacccagaaaguggugaucuucaucuuauuaaugcucgucacucccagcaugacuaugcggugcguggggaucgggaaccgggacuucguggagggccuaucuggagccaccuggguugauguggugcuggagcacggagggugcguuaccacgauggccaagaacaaacccacccuugauaucgagcugcagaagaccgaggcuacacagcuggccacacucagaaagcugugcaucgagggcaagaucaccaacaucacuaccgacucacgaugccccacgcagggcgaggccacccugccugaggaacaggaccagaauuacguguguaagcauaccuacguggaccggggauggggcaacgggugcggccucuuuggaaagggcagccuggugaccugcgccaaguuccagugccuggagcccauagaggggaagguggugcaguaugaaaaccucaaauacacggucauuauaaccgugcacaccggggaccagcaccaaguaggaaacgagacccaggggguaacggcggaaaucacaccccaggccagcaccaccgaggcaaucuugccugaguacggcacccuggggcucgaguguuccccgcgaacuggccuggacuucaacgagaugauccuguuaacgaugaaaaacaaagcguggauggugcaccggcagugguucuuugaccugccccuaccguggaccagcggcgccaccacagaaacgccgaccuggaaccgcaaagagcuccugguaaccuuuaaaaacgcucaugccaagaagcaggaagugguuguacuggguucccaggagggagcgaugcacacagcccucacaggggccaccgagauccagaacagcggaggaaccuccaucuucgcaggccaccugaagugccggcugaagauggauaaguuggaguugaaggggaugagcuacgccauguguacgaacgcuuucgugcugaaaaaggagguuagugagacccagcacgggaccauccugaucaaggucgaguauaagggagaggacguaccaugcaaaaucccauucagcaccgaggacggacagggcaaagcccauaacggccgccuuaucacggcaaaccccguggucaccaagaaagaggagcccgugaacauagaggccgaacccccauucggggagagcaacaucgugauaggcauaggggauaacgcccugaaaauuaacugguauaagaaggggagcagcauugggaagauguucgaggccaccgcgcgcggcgcucgccggauggcaauacuaggggacaccgcgugggauuucgggucugucggcgggguccuuaacagccugggcaagauggugcaccagaucuucggguccgcuuacacggcgcuauuuagcggcguauccugggugaugaaaauuggcaucggggugcugcugaccuggaucggccugaacucuaagaacacguccaugagcuuuucuugcaucgccaucgggaucauaacccucuaccugggagccgucguucaggcggacauggggugcgucaucaacuggaaggggaaggagcuaaaguguggcagcgggauauucgucacgaaugaggugcacaccuggacugaacaguacaaguuccaggcagacagccccaagcgccucgccaccgccauagccggcgcgugggaaaacgggguguguggaauacgcagcacgacccggauggagaaccugcuguggaagcagaucgccaacgagcugaacuacauacucugggagaacaacaucaaacugaccguagucgucggggacaucaucggcguccuugagcaggggaagcgcacguugacgccucagccuauggaacucaaguacuccuggaagaccugggggaaggcgaagaucgugaccgcagaaacacagaacagcuccuuuaucaucgauggccccaacacgcccgagugccccucuguuucccgggcguggaacgucugggagguggaggacuacggguucgguguguucaccaccaacauauggcucaagcugcgcgaggucuacacccagcugugcgaccaccggcuuaugagcgcagcgguaaaggacgaacgcgccgugcacgccgacaugggcuauuggaucgagagccagaagaacggguccuggaaacuggagaaggcgagccuuaucgagguaaagaccuguacguggccgaagucccauacacucuggucuaacggcguauuggagucggacaugauuauccccaagagccuggccggucccauaucgcagcacaaccaccggcccggguaccauacucagaccgccgggcccuggcacuuaggcaagcuggaacuggauuucaauuacugugaagggaccacaguggucauuaccgagaacugcgggacccgcggccccucgcuacggacgaccaccguauccgggaaguuaauucacgaguggugcugucgcagcugcacacugcccccgcuccgauacaugggagaggacgggugcugguaugguauggagauccguccgauauccgagaaggaggagaacauggucaagagccuggucagcgcugggagcgguaagguagacaacuucacgaugggcgugcugugucucgccauccucuucgaggaggucaugagggggaaguucggcaagaagcacaugauugcgggcguguuuuucaccuucgugcugcuccuuuccggacagaucacguggcgcgauauggcccacacacugauaaugaucggcagcaacgccucagaccgcauggggaugggugucacauaccucgcccuaauugccaccuucaaaauccagcccuuucuagcccuaggcuuuuucuugcgcaagcugaccucaagagagaacuugcugcugggcgugggauuagccauggugaccacgcuacagcugccugaggacaucgagcagauggccaaugggaucgcgcucggccuaauggcgcugaaauugauaacccaguuugagacguaucaguuauggaccgcguugauaagccucacgugcagcaacaccaucuuuacccucaccguugccuggagaacggccacccuaauucucgccggugucagccuauugcccgucugccagucuagcuccaugcggaagaccgacuggcucccuauggcgguggccgccaugggagugccaccccuuccgcuguuuauauuuggacuuaaggacaccuugaagcgccgcucguggccacugaacgagggcgucauggcagugggccuugugucgauucuggccagcucccugcuccgcaacgacguccccauggcgggacccuuaguugccggcggucugcucauugccugcuacgugaucacgggaaccagcgcggaccugacggucgaaaaagccgcggacaucaccugggaggaggaggcagagcaaacggggguaucccacaaccugaugaucaccgucgacgacgacgguaccaugcgcaucaaagaugacgagaccgagaacauccucaccguccugcugaaaacggcacuucugaucgugucuggcauuuucccauacuccauccccgccacccugcucguuuggcacaccuggcagaagcagacgcagcggagcgggguccuuugggacgugcccucaccgcccgagacgcagaaggcggaacucgaggagggcguuuaccgcauaaagcagcagggcaucuucggcaagacucaggucggggugggcguccagaaggaggggguguuccacacgauguggcacguaacccgcggugccgugcucacguacaacggcaagcgccuggaacccaauugggccucuguaaagaaggaccugaucucguacgggggcggguggaggcucagcgcccaguggcagaaaggcgaggagguacaggugaucgcgguggagcccggcaagaacccuaagaacuuccagaccaugccagggaccuuccaaacuacgacaggugagaucggggccaucgcccuggacuucaagccgggcaccagugggucucccaucauaaaccgggaggggaagguggugggccuguacgggaacggugucguuaccaagaacggaggguacgugagcggcauagcgcaaacaaacgcagaaccggacgggcccacccccgagcuggaggaggagauguucaagaagcggaaucucaccaucauggaccugcaccccggcuccgggaagacacgcaaguacuugccggccaucgugcgggaagcgaucaagaggcggcuucgcacucuuauucuggcccccaccagagugguggccgcugaaauggaggaagcccucaaggggcugcccauccgguaucagacaaccgcaacuaaguccgagcacacagggcgggagauagucgaucugaugugccacgccacguucaccaugcgccuccugucacccguaagagugcccaacuacaaccugauuaucauggaugaggcccacuucaccgaccccgccagcauugcugcccgaggcuacaucuccacccgggucggcaugggugaggccgccgccaucuucaugaccgcgacgccgccuggcacggccgaugccuucccgcagaguaaugcccccauccaggacgaggagcgcgacaucccggaacgcuccuggaacucagggaaugaguggaucaccgauuucgcaggcaagacagucugguuugugcccucuaucaaagucgggaacgacaucgcgaacugccuccgcaagaacggcaagaaggucauccaacuaagcaggaaaaccuucgacacggaguaccagaagaccaaauugaacgacugggacuucguugucacaacugacauuuccgagaugggcgccaacuuuaaggcagaccgagugaucgacccgcgccgcugucuuaagccggugauccugacggacgguccugagcgcgucauccuggcgggcccaaugccggugaccgcagcgagcgccgcucagcggcgcgggcgggugggcaggaauccucagaaggagaacgaccaguacaucuucaccggucagccccucaacaacgacgaggaccacgcccacuggaccgaggccaagaugcugcuggacaacauuaacaccccugagggcauaaucccggcacuauucgagcccgaacgggagaagucugccgccaucgauggcgaauacaggcugaagggcgaaagcaggaagaccuucguugaacugaugcgccggggagaucuccccguguggcuggcccacaagguugcguccgaggggaucaaauacacugaccgcaaauggugcuuugacggccagcggaacaaccagauccuggaggagaacauggauguggaaaucuggaccaaggaaggagaaaagaagaaacuccgcccccgguggcuagacgcucgcaccuacagcgacccucuggcccuaaaagaguucaaggaguucgcagccgggcgcaagagcauagcgcuggaccuggugacugaaaucgguagggucccuucacaccuagcacaccgcacccggaacgcccuggauaaccucgugaugcuccauaccucggagcacggcggccgcgccuaccgucacgccguggaggagcugccugagaccauggagacgcugcuccugcuagggcucaugauccugcuuacugguggugcgaugcuguuucugaucagcgggaagggcaucgguaagacaagcaucggacuuaucugugucauugccuccucggggaugcuguggauggccgagaucccucugcaauggaucgcuuccgccaucgugcuggaguucuucaugaugguacuccuaauacccgaaccugagaagcagcgcacgccucaggacaaucagcuggcauacguggucaucggcauucucacgcuggccgccaucauagccgccaacgagaugggucugcuagagacuaccaagagagaccugggaaugucaaaggagccgggcguggucuccccaacgagcuaccuggauguggaccuccaccccgcguccgcguggacacucuacgccguggccacgaccgucauaacacccaugcuucgccacacgaucgagaacagcacugcuaacgugaguuuggcugcgaucgccaaccaggccgugguccugaugggucuugacaagggcuggccgaucuccaagauggacuuaggcgugccccuccuggcucucggcugcuauucccaagugaaucccuuaacgcucacggccgccguccuccugcugauuacgcacuacgcgaucaucggccccgggcuccaggccaaggcgacccgggaagcccagaagcguaccgccgcagguaucaugaaaaauccuacuguggaugggaucaugacaauagaccuggacccagucauuuaugauagcaaguucgagaagcagcugggccaggucauguugcuggugcugugcgcugugcagcuacugcuaaugcgaaccuccugggcguugugcgaggcacugacccuggccaccggccccaucaccacccucugggagggcucccccggaaaauuuuggaacacaaccaucgccgucuccauggcgaacauauuccgcggcagcuaccuagcgggcgccgggcuggccuucuccaucaugaaguccguugggacuggcaaacggggcacaggcucacagggggaaacccucggcgagaaauggaagaagaaacugaaccaauugucuagaaaagacuucgaccucuacaagaaauccggcaucacggagguugaccggacagaggccaaagaaggguuaaaacgcggcgaaaucacgcaccacgcugugucccgggguagcgccaaacugcagugguucguggaaagaaacauggugaucccggagggaagagucaucgaucucgggugcggccgcggcggcuggaguuacuacugcgccggccucaagaaagugaccgagguccguggguacaccaagggcgggccgggccacgaggagccgguccccaugucaacauacggguggaacaucguuaagcugaugucuggcaaggaugucuucuaucucccgcccgaaaaaugcgacacgcugcugugcgacaucggagaaagcuccccgagccccaccguggaagaaucccgcacaauacgcgugcuaaagaugguggagcccugguugaagaacaaccaguucugcaucaagguccugaauccuuauaugcccacaguuaucgagcacuuagagcggcuacagaggaagcacgggggaaugcuggugcggaacccacugagcaggaacagcacgcacgaaauguacuggaucagcaacggaaccggcaacauugucgcuuccgugaacauggucagccggcugcuauugaaccgguucacgaugacccaccggcgcccgaccaucgagaaagacgucgaucugggcgccgggacacgacacgugaaugcggagccagagaccccgaacauggacgugaucggcgagcgcaucaagcggauuaaggaggagcacaacuccacguggcacuacgacgacgagaacccguacaagacgugggcauaccacggaagcuacgagguuaaggccaccggcucagccagcagcaugauaaacggaguggucaagcugcuaaccaagccgugggacguggugcccauggucacccagauggcgaugacggacaccaccccguucggccagcagcgcguauucaaggagaaaguggacacccggacaccucgcucuaugcccggcacgcgucgcgucauggguauuacugcagaguggcucuggcggacauugggacggaacaagaagccucggcugugcacucgcgaggaguucaccaagaaagugcgcacuaacgcugcaaugggagcaguguucacugaggagaaccagugggacagugcgaaggccgccgucgaggaugaggacuucuggaaacuuguggaccgcgaacgagaacuccauaaguuggggaagugcggguccugcguauauaacaugaugggcaagagggagaagaagcucggcgaauuugggaaggccaagggaagccgagccaucugguacauguggcugggggcgcgguaccuggaguucgaggcacuaggcuuccugaacgaggaccauugguuuucucgcgagaauagcuacuccgggguagagggcgaaggccugcacaagcucggauacauccugcgggacaucagcaagauacccggcggggccauguacgcggacgacaccgcgggcugggacacccggauuacggaggacgacuugcacaacgaggaaaagaucacccaacagauggacccugagcaccgacaguuagcgaacgccauuuucaagcugacguaccagaacaagguggugaagguccagcgccccacccccaccggcacagugauggacaucauuucccgaaaggaccagcgcgggagcggccagguggggaccuacggacugaacacguucaccaauauggaggcccagcucauucgucagauggagggggagggcguccuguccaaggccgaccuggaaaacccgcaccuuccggaaaagaaaaucacacaguggcucgagaccaagggaguggagcgccucaagaggauggccauaagcggugaugauugcguggugaagcccauagaugacagguucgcaaacgcccuccuggcacugaacgacaugggcaagguacggaaggacaucccccaguggcaaccauccaagggguggcacgacuggcaacaggucccguucugcagucaucacuuccacgagcucaucaugaaggacggcaggaaauuagucgugcccugucggccccaggacgagcugaucgggcgcgcccggauaucgcagggugccggauggucgcucaaggaaacugcgugccuggggaaagccuacgcccagauguggucccugauguacuuucaucgcagggaccucaggcuggccucuaacgcgaucugcucugcuguacccguccauugggugcccacgucgagaaccaccugguccauccacgcccaccaccaguggaugacgaccgaggacaugcuaaccguuuggaaccggguuuggaucgaagacaacccuuggauggaagauaaaacccccgugacaacgugggagaaugugcccuaccucggcaagcgcgaggaccaguggugcgggagccugauuggcuuaacuucuagggcgaccugggcccagaauauaccgacggcaauccaacaggugcgcucccucaucgggaacgaagaguuccuggacuacaugcccucaaugaaacgguuccgcaaggaggaggaguccgagggcgcaaucugguaa

SEQ ID NO: 25861 - RNA, 9873 nt, Artificial Sequence
  derived and/or modified CDS sequence (opt11) from DENV-3__JF937633__SS-prME
acuucucucugccucaugaugauacuaccagccgcgcucgcguuccaccucaccucacgagauggagagccccggaugaucguggggaagaacgagcgggguaagucgcugcuguucaagaccgccuccgggauuaacauguguacccucauagccauggaccugggugaaaugugcgacgacacugugaccuauaagugcccccauaucacagagguugagccggaggacaucgacugcugguguaaccucacaaguacuugggugacauauggaacuuguaaucaggccggcgaacaccggcgcgacaagcgguccguggcccucgcaccccacgugggcaugggucuggacacccgaacccaaaccuggaugagcgccgagggcgcauggcgacagguugaaaaggucgaaacgugggcccugcgccacccaggguucaccauccucgcucucuuccuggcgcacuacauaggcaccucccucacucagaaaguggucaucuucauccugcugaugcucgucacgcccucuaugacuaugcggugugucggggugggcaaccgcgacuucgucgagggccuguccggggccaccuggguggacgucguccuggagcauggugggugcgugaccacgauggccaaaaacaagcccacgcuugacaucgaacugcagaagaccgaggccacccaguuggccacgcuucgaaaauuaugcaucgaggggaagauuaccaacauaaccaccgacagccgcugcccuacgcaaggcgaggccacccuccccgaagaacaggaccagaauuacguuugcaaacacaccuacgucgaccgggguuggggcaacggguguggauuauuugggaagggcucccuggugaccugcgccaaguuucagugucuggagcccaucgagggcaaggugguacaguacgagaaccugaaguacacugugaucaucacugugcauaccggggaccagcaucaggucggcaacgaaacccaggggguaacggccgagauaacgccucaggccagcaccaccgaggcaaucuuaccggaguacgggacccuggggcuugagugcucgccacgcacaggccuggacuucaacgaaaugauccugcuuaccaugaagaauaaggccuggaugguccaccggcagugguucuucgacuugccucugcccuggacaagcggcgccaccacggagacgccuaccuggaaccgcaaggagcuccugguuaccuucaaaaacgcccacgccaagaagcaggagguuguaguguuggggucccaggagggcgcgaugcacacggcccucaccggagcgaccgagauccagaacuccggcgggacgaguaucuucgcuggccaccugaagugcaggcugaagauggacaagcucgagcugaagggcaugagcuaugccaugugcacgaacacuuucguguugaagaaggaggucuccgaaacccagcacgggaccauccucaucaagguagaguacaagggggaagacgugccgugcaagauccccuucagcacugaggacggccagggcaaggcgcacaacggccgccugauaacagccaacccagucgugacgaaaaaggaggaaccaguuaacauugaggccgaaccgcccuucggcgagucuaacaucgucaucggcauaggggacaacgcccugaaaauuaacugguacaaaaaggguuccagcauagggaaaauguuugaggcgaccgcucggggugccagacggauggccauccugggcgacacggccugggacuucgggagcguuggugguguguugaacagccugggcaagaugguccaccagaucuucggguccgcguacaccgcccuguucagugguguguccuggguaaugaagauaggcaucgggguccuccuuaccuggauaggccugaacagcaagaauaccuccaugagcuucuccuguauagcgaucgggaucaucacgcucuaccugggagccguggugcaggcugacaugggcugugucaucaacuggaagggcaaagagcugaaguguggaagcgggaucuucgucaccaacgaggugcacaccuggaccgaacaauacaaguuccaggcggacucccccaaacgccuggccacggcaaucgccggugcgugggagaacgggguuuguggcauccgcuccacuacccggauggagaaucuguuguggaagcagaucgcgaacgaguugaacuacauccuuugggagaacaacaucaagcugaccgugguuguuggugacaucaucggcgugcucgagcaaggcaagagaacgcugacaccacaaccuauggagcugaaguauaguuggaaaaccugggggaaggcaaagaucgugaccgccgagacgcaaaacagcucuuucauaauagauggccccaacacaccggagugccccagcgucuccagagccuggaacgucugggagguggaggacuacggguuuggcguguucaccaccaacaucuggcucaagcugcgcgagguguacacccagcuuugcgaccaucgguugaugagcgcggccgucaaagaugaacgcgccguccacgccgacaugggcuacuggaucgaaagccagaagaacggauccuggaagcuggagaaggccagucugauugaggugaagacuugcaccuggccgaagucucauacccucuggagcaacggugugcuggaguccgauaugaucaucccgaaaagccuggcggggcccaucagccagcacaaccaccguccgggcuaccacacccaaacggcagggcccuggcaccucgguaagcuggaguuagacuucaauuacugcgaggguaccaccguaguuaucaccgagaacugcgguacccgcggccccagccuccggaccaccaccguuuccggcaaacugauacacgaguggugcugccgcagcugcacgcugcccccguugcgguacaugggcgaggacgggugcugguauggcauggagauccgccccaucagugagaaggaggagaacauggugaagucguuagugucugccggcagcgggaagguggacaacuucaccaugggcguguuaugccuagccauccuguucgaggagguuaugaggggaaaauucggcaaaaagcacaugauugcgggggucuucuuuaccuucguccugcuccugucugggcagaucacuuggcgcgacauggcccacacguuaaucaugaucggcucgaacgccucggacagaauggggaugggcgugaccuaccucgcauuaaucgcaaccuucaagauacagcccuuucuggcucucggcuuuuuccugagaaaauugacuagccgggaaaacuuacugcugggcgugggccucgcuauggccacgacgcugcaacugcccgaggauaucgagcagauggccaacgggaucgcccucggccugauggcgcugaagcucauaacgcaguucgagaccuaccagcuguggacagcgcugauuagccugaccugcucaaacacgaucuucacccugacaguugccuggcgcaccgccacccugauucucgcgggagugucgcugcucccggucugccaguccucauccaugcggaagaccgauuggcuccccauggccgucgcggccaugggcguuccgccguugccguuauucaucuuugggcucaaggauacgcugaagcgccgcucauggccacuaaaugagggcgucauggccgugggacucgucuccauccuggccucaucccuacuucggaaugacgugcccauggccggucccuugguggccggugggcuguugaucgccugcuacgugaucacgggcacaagugccgaccucacggucgaaaaggccgcagacaucacaugggaggaggaggccgagcagacuggggugucgcauaaccugaugaucaccguugacgaugacgggaccaugcgcaucaaggacgacgagaccgagaacauccucacgguacuccugaagacugcccuccuuauugugagcggcaucuucccguacucgaucccggcuacccugcuaguguggcauacguggcagaagcagacgcagcgcagcgggguccuuugggacgugccgucaccgcccgagacccaaaaggccgagcuggaggagggcguguaucgcaucaagcagcaaggcaucuucggcaaaacccagguuggagugggcguccaaaaggagggcgucuuucauaccauguggcacgugacacgaggugcggugcucacuuacaaugggaaacgccuggagcccaauugggcuagcgucaagaaggaccugauuuccuaugggggcggguggcggcugagcgcccaguggcagaagggcgaagagguccaggugaucgccgucgagcccggcaagaaccccaaaaacuuccagaccaugcccgggaccuuccagacgaccacuggcgagaucggggcaaucgcccuggacuuuaagcccggaaccuccggcuccccaaucauuaaccgcgaagggaaagugguaggccucuacgggaacggcgucgugacgaaaaacggaggcuacgugagcggcaucgcccaaaccaacgcagagccggacggucccacuccagagcuggaggaggagauguucaagaagcggaauuuaacuaucauggaucugcaucccgguuccgggaaaacccgcaaguaccugccggccaucguacgggaagcgaucaagcgccggcucagaacguuaauucuggcccccacccgggugguagcugccgagauggaagaggcgcuuaagggcuugcccaucagauaucagacgaccgcgaccaagagcgagcacaccgggcgggaaauagucgaccucaugugccacgccaccuucacgaugcgccuccuguccccggugagaguuccgaauuacaaucugauuaucauggacgaggcccacuucacggaccccgccaguaucgccgcacgcggcuacaucucaacacgagucggaaugggcgaagccgccgccaucuucaugacugcgacgccucccggaaccgcggacgcuuucccgcagucgaacgcccccauccaggacgaggagcgggacauccccgaaagaucguggaacucggggaaugaauggaucaccgacuucgccggcaagaccgugugguucgugcccuccauuaaagcugggaacgacaucgccaacugccuccgcaaaaauggcaagaaggucauucagcugagcagaaagacuuucgauaccgaguaucagaagacaaagcugaacgacugggacuucguggugaccacugacauuuccgagaugggcgcuaauuucaaggccgaccgaguuaucgacccgcgccgaugccucaagcccgucauccuuacggacgggcccgaacgcgugauccuggccgggccuaugccggucaccgcggcauccgcugcccagcggcgcgggcgcgugggacgcaacccccagaaggagaacgaccaguauauuuucaccgggcagccccuaaacaaugacgaagaucaugcgcacuggaccgaggcgaagauguugcuggacaacaucaacacccccgaggggaucaucccggccuuguucgagcccgaacgggagaaauccgccgccaucgacggcgaguacagacucaagggggaaagccggaagaccuucguggagcugaugcgccggggcgaccuccccguauggcuggcgcauaagguggcguccgagggcauuaaguacaccgacagaaaguggugcuucgauggccagcgcaacaaccaaauucuggaggagaacauggacguagagaucuggaccaaagagggcgaaaagaagaaacuucgcccccgguggcuggaugccagaacguacagcgacccauuggcccucaaagaguucaaggaguucgccgcggggcguaaauccaucacccuggaccugguaaccgagaucggaagaguuccgucucaccuugcccaccgaacgcggaacgcucucgacaaccuggucaugcuucacacgagugaacacgggggcagagccuaccgucacgccguagaggagcuacccgagacaauggagacccugcuccuccucgggcucaugauccugcugaccggcggcgcuaugcuguuccugaucagcgggaaaggcauaggaaagacaagcauaggccugaucugcgugaucgccuccucggggaugcucuggauggccgaaauaccgcuccaguggaucgcuagcgccauuguacuugaguucuucaugauggugcuccugauucccgagccagaaaagcaacgaacgccgcaggacaaccagcucgcguacguggucauaggaauacuuacacuggcggccauuaucgcugccaacgagaugggccugcucgagaccacgaagcgugauuuagggaugucaaaggagcccggcguggugucccccaccucauaccuggacgucgaccuccacccggcgucugcguggacucuguaugccguagcgacgacgguaaucacgcccauguugcgccauacaaucgagaacagcaccgcuaacgucuccuuagccgccaucgccaaccaagcugucguacugaugggguuggacaagggcuggccgaucagcaaaauggaccuaggggucccccuguuggcgcucggcugcuacucccaggugaacccccugacucugaccgccgccgugcuccugcuuaucacccacuaugccauuaucgguccagggcuccaggcaaaagcgacccgugaagcucagaaacguaccgccgccggcaucaugaagaacccgaccgucgacggaaucaugacaauugaucucgaccccguuaucuacgacagcaaguucgagaagcagcugggccaggugaugcuccuggucuuaugugcagugcaacuguuacucaugaggaccuccugggcguugugcgaggcccugacgcuggcaaccggccccauuaccacccucugggaggggagcccugguaaguucuggaacacuaccauugccgugucuauggcaaauaucuuccgcgggagcuaccucgccggcgccggguuagccuucuccaucaugaaguccgucggcaccggcaaacgggggaccggcagccagggggagacccugggagagaaguggaagaagaagcugaaccagcugagcagaaaggacuucgaccucuacaagaaguccgguaucacggaggucgaccgcaccgaagcaaaagagggguugaagcgcggggagaucacccaccacgcggugucccgggguucagccaagcugcagugguucguggagaggaacaugguaaucccggagggacgugugaucgaucucggaugcggccgcggaggaugguccuacuacugcgccggccuaaagaaagucacagaggugcggggcuacacgaagggugggcccggccaugaggagccuguacccaugagcaccuacggguggaacaucguaaagcugauguccgggaaagacguguucuaccuuccgccggagaagugcgacacgcuguuaugcgacauaggcgagagcucgccuucgccaaccguggaagaaaguagaacaauccgcguccugaagaugguagagccuuggcucaagaauaaccaguucugcauuaagguguuaaaccccuacaugcccaccgucaucgagcaccuggagcggcuccagcgcaagcacggugguaugcuaguccggaacccccuuucccgcaacucgacccaugaaauguauuggaucagcaacgggaccggcaacaucguggcauccgucaacauggugucccggcuccugcugaaucgcuucaccaugacccaccggagaccgacgauagagaaagacguagaccucggcgccgggacccggcacgucaacgcggagcccgagacccccaacauggaugucaucggcgagcgcaucaagcggaucaaggaggagcacaacuccaccuggcacuacgacgacgagaacccguacaagacaugggccuaccacggcagcuacgaggugaaggccaccggcuccgcuagcuccaugaucaacggggucgugaagcuacugacgaagcccugggacgugguaccaaugguuacccagauggccaugaccgauaccacgcccuucggccagcagagagucuuuaaggagaaaguggacacucguaccccacgaucaaugccugggacacggcgcgugaugggcaucacggcggaguggcuguggcggacuuuaggacgcaacaagaaaccaaggcugugcacccgcgaagaauuuacgaaaaaggucaggacgaacgccgccaugggggccguguucaccgaggaaaaccaaugggacagcgcgaaggcggccguggaggacgaagacuucuggaagcucgucgaucgggagcgggaguugcacaagcugggaaagugcggauccugcgucuacaauaugauggguaagcgagagaagaagcucggggaguucgggaaagcuaagggaagccgcgccaucugguacauguggcucggcgcgcgguacuuggaguucgaggcccucggcuuccugaacgaggaccacugguuuagcagagaaaacucguacuccggcguagagggcgagggccugcauaagcucggguauauccugagagacaucagcaagauccccggcggagccauguacgccgacgacacugccggcugggauacccgcauuacggaggacgaccugcacaacgaagagaagauaacccagcagauggauccugaacacagacagcucgcaaacgccauuuucaagcugaccuaccagaauaaggucgugaaagugcaacgccccacccccaccgggacggucauggacauaaucuccaggaaagaccaacgcggaagcggccaaguagggaccuacggucugaauaccuucaccaacauggaggcccaacucauucggcaaauggagggggagggcgugcugucaaaggccgaccucgagaacccccaccucccagagaaaaagaucacgcaguggcuggagaccaagggcgucgaacgccugaaacggauggccaucagcggggacgacugcguggugaagcccaucgacgaccguuuugcuaacgcccuccuggcucugaacgacaugggcaagguccggaaggauaucccucaguggcaacccuccaagggguggcacgacuggcagcaggucccuuucugcagccaucacuuccacgagcugaucaugaaggacgguagaaagcugguggugcccugccguccgcaggacgagcugaucgggcgcgcccggauaucccaaggcgccgguuggagucucaaggaaacugcgugccuggggaaggcguacgcgcaaauguggucgcugauguauuuccauaggcgcgaccucagacuggccagcaacgcuauuugcagugccgugcccgugcacuggguccccaccucccgcacuacuuggucgauccacgcccaccaucaguggaugaccaccgaggacaugcugaccguguggaaucggguauggaucgaggauaaccccuggauggaggacaagaccccugucaccacgugggagaacgugcccuaucuaggcaagcgcgaggaccaauggugcggaaguuuaaucggccugaccagccgggccaccugggcacagaacauccccacagcgauccagcaggucaggucccuaaucggcaacgaggaguuccuggacuauaugcccagcaugaagcgauuucgcaaggaggaggagagcgagggcgccaucugguga

SEQ ID NO: 25862 - RNA, 9873 nt, Artificial Sequence
  derived and/or modified CDS sequence (opt11) from DENV-3__JF937634__SS-prME
acgagccucugccucaugaugauccuacccgccgcucuggcguuccaccugacuagcagagacggugagccucggaugauaguggggaaaaacgagcgcggcaagagccuguuauucaagaccgcgucaggcaucaacaugugcacucucaucgccauggaucugggcgaaaugugcgacgauaccguuaccuauaagugcccccauauaaccgaggucgagccagaggauaucgacugcuggugcaaccucaccagcaccugggugaccuacgggacgugcaaccaagccggggagcaucggcgagauaaacgguccguagcucucgcgccccacgugggcauggggcuggacacgcgcacccagaccuggauguccgccgaaggcgccuggcggcaggucgagaaggucgaaacgugggcccuucgccacccuggguucaccauccucgcgcuguuccuggcccacuacaucgggaccucccugacccagaagguggugaucuuuauccugcuaaugcucgugacgcccuccaugacaaugcgcugcgugggagugggcaaccgcgacuucguagaaggccuguccggggcuacuuggguggacguggugcuggagcacggcgggugcgugaccaccauggcaaagaacaaacccacgcucgauaucgagcugcaaaagaccgaggccacccaguuagcgacccugcggaagcugugcaucgagggaaagaucaccaacaucaccaccgacagccgcugccccacgcagggcgaggcgacccugccagaggaacaggaccagaacuacguuugcaagcacaccuacgucgaucgggguuggggcaacggaugcggccucuucgguaagggcucccucguaaccugcgccaaguuccagugccuggagccaaucgaaggcaaggugguccaguaugagaacuuaaaguacacggugaucaucaccguacacaccggggaccagcaccaagucggcaacgaaacgcagggagugacagccgagaucacgccacaggcgaguaccaccgaggccauacugcccgaauaugggacucuggggcucgagugcuccccgaggacgggccuggauuucaacgagaugauccugcucaccaugaagaacaaggcguggaugguccaucgccaaugguucuuugacuugccucuacccuggacgagcggcgccaccacggaaacccccaccuggaaccguaaggaacuccuggucaccuucaagaacgcccacgccaaaaagcaggagguuguuguucuagggucccaggaaggcgcgaugcacacggccuuaaccggugccacagaaauccagaacagcggcgggacuuccaucuucgccggucaccugaagugcagacucaagauggacaagcucgagcugaagggcaugaguuacgccaugugcaccaacaccuucgugcugaagaaggaggucuccgaaacucagcacggcaccauccucaucaagguggaguacaagggcgaggacgugcccugcaagauccccuucagcacagaagacgggcaagguaaggcgcauaacggccgccugaucaccgccaaccccguugugaccaagaaggaagagcccguuaauaucgaggccgagccgcccuucggggagagcaacaucgucaucggaaucggggacaaugcgcugaagaucaacugguacaaaaagggcuccucuaucgggaagauguucgaggcgacugcccggggcgcccgccggauggccauccuaggcgauacggccugggacuuuggguccguuggcggggugcucaacagccuuggcaagaugguccaccagaucuuuggguccgccuacaccgcacuguucagcgguguguccugggugaugaagaucggcauaggggugcucuugaccuggauuggccugaacagcaagaacaccuccaugucuuucucaugcaucgccauaggaauuauaacucucuacuuaggcgcgguagugcaggccgauaugggcugcguaaucaacuggaagggcaaagagcuuaagugcggaagcggaaucuucgugacgaacgaggugcacacguggaccgagcaguacaaguuccaggcggauucccccaagcgacucgccacggccaucgccggcgccugggagaacgggguaugcggcauccggagcaccacccggauggagaaccugcuauggaagcagaucgugaaugagcucaauuacauccugugggagaacaacauaaagcuaaccguugucgugggcgacaucaucggcgugcucgagcaaggaaagcgcacguugaccccccagccgauggagcugaaguacagcuggaagaccugggggaaagccaagaucgucacagcggagacgcagaauagcucguuuaucauugacggccccaacacccccgagugccccucagugucccgggcauggaacguaugggaaguggaggacuacggguucggcguguucaccacgaacaucugguugaaauugcgcgaaguguacacccaacuuugugaccaccgccucaugagcgccgcgguuaaggacgagagggccgugcacgccgacauggguuacuggaucgaaagccagaagaacggcuccuggaagcuggagaaggccagccuuaucgaggugaagacaugcaccuggccgaaaucccacacccucuggagcaacggcguacuggaguccgauaugaucauacccaagagccuggccgggcccaucucccagcacaaccaccggccgggcuaucacacgcagacugcugggcccuggcaccuaggcaagcuggagcuggacuuuaacuacugugagggcaccacaguaguaauaacugagaacuguggaacucgcggccccagcuugcggaccaccaccgucuccggaaagcugauccacgaaugguguugcagaagcugcacccugcccccgcuccgguauaugggcgaggacgggugcugguacggcauggagauccgccccauauccgagaaggaggagaacauggucaagagccuggugucagccgggagcgggaagguagauaacuucaccaugggagugcugugccuggccauccuguuugaggaggugaugcgugggaaguucggcaagaaacacaugauugcagggguguucuucaccuuugugcugcuucuauccgggcagauuaccuggcgcgacauggcccauacucuaaucaugaucggcagcaacgcguccgaucggauggggaugggcgugaccuaccucgcccugaucgccaccuucaagauccagcccuuccuggcacucggguucuuucuucgcaaguugaccucucgggaaaaucuccuguugggggucggucucgcgauggccacgacccuacagcugccggaggacauagagcagauggccaacggaaucgcccucggccugauggccuugaagcucauuacacaguucgagaccuaccaacucuggaccgcgcugaucagccuaaccuguuccaauaccaucuucacuuugacggucgcauggcgcaccgcuacccugauccucgccggggucagucugcuaccugugugccaguccagcuccaugcggaagacugacuggcuuccgauggccguggcggccaugggggucccgccccucccacucuuuaucuucgggcucaaggacacgcugaaacgccguaguuggccgcugaacgagggcgugauggccgugggcuuagucuccauccuggcgucgucccugcugcgaaacgacgugcccauggccggcccucugguggcgggagggcugcugauugccugcuacguuaucacuggcaccagcgccgaccugacaguggagaaggccgccgacauaacaugggaggaagaggcugagcagaccggcgugagccacaaccuaaugaucaccguagaugacgauggcaccaugcgcauaaaggacgacgagaccgagaauauucucacggugcugcuaaaaaccgcccuccugauugugagcggcauuuuuccguauuccaucccagccacccugcucgucuggcacaccuggcagaagcagacucagcggagcgguguucugugggacgugccuucgccacccgagacgcagaaggccgaacuggaggagggcgucuaccgcaucaagcagcaagggauuuucggcaagacacaaguggggguuggcguccagaaagaggggguguuccacacgauguggcaugugacacggggcgcggucuuaacuuacaacgggaaacggcuagagccaaauugggcgucagugaagaaggacuugaucagcuacggggggggguggcggcucagcgcucaguggcagaagggcgaagaggugcaagugauagccguggagcccgggaagaaccccaagaacuuucagacuaugccugggaccuuccaaacgaccaccggcgaaauuggugccaucgcgcuggacuucaaacccggaaccuccggcagccccauuauaaaccgcgaggggaagguaguggggcuguacggcaacgggguggugacgaagaacgggggguacgucucuggaauagcccagaccaacgcagagccggacgggccaacccccgagcucgaagaggagauguucaaaaagcggaaccucacgaucauggaccugcaccccggcagcgggaagacgcgcaaguaucuaccugccauaguucgggaggccaucaagcgccggcucagaaccuugauccucgcgcccacccgaguggucgccgccgagauggaggaggcccucaagggguuaccaauccgguaccagacuacugccaccaaaucagagcauaccggucgggaaaucguagaucugaugugccacgcgaccuucacgaugcgccucuugucccccgugagagucccgaauuacaaccugaucaucauggacgaggcccacuucacagaccccgccucgaucgccgcccgcggcuauaucucuacacgggugggcaugggugaggcggccgccauauucaugacagccacgccgcccggcacagcggacgccuucccgcagagcaacgcgcccauccaggaugaggagcgcgacauccccgagaggucuuggaacagugggaacgaguggaucaccgacuucgccggaaaaaccgugugguucgugcccuccauuaaggccgggaacgacauugcaaauugccuccggaagaacggcaagaaggugauucagcugagccguaagacguucgacacggaauaccaaaagacaaagcugaacgacugggacuucgucgugaccacggauaucuccgaaaugggugccaacuucaaggcggaccgggucaucgauccucgccggugccucaagcccgugauccugaccgacgggcccgagcgcgucauacuggccggcccuaugccggugacugccgcgagcgccgcccagcggcgcgggcgggugggucgcaacccccagaaggagaaugaccaguauaucuucaccgggcagccccucaacaaugacgaggaccacgcccacuggaccgaggccaagaugcugcuggacaacaucaacacgcccgaaggcaucaucccggcccucuuugagcccgagcgggaaaagagcgccgccauugacggcgaguaccgccugaaaggggagucucggaagaccuucgucgagcugaugcgccguggcgaucuacccguguggcuggcucacaagguugcgucugaagggaucaaguacaccgaccgcaaguggugcuucgauggccagcggaauaaccaaauccuggaggagaacauggacguggagaucuggaccaaggaaggcgaaaagaagaagcuccguccacgguggcuagaugcccgcaccuauagcgacccgcuggcccucaaggaauucaaggaauucgcugcuggucgcaaguccaucgcacuggaccucgugaccgaaaucggccggguccccagccaccucgcccauaggacccggaacgcccuggacaacuuagugaugcuccacaccuccgagcaugguggccgugcuuacaggcaugccguagaagagcugccggagacgauggaaaccuugcuccugcuggggcucaugauccugcugaccggcggcgcaaugcuguuccugaucaguggaaagggaauuggaaagacgagcaucgggcugaucugcgugaucgccuccagcgggauguuguggauggccgagaucccgcugcaguggaucgccucagcgauaguacuagaguucuucaugauggucuuacugaucccagagcccgaaaagcaacgcacgccccaggauaaccagcuggccuaugucgugauaggcauccucacgcuggccgccaucauagccgccaacgagaugggguuacucgagaccaccaagcgggaccuggggaugucgaaggagcccgguguggucucccccaccucguaccuggaugucgaccuccaccccgcgagugcuuggacccuguacgcuguggccaccaccgucaucacacccaugcugcgccacaccaucgagaauagcaccgcgaacgugucccucgccgccaucgccaaccaggccgucguccugauggggcuggacaagggcuggccgaucagcaaaauggaccucgggguaccccugcuggcgcucggcugcuacucccaggugaacccucugacgcugaccgcggccguccuccugcugaucacccacuacgccaucaucggaccuggacuccaggcgaaggcgacccgcgaggcucagaagcgaaccgcagccggcaucaugaaaaauccgacgguggacgggaucaugaccaucgaccuggaccccguaaucuacgauagcaaguucgagaagcagcugggccaggucaugcuucuggugcugugcgcuguccagcuccuacugaugaggaccuccugggcgcucugcgaggcccuuacccucgccacgggccccaucaccaccuugugggaggggucacccggcaaguucuggaacaccacgaucgcugucuccauggcgaacaucuuucgcgggagcuaccuggccggagccgggcuggccuucuccaucaugaaguccguaggcaccggcaagcgagggaccggcucgcagggggaaacccucggcgagaaguggaagaaaaagcugaaccaacugagcagaaaagacuucgaccucuauaagaaguccgggaucaccgagguugaucggaccgaagccaaggagggucugaagagaggcgagaucacgcaccaugcggucucccgggggagcgccaagcugcagugguucguggaacgcaacauggugauucccgagggccggguaaucgaccucggauguggacgcgggggcugguccuacuauugugcuggccugaagaaagugaccgaagugcgagguuacacgaagggcgggcccgggcacgaggagcccguccccaugucgacguacggguggaacaucguaaaacugauguccggaaaggacguguucuaucucccgcccgagaagugcgacaccuugcugugcgauaucggcgaaagcucccccagccccacgguggaagaaucccgcaccauccgugugcuuaagaugguggagccguggcugaaaaacaaccaguucugcaucaaggugcugaacccuuauaugcccacgguuaucgagcaccuagagcggcugcagcgcaagcacgggggcaugcuggugcggaacccccucagccgcaacuccacccacgagauguacuggaucagcaacgggaccggcaacaucgucgccuccgugaacaugguaagucgcuugcugcugaaccguuuuacuaugacucaccggcggccuaccauagagaaagauguugaccucggcgccgggacccggcacgugaacgcugagccggagacacccaacauggaggugaucggcgaacgcauaaagagaaucaaggaagagcacaacucuacauggcacuaugaugacgagaacccguacaaaaccugggccuaccacgggagcuaugagguaaaggccaccggaucugcuagcaguaugauuaacgggguggucaaguuacucaccaagccaugggacguagugcccauggucacgcagauggccaugacagacaccacaccauucggccagcagcgcguguucaaggagaaagucgacaccagaaccccgcgcagcaugccaggcacgagacgggucauggggaucaccgcugaguggcucuggcgcacgcugggccguaacaagaagcccagauuaugcacccgcgaggaguucaccaagaagguccgcacgaacgccgccaugggggccguguucacggaagagaaucagugggacucggcgaaggccgccguugaggacgaggauuucuggaagcucguagauagagagcgcgagcugcacaaacucggcaaguguggguccugcguguacaacaugaugggaaaacgggagaagaagcucggcgaguucgggaaagccaagggcucucgcgccaucugguacauguggcugggggcccguuaccuggaguuugaggcacucgguuuccuuaacgaggaccacugguucucucgugagaacagcuacuccggggucgagggcgagggucugcacaagcucggguacauccugcgggacauaucgaagauucccggcggggccauguacgccgaugacaccgccggcugggacaccagaaucacggaagacgacuugcauaacgaggagaagaucacacaacagauggacccggaacaccggcaacuagcggacgccauauucaaguuaaccuaccagaauaagguggugaagguccagcgcccgacuccaacgggcacgguaauggacaucauaucucggaaggaucaacgcgggagcggccagguggguacguacggucuuaacacauucaccaacauggaggcccagcucauccggcaaauggagggggaagguguguuaucaaaagccgaccuggagaacccccaccugccggagaagaagaucacgcaguggcuggagacgaaggggguggagagacugaagcguauggccauuagcggagacgauugcguaguuaagccaaucgacgacagguuugcgaacgcucuacuggcacuaaaugacaugggcaaggugcggaaggacauaccccaguggcagcccuccaagggguggcaugauuggcagcaggucccauucugcagccaccacuuccaugagcucaucaugaaggacggccggaagcuggucgugccgugccggccccaggacgagcucaucgggcgugcucggaucucgcagggcgcggguuggucgcucaaggagaccgcgugcuuagggaaggcuuacgcccaaauguggagccugauguacuuccaccgccgcgaccuccggcuagccagcaacgcgauuugcucugccgugccaguccacugggugccuaccucucgcaccacguggucgauucacgcccaccaccaguggaugaccaccgaagacaugcugaccguguggaaccgggucuggaucgaggacaacccuuggauggaggacaagacgcccgugaccaccugggagaaugugccguaccugggcaagagagaggaccaguggugcggaagccugaucggccugaccagccgggcaaccugggcccaaaacaucccgacggcgauccagcaggucaggucccucaucggaaacgaagaguucuuagauuauaugcccuccaugaagcgguucagaaaggaggaggagucagagggggccaucugguga

SEQ ID NO: 25863 - RNA, 9873 nt, Artificial Sequence
  derived and/or modified CDS sequence (opt11) from DENV-3__JF937636__SS-prME
accagucugugucucaugaugauccugcccgcagcccucgcguuccaccuaaccuccagggacggcgaaccccgaaugaucgucgggaagaaugaacggggcaagagccugcuguucaagaccgccuccgggaucaacaugugcacacucaucgccauggacuugggggagaugugcgacgacacagugaccuacaaaugcccccacaucaccgagguagagcccgaggauauugacuguuggugcaaccugaccagcaccugggucacuuacgggacgugcaaucaggccggcgagcaccggcgcgacaaacguuccguagcccuggcuccccacgucgguaugggucuggacacccguacucagacauggaugucagccgagggcgccuggaggcagguugaaaaggucgagacgugggcccugaggcacccgggguucaccauucucgcgcuguuccuggcacacuacauuggaaccucccuuacccaaaagguggugaucuucauucugcugaugcucgucacgccgagcaugaccaugcggugcguggggguugguaaccgugacuucgucgagggccuauccggggcaaccugggucgacgugguccuggagcacggcgggugcgugacaacgauggccaaaaacaaaccaacccucgauaucgagcugcagaagaccgaggcgacccagcuagcgacgcuccggaagcugugcaucgagggcaaaaucacaaacaucaccaccgacagccgcugccccacgcagggcgaggccaccuugcccgaggagcaggaccagaacuacgugugcaaacacacuuauguugaucggggguggggcaacgggugcggccucuucgguaagggcucccuggugaccugcgccaaauuucagugccuggagcccauagagggcaaagugguccaguacgagaaucucaaguauacggugaucaucacagugcacacuggagaccagcaccaaguuggcaacgaaacccaaggggugacggcagagaucacgccccaagccagcaccaccgaggcaauacugccugaguauggcacacugggucucgagugcuccccgcgaaccggccuggacuuuaacgagaugauccugcucacaaugaagaacaaggccuggaugguccaccggcagugguucuuugacuuaccccugccuuggaccagcggcgccaccacggaaacccccaccuggaaccgcaaggagcuccuggugacuuucaaaaacgcgcaugccaagaagcaggaagucguugugcuggguucccaggagggcgcgaugcacacggcccucaccggagccaccgagauccagaacagcggugggaccuccaucuucgccggccaccugaaaugccggcugaagauggacaagcuagagcugaaagguaugucuuacgccaugugcacgaacaccuucgugcugaagaaggaggucuccgagacccagcacgggacuauccucaucaagguggaguauaagggcgaagacgugccaugcaagauccccuucagcacggaagacggacagggcaaggcgcacaacggccgccugauaaccgcgaacccugucgugacgaagaaggaagaacccgucaacaucgaggccgagccgcccuucggcgagagcaauaucgucaucgguaucggcgauaacgcccugaagaucaacugguacaagaagggguccucuauugggaagauguucgaggcgaccgcccggggcgcccgacggauggccauccugggcgacacggcaugggacuuuggguccgucggcggagugcucaacagccuugggaagaugguccaccagaucuucggguccgcguacaccgcccucuuuagcggcguguccugggugaugaaaaucggcaucgggguucucuugacuuggaucggccugaauagcaagaacacauccaugagcuucuccugcauugccaucggaaucaucacccucuaccugggcgccguggugcaggccgacauggggugcgucaucaacuggaaaggcaaggagcugaagugcggcagcgggauuuucgugaccaacgaggugcacaccuggaccgaacaguauaaauuccaggcggacucccccaagcgccucgccacagccaucgccggcgcuugggaaaacggggucugcggcaucagaagcaccacuagaauggaaaaccugcuguggaagcagauagcgaaugaacucaacuacauccucugggaaaauaacaucaaacugaccgugguggugggggacaucaucggcgugcucgaacaagguaagagaacacugacgccccaaccgauggagcuuaaguacuccuggaagaccugggggaaggccaagaucguaaccgccgagacgcagaacagcuccuucaucauagaugggcccaacacccccgaguguccuuccgucucccgcgccuggaacgugugggagguggaggacuacggguuugguguauucaccacgaacaucuggcucaagcugcgcgagguguauacgcaauuaugcgaucaccggcucaugagcgcggcugugaaggacgagcgcgcgguucacgcggauaugggcuacuggaucgagagccagaagaauggguccuggaaacuggaaaaggcuucacugaucgagguaaagaccugcacguggccgaagucccacacccucuggagcaacggcgugcuagaguccgacaugaucauucccaagucucuugcggggcccaucucccagcacaaccaccggccgggcuaccacacccagacggcagggccauggcaucucggaaagcuggaacuggacuucaacuauugcgagggcacgaccgucguaauaaccgagaacugcgggacgcgcggccccagccuccguaccaccaccguguccgggaaacuuauacacgaauggugcugccgcagcugcacgcugccgccgcuccgguacaugggcgaggacgggugcugguacggcauggaaauccgccccaucagugagaaggaggaaaacauggucaagagccuuguguccgccggcagcgggaagguggauaauuucaccaugggcauccugugccucgccaucuuauucgaggaggucaugcgcggaaaguucggcaagaaacacaugaucgccgggguguuuuucacauucguacugcuccugucaggacagaucacguggcgcgacauggcgcacacgcugauaaugaucggcucaaacgccuccgaucggauggggauggggguuaccuaccucgcacugaucgcgaccuuuaagauccagcccuuucuggcccucggauucuuccugcggaagcugacaagcagagagaaccuccugcucggugugggccucgccauggccacuacccugcaguugccugaggacauagagcagauggccaacgggaucgcccucggccugauggcucugaagcucaucacccaguucgagaccuaccaguuauggacggcccugaucagcuugaccugcuccaauaccauauucaccuugacgguggcauggcguaccgccacccugauccucgcaggagucagccugcugccgguaugccagucuagcuccaugcgcaagaccgacuggcucccgauggcggucgccgccaugggcgugccaccccucccgcuguucaucuucagccucaaggacacgcugaagcgccgcuccuggccucugaacgagggggugauggccgucggccugguuagcaucuuagccuccagcuuacuccgaaacgacgugcccauggcgggaccucucgucgccgggggccugcuaaucgccuguuaugugaucaccgggacgagugccgaccugaccguggagaaggcugcggacaucacgugggaggaggaggccgagcagacaggcgucagccacaaccugaugaucacuguggacgaugacgggaccaugcgcaucaaggacgacgagacagagaacauucucacgguacugcuaaagaccgcccuauuaaucgucuccggcauauucccguacagcauccccgccacccugcucguguggcacaccuggcaaaagcaaacucaaaggucaggcguucugugggacgugcccagucccccggagacccagaaggcagagcucgaggaggggguguaucgcaucaagcaacagggcaucuucgguaagacucaggugggugugggggugcaaaaggagggcguguuccacaccauguggcacgucacgcggggagccgugcucacauacaacgggaagcgccuggagcccaacugggccagcgugaagaaagaucugaucagcuacggcggggguuggcggcucucugcccaguggcagaagggugaagagguacaggugauugccguagagcccggcaagaaccccaaaaacuuccagaccaugcccggcaccuuucagacgaccaccggagagauuggggcgaucgcgcuugacuucaagcccgggacgucgggaagccccauaaucaaucgagaggggaaggucguggggcuauauggcaacggggugguuacgaagaacggggguuacgugagcggcaucgcucagaccaacgcggagcccgacgggcccacacccgagcuagaggaggagauguucaagaagcguaaccucacaauaauggaccugcaccccggaucgggcaagacgagaaaauaucugccggccaucgugcgggaggccauccgucggcgacuucgcacacuaauccuggccccuacccgcgucguugcugcagaaauggaggaagcccucaagggucugcccauccgguaucagaccacugccaccaaguccgagcauaccggccgcgagauaguggacuugaugugucacgccaccuucacgaugcggcuauuaagcccaguccgcgucccuaauuauaaccugaucaucauggacgaggcucacuuuaccgauccugccuccaucgccgcgcggggguacauaucaacccgcgucggcaugggcgaagccgcggccauuuuuaugaccgcgacgccgcccgggaccgccgacgcguucccucaguccaacgccccuauccaggacgaggagcgcgacauacccgagcggagcuggaacucuggcaacgaguggaucaccgacuucgccgggaagacggucugguucgugcccagcaucaaagcgggcaacgacaucgccaacugccucaggaagaaugggaagaaggugauccagcugucccggaagacguucgacaccgaguaccagaagacaaagcugaacgacugggacuucgucgugaccacggacauuagcgagaugggcgccaacuucaaggccgaccgcgugaucgacccccggagaugccucaagcccgucauacugaccgacggccccgagcgggucauccuggccgggccuaugccggugaccgcggcguccgccgcucagcgccggggccgcgucgggcggaacccccaaaaggagaacgaucaguacauauucaccggucagcccuuaaacaacgacgaggaccacgcccacuggacggaggccaaaaugcugcuggacaacaucaacacucccgagggaaucaucccggcacuguucgagcccgagcgcgagaagucugcugccauugauggcgaguaccguuugaagggcgaaucgcgaaaaacguucguggagcugaugagacgcggggaccuccccgucuggcucgcgcacaaggucgcuagcgaagggaucaaauacacggaccgcaaauggugcuucgacgggcagagaaacaaccagaucuuagaggagaacauggacguggaaauauggacaaaggagggugagaagaagaaguuaaggccacgcuggcuggaugcccgcacauacuccgacccgcuggcauuaaaggaguucaaggaguucgccgcggggcgcaagagcaucgcccucgacuuggucaccgaaaucggucgcgugcccucacacuuagcccaccggacccguaacgcccuggacaaccucguuaugcuccauacgucggagcacggcgggcgcgccuaccgacacgcgguagaggaacuccccgagacgauggagacccugcuauugcugggacucaugauacuacugacgggcggcgcgaugcuguuucugauuagcgggaaggggaucggcaagaccagcauaggccugaucugcguuaucgccagcucgggcaugcucuggauggcggagauuccgcugcaauggaucgccagcgccaucgugcucgaguucuuuaugaugguccuccugauucccgagcccgagaagcagcggacgccccaggacaaccagcuggccuacguagugaucgggauacucacccuugccgccaucaucgcugcgaaugagauggggcugcucgagaccaccaagcgcgaccugggcauguccaaggagccgggcgucgugucuccaacguccuacuuggauguggaccuccauccagccagcgccuggacgcuguacgcugucgcgacgaccgucaucacgcccaugcugcggcacacgaucgagaacuccaccgccaaugugagcuuagccgccaucgccaaccaggcagugguucugaugggucuggacaagggguggccgaucuccaagauggaccucggcguaccccugcuggcacucggaugcuacagccaggucaacccgcugacccugacggcugcugugcugcuguuaaucacccacuacgccaucaucgggcccggccuccaggccaaggccacacgcgaggcccagaagcggacugccgccggaauaaugaagaacccuacgguggacgggaucaugaccaucgaccuggaccccguaaucuaugacuccaaguucgagaaacagcugggucaggugaugcuccuggugcugugugcgguccagcuccuccugaugcgcacuagcugggcgcucugugaggccuugacccuggccacuggucccaucaccacccucugggaaggcucgcccgggaaguuuuggaacaccacgaucgcgguuagcauggccaauaucuuucggggcuccuaucuggccggagcgggccuggccuuuucuaucaugaagucaguagggacgggcaagcgcgggaccgggagccagggugagacucugggggagaaauggaagaagaagcugaaccagcugagccggaaggauuucgaucucuacaagaaguccggcauaaccgaagucgaccggacugaagccaaggagggacuuaagaggggcgagauaacccaccacgccgugagcagaggcuccgcuaagcugcaaugguucguggaacggaacauggucaucccugagggccgcgugaucgaccucggcugcggucgcggaggguggagcuacuacugcgccggccugaagaaggugaccgagguacgcggcuacaccaagggcgguccggggcacgaggagcccgugcccauguccacguauggcuggaacaucgugaagcugaugucagggaaggacgucuucuaccucccgcccgagaagugcgacacccuacugugcgacaucggcgaguccucucccucccccacgguugaggagucccgcaccauaagggugcugaagauggucgagccguggcucaaaaacaaccaguucuguauaaaggugcugaaccccuacaugcccacgguaaucgagcaccuagagaggcuucagcggaaacacggcgggaugcuaguaaggaacccccuuucccggaauagcacccacgaaauguacuggaucuccaacggcaccgggaauaucguggcuagcguuaauauggucucccggcuccugcugaaccgguucaccaugacgcaccgccggccgaccaucgagaaggauguggaccucggcgcgggcacacgccacgugaaugcggagccagagacucccaacauggacguaaucggggaacggaucaaacgcaucaaagaggagcacaacaguacguggcacuacgacgacgagaacccguauaagacgugggccuaccaugguuccuacgaggugaaggccaccgggucggccagcagcaugaucaacggcguggucaagcugcugaccaagcccugggacguugucccgauggugacgcaaauggcgaugaccgacaccacccccuucgggcagcagcguguguucaaggagaaggucgauacacgaacucccagaagcaugcccggcacccggcgggucaugggcauaaccgccgaauggcuguggcgcacacuggggcggaacaagaagccccgccugugcacacgcgaggaauuuacuaagaagguucggaccaacgccgccaugggcgccguguuuacggaggagaaccaaugggacuccgccaaggccgccguugaagacgaggacuucuggaagcucguggaccgggagagggaacuacacaaacuugguaagugcggaagcugcguauacaacaugauggguaagcgcgaaaagaaacucggcgaguucggcaaggcgaaggggucccgugcgauaugguacauguggcuuggcgcccgcuaccuggaguuugaggcccuggguuuccugaacgaggaucacugguucagccgggagaacuccuacagcggcguggagggggagggacuucacaaacucggcuacauccuacgagacaucuccaagauccccggcggcgcaauguacgccgacgacacggcggggugggacacacggaucaccgaggaugaccuucacaacgaggagaaaaucacacagcagauggauccagagcaccgacagcuggccaaugcgaucuucaagcugaccuaccaaaacaagguggucaaagugcagagacccacccccacagguaccgugauggauaucaucagccguaaagaccagcggggauccggucaagucgggacguacggacugaacacuuucacaaacauggaggcccagcucauccgccagauggagggcgagggggugcugagcaaggccgacuuagagaacccgcaccucccggagaagaaaauuacgcagugguuggagacgaagggcguugagcggcuaaagcgcauggccaucuccggggacgacugcgucguuaagcccaucgacgaccgcuucgccaacgcccuccuagcucugaacgacaugggcaaggugcgcaaggacaucccccaauggcaaccgagcaaggguuggcacgacuggcagcaggucccuuucugcagucaccacuuucacgagcucaucaugaaggacgggcggaagcugguggugccuugccgcccgcaggaugaacuuauuggcagggcccgcaucagccagggggcgggcuggucccucaaggagacggcgugccuggguaaggccuacgcccaaauguggucgcugauguacuuucaucgccgggaccuccgcuuagcguccaacgccaucugcagcgccgucccagugcacuggguuccgacgagccggaccacguggagcauucacgcacaccaccaguggaugacaaccgaggauaugcugacagucuggaacaggguguggauagaggacaauccuuggauggaggacaagacucccgugaccaccugggaaaacgucccguaccucgggaagcgggaggaccaguggugcggcucguugaucgggcugaccucccgagccacaugggcacagaacauuccgaccgccauucagcagguacggucacucaucggaaacgaggaguuccuugacuauaugcccuccaugaagagguucagaaaggaggaggagucugagggggccauaugguaa

SEQ ID NO: 25864 - RNA, 9873 nt, Artificial Sequence
  derived and/or modified CDS sequence (opt11) from DENV-3__JF937626__SS-prME
accagccugugccugaugaugauccucccagcugcacuugcauuccauuuaacaucacgcgacggugaaccaaggaugaucguagggaaaaacgaacgagggaaaagucuacuauucaaaaccgccagcgggaucaacaugugcacccucauagcgauggaccuuggcgaaaugugcgaugacacaguaacauacaaaugcccacacaucacagaaguggaaccggaagacauugauugcuggugcaacuugaccagcacauggguuacauacggcacgugcaaccaagccggggaacaccgccgggacaaacgcucgguggcguuggcgccgcacgucggcaugggccucgacacccgcacccagacauggaugucagcggaaggggccuggcgccagguggagaaaguugagacaugggcacuccgccauccgggauucacaauacuagcauuguuuuuggcccacuacaucggcaccagucuaacacagaaagucguaauauuuauccuccuaaugcuuguaacaccaagcaugacaaugcgaugcguaggcguaggcaacagagacuucguugaaggucucucuggagcaaccuggguagacguaguccuugagcacggaggauguguuacgacaauggcuaagaauaaacccacgcucgacaucgaacugcagaaaacggaggcgacgcaacucgccacgcuccgaaaauuaugcaucgagggaaaaauaaccaacaucacaacggacucacggugcccaacacagggcgaggcuacccucccggaggagcaagaccaaaauuaugucugcaaacacacauacguggaccgaggguggggaaacggcugcggcuuauucggcaaaggcucucuagugacgugcgcaaaauuccaaugucuggagccaauagagggaaagguaguccaguacgaaaaccuuaaguacacaguaauaauuaccguacauacaggagaccaacaccaaguugguaacgaaacucagggaguaacagcggagaucacuccacaagcgagcacaacggaagcaauacuccccgaguacggaacgcuggggcuagaauguucgcccaggacgggcuuagacuucaacgaaaugauccuacugacgaugaagaacaaagcguggaugguacaccgacagugguucuucgaccugccacugccauggacgucaggugcaacuacggagacaccgaccuggaaccgaaaagaacugcucgugaccuucaagaaugcgcacgcgaaaaagcaagaagucguaguccuagguucgcaggaaggagccaugcauacagcccuaacgggggcuacggagauucaaaacagcgggggcaccagcauauuugcgggucaccucaagugccgacuaaagauggacaaauuggagcuaaagggaaugucguaugcaauguguacuaacaccuucgugcuaaagaaagaagucucagaaacacagcacggcaccauucuaauaaagguagaguacaaaggcgaagacgugcccuguaaaauaccguuuuccacggaagacgggcagggcaaggcccacaacggaagacuaauaaccgcuaaucccgucgugacgaagaaagaggagccgguaaacauagaggcugagccaccuuucggcgagucuaacaucgucauugggaucggagauaaugcucugaaaauaaacugguacaagaaagggaguagcauaggcaaaauguucgaggcaaccgcaaggggcgcgcggcgcauggcuauccugggugacacggcaugggacuucggcagcgugggaggcguccuuaauucacuggggaagaugguacaccagaucuucggcuccgccuauacggcccucuucagcggugucuccugggucaugaaaauugguauuggaguguuacugacauggaucggcuuaaauuccaagaacaccucuauguccuuuuccugcaucgcgaucggaaucauaacucuguaccucggcgcagucguccaggccgacaugggcugcgucauuaacuggaaaggcaaggaguugaaauguggaucaggaauauucgugaccaacgagguccacaccuggaccgagcaguauaaguuccaagcagacagccccaaacggcuggcaaccgccauagcuggagccugggaaaauggugucugcggcauucgcaguacaacucgcauggaaaaccucuuauggaaacaaaucgccaaugagcucaacuauauacuaugggagaauaacaucaaauugacgguuguuguaggugacaucauagguguacucgagcaaggaaaaaggacacucacgccccagccaauggagcucaaguacuccuggaagacauggggcaaagccaagauuguaacugcagaaacacagaacagcucguucauaauagacggcccaaauacuccggaaugccccuccgugucaagagccuggaacguaugggaagucgaagacuacggcuucggugucuucacgacgaacauuuggcugaaacuaagagagguuuacacacagcugugcgaccauagacugaugagcgcggccguaaaagacgagcgcgcaguccacgccgacaugggcuacuggauugaaagccagaaaaaugguucauggaaacucgaaaaggcaucucucaucgagguaaaaacauguacauggccgaaaucacacacucuauggagcaacggugugcucgaauccgacaugaucauaccaaagagcuuagccggccccaucagucaacacaaucacagacccggauaccacacgcaaaccgcaggaccguggcaucuagggaagcuggagcuugacuucaacuacugugaaggcaccacuguagucaucaccgaaaacugugggacccgugggccaagucuccguaccaccacgguuuccggaaaguugauccaugaauggugcugccgaucguguacguuacccccacugagguauaugggcgaagacggaugcugguacggaauggagauccgacccaucagcgaaaaagaagaaaauauggugaaaucucucgugucagccgggaguggaaaagucgauaauuuuaccaugggaguccuuugccuugcgauccuauuugaagaaguuaugcgaggcaaauucgggaagaaacauaugaucgccggcguguucuuuacauucguacuacuccugucuggacaaauuacauggagagauauggcgcacacgcuaaucaugaucggcagcaacgcgagcgaccgcauggggaugggggugacguaucuggcgcuaaucgccacauucaaaauucagcccuuccuagcguuaggauucuuccuacgaaaacuuacaucacgagaaaacuuacuacuaggcguaggacuagcaauggcaacuacacugcagcugcccgaagacaucgaacagauggccaacgguauagcucugggccugauggcacuaaaauuaauaacccaauucgaaaccuaccaacuuuggacggcgcugauaagccuaaccugcaguaauacuauauuuacgcugacaguagcauggcgcaccgcaacccuuauccuggcuggagugagccucuuaccuguaugccagagcucauccaugcgaaagacagacuggcuaccaauggccgucgccgccaugggcguaccgccgcucccccuauucauuuucgggcuaaaagacacguugaaacgcagaaguuggccacugaaugaaggcguuauggccgucggccuaguauccaucuuagcaaguucucugcugcggaaugacguucccauggccggacccuuagucgccggcggacuccucaucgcgugcuacguaauaacaggaaccucugccgaccugaccguagagaaggcggccgacaugacgugggaagaagaggccgaacagacaggugugagucauaaucucaugaucacaguagacgaugaugggaccaugaggaucaaagaugacgagacugagaacauccugacaguauuauuaaagaccgcacuacucaucgucagcggcaucuucccauacuccaucccagcaacguuacugguauggcacacguggcaaaaacaaacgcaacgaagcgggguccucugggacguaccgaguccaccagaaacgcaaaaagccgagcucgaggaaggcguauaccguauaaagcagcagggaauauuuggaaagacccaaguaggaguagguguacaaaaggaaggcgucuuccacaccauguggcacgugacgcgaggagcagugcucacauacaacggcaaacggcucgaacccaauugggcaagcguuaagaaagaccuaauuagcuacggaggaggcuggagacuuagugcccaauggcaaaaaggggaggagguacaagucaucgcagucgagcccggcaaaaaccccaaaaacuuucagacaaugccuggcacauuucagaccacgaccggagaaaucggagccauagcauuagacuucaaaccggguacaaguggaucucccaucaucaacagagaggguaaaguaguuggucuguacgggaauggcgucgugaccaaaaacggcggcuacgugagcggcauugcgcaaacgaacgcagaaccugauggccccacgccggagcucgaagaagaaauguucaagaaacgaaacuugaccaucauggaccuccacccaggcaguggaaagacacgcaaguaccuccccgcuauagugcgcgaggccauaaaaaggcgccuccgcacuuugauacuggcucccacaagaguuguagcggccgagauggaggaagcucugaaaggacuaccgauccgauaccagaccaccgccacuaaauccgaacauaccgggagggagaucgucgaccugaugugucacgccaccuuuacaaugcgccugcucucuccgguuagagugccgaacuacaaccuuaucauaauggacgaagcccacuuuaccgauccggcaagcauagcagcuagaggauacauuucaacgcggguugguaugggcgaggcggcggcaaucuucaugacggcaacaccgccggguaccgcagacgccuucccacaaagcaacgcgccuauucaggacgaagagagggauauacccgaacgaucguggaauagcggaaaugaauggaucacagacuucgcgggcaaaaccguaugguucguaccuuccauaaaagccggcaacgacauagccaacugccucagaaagaacggcaagaaaguuauccagcuaucacgaaaaaccuuugauacagaauaccagaagacaaagcuaaacgauugggauuucguaguuaccacugacaucagcgagaugggugccaacuucaaagcggaccggguaaucgacccccgccgcugccugaaacccgugauccucacggacggaccagaaagaguaauauuggccgguccaaugccaguaaccgccgcuucugcugcacaacgccgaggacgcgucggccgaaacccucagaaggaaaacgaucaauacauauucaccggacagccacucaauaacgacgaagaccacgcgcacuggacagaggcgaaaaugcuccucgacaauauaaauacaccagaggguauaauccccgcguuauucgaaccagagcgggagaaaagugccgccauagacggcgaguacagacucaaaggggaauccagaaaaaccuuuguagaguuaaugcgaagaggagaccucccagucugguuagcccacaaaguggcaucagagggcaucaaauacaccgacagaaaauggugcuucgauggucagcgcaacaaccagauccucgaggaaaacauggacguagaaauauggaccaaggaaggugagaagaaaaagcuacgccccagguggcuugacgcucgcaccuacagugacccccuagcauugaaagaguucaaagaguuugcagcgggccggaaaagcauagcauuagaucucguaaccgagauaggccgagugccaagccaccuagcacaucgaacacggaacgcacuggauaacuuggucaugcuccauaccagcgagcacggagggcgagccuacagacaugcgguagaggaacuaccggagaccauggagacgcugcucuuacucggacucaugauccuacuaacaggaggagcaauguuguuccucauuagcgggaaaggaauagguaaaaccagcaucggauugaucugugugaucgcgucaucagggaugcuauggauggccgaaaucccacuucaauggaucgccagcgcaauaguacuggaguuuuucaugaugguccuccugauaccggaaccagaaaagcaacggacaccccaggauaaccagcucgcauacgugguuauaggcauccuuacacucgcggccaucaucgcagccaacgaaaugggacugcuagaaacgacuaaacgagaucuggguauguccaaggaaccugggguaguuucgcccacgucguaccuugacgucgaccuccacccugccagcgcuuggacccuuuacgcgguggcgacuacggucaucaccccaaugcuacgccauaccaucgagaacucuacugcgaauguaucucuggcggcuaucgcgaaucaggccguugugcuaaugggacucgauaagggauggccgauuuccaaaauggaucuaggagugccuuugcucgcgcuggguugcuacucacaagucaacccccuaacucuaacggccgccgugcuuuuacuaauaacgcacuacgcaauuaucggacccgggcuacaagccaaagcgacaagagaggcccaaaagcgcacggccgccgggaucaugaagaaccccaccguagacggaauuaugaccauagaucuagaucccguaauauaugacagcaaguucgaaaagcagcucgggcaaguuaugcucuuaguccuaugcgcaguacaacuacugcuaaugcgaaccucaugggcccucugcgaggcccuuacucuugcaacugggccgauaacaacgcuaugggaaggaagucccggcaaauuuuggaacaccaccauagcaguguccauggccaauaucuucaggggaucuuaccucgccggggcgggacuagccuucagcauaaugaaaagcguuggaacggguaaacguggaacaggcucacaaggcgaaacacucggagagaaauggaagaagaaacuaaaucagcuaagccggaaagacuuugaucuuuacaagaaaagcggaauaaccgaagucgacagaacagaggcgaaagagggccuuaaacgaggcgaaaucacgcaucacgcuguuagccggggaucagcaaaacuucagugguucgucgaacggaacauggucguccccgaagggcgcgugauagaccugggaugcggcagaggaggguggagcuacuauugcgccggacucaagaaagucaccgaaguccgcggcuauacaaaaggcgggccaggucaugaagaaccggucccgaugagcaccuacggauggaacauaguuaaacuuauguccggcaaggacgucuucuaccuaccgcccgaaaaaugugauacacuuuuaugcgacaucggggaaaguagcccaagcccgaccguggaagagagucgaaccauacgcguccuaaaaaugguugagccauggcuaaagaacaaucaauucugcauaaaaguccuaaaccccuacaugccaaccguuauagagcaccuagaacgauuacagcgaaagcacggcggaauguuaguacggaacccccuaucuaggaauagcacacaugagauguauuggauuucaaacgggaccgggaacauuguugccucgguaaauauggucuccagauugcuacuuaacagauuuaccaugacccaccggcgacccaccaucgagaaggacgucgauuuaggagcaggcacccgucacgucaacgcagaaccggaaaccccaaauauggacgucauuggcgaacguauuaaacggaucaaggaggagcacaacucaacguggcauuacgaugacgaaaaccccuacaagacaugggcguaccacggcaguuacgaagugaaagcgaccgguagugcgucgagcaugauaaauggaguggucaaacuucuaacaaagcccugggacguaguccccauggucacgcaaauggcuaugacggacaccaccccguucggacagcagcgagucuuuaaggagaagguagacacgaggacuccaagaaguaugccagggacacgacgagucaugggcaucacagcagaauggcucuggaggacgcugggccgcaacaaaaagccaagacucuguacaagggaagaauuuacaaagaaaguaaggacaaaugcggcuaugggagccgucuucacggaggaaaaccaaugggacagcgcgaaagcagccguugaggaugaggacuucuggaagcucguggaccgcgaacgagagcuacacaaacugggaaaaugcgguagcuguguuuauaacaugaugggaaagcgcgagaagaaacuuggagaguucgggaaggcaaaaggaucacgggcaauaugguacaugugguuaggagcccgcuaccuggaguucgaggcccucgguuucuuaaacgaagaucacugguucucccgggaaaacucuuauucgggaguagaaggggagggacuccacaaacucggauacaucuugagggauauuagcaagaucccaggcggagccauguacgcugacgacaccgcgggaugggacacccguaucaccgaagaugacuugcauaacgaggagaaaauaacgcaacaaauggaccccgagcaccgucagcucgcgaacgcuauauuuaagcuaaccuaccaaaauaaagucguaaaggugcaaaggccaacacccacggguacggucauggacauaauaagccggaaggaccaacggggaucaggccaaguaggcacauacggcuugaauacauucaccaacauggaggcccaacuaauucggcagauggaaggggagggcguccucagcaaagccgaccuugaaaauccacaccuaccagagaagaaaauuacccaguggcuggagacgaaaggaguugaaaggcuuaagcgaauggccauaagcggggacgacugugucgugaagccgaucgacgacagauucgcgaaugcacuacucgcacugaacgauauggggaagguacggaaggauauaccccaguggcaaccuucgaagggcuggcaugacuggcaacaggucccguucugcucucaccacuuccacgagcucauuaugaaggacgggaggaaacucguaguaccaugccgcccccaagaugaacuaauagggcgagcacgcaucagccagggagccggguggucguuaaaagagacugcgugccuagggaaggcguacgcccaaauguggucucugauguacuuccaccgacgagaccuaagacuugccaguaaugccauaugcucggcugucccaguacacuggguacccacgucacgaacaacauggaguauucacgcacaucaccaguggaugacaacggaagacaugcuuaccgucuggaaccgaguauggaucgaggauaaccccuggauggaagacaaaacucccgucacaacgugggagaacguacccuauuuaggaaaacgcgaagaccaguggugcgguucccugaucggccucacaagccgcgcgacaugggcccaaaacauaccaaccgcaauccagcagguacggagcuuaauaggcaacgaggaauuucuagauuacaugccgucuaugaagcgguuucgaaaagaagaagagucggagggagccaucugguaa

SEQ ID NO: 25865 - RNA, 9873 nt, Artificial Sequence
  derived and/or modified CDS sequence (opt11) from DENV-3__JF937621__SS-prME
acaaguuuaugccuuaugaugauccugccggccgcccuggcuuuccaucucaccagcagagacggugagccccggaugaucguggggaagaacgagagaggcaagagccugcuguucaagacagcaucaggaaucaacaugugcacacucaucgccauggaucugggcgagaugugcgacgauaccguuacauacaaaugcccccacaucaccgagguggagcccgaggacaucgacugcuggugcaaccugaccagcacuugggugacauacgggacgugcaaccaggccggcgaacaccggcgcgacaagcgguccgucgccuuggcgccccacguaggcaugggguuggacacacgcacccagaccuggaugagcgccgagggggcguggcgacagguggagaaggucgagacgugggcccuacgccaccccggguucaccauccucgcacuguuccuugcccacuauaucggaaccuccuugacccagaagguggugaucuuuauucugcugaugcucgucacgcccagcaugacaaugcggugcgugggggugggaaaccgcgacuucguagagggccuguccggggccaccuggguggacgugguccucgagcacggcgggugcgugaccacgauggcaaaaaacaagcccacgcucgacauagagcugcagaagaccgaagcaacccaacuggcgacgcuccggaaacugugcauagaggggaagaucaccaacauuaccaccgacagccgcugccccacacagggcgaggccacccugccugaggagcaggaccagaacuacgugugcaagcacaccuacgucgaccgggggugggguaacggguguggccucuuugggaagggcucccuugugacaugcgccaaauuccagugccuagagcccauugagggcaagguuguacaguacgagaacuuaaaguacaccgugaucaucacuguccacaccggggaucaacaccaggucgguaacgagacccagggggugacggcggagauuacgccccaggccagcacgacggaggcgauccugccugaauacggcacacugggguuggaauguuccccccgcacagggcuggacuucaacgagaugauccuguugacuaugaagaacaaagccuggaugguccaccggcagugguucuucgaccuaccccugccauggacaagcggcgccaccacggagacccccacuuggaaccgcaaggagcuccuggugaccuuuaagaacgcccacgccaaaaaacaggagguggucguccuugggucccaagaaggcgccaugcacacggcgcucaccggggcuacugagauacagaacuccggugggaccucgaucuucgcaggccaccugaaaugccggcugaagauggacaagcucgaacuaaaggggaugagcuacgccaugugcacgaacaccuucguacugaaaaaggaggucucggagacccagcacgggaccauccucauaaaaguugaguauaagggcgaggacgugccgugcaagauccccuucagcacggaggacggacaggguaaggcgcacaacggacgccugauaaccgccaaccccgucgugaccaagaaggaggagcccgugaacaucgaggcugagccgccuuucggggagagcaacaucgucaucggcaucggagacaacgcccugaagaucaacugguacaagaagggcuccucgaucggcaagauguucgaggcgacagcccggggugcccgccggauggccauccuaggcgauacagccugggacuucgggucugugggcgggguucucaauagccucgggaagaugguacaccagauuuucggguccgcguacacagcguuguuuucgggcguguccugggucaugaagauaggcaucgggguucuacugacauggaucggucugaacagcaaaaacaccuccaugagcuucucuugcaucgcaaucgggaucaucacgcucuaccuuggcgcggugguccaggccgacauggggugcgugaucaauuggaaagguaaggaacugaagugcggcagcgggaucuucguaacuaacgaggugcauaccuggaccgagcaguacaaguuccaagcggacucccccaagcgccucgccacggcgaucgccggcgcgugggaaaauggggucugcggcauccgcagcaccacccggauggagaacuuacuguggaagcagaucgcgaacgagcucaacuacauccugugggaaaacaacaucaagcuaaccguaguggugggggacaucaucggcgugcucgagcagggcaagcgcacccugacgccccagccgauggagcugaaguacuccuggaagaccugggggaaggccaagaucgugaccgccgaaacgcagaauagcaguuucaucaucgacggacccaacacccccgagugcccgagcgucucccgagccuggaacgugugggagguggaggacuacggguuuggcgucuuuacaaccaacauuuggcucaaacuacgcgagguguacacccagcugugcgaccaccggcucaugucggcggcagugaaagacgagcgcgcgguccaugcugauauggguuacuggauugaaagccagaagaauggguccuggaaacuggaaaaggccagucugaucgagguuaagacgugcacuuggccgaagucccauacccucuggagcaacggcguccuggaguccgacaugaucauuccuaagagucuggcggggccaauuucccagcacaaccacaggccuggcuaucacacccaaacggcgggccccuggcaccugggcaaacuagaacuggacuucaacuacugcgagggcacaaccgucgugaucaccgagaacugcgggacgaggggccccagccuccggaccaccacgguauccgggaagcugauccacgagugguguugccggagcugcacucugcccccgcuccgauacaugggcgaggacggguguugguacgggauggagauccgccccauuuccgagaaggaggagaacauggucaaaagccugguguccgcgggcucuggaaagguggacaauuuuaccaugggaguccugugccucgccauccuguucgaggaggugaugagaggcaaguucggcaagaagcauaugaucgcugggguguucuuuaccuucguccugcucuuguccggccagaucacguggagagacauggcgcacacguugauaaugaucggcagcaacgccuccgaucggauggggaugggagugaccuaccuggcccuuaucgccacuuuuaagauccagccguuucucgcccucggguucuuucugcgaaagcugacuagccgggaaaaccuccugcugggcgugggccucgcuauggccacgacccugcagcuucccgaggauaucgagcaaauggccaacgggaucgcacuaggcuugauggcgcugaaacucaucacccaguuugagacguaucaguuauggacggcccugauuagucugaccugcuccaacaccaucuucacgcugacggucgccuggcgcaccgcuacccugauccucgcuggugugagcuugcugccggucugccaguccaguuccaugcgaaagaccgacuggcuccccauggcgguugccgcuaugggcguacccccccucccgcuguucaucuucgggcucaaagauacacugaagagacgcuccuggccccugaaugagggcgucauggccgugggccuuguguccauccuggcgagcucccuguugcgcaacgacgucccgauggcgggcccacugguggccggaggacuguuaaucgccuguuacguuaucaccggcacgucugccgaccugacagucgagcgggccgccgacaucacuugggaggaagaggccgagcagaccggugugucccacaaccucaugaucaccguggaugacgacggcaccaugcggaucaaggacgacgagaccgagaacauccucacgguccuguugaagaccgcccucuuaaucgugagcggcaucuucccguacucaauucccgcuacucugcucguguggcacacauggcagaagcagacgcagcgcagcgggguccugugggacgugcccagcccgccugagacccaaaaggccgaacuggaggagggcguuuaccgaaucaagcaacaggggaucuuuggcaaaacacaagucggcgugggggugcagaaggaaggcguuuuucacaccauguggcacgugacacgcggagcgguacuaaccuacaacggaaaacgguuagagcccaacugggcaagcgucaagaaagaccugauauccuacggaggcggguggcgccucucugcucaauggcagaagggcgaggagguccaaguaaucgccguggagccaggaaagaaucccaagaacuuccaaaccaugcccgggaccuuccagacgacuaccggcgagaucggggcaaucgcccuggacuucaagcccggcacaucaggaagccccaucaucaaccgggaggggaagguugucggccuguauggaaacggggugguuacgaagaacgggggcuacgugucuggaaucgcacaaaccaacgccgagccggauggaccaaccccugaacuugaggaggagauguucaaaaagcgcaaccucacaaucauggaccugcacccaggcuccggaaagacgcguaaguaccugccggccaucguccgugaggcuauuaagaggcgucuccggacccugauccuggcgccgacccggguaguggccgccgagauggaggaggcccucaaaggccugccgauccgguaccagacuacggcgaccaaaagcgaacacacggggagagagaucguagaccugaugugccacgccaccuucacgaugcggcuccuaucccccgugcgcgugccuaauuacaaccucaucaucauggacgaagcccauuuuacagaucccgccagcauagccgcgcggggauacaucuccacuagagucggaaugggggaggccgccgccaucuucaugaccgcgaccccgccaggcaccgcggacgcuuucccccagaguaacgcccccauccaggacgaggagcgcgacaucccugaaagauccuggaacagugggaacgaguggaucacugacuucgccggcaagacggucugguucguccccuccaucaaggcugggaaugacaucgccaacugucugcgaaagaacggcaagaaggucauccagcugagucgaaagacauuugacaccgaguaccagaagaccaagcucaaugacugggauuucguggugaccacugacaucagcgagaugggggccaacuucaaagccgaucgggucauugauccucgaaggugccucaagcccgugaucuuaaccgacgggcccgagcgggugauccuugcaggccccaugccggucaccgcggcaagcgccgcucagcgccgggggcgcguuggccggaacccccagaaggagaacgaccaauauaucuucaccgggcaaccccuaaacaacgacgaggaccacgcccacuggaccgaggcgaagaugcugcuggacaacauaaacacccccgaggggauaaucccggcucucuucgagcccgaaagggagaaguccgccgccaucgacggcgaguaucggcugaagggggaaucuagaaaaaccuuuguggaacuaaugcgccgcggcgaccuccccguguggcucgcccauaagguggcuuccgagggcaucaaguauaccgaccggaaauggugcuucgacggucagcgcaacaaccagauccuggaggagaacauggacguagaaaucuggaccaaggagggcgagaagaaaaagcuccggccccguugguuggacgcccgcacguacagcgauccgcuggcccugaaggaauucaaggaguucgccgcgggccggaaguccaucgcccuggaccuggugacagagaucgguagggugcccucacaccuagcgcacagaaccagaaacgcacuggacaacuugguaaugcuacauacaucagagcaugggggccgggcauaccgccacgccguagaggagcugcccgagacuauggagacccuacuucugcugggacucaugauccugcuuacaggcggcgccaugcuuuuccuuauuucagggaagggcaucgggaagacaucaaucggccugaucugcgugaucgccuccuccgggaugcucuggauggccgaaaucccgcugcaauggaucgccuccgcgaucguccuggaguucuucaugauggugcuucugaucccggagcccgagaaacagagaacgccgcaggacaaccagcuggccuacguggucauuggcauccucacucuggccgccauuaucgccgcgaacgaaauggggcugcucgagacaacgaaacgcgaccuggggaugagcaaggagccggggguggugucccccacgagcuaccuagacgucgaccuccacccagccuccgccuggacgcuauacgccguugcuacgaccguaaucacgcccaugcugcggcacaccauugagaacagcaccgcgaacgucucccucgccgccauagcaaaccaggcagugguacugauggggcuggauaagggcuggccgaucagcaagauggaccucgggguccccuuacuggcccucggcugcuacucccaggugaacccgcuaacucugacagcagccgugcuccuacugaucacccacuaugccauaaucggcccaggacuccaggcgaaggccacccgagaggcacagaagaggaccgccgcuggcaucaugaagaacccgacggucgacggaauuaugaccaucgaccuggaucccgucaucuaugacagcaaguucgagaagcagcugggccaggugaugcuccuuguccugugugcggugcagcucuuacugaugcgcaccagcugggcccucugugaggccuuaacccuggcuacgggccccaucacaacccucugggaggggaguccuggcaaguucuggaacaccacgaucgcggugucaauggccaacaucuuucgggggagcuacuuagcaggcgccgggcuggcauuuucaaucaugaagaguguaggcacgggcaagagggggacaggcucccagggggagacccuaggugagaaguggaagaagaagcugaaucagcugagccggaaggacuucgaccuauauaaaaagucgggaaucacggagguggauagaacggaggcaaaggagggucucaagcggggcgagauaacccaccaugcuguuagccgcggcucugccaagcugcagugguucgucgagcggaacauggugauaccggagggccgcgugaucgaccucggaugcggccgcgggggaugguccuacuacugugccggguuaaagaagguaaccgaagugcgaggguauaccaagggggggcccggccacgaggagccugugcccaugagcacguacggguggaacaucgucaagcuuauguccggcaaggacguguucuaccucccgcccgagaagugcgacacccugcugugcgacaucggcgagagcucccccagccccaccguggaggagucccgcacaauccguguucugaagauggucgagccguggcucaagaacaaccaguucugcaucaaaguguugaacccuuacaugcccacggucaucgagcacuuggagcgcuugcagcggaagcacgguggcaugcuggugcgcaacccucugagccggaacuccacccacgagauguacuggauuagcaacgggaccggcaacauuguggccuccguuaacauggugagccgacuccugcugaacagguuuaccaugacucaccgccggccgacgaucgagaaagacgucgaccucggugcggggacccgccacgucaacgccgagccagagacucccaacauggacgugaucggggagcggaucaagcgcaucaaggaggagcacaacuccacguggcacuacgacgacgaaaauccauacaagacuugggccuaccacgggagcuaugaggugaaagccacgggcucugccagcucuaugaucaacgggguugugaagcugcucaccaagcccugggacgucgugcccaugguuacacagauggcgaugacugacaccacuccguucggacagcagcgggucuucaaggagaagguggacacgaggacgccgcggagcaugcccggcacgcgccgggugauggggauaaccgccgaauggcucuggaggacgcugggaaggaacaagaagccccgccuguguacccgcgaggaguucaccaagaagguccggaccaacgccgccaugggggcgguauucacagaagaaaaccagugggacagugccaaggccgccguggaagacgaggacuucuggaagcucgucgaccgagagcgagagcugcacaagcuaggcaagugcggcuccugcguguacaacaugaugggcaagcgcgagaagaagcucggcgaguucgggaaggcgaagggcagccgggcuaucugguacauguggcugggggcccgcuacuuggaauucgaagcccucggcuuucuuaacgaggaccacugguucucccgggagaacucuuacucugggguggagggcgagggccugcauaagcucggcuacauccugcgcgacauuagcaagauccccggcggugccauguacgccgacgacaccgcgggcugggacacccggaucaccgaagacgaccugcacaacgaggagaaaauaacucagcagauggacccggagcaccgccaguuagccaacgccaucuucaagcugacuuaccagaacaagguaguaaaggugcagcguccuaccccaacgggaaccgucauggauauaauaucccguaaggaccaacgggggagcggucagguggguacuuacggacugaauacauucaccaacauggaggcccagcucauccgccagauggagggugagggcguguuauccaaggccgaccuggagaacccgcaccucccggaaaagaagauaacccaguggcuagagaccaaaggcguggagagacuuaaacgcauggcgauaagcggggacgacugcgucguuaagccgaucgacgaccgguucgccaacgcccuccuggcccugaaugacaugggcaagguccggaaggacauuccgcaguggcagcccuccaagggguggcaugacuggcagcaagucccguucugcagccaccacuuucacgaacucaucaugaaggacgggcggaaguuaguagucccgugccgcccccaggacgagcuuaucgggcgggcccgcaucucccagggcgcgggauggagccucaaagagaccgcaugccugggaaaagcauacgcccagauguggagucugauguacuuccacagacgggaccuccgccucgccagcaacgccauuugcuccgccguacccgugcacuggguuccgaccucccggaccacuuggucuauccacgcccaccaccaguggaugaccaccgaggacaugcugaccguguggaaccgcguuuggaucgaagacaaccccuggauggaagacaagacgcccgugaccaccugggagaacgugcccuaccuaggcaagcgagaagaccaauggugcgggagccugaucggccugaccucacgcgccacuugggcgcagaacauuccgaccgccauccaacagguccgguccuugaucgggaacgaggaguuccuggacuacaugccgagcaugaaacgcuuccggaaggaggaggaguccgagggcgcuaucugguga

SEQ ID NO: 25866 - RNA, 9873 nt, Artificial Sequence
  derived and/or modified CDS sequence (opt11) from DENV-3__JF937623__SS-prME
gccagccugugccucaugaugauccugcccgccgcccuugccuuccaccucacgucgcgggacggcgaacccaggaugaucguggguaagaacgaacggggcaagagccuguuauucaagaccgcaucagggaucaacauguguacccucaucgccauggacuugggcgaaaugugcgacgacaccgugaccuacaagugcccccacauuaccgaaguggagccagaggauaucgacugcuggugcaaccugacgagcaccugggugaccuacgggaccugcaaccaggcaggcgagcaccgacgcgacaagcggagcgucgcgcucgcgccccaugugggcaugggguuggacacacgcacccagaccuggaugagcgccgagggcgccuggcgccagguggagaaggucgagaccugggcgcugcgccacccgggguucacgauccucgcccuguuccuggcccacuauaucgggacuucccucacccagaagguggugauauucauucuccucaugcucgucacucccucuaugacgaugcggugugucggggucggcaaccgcgacuucgucgagggccugaguggcgccaccuggguggaugugguccuggagcauggcgggugugucaccaccauggccaagaauaaacccacgcucgacaucgagcugcagaagaccgaggcgacccagcuggcuacucuccggaagcugugcaucgagggcaagaucacaaacauaaccacagacagucgcugcccgacccagggcgaggccacgcugccggaggagcaggaccagaacuacgugugcaagcauaccuacgucgaccggggguggggcaacgggugcggccucuucgggaaggggucccucguaaccugcgccaaguuccaaugccuggagcccaucgagggcaagguaguucaauacgaaaacuuaaaguacaccgugauaaucacggugcacaccggcgaccagcaccaggucggcaacgagacgcagggggugaccgccgaaaucacgccacaggcgagcacaaccgaggccauccugcccgaguacggcacacugggguuagagugcuccccgcgcaccggccuggacuucaacgagaugaucuugcucacaaugaaaaacaaggccuggaugguccaccggcagugguucuuugaccugccccugccguggaccagcggugcuaccaccgagacgcccaccuggaacagaaaggagcuccuggugaccuucaagaacgcucacgcgaagaaacaggaaguggucguacuggggucccaggagggcgccaugcacaccgcccucacgggcgcgaccgagauccagaacucgggcgggaccuccaucuucgcuggccaccucaaaugccgucuuaagauggacaaacucgagcugaagggcaugucuuacgcuaugugcaccaacacguucgugcucaagaaggaggucuccgagacacagcacgggaccauccucaucaagguggaguacaagggugaagacgugccuugcaagaucccuuucaguaccgaggacgggcagggcaaggcucacaacggccgucugauaacggcuaaccccguagugacgaagaaggaggaacccgugaacaucgaggccgaaccgcccuucggggagagcaacaucgucauaggcaucggggacaacgcgcugaagaucaacugguacaagaaagguuccagcaucggcaaaauguucgaggccaccgcucggggcgcacgccguauggccauccugggcgacaccgcgugggacuucgggaguguaggagggguguugaacucacuaggcaagaugguccaccaaaucuucgguuccgcauacacggcccuguucagcggcguauccugggugaugaagaucggcaucgguguccuccugaccuggaucggcuugaacagcaagaacaccuccaugagcuucuccugcauagccaucgggaucaucacccucuaccugggggcggugguucaggcggacauggggugcgucauuaauuggaagggcaaggagcugaagugcggcagugggauauucguaacgaacgaggugcacacuuggaccgagcaauacaaauuccaggccgacucacccaagcgacucgccaccgccaucgccggcgccugggagaacggcgucugcggcauacgcucaacgacccgcauggagaaccuacuguggaagcagauagccaacgagcucaacuacauccugugggagaacaauaucaagcugaccgucgugguuggggauaucaucggcgugcuugagcagggcaagcgcacccugacuccccagccgauggaguuaaaguauucuuggaagaccugggggaaggccaaaaucgugaccgccgagacgcagaacucuagcuucaucaucgacggccccaacacgccugagugccccagcgucagccgggcauggaacgucugggagguagaggacuacgguuucggcgucuucaccaccaacaucuggcucaagcugcgcgagguguauacccagcuaugcgaucaccggcucaugagcgccgccgugaaggacgagcgcgccguccacgcugacaugggcuacuggaucgagagccagaaaaacggguccuggaagcuggaaaaggcgucucuaaucgaggucaaaaccugcacguggccuaagucccauaccuuguggagcaacggcgugcuggaguccgauaugauaaucccaaagucgcuugccgggccaauaucccagcacaaccaucggccgggcuaccacacccagaccgccgggcccuggcaccucggcaagcuggagcuggacuucaacuacugcgagggcacgaccgucgugaucacagagaacugcgggacacgaggccccagccuccggacgaccaccgucuccgggaaacuuauccacgagugguguugucgcagcugcacgcugcccccgcuccgguacaugggcgaagaugggugcugguacggcauggaaauccgcccuauaucagagaaggaggagaacauggucaagucccugguguccgccgggagcgggaagguggacaacuucacgauggggguccugugccucgccauccuguucgaggaggugaugagaggaaaguucggcaagaagcacaugaucgcgggaaucuucuucaccuucgugcugcuccugagcggccagauuaccuggcgcgacauggcccacacccugaucaugaucggaagcaacgccucggaccggauggguaugggcgugacguaccucgcccugaucgcaacguucaaaauccagcccuucuuagcgcucggguucuuccugcgcaagcugaccucccgggaaaacuuacugcugggcgugggccucgccauggccaccacgcugcaacugccggaggauauagagcagauggcgaacgggaucgcccucggccucauggcccugaaacucauuacccaauucgaaacguaucaacuguggacggcccugaucagcuuaacgugcucaaacaccaucuucacccugaccgucgccuggcgcacggccacccucauccucgcuggggucagucugcugccggugugucagucaagcuccaugcggaagaccgacuggcuccccauggccguagccgccaugggcgucccgccccucccgcuguucauauucggccucaaggacacacugaagcgacgcagcuggcccuugaacgagggugugauggccgucggccucguguccauccuggcgucgucccugcuccggaaugacgugcccauggccgggccccucguggcgggcggccuccucaucgccugcuacgugaucacgggcacaagcgccgaucucaccguggaaaaggcugccgacaugaccugggaggaagaggccgaacaaacgggcgucucccacaaucugaugaucaccguggacgacgacggcaccaugaggaucaaggacgacgagaccgaaaacauccucaccgugcugcuuaaaacggcucuccugaucgugaguggcaucuucccguauuccauucccgcgaccuuacucguguggcacaccuggcagaagcagacccagcggagcggggugcugugggacgucccgagcccgcccgagacgcagaaggcggaacuggaggagggcaucuaccgcaucaagcagcaggggaucuucggcaagacccaggucggggugggcguccagaaagagggcguguuucacaccauguggcacgugacccgcggggcaguccucacguacaacggcaaacgccuggagcccaacugggccagcgugaagaaggaccucaucagcuaugggggaggguggcggcuaagcgcacaguggcagaagggcgaggaggugcaggucauagcgguggagcccggcaaaaaucccaaaaacuuccagaccaugcccgggaccuuccagacgaccaccggcgaaaucggggccauugcccuggacuucaagccaggaaccucgggcucacccaucaucaaccgcgaagggaaggugguuggccuguacgggaacgguguggugaccaagaacggaggguacgucagcggcaucgcccagacuaaugccgagcccgaugguccgacccccgaacuggaagaggagauguuuaagaagcggaaccuaaccaucauggaccugcaucccggcuccgggaagacacgcaaguaucugccggcgaucgugcgagaggccaucaagcgccggcuccgcacccugauccuggcgccaaccaggguggucgccgccgaaauggaagaagcgcuaaagggcuuacccauacgcuaucagaccacagccacuaaguccgagcacaccgggcgggagaucguugacuugaugugccaugcuaccuucaccaugcgccuccugucccccgugcgggucccgaacuacaaccuaaucaucauggacgaggcccacuucacggacccagcaagcaucgcugcacguggcuacaucuccacgcgggugggcaugggagaggccgcggccauauucaugaccgccacgccacccggcacggccgacgccuucccgcagucaaacgcccccauccaggacgaagaacgcgauauccccgagcgcuccuggaacagcggcaacgaguggauuaccgacuuugcgggcaagacugugugguucgucccauccauaaaggcagggaacgacaucgcuaacugucuccggaaaaacgggaagaaggugauccagcugucucgcaagacuuucgacacggaauaccaaaagacuaagcugaacgacugggacuucguggucacgaccgacaucagcgagaugggcgccaacuucaaagccgaccgggugaucgacccgcgcagaugccugaagcccgugauuuugacggacgggccggagagagucaucuuagcgggacccaugcccgugaccgccgccagcgccgcccagcggcgcgggcgggugggcaggaauccccagaaggaaaacgaccaguacaucuucacagggcagccacuuaacaacgacgaggaccacgcgcacuggaccgaagccaagaugcuguuagacaacaucaacacccccgagggcaucaucccagcuuuguucgagccagagcgggaaaaguccgccgcgaucgauggcgaguaccgccugaagggggagagccggaagacguucguugagcugaugcgccgaggcgaccuccccguguggcuggcucauaaaguggccuccgaggggaucaaguacaccgaccgcaagugguguuucgaugggcagcggaacaaccagauccuggaggagaacauggacguagagauauggacaaaggagggcgagaagaagaagcuccgcccccgcuggcuggacgcccgcaccuacagcgauccgcuggcccucaaggaguucaaggaguucgcggcugggcggaaguccauugcccucgaccuggugacagagaucgguagaguuccaagccaccucgcccaccgcacgcggaacgcccuggacaaccuggugaugcuccacacuuccgagcaugggggccgcgcguaccggcacgccguggaggagcugcccgagacgauggaaacgcugcuucugcuggggcucaugauccugcugaccgguggcgccaugcuguuccugaucuccgggaagggcauugguaagaccagcaucggccugaucugcgucaucgccuccagcgggaugcucuggauggccgagaucccguuacaguggaucgcguccgcuaucguucuggaguucuucaugauggugcuucugaucccugagcccgaaaagcagcgaacaccccaggacaaucagcuggccuacguggugaucggcauccugacguuggcggccaucauagcggccaacgagaugggccuacuggagaccacaaagcgggacuuagggaugagcaaggagccggguguagucagccccaccagcuaucuggacguagaccuccaccccgccuccgccuggacucuguacgcgguggccaccaccguuaucacccccaugcugcgccacacgauagagaacucaaccgccaacgugucucuugccgccaucgcgaaccaggccgugguccuuauggggcucgauaaggguuggccgaucagcaagauggaccugggggugccccugcuggcccuaggcuguuacucccaagugaacccccugacacugaccgccgccgucuugcugcugaucacgcacuacgcgaucaucggccccgggcuccaagccaaggccacccgugaggcacagaagcgcacugccgcggguauuaugaagaacccgaccguggacgggaucaugaccaucgacuuggaccccgugaucuacgacagcaaguuugaaaagcagcugggccaggucaugcugcuggugcugugugccgugcaacuccuauugaugcggacauccugggcucucugcgaggcacugacccuggcgacgggccccaucaccacguugugggaagggagccccggcaaauucuggaacaccaccauagcggucuccauggccaauaucuuccgagggagcuaccuggccggcgccgggcuggccuucuccaucaugaagucggugggcacggggaagaggggcaccggaagccagggggagacccucggcgagaaauggaagaagaagcugaaucaguugagucgcaaggacuucgaccucuacaagaagucugggaucacagagguggaccggaccgaggccaaggagggccugaagagaggcgagaucacgcaccacgcgguuucccggggcagcgccaagcugcagugguuuguggagcgcaacauggugauccccgagggccgggucaucgaccucgggugcggccgcgggggcugguccuacuacugcgccggccugaaaaaggucaccgaggugcggggguauaccaaaggcgggcccggccacgaggagcccguccccaugagcacauacggauggaacaucgugaaacugauguccggcaaggacguguucuaucuaccgccugaaaagugcgacacgcugcugugcgacaucggcgagagcucccccagccccaccguugaggagucccgcaccauccgcgugcugaagaugguugagccuuggcucaagaacaaccaguucugcaucaagguauugaauccguacaugcccaccgugaucgaacacuuggagcgguugcagcgcaagcacggagggaugcugguacggaauccccugagccgcaacuccacacacgagauguacuggaucagcaacgggacgggcaacaucgucgcguccgugaauauggugagccggcuccuccugaaucgguucaccaugacacaccggcgccccacgauugagaaggacguggauuuaggcgccgggacccggcacgugaacgccgaacccgaaacgcccaacauggacgugaucggcgagcgcaucaagcgaauuaaggaggagcacaacuccaccuggcacuacgacgacgagaacccguacaagacgugggcauaccacgggucuuacgaaguuaaagcgaccggcuccgcgucauccaugauuaacggugucgugaagcuguuaaccaagcccugggacguagugccgauggucacccagauggccaugacggacaccaccccguucggccagcagaggguguucaaggaaaaaguggacacccggaccccgcgcagcaugccaggcacccggcggguaaugggaaucaccgcagaguggcucuggcggacccugggccgcaacaagaagccccggcuguguacgagggaggaguucaccaaaaagguccgcaccaacgccgcaaugggcgccguauucaccgaggagaaccagugggacucggccaaggccgccgucgaggacgaggacuucuggaaacuuguggaccgggaacgcgagcugcauaagcugggcaagugcggcuccugcguguacaacaugaugggcaaacgggagaaaaagcugggcgaguucggaaaggcgaagggcagccgugccaucugguacauguggcugggggcccgguaccuggaguucgaggcccucggcuuucugaacgaggaccacugguucuccagagaaaacucuuacuccgggguagagggugaaggccugcacaaguugggguacaucuuacgugacaucuccaagaucccgggcggggccauguacgcggacgacacugcaggcugggacacccgcaucaccgaggacgaccugcacaacgaggagaaaauaacgcagcagauggacccggaacaccggcagcuggcgaacgccaucuucaagcugacguaccagaacaagguggugaagguccagcgccccaccccaaccggcaccgugauggacaucaucucccgaaaggaccagcgcggaagcggacagguggggacuuacggccugaauacguucaccaauauggaggcccagcucauucggcagauggagggggagggcguccugaguaaggcggaucuggagaacccccaccucccggagaagaaaaucacccaguggcuggagaccaagggcguggagcgccugaagcgcauggccaucagcggggacgacugcguagucaagccaaucgacgaccguuucgccaacgccuuacuggccuugaacgacaugggcaaggugcggaaggacauaccccaguggcagcccuccaaaggguggcacgacuggcagcaggucccguucugcagccaccacuuccacgagcucaucaugaaggacgggcggaagcuggucgugcccugucggccccaggaugaauugaucggcagagcgaggaucucccaaggcgccggcuggucucucaaggaaacggccugccuggggaaggccuacgcgcagauguggaguuugauguacuuccaccggcgcgaccuccggcuggccuccaacgccaucugcagugccgugcccguccacuggguuccgacuagcaggacgaccugguccauccacgcccaccaucaguggaugacgaccgaggacaugcugaccguguggaaccgggucuggaucgaggauaacccguggauggaggacaagaccccgguaaccaccugggagaacguccccuaccucggcaagcgcgaggaccaguggugcgggagccugaucggucugacuagccgggcgacuugggcgcagaacaucccgacggccauccagcagguccggucccucaucggcaacgaggaguuccuagacuacaugcccucgaugaagcgguuccgcaaggaggaggaguccgagggcgccaucugguga

SEQ ID NO: 25867 - RNA, 9873 nt, Artificial Sequence
  derived and/or modified CDS sequence (opt11) from DENV-3__JF937637__SS-prME
accagccugugccugaugaugaucuuacccgcagcccuagcguuccaccugaccagccgggacggcgaacccaggaugauuguggggaagaacgaacggggcaagagccugcuguucaagaccgcgagcgggaucaacaugugcacccucaucgccauggaucugggcgaaaugugcgacgauaccgugacauacaagugcccccacaucaccgagguggagccggaagacaucgauuguuggugcaaucugaccagcacauggguaacguauggcacgugcaaccaggccggagagcaccgaagagacaagcgguccgucgcacucgcgccgcacgugggcaugggguuagacacaagaacccagaccuggaugucagccgagggggccuggaggcagguugagaagguggagacgugggccuuacgccacccgggguucacaauccuagcgcuguuccucgcccacuauaucggcacuucccucacacagaagguagugaucuucauccugcuaaugcuggucacgccaagcaugaccaugcggugcgugggcgugggcaaccgcgacuucguugaaggccuguccggggccaccuggguggacgugguucuggagcacggcgggugcgugacgacaauggccaaaaacaaaccaacacuugacaucgaguuacagaagaccgaggcaacccaguuagcgacacuuaggaaguuaugcaucgagggcaagaucacaaacauaaccaccgacagcagaugccccacccagggcgaggcuaccuuaccggaagaacaggaucagaacuacgugugcaaacacaccuacgucgaucguggguggggcaauggauguggacucuucgggaaaggcagucuggugaccugcgccaaguuccagugucuggagcccaucgagggcaaggugguccaguaugagaaccugaaauacacgguuaucauaacaguacacaccggggaucagcaccagguggguaacgagacccaggggguuacugccgagaucacaccccaggccucaaccaccgaagccauccuccccgaguacggcacucuggggcucgagugcuccccgcgcaccggucucgauuucaaugagaugauucuucucaccaugaaaaacaaggccuggaugguccaccggcagugguucuuugaccugccgcugcccuggaccagcggugccacuacggaaacgccgaccuggaaucgcaaggaauugcugguuacauuuaagaacgcccacgccaagaaacaggagguggucguauuggggucccaggagggugcgaugcacacggcccucacaggggccacggaaauccaaaauaguggcgggaccuccaucuucgccggccaucuuaagugucggcugaagauggauaagcucgagcugaaagguaugagcuacgcgaugugcacgaacgcguucguacuuaagaaagaaguaucggagacccagcacgggacgauccucauaaagguggaauacaagggcgaggacgugccauguaagauucccuuuagcacggaggaugggcagggcaaggcacauaacggccggcugauaacggcgaaccccguggugaccaaaaaggaggaacccgugaacauagaagcggagccgcccuucggggagagcaacaucguuaucggcauuggagacaacgcgcugaagauaaacugguacaagaaggguuccagcaucgggaagauguucgaggcaacagcccggggcgcgcgcaggauggccauccugggcgacacggcgugggauuucggguccgugggcgggguuuuaaacagccugggaaaaaugguccaccagauauuuggaucggccuacacggcgcuguucagcggaguguccuggguaaugaaaaucggcaucggggugcucuugacauggaucgggcugaauagcaagaacaccuccaugagcuucuccugcauugccaucggcaucaucacccuauaccugggcgccguggugcaggcugacauggggugcgucauaaacuggaaaggcaaggagcugaagugcgguuccgggaucuuugugaccaacgaggugcacaccuggacagagcaguacaaauuccaggcugacagcccgaagcgcuuagcgacugccaucgccggcgcgugggaaaacggggucugcgggauucgcagcacgacucggauggaaaauuuauuauggaaacagaucgccaacgagcucaacuauauccugugggagaacaauauuaaguugaccguggucguuggggacaucaucggcgugcucgagcaggggaagcguacccugacgccccagccgauggaacugaaguacuccuggaagaccugggggaaagccaaaauugugaccgcggagacccagaacagcucuuucaucauagacggccccaauacgccggaaugccccagcgucucgagggcguggaaugugugggagguggaggauuacggguucggcgucuucacgacaaacauuuggcugaaacuucgcgaaguguauacccagcugugcgaccaccguuugaugagcgccgccgucaaagacgaacgcgcgguccacgcagauaugggauacuggaucgagagccagaagaauggguccuggaaacuggagaaagcuagccucaucgaggugaagaccugcacguggccgaagucccacacgcucuggagcaauggggugcucgaauccgacaugauaauuccuaagagccuggccgggcccaucucccagcacaaucaccgcccgggcuaccauacucaaaccgcagggcccuggcaucuggguaaguuagaacuggacuucaacuacugugagggcacgaccgucgugaucacggagaacugcgggaccagaggccccagcuugcggacgacuaccguauccgggaaacugauacacgaguggugcugccggucuugcacacugcccccgcuccgguacaugggcgaggacgggugcugguacggcauggagauccggcccaucagugagaaggaggagaacauggugaagucauugguguccgcaggaagcgguaagguggacaacuucacgaugggcguacugugccucgcaauccuguucgaggaggucaugcggggaaaguucggcaaaaagcacaugaucgcagggguguucuuuaccuucgucuugcuccuguccggccaaaucaccuggagggauauggcccacacgcuuaucaugauaggcagcaacgccagcgaucggauggggaugggcguuacguaccucgcccugaucgcgaccuuuaagauucagccguuccuggcgcuaggcuuuuuccugcgcaagcugaccucaagagagaaucuccuacugggggucgggcucgccauggcaaccacgcuucagcugccagaggacauugagcagauggcgaacgggauugcgcuaggccucauggcgcugaaacuaaucacccaguucgaaaccuaccagcuguggaccgcccucaucagccucacuugcaguaauacuaucuuuacccugaccguagccuggcgcacggccacccugaucuuagcggggguaucguugcugccggucugccagagcaguuccaugcggaaaacugauuggcuacccauggccguagcagccauggguguaccgccccuuccgcuguucauauucggguuaaaggacacgcugaagcgccggucguggccccugaacgagggcgucauggcagugggcuuagugagcaucuuagccagcucacugcuccggaacgauguccccauggcagggccgcucguugcgggcggacuuuuaaucgcuugcuacgucaucacgggaacaucggccgaccucaccguugagaaggcggcugacaucaccugggaggaggaagccgaacagacgggugugucacauaaccugaugaucacuguggacgaugacgggaccaugcgcaucaaggacgaugagaccgagaacauuuugaccgucuugcuuaagacggcacucuuaauaguaagcgggaucuucccauacuccauccccgccaccuugcuaguguggcacaccuggcaaaaacagacccagcggagcgguguccuuugggacgugccgagcccgcccgaaacucagaaggcugaguuagaggagggcguguaccgcauaaagcagcaggggaucuucggcaagacccaggucgguguuggcguucagaaggagggcguuuuccacaccauguggcacgugacccgaggcgcggugcuaacguauaacggcaaacgucuggagccgaacugggccagcgucaaaaaggaucugaucuccuaugggggcggguggcggcucagcgcccaauggcagaagggcgaggagguccaggugaucgcggucgagccuggcaagaaccccaagaacuuccagaccaugcccgggacauuccagaccacgaccggcgagaucggggcuaucgcucuggacuuuaagcccggcaccuccgggagccccauaaucaaccgcgaaggaaagguggugggacuguacgggaauggcgucgugaccaaaaacgggggcuacguuucgggcaucgcacagacgaaugccgaaccggacgggccuaccccugaguuagaagaggagauguucaaaaagcggaaccucacaaucauggaucugcaccccgguucuggcaagacccgcaaguaucuuccugcgauaguccgugaggccauaaagcgacggcucaggacgcugauccuggcccccacccgagugguugccgccgagauggaggaggcacucaaggggcuucccauccgguaccagaccaccgcgacaaaguccgagcauacagggcgggagaucguagaccugaugugccacgccaccuucaccaugagacuguugucgccugugcgcgugccgaacuacaaccuuaucaucauggaugaggcccauuucacugaccccgccaguaucgcugcaaggggcuauauuuccacccgcgucgguaugggugaggcagccgcgaucuucaugaccgcgacuccaccggggacggcggaugccuucccgcagagcaacgcacccauccaggaugaggaacgcgacauccccgagcguucauggaacagcggaaacgaguggaucaccgacuuugcggguaagacugugugguucguuccauccauaaaggccggaaacgauaucgccaacugccuccggaagaacggcaagaagguaauacaguugucgcgcaaaacguucgauacugaguaucaaaagaccaaguuaaacgauugggacuuugugguuaccaccgacauuuccgagaugggcgccaauuuuaaggccgaccgugucaucgacccgagaagaugccucaaaccagugauccuaacggacggccccgagcgcguaaucuuggcagggcccaugcccgucaccgccgccagcgccgcgcagcggcgcggucgggugggucgaaacccccagaaagagaacgaccaguacaucuucaccgggcagccccucaacaacgacgaagaucacgcccauuggaccgaggccaagaugcugcuagacaacaucaacacccccgaaggaauaaucccggcccuguucgagccugagcgagagaaaagugccgcuaucgacggcgaguacagguugaagggggagagccggaagacguuuguggagcuaaugcgucggggcgaccugcccgucuggcuugcccacaaaguggccagcgaggggaucaaguacacggacaggaaaugguguuuugacggacagcggaacaaccaaauccucgaagagaacauggauguugagaucuggaccaaagagggagagaaaaagaagcuccgcccccgguggcuggacgcccgcaccuacucugacccgcuggcccucaaagaguucaaagaguucgcagcuggccgcaagucuauagcccuggaccuagugaccgagaucggccggguacccagccaccucgcacaccgcacacgcaaugcccucgacaaccuagucaugcuccacacauccgagcacgguggcagggcguaucggcacgcagucgaggagcugcccgagaccauggaaacucugcuccugcuggggcucaugauucugcugaccggaggcgccaugcuguucuuaaucagcggcaaaggcaucgguaagaccagcauuggcuuaauuugcgugauagccaguuccgggaugcucuggauggccgagaucccacugcaguggauagcuuccgcuauaguccuggaauuuuucaugauggugcuucuaauccccgagccugaaaagcagcggacgccucaggacaaccagcuggccuacguggucauaggaauuuugacgcucgccgccaucaucgcggccaacgagaugggccugcuagagaccaccaagcgggauuuagggaugucgaaggagccgggcguagucagcccuaccagcuacuuggaugucgaccuucaucccgcauccgcguggacguuauaugccguggcuaccacaguaauuacgcccaugcugcgccauacgauagagaacagcaccgccaaugucucccucgcagccaucgcgaaccaggccgugguguugauggggcuggacaagggcuggccaaucucgaaaauggaccucggggucccccugcuggcccucgggugcuacucccaggugaacccccugacccugaccgccgccgugcucuuacugaucacgcacuacgcgaucaucggcccaggucuccaggccaaagccacccgggaggcgcagaaacgcaccgccgcgggcauuaugaagaacccaacaguugacgggaucaugacgauagaucuggaucccgugaucuaugauagcaaguuugagaaacaacugggacaggugaugcuccuuguacugugcgccguccagcucuugcuuaugcggaccuccugggcccucugcgaggcccuaacccuggcuaccggccccaucacgacacucugggaagggagccccggcaaauuuuggaacaccacuaucgcgguuuccauggcaaacaucuuccgcgggucguaccuggccggcgccggauuggcguucucaauuaugaaguccgucgguacggggaagagggggaccggcucccaaggagagacccuaggcgagaaauggaagaagaaguuaaaccaacucagccgcaaggacuucgaucuuuacaagaaguccgggaucacagagguggaccggacagaagccaaagagggucugaagcgcggcgaaaucacccaccacgcaguaucccgcgggucagccaagcuacagugguucgucgagcgcaauaugguuauaccagaaggcagggugaucgaucucgggugcgguagagggggcugguccuacuacugcgccggccugaagaaagucacagaggugcggggguacaccaaaggcgggcccggccaugaggaacccgugccgaugagcacuuacggcuggaacauagucaagcugauguccggcaaggacguguuuuaccugccuccugagaaaugcgacacucugcugugugacauaggcgaaagcucgcccucuccuaccguggaagagucccgcacaauacgaguccuaaagaugguggaaccguggcucaagaauaaccaguucugcauaaaggugcugaaucccuacaugccuaccguuauagaacaccuggaaagauugcagcgcaagcacgguggaaugcugguuagaaacccccugucgcgcaacuccacgcacgagauguacuggauaaguaaugggacuggcaauaucguggcgagugucaauauggugagccgguuacugcugaaccgguucacuaugacccaccggcgcccuacaauugaaaaggacguggaccucggcgccggcacccgccacgucaacgcggaacccgagacacccaacauggacgugaucggagagcgaaucaagagaaucaaggaggaacauaacuccaccuggcacuacgacgacgagaacccguacaagacgugggccuaucacgggagcuacgaggugaaggcaaccggaagcgcgagcucuaugauuaacgggguggugaaacugcucacgaagccuugggacguuguaccuaugguaacucagauggccaugacggacaccaccccuuuuggacagcagaggguguucaaggaaaagguggacacccggacgccacguagcaugccgggcacucggcgagugauggggaucaccgccgaguggcucuggcggacauugggacgcaacaaaaagccucggcuuuguacgcgggaggaguuuacgaagaaagugcgcacaaacgccgcgaugggggcagucuucacagaggagaaucagugggacucugcgaaggccgcgguagaagaugaggacuuuuggaaacucgucgauagggagcgcgagcugcauaagcugggcaagugcgguagcugcguguacaauaugaugggaaagcgggaaaagaaguuaggcgaguucgggaaggccaagggcagccgggccaucugguauauguggcuuggggcccgcuaccuggaguucgaggcccugggauucuugaacgaagaccacugguucagccgcgagaacaguuauucuggaguggaaggcgagggccugcacaaacucggguacauacugcgggacauuagcaagauccccggcggggccauguacgcugacgacacggcgggcugggacacccgcaucacugaagacgacuuacauaacgaagagaaaaucacccaacaaauggaccccgagcacaggcaguuagccaaugcaaucuucaaacucacguaucagaacaaggucgugaagguacagcgcccuacccccaccggcacuguuauggacaucaucagucggaaggaccagcgcgggagcggccaaguagggaccuacggauugaacacguucaccaacauggaggcccagcucaucagacagauggaaggggaaggaguguuacugaaggcggaccuggagaacccccaucuccccgagaagaaaaucacgcaaugguuagagaccaagggcguggagcgcuugaagcggauggcuauuuccggggacgacugcgugguuaaaccaauugacgacagauuugccaacgcccugcuggcgcuuaacgacaugggaaaggucaggaaggacaucccgcaguggcagccgagcaagggguggcacgacuggcaacaggugcccuucugcagucaccacuuccacgagcuaauuaugaaagacgggagaaaacuugugguucccugccgcccucaggacgaacucaucgggcgcgcacggaucucgcaaggcgcaggcuggucccugaaggaaacggccugccuagggaaggccuacgcgcagauguggagccucauguacuuccaccgccgcgaccugcggcuggccuccaaugcgaucugcagcgcuguucccgugcacugggucccgaccagucgcaccaccuggagcauccacgcccaccaucaguggaugacgacugaggauaugcugaccguguggaaccggguuuggaucgaggauaaucccuggauggaagacaagacccccgucacgacgugggagaacgugcccuacuuagggaagcgggaggaccaguggugcggcucccugaucggccucaccagcagagcaaccugggcccagaacaucccuacggccauccaacaggugaggucccugauagggaacgaagaguucuuggacuauaugcccuccaugaagcgguuucgcaaggaggaggagagcgagggcgccaucugguga

SEQ ID NO: 25868 - RNA, 9873 nt, Artificial Sequence
  derived and/or modified CDS sequence (opt11) from DENV-3__JF937638__SS-prME
accagccugugccuccugaugauucugcccgccgcguuggccuuucaucugaccucacgagacggcgagccacggaugaucguggggaagaacgagagaggaaagagccugcuguucaaaacugccuccgggaucaauaugugcacccugaucgccauggaucugggcgagaugugcgacgacaccgugacauacaagugcccucacaucacggagguagaacccgaggacauagacugcuggugcaaccuuacgagcacgugggugacuuacggaacguguaaccaggccggcgagcaucggcgagacaagcgguccgucgcccuggcuccacacguaggcaugggucucgacacacgcacccagacauggaugagcgccgagggugccuggcgacagguggagaagguggaaacgugggccuugcgccauccgggauuuaccauccucgcgcuguuccucgcccacuauaucgggacgagccugacccagaaggugguaaucuucauucugcuuaugcugguaacacccagcaugaccaugaggugcgugggggugggcaaucgggacuucgucgagggccuguccggggccaccuggguggacgugguccucgaacauggugggugcgugacgacgauggccaaaaacaagccaacccuagacaucgagcugcagaagacggaggcuacccagcuagcgacccuacggaagcuauguaucgagggaaagaucaccaacaucaccaccgacagccggugccccacgcagggcgaagcuacccuuccggaggagcaggaccagaacuacgugugcaagcacacauacguggaccgggggugggggaaugggugcggcuuguuugggaagggcucccugguuaccugugccaaauuucagugccucgagcccaucgagggaaaggucguccaguacgagaaucucaaguacacggucaucauaaccgugcacaccggggaccagcaccaggucggcaacgagacucaaggggucacggccgagaucacgccccaggcuaguaccacagaggcaauccugcccgaguaugggacuuuggggcuggaaugcuccccgaggacggggcuugauuuuaacgagaugauccuguugaccaugaagaacaaagcauggaugguucaccggcaaugguucuucgacuuaccacuccccuggaccagcggcgcaacgacggaaacccccacguggaaccgcaaggaacugcuaguuaccuucaagaaugcucaugccaagaagcaggaagucgucgugcuugggagucaggagggcgcgaugcacacggcucugaccggggcuaccgagauacagaacagcggcgggaccuccaucuucgccggccaccuuaaguguaggcucaagauggacaagcuggagcugaagggcaugagcuaugccauguguaccaacacguucgugcucaagaaggagguaagugaaacccaacacgggaccaucuugaucaagguggaguacaagggcgaggacgugccguguaagaucccuuuuuccacggaggacggccagggcaaggcgcacaacggccgccugaucaccgcuaaccccgucgugaccaagaaagaggagcccgugaauauagaggccgagccccccuucggggaguccaacaucgucaucggcaucggggacaacgcucucaagaucaacugguacaagaagggcucaucgauagggaagauguuugaggcgaccgcgcgaggcgcccgcaggauggccauccucggcgauaccgcaugggauuucgguucugugggcggggugcugaacucucugggcaaaaugguacaucagauauucgggucggcguacaccgcccucuucagcggcgucuccugggugaugaagaucggaaucgggguccuguugaccuggauuggccucaacagcaagaacaccagcaugagcuucuccuguaucgccaucggcauuauaacgcucuaucugggcgcgguggugcaagccgacaugggaugcgucaucaacuggaagggcaaggagcucaagugcggauccgggauuuucgugacgaacgaggugcacaccuggaccgaacaauacaaguuccaggcggacucccccaagcgcuuggcuacggccauagcuggcgcgugggagaacgggguuugcgggaucagauccaccaccaggauggagaaccugcucuggaagcaaaucgcgaacgagcugaacuacauccugugggaaaauaacaucaagcugacaguuguggucggggacauuaucggcgugcuggaacaagguaaacgcacgcugacuccccagccgauggaguugaaguacuccuggaagaccuggggcaaggcgaaaaucgugaccgccgagacacagaacagcucauuuauaaucgacgggcccaacacgcccgagugccccagcgucucccgugccuggaacguuugggagguggaggauuacggcuuuggggucuucacaaccaacauuuggcugaaguuacgcgagguguacacccagcucugcgaccaccgacugaugagcgcggcugucaaagacgagcgcgccgugcacgccgauaugggcuacuggaucgagagccagaagaacgguaguuggaagcuggagaaggccucccucauagaaguuaagaccugcaccuggccaaaaagccauacuuuauggagcaacggaguguuggaguccgauaugaucauccccaaaagccuggcggggcccaucucccagcacaaccaccggccgggcuaccacacccagacagcagggcccuggcaccucggcaagcuagaguuagacuuuaacuacugcgagggcaccaccgucgugaucacugagaacugcgggacgaggggccccagccugcggaccaccaccgugucagggaaauugauccacgaauggugcugccgcagcugcacgcugccgccccugcgauauaugggcgaggacggcugcugguacgggauggagauccgccccaucucggagaaggaggagaacauggugaagagccuaguuuccgccggcuccgggaagguggauaacuucacaaugggcguccugugcuuggccauccuguucgaggaggugaugcgggggaaguuuggcaagaagcacaugaucgcugggguguucuucacuuucguccuccugcugaguggccagaucaccuggcgcgacauggcgcacacccucaucaugaucggcuccaacgccuccgaucggauggggaugggcgugacauaccuggcccugaucgccaccuucaagauccagcccuuccucgcacugggguuuuuccuccgccggcucaccagcagggagaaucugcugcucggcguaggccuagcgauggcgaccaccuuacaacuccccgaggacaucgagcagauggcuaacgggaucgcccugggccugauggcucuuaagcugauuacgcaguucgagaccuaccagcuguggacggcacucaucagucugaccugcaguaacaccaucuucacccugacggucgccuggcggaccgccacauugaucuuagccgggguuagcuuacucccagucugccgcuccucuuccaugcgcaagaccgacuggcugccaauggcggucgccgccaugggcgugccgccccugccgcucuucauauucagccucaaggacacgcugaagcggcgcucguggccacuaaacgagggggucauggccguaggccucgugucgaucuuagccuccucccuccuacggaacgacgucccuauggcgggaccccuuguggccggcggccuucugaucgccuguuacgugaucacagggaccucagccgaccugaccgucgaaaaggccgcggacauaacaugggaggaggaggccgagcagaccggcgugucacauaaccuaaugaucacgguggacgacgacgggaccaugcgcauaaaggaugaugagacggagaacaucuuaacgguccugcucaaaaccgcccugcucauagucuccgggaucuucccguacucaauccccgccacccuccugguuuggcauaccuggcagaagcaaacgcagcggagcggcguccugugggacguaccguccccgcccgagacgcagaaggccgagcucgaggagggcguguaccgcaucaagcagcaggggaucuucgggaagacacaggucggcgugggggugcagaaggagggcgucuuucacaccauguggcacgugacgcggggcgcggugcugacuuacaaugggaagcgccuugagcccaacugggccuccguaaagaaggaccuuaucagcuacggcggggguuggaggcugagcgcucaguggcagaagggggaggagguccaggucaucgccgucgagcccggcaagaaccccaaaaacuuccaaaccaugcccggcaccuuccagacgaccaccggggagaucggcgcgaucgcccuggacuucaagcccgggaccuccggcagucccauaaucaaccgugagggcaagguggucgggcuuuauggcaacggggucgugacgaaaaacgggggguacguuucuggcaucgcgcagaccaacgcagaaccugacggccccacccccgagcucgaagaggagauguucaagaagcguaaccugacgaucauggaucugcaccccggaucggguaaaacgcgaaaguaccuccccgcgauuguccgggaggccauuaaacgccggcugagaacgcugauccuugcccccacccgaguggucgccgccgagauggaggaggcccucaaggggcugccaauccgcuaucagacuaccgcgacaaaauccgaacauaccgguagagagaucgucgaucucaugugccacgcgacuuucacgaugcggcuucugagucccgugcgugugccuaacuacaaccuuaucaucauggacgaagcacacuucaccgaccccgcaagcaucgccgcgcggggguacaucagcacucgcguaggcaugggcgaagccgccgcaaucuucaugacggcuacgccgcccgggaccgccgaugcauuuccacaguccaaugcccccauacaggacgaggaacgggauauccccgagcgcagcuggaacuccggcaaugaguggaucacugacuucgccgggaaaaccguuugguucguuccgagcaucaaagcgggcaacgacaucgccaauugccuccggaagaacgguaaaaaagucauccaguugucccgcaaaacguuugacacggaguaccagaagaccaaguugaacgacugggacuucgugguuacaacggauauaagugagaugggcgcuaacuucaaggccgaucgggucaucgacccgaggcggugucucaagcccgugaucuugaccgacgggcccgagcgcgugauccucgccgggccaaugccagucacugcggcgagugcagcucagcggcgcggccgggugggacgcaacccccagaaggaaaacgaccaguacaucuuuacuggccaaccccuuaacaacgacgaagaccacgcccacuggaccgaggcgaagaugcuucuagacaacaucaacacgcccgaggggauaaucccggcccuguuugagccggaacgggagaaguccgccgccaucgauggcgaguaccgccugaagggcgagucgagaaaaacguucguggagcuaaugagaaggggugaucugcccgucuggcucgcucacaagguggccucggagggcaucaaguacacugacaggaaauggugcuucgacgggcaacggaacaaccagauucucgaagagaacauggaugucgagauauggacaaaggaaggcgagaagaaaaaacugcgccccagguggcuggacgcccggacuuacagugacccgcucgcccugaaggaauucaaggaguuugccgcgggccgcaagucgaucgcccuggaccugguaaccgagauagggcgggugcccucccaccuggcgcaucgcacucggaaugcccuggacaaccuaguuaugcugcacacuagcgaacacggagggcgcgccuaccggcacgcgguggaggaguugccagagacgauggagacccugcugcuguuaggccucaugauccuacucaccgggggugccaugcuuuuccucauaaguggcaaagggaucggaaagacuuccaucgggcucaucuguguuaucgccagcuccggcaugcucuggauggcugaaaucccgcugcaguggaucgccagcgcgauaguccucgaguuuuucaugauggugcuguugauucccgagcccgagaaacagcgcacgccucaggacaaccagcucgcauacguggucaucgggauccucacacuggccgcaaucaucgcggcaaacgagauggggcuccuggagaccaccaagcgggaccugggcauguccaaagagccggggguggucagccccacguccuaccucgacgucgaccugcacccagcuagugccuggacacucuacgcaguggcuaccaccgugaucacgcccaugcuccgccacaccaucgaaaauuccaccgcuaaugucagccuagccgcgauugcaaaccaggcgguugugcugaugggccucgauaagggguggccgaucuccaagauggaucuggggguccccuugcuugcgcuggggugcuauagccaagugaacccucugacccucacggcggcugugcugcugcucaucacccacuacgccauaaucggucccggucugcaggcgaaggccacccgggaagcccagaaaaggaccgccgccgggauaaugaagaacccgacgguagauggaauuaugaccaucgaccuugacccuguuauauacgacucgaaguucgagaagcagcucggccaggugaugcugcuaguccucugcgccgugcagcugcugcucaugcgcaccagcugggcccuuugcgaggcccugacccuugccaccgggcccaucacuacauuaugggaggggucccccgggaaguucuggaacacuacgaucgcggugagcauggccaacauuuuccggggauccuaccuggccggggcgggccuagccuucucuaucaugaaguccgucgggacaggcaagcggggcacugggagucagggcgagacgcugggagaaaaguggaaacguaagcugaaccaacucagccggaaggauuuugaccuguacaaaaaauccggcaucaccgagguugaccgcacggaagcgaaggagggguugaaacgaggcgagaucacccaccacgccgugagccgcggcucugcuaagcugcagugguucgucgaacgcaacauggugacgccggaggggaggguaauugaccuuggcugugggcgggguggguggagcuacuauugcgccggccuaaagaagguuaccgaggugcggggcuacacgaagggcgggcccggucacgaggagccgguacccaugucaacuuacggcuggaacaucgucaaacucaugagcgggaaggacgucuuuuacuuaccgcccgaaaagugugacacccuguugugcgacaucggcgaguccagccccucucccaccguagaggagagcagaacgauccggguucucaagaugguugagcccuggcugaagaacaaucaguucugcaucaaggugcugaacccuuacaugccuaccguaaucgagcaccucgaacgccugcagcggaagcacggcggcaugcuggugcgcaacccccuuucgcgaaacagcacgcacgagauguacuggaucucgaauggaaccgggaauaucguggccucagucaacauggucagcagacuccugcucaacagauucacgaugacccacagacggccgacgaucgaaaaggacguugaucugggcgcuggcacccgccacgucaacgcagagccugaaacacccaacauggauguuaucggggagcggaucaaacgcauaaaggaggagcacaaccugaccuggcacuacgacgacgagaacccuuauaaaacgugggcauaccacggcaguuacgaagucaaagccacgggguccgcuucauccaugaucaacggcgucgugaagcucuugaccaagcccugggacgucgugccuauggugacucaaauggcuaugacggauaccacacccuuugggcagcagagaguauucaaggagaaaguagacacccgcacuccgcggagcaugccuggcacucgccgggugaugggcauaacggcagaauggcuguggcgcacccugggaagaaauaagaagcccagacugugcacccgagaggaguuuaccaagaaggucagaacgaacgcugcaaugggcgccguguuuaccgaggagaaccagugggauagcgccaaggccgccguggaggacgaggacuucuggaaguuggucgaucgcgaacgcgagcuccacaagcuagggaaguguggcucuugcguauacaacaugauggggaagagagaaaagaagcugggcgaguucggcaaggccaaggggucucgugccaucugguacauguggcuuggcgccagauaccuggaguucgaggcccugggauuccucaaugaggaccacugguucucucgggagaauagcuacuccggcgucgagggggagggccugcacaagcucgguuacauauugagggacaucagcaaaauacccgggggcgcuauguacgccgacgacaccgcggggugggacacacggaucacagaggacgaccuccacaaugaggagaaaaucacccagcagauggacccggaacaccgacagcuggccaaugccauauucaaacucacauaccagaacaaagucgugaagguacagcggcccacccccacaggcacggucauggacaucaucucccgcaaggaccagcgcggcaguggucaggugggaacauacggccugaacaccuucaccaacauggaggcccaaauaauccgccaaauggagggcgagggugugcuguccaaggcagaccucgagaacccccaccuccccgagaagaagauaacacaguggcuggagaccaaggguguugagcgacucaaacgcauggcgaucagcggcgacgauugcguaguuaagcccaucgacgaccgguucgccaacgcccugcuagcucucaacgacauggggaagguccgcaaggauaucccccaguggcagcccuccaagggcuggcacgauuggcagcagguccccuucugcucacaucacuuccacgaacugaucaugaaggacgggcgaaagcuaguggucccaugucgcccacaggacgagcucauaggacgggcccgaauaucccagggggcgggguggagccuaaaggaaaccgccugccugggcaaggccuaugcccagauguggagccucauguauuuccaccgccgagaccugcgccuggccagcaaugccaucuguuccgcgguaccugugcacugggucccgacuucacggacgaccugguccauccacgcccaccaccaguggaugaccaccgaggacaugcucacgguguggaaccgcguguggaucgaggacaaccccuggauggaagacaagacccccgugaccaccugggaaaacguuccauaccucggaaagagggaggaucaguggugcggcucucuuaucgggcugacuucuagggcuaccugggcacagaacaucccgaccgccauccagcaaguacgguccuuaaucgguaacgaagaauuccuggacuacaugccgaguaugaagcgauuccgaaaggaggaggaguccgagggugccaucugguga

SEQ ID NO: 25869 - RNA, 9873 nt, Artificial Sequence
  derived and/or modified CDS sequence (opt11) from DENV-3__JF937639__SS-prME
accucacucugccugaugaugaucuugcccgccgcucuagcguuccacuuaaccagccgcgacggcgagccccgaaugauugucgggaagaacgaacgcggcaagagccugcucuuuaaaacagcuucggggauaaauauguguacucucauugccauggaucugggcgagaugugcgaugauacggucaccuauaaaugcccccacauaaccgagguagagcccgaagauaucgacuguuggugcaaccucaccucaacuugggugaccuaugggacuugcaaccaggccggugagcaccggcgcgacaagagguccguagcccucgcgccgcacguggguaugggccuggacacccgcacccagacguggaugucggccgaaggggccuggcgccagguagagaaaguagagacgugggcccugcgccacccgggguuuacuauccucgcacuuuuccuggcgcacuauaucggcacgucccucacgcagaagguuguaauauucauccugcugaugcuugucacgcccagcaugaccaugcggugcguuggggugggcaaccgcgacuucgucgaaggacuguccggugcgacguggguggacguggucuuggaacacggcggcugcgucacuacaauggcaaagaacaagccgacccucgacauugagcuccagaagaccgaggccacccagcuggcgacucuccggaagcuguguaucgagggcaagaucaccaacauaaccaccgauagccgcugcccuacgcaaggugaggccacacugccggaggagcaggaccaaaacuauguuugcaagcauaccuacgucgaccgggggugggggaaugggugcggccucuucgggaaggggucccuggucacaugcgccaaguuucagugccuggagccaauugagggcaagguagugcaguaugagaacuuaaaguacacggucaucaucaccgugcacacaggggaccagcaucaggucggcaacgagacccagggugugacggccgagaucacgccccaggccagcaccaccgaggcgauccugcccgaguacggcacccuggggcucgagugcucuccgcgcaccggccuggacuuuaacgagaugauucuccucaccaugaagaacaaggccuggaugguccacagacaaugguucuucgaccugccccugcccuggacuucuggcgccaccacggaaacccccacuuggaaucgcaaggagcuccucguuaccuucaaaaacgcccacgccaagaagcaagaagugguagugcuagggucucaggagggcgcaaugcacacagcgcugaccggagccaccgaaauccagaacagcggcgguacuucaaucuucgccggccaccugaagugccgguuaaaaauggacaagcuugaguugaagggcaugaguuacgccaugugcacgaacacauucgugcugaagaaggaggucuccgagacccaacacgggaccauccucaucaagguggaguacaaaggggaggacgccccgugcaagauccccuucagcacagaggacgggcagggcaaggcccacaauggcaggcugaucaccgccaacccgguggucacuaaaaaggaggagcccgugaacaucgaggccgaaccacccuucggugagagcaacauuguaauaggaauaggggacaaugcguuaaagaucaacugguacaaaaaggggucaaguaucgggaagauguucgaggcaacugcacgcggugcccgccgaauggccauccugggggacacggcgugggauuucggguccgucgguggggugcucaacagccuuggcaagaugguccaccagauuuucgggucggccuacaccgcccuguucagcggcgucuccugggucaugaagaucggcaucgggguucugcugaccuggauaggccugaacagcagaaacacuuccaugagcuucucuugcaucgccaucgguaucauuacccucuaccuuggcgccgucgugcaggcggacauggggugcgugaucaacuggaaaggcaaggaacugaaaugcgguagcgggaucuucgucacgaacgagguccacaccuggaccgagcaguacaaguuccaggcugacucgccuaaacgccuggcaacagcaaucgcaggcgcgugggagaacggaguauguggcauacgcagcacgacccgcauggagaaccugcuguggaagcaaaucgccaacgagcucaacuacauccugugggagaacaacaucaagcugaccgucgucgugggggacaucaucggcguccucgagcaagguaagcggacguugacuccccagccgauggaguuaaaguacuccuggaaaaccugggggaaggcuaaaaucguuaccgccgagacgcagaauucuuccuucauaaucgacggcccgaacaccccugagugccccagcguaagucgcgcuuggaaugucugggagguugaggacuaugguuuugggguuuucaccacgaacaucuggcucaaacugcgggaagccuacacccagcuuugcgaccaccgcuuaaugucagccgccguuaaggacgagcgggcugugcacgcagauaugggcuacuggaucgaaucacagaagaacggguccuggaagcuggagaaggccagucugauugaagucaaaacuugcaccuggccgaagagccacaccauauggucgaacgguguccucgaguccgacaugaucaucccaaaaucgcuggccgggcccauuucccagcacaaccaucgccccgguuaccacacucagacggccgggcccuggcauuuaggcaagcucgaguuagacuucaacuacugugaaggcaccacgguggugaucaccgagaacugcgggacgcgggggccgagccuccgcaccacuacugucucugggaagcugauccacgagugguguugccgcuccugcacucuccccccgcuucgcuacaugggcgaggacgggugcugguauggcauggagauacggcccaucuccgagaaagaggagaacaugguaaagagccucgucucagccggcagcggaaaggucgacaacuucacuaugggcgugcucugccuggcgauacucuucgaagaggugaugcgagggaaauucggaaaaaagcauaugaucgcgggggucuuccugaccuucgugcugcuccuguccggccaaauuaccuggagagacauggcacauacgcucaucaugaucggcucaaacgccagugaccgcaugggaaugggcguaaccuaccucgcccugaucgcgaccuucaagauccagcccuuccuggcccucggauucuuccugcgcaagcugacaagccgcgagaaucuccugcugggcgucggucuggccauggccacgacccuccagcugcccgaggacauagagcaaauggcgaaugggaucgccuuaggccugauggccuuaaagcucauaacccaguucgagaccuaccagcuguggacggcuuugaucagccuuaccugcucgaacaccauuuucacccugacuguggccuggcggaccgcgacacuuauucucgccggggucagccugcucccugucugccagucuucauccaugcgcaaaaccgacuggcuccccauggccguggcggcaaugggcgugccccccuugccccuguucauauucagccucaaggacacgcucaaacgcaggagcuggccgcugaacgaaggggugauggccguaggccucgucagcauccuggccuccagccugcuccgcaaugacgugccgauggccggaccccucguggccgggggccugcugaucgccugcuacgucauaaccgggaccuccgcggaucugaccguggagaaggccgccgacaucacuugggaggaggaggccgaacaaaccgguguaucacacaaccugaugaucacaguggacgaugaugggaccaugcggaucaaagacgacgagaccgaaaacauucucacuguucugcugaagaccgcguuguugaucguguccggcaucuucccguacagcaucccugcgacccuccuaguuuggcacacuuggcagaagcaaacgaagcgcuccggcgugcuuugggaugugcccucaccgcccgagacgcagaaagccgaacuggaggagggcguauaucggaucaagcagcaaggcaucuuuggaaaaacccaggugggcgugggaguccaaaaggagggcguauuccacacaauguggcacgucacccgaggcgcgguucucaccuauaacggaaagcggcuggagcccaacugggccagcguuaagaaagaccugaucagcuacggcggggguuggcgucuaagcgcgcaauggcagaaaggggaggaaguccaagucaucgccguggagccaggcaaaaaccccaagaacuuccagaccaugcccggcacauuccagacgaccacuggagaaauuggagccauagcgcuggacuucaagcccgggacuagcgguagccccaucaucaaccgggagggcaaggugguugggcuguacggcaacggugugguuacaaagaacggaggguaugucucggggaucgcccagaccaaugccgagccggauggacccacccccgagcuggaggaggagauguucaagaagcgcaaccucaccauuauggaccugcaccccgggagcggcaaaacgcggaaguaucuccccgccauugugcgcgaggccauuaaacggcgguuacggacgcugauccuggcacccacccgugugguggcugcggaaauggaggaagcccuuaagggccuacccauccgguaccagaccaccgcgaccaaguccgagcacaccggccgcgagauuguggaccuuaugugccaugccaccuuuacgaugagacuccugagccccgugcgcgucccgaacuacaaucugaucaucauggacgaagcccacuuuacagaccccgcguccaucgccgcgcgggguuauaucagcacccgcguggguaugggcgaggcagcggcuauauuuaugacagcaacgccgccuggaaccgccgacgccuucccacaauccaaugcgcccauacaggacgaggaacgagacaucccggagaggucguggaacuccggcaaugaguggauuaccgacuucgcugggaaaacagugugguucguccccagcauaaaggccgguaaugacaucgcgaacugccuuaggaaaaacgggaaaaaggugauccagcucucccgcaagacguucgacaccgaguaccagaagacaaagcugaacgacugggacuucguggucaccacggauaucucugagaugggugccaacuucaaggcugaccgcgugauagacccaagacgcugucucaaaccugugauccucacggacggccccgagcggguaauacuggccgggcccaugccugugacagccgcguccgccgcgcagcgccggggccgcgugggucggaacccucagaaggaaaacgaccaguacaucuucaccggccagccccucaacaacgacgaggaucaugcccacuggacagaggcaaagaugcugcuggacaacaucaacacccccgaggggauaauaccggccuuauuugagcccgagcgcgagaaaagcgcugccaucgacggcgaguacagacugaagggggagucacggaagaccuuugucgaguuaaugcggcgcggagaucucccuguguggcuggcccacaagguugcuucugaggggaucaaguauacagaucguaagugguguuuugacggccagcgcaacaaucagauccuggaagaaaacauggaugucgagaucuggaccaaggagggcgagaagaagaaguugcgaccccgcuggcuggaugcacgcacguacuccgacccccuggcccucaaggaguucaaggaguuugccgccggccgcaaaagcauagcccuggaccucgugaccgagaucgggcgcguccccucccaucucgcccaccggacucgaaacgcguuggauaaccugguaaugcuccauacuagcgagcauggugggcgagccuaccgacacgccguggaggagcuuccugagaccauggagacucuauuacugcugggccucaugauccugcuaaccgggggcgccaugcuguuucugaucucugguaaggguaucggcaagaccuccauugggcugauaugcguuauugcaagcuccggcaugcuauggauggcagagauccccuuacaguggauugccagcgccaucgugcuggaauucuuuaugauggugcucuuaauuccugagccggaaaagcagcgaaccccgcaggacaaucagcuugccuacgucgugaucgggauacucacacuggccgcaaucaucgcggcuaacgagaugggccugcuagagaccaccaagcgcgaucugggcaugucaaaggagccgggaguggucagccccacuuccuaccuggacgucgaucugcacccagccagcgcguggacccuguacgcaguggcaaccacuguuaucacccccaugcuccggcacacgauugagaacucgaccgcgaauguuucccucgccgcgaucgccaaccaagcuguuguccugaugggccuggacaaaggguggccgauauccaagauggaccuuggcgugccccuccuggcgcucgggugcuacagccagguaaacccccuaacccugacggcagcgguccuccugcugauuacccacuacgccauaauaggacccggccuacaggccaaggccacuagagaggcccagaaacggaccgcggccgggauaaugaagaauccgacgguggauggcaucaugacuaucgaccuggacccagugaucuacgacuccaaauucgagaaacagcuggggcaggucaugcuccugguauuaugcgcggugcagcuccugcugaugcgaaccucuugggcccucugugaagcgcugacccuagcaacaggccccauuaccacccugugggaaggcuccccugggaaguucuggaacaccacgaucgccgucagcauggcaaacauuuuccggggguccuaccuggcaggggcugggcuggcauucagcaucaugaaguccgucggaaccggaaagcgcggcaccgggagccaaggcgagacucucggagagaaguggaagaagaagcugaaccagcuaagcaggaaagacuucgaccucuacaagaaguccggcaucaccgagguggaccguacugaggcuaaggaggggcucaagcggggcgaaaucacccaucacgcggucagccgcggcucugccaagcugcagugguucguggagcggaacauggucauaccggaggggcgcguaaucgacuugggcugcggccggggcggcuggagcuauuauugcgcaggccugaagaaggugaccgaagugcgcggcuacacuaaaggcgggcccggucaugaagagccgguaccgaugucuacguauggcuggaauaucgugaaacugaugucuggcaaagacguguucuaccuuccucccgagaaaugcgacacccuccugugugacauaggugaguccuccccaucccccacggucgaggagagccgcacaauccgggugcucaagaugguagagccguggcuaaagaacaaccaguucugcaucaagguccugaaccccuacaugccuacggugaucgaacaccuggaacgccuccaacggaagcacggcgggaugcuagugcguaacccucugucccgaaacucaacgcaugaaauguauuggaucuccaauggcaccgggaauaucgucgccucagugaacauggugucccguuugcugcugaaucgauucacgaugacccaccgacggccgacaauagagaaggacguagaccugggcgcaggcaccagacacgugaacgccgaacccgagacccccaauauggaugugaucggggagcggauaaagcgcaucaaggaggagcacaauucuacauggcauuaugacgaugagaacccguauaaaacuugggccuaccauggcuccuacgaggucaaggcgaccgggagcgccuccagcaugauaaacggcguugugaagcugcugaccaagccuugggacgucgugccaauggucacgcagauggccaugacagacaccacccccuucggccagcagcggguauucaaggaaaaaguggacacucgcacaccgcggucgaugccugggacaaggcgggugaugggcauaaccgccgaguggcuguggcgcacguuggggaggaacaagaagccucgccugugcacacgcgaagaguucaccaagaaggugcggacgaacgcggccaugggugccguguucaccgaggaaaaccagugggacucggcaaaggcggcggucgaggacgaggacuucuggaagcucguggaccgcgagcgcgagcugcacaagcuggggaagugcggaagcugcguuuacaacaugaugggcaagcgcgaaaagaaacuuggcgaguucggcaaggccaaaggcucuagagccauuugguacauguggcugggcgcccgcuaccuggaguuugaggcccucggguuccucaaugaggaccacugguucagccgggaaaacuccuacagcggggucgagggggagggccugcacaagcucggcuacauccugcgcgauaucucuaagaucccuggaggcgcgauguacgccgacgacacggccgguugggacacccgaaucaccgaagacgaccugcacaacgaggagaagaucacucagcagauggacccggagcaccgccagcucgcaaacgcaaucuuuaagcugaccuaccagaauaaaguggugaagguccagcggccaaccccuacagggaccgugauggauauaauuagccgcaaagaucagcggggcuccggccaggugggaacguacgggcugaacacauucacaaacauggaggcgcagcucauccgccagauggaaggcgaggggguacugucgaaggccgaccuggagaacccccaccuuccggagaagaagauuacacaauggcuggaaacgaaaggcguugaaagacugaagagaauggccaucuccggggacgacugugucgucaaacccaucgacgaucgguucgccaacgccuuauuagcgcugaacgauauggggaagguccgcaaagacaucccucaguggcagccuagcaaaggcuggcacgacuggcagcaggugccauucugcucacaccacuuccacgagcuuaucaugaaggacgggcggaagcuggucgugccuugccgcccccaagaugagcugauaggccgggcgcgcaucagccagggggccgggugguccuugaaagagaccgcaugccugggcaaagcguaugcccagauguggagccugauguacuuccaccggcgggaccuccgccuggcuaguaacgcuauuugcagugccgugcccgugcacuggguaccgaccucccggaccacauggagcauccacgcgcaccaccaguggaugacuacagaagacaugcuaaccguguggaacagggucuggaucgaagauaacccuuggauggaggacaagacgccugugacgaccugggagaacgugcccuaucucgggaagcgcgaggaccaguggugcggcagccugaucgggcugacgucgcgcgccacgugggcccagaacaucccgaccgccauccagcagguccggagccugauaggcaacgaggaguuccucgacuacaugcccaguaugaagcguuuccggaaggaggaggaaagcgagggggcgaucugguag

SEQ ID NO: 25870 - RNA, 9873 nt, Artificial Sequence
  derived and/or modified CDS sequence (opt11) from DENV-3__JF937627__SS-prME
accagccuuugcuuaaugaugauccugcccgccgcccuggcguuccaccucaccagccgugauggggaaccccggaugauuguggggaagaacgagcgcgguaagagccugcuguucaagaccgccuccgggauuaacaugugcacccucaucgccauggaccugggggagaugugcgacgacaccgucaccuacaaguguccccacaucaccgagguggagcccgaggacauugauugcugguguaaccugaccucgaccugggugaccuacgggaccugcaaccaagcuggcgagcaccggcgggauaagcgcucggucgcucucgcgccccaugugggcauggggcuggacaccaggacucaaaccuggaugagcgcugagggcgccuggagacagguggaaaaggucgagaccugggcccugcgccaccccggguucacaauccucgcgcuguuucuggcccacuacaucggcaccuccuuaacacagaaggugguuaucuucauccugcucaugcucgucacacccagcaugaccaugcguugcguuggggugggcaauagagacuucgucgagggccucuccggcgccacauggguggacgugguccuggagcacggcgggugugugacuacgauggccaagaacaagccaacucuugacaucgaauugcagaagaccgaagccacccaguuagccacgcuccggaagcugugcaucgagggcaagaucaccaacaucaccaccgacagccgcugccccacgcagggcgaggcuacucugccugaggagcaagaccaaaauuacgugugcaagcacacuuacgucgaccgggggugggggaacggguguggccucuuugggaagggcucccugguuaccugcgcaaaauuccagugccuggagcccaucgaggguaaagugguccagcaugagaaccucaaguacaccgugaucaucaccguccauaccggcgaccagcaucaagucgguaaugagacucagggggugaccgccgagaucacgccccaggccucgaccaccgaagcuauuuugccggaguauggcacccugggacucgagugcuccccgcgcacgggccuggacuucaaugagaugauucuacugaccaugaaaaacaaggccuggaugguccaccggcagugguuuuucgaccugccccuccccuggacuagcggcgccaccacggaaacccccacuuggaaccgaaaggagcuccuggugaccuucaagaacgcccacgccaagaagcaggaggugguggugcuggguagccaagagggcgcgaugcacaccgcccuaaccggagccaccgagauccagaacagcggcgggaccuccauuuucgccggccaccugaagugccggcugaagauggacaaauuagagcugaaaggcaugucguacgccaugugcacaaacaccuucgugcugaagaaggaggucuccgagacccagcacgggaccauacuuaucaagguggaguacaagggggaggacgugccgugcaagauccccuucuccacugaggacggccagggcaaggcgcacaacggccgacugaucaccgcgaacccagucgugacuaaacgggaggagcccgugaacaucgaggccgagccgcccuucggugagagcaacauaguaaucgggaucggggacaacgcccugaagaucaacugguauaagaagggcucaagcauugggaagauguucgaggcgacggcccgcggcgcucgccgcauggccauucugggagacacggcuugggacuucggcuccguaggaggggugcucaacagccugggcaagaugguucaccagaucuuuggguccgcguacacggcccuguucagcgguguauccugggugaugaagaucggcauagggguccuccugacauggaucggcuugaacagcaagaacaccuccaugaguuuuuccugcaucgccaucgggaucaucacgcucuaccuaggggccgucgugcaggccgacaugggguguguaaucaacuggaaaggcaaggagcuaaagugcggcucagguauuuucgugaccaacgaggugcacaccuggaccgagcaauacaaguuccaggcggacuccccuaagcgccucgcuacggcgaucgccggggccugggaaaacggggucugcggcauccggucuacgacccguauggaaaaucugcuauggaagcaaaucgcgaacgagcucaacuacaucuuaugggagaacaacaucaagcugaccgugguagucggggacaucaucggggugcucgagcagggcaagcggacgcugacgccccagccgauggagcugaaguacuccuggaagaccuggggaaaggccaagaucgucaccgccgagacgcagaacagcuccuucaucaucgauggccccaacaccccugagugccccagcguauccagagcauggaacguaugggagguggaggauuacggguuuggcgucuucaccaccaacaucuggcucaaguugcgggagguguacacccagcuaugcgaccaccgccugaugagcgcggccgucaaggacgagcgggccgugcacgccgacaugggcuacuggaucgagucucaaaagaauggguccuggaaacuugagaaggcuucacugaucgaagugaagacguguaccuggccgaagucucacacccuauggagcaacggcgugcuggaguccgacaugaucauccccaagagccuggccgggcccaucucccaacacaaccaucguccgggcuaccauacccagacggccggucccuggcaccugggcaagcuagagcuggacuucaacuacugugagggaaccaccgucgugaucaccgaaaacugcgggacgcguggaccaucccuccgcacaaccacagugucaggaaagcucauccacgaguggugcugccggagcugcacgcugcccccgcuccgcuacaugggcgaggacggguguugguacggcauggagauccguccaaucuccgagaaggaggagaacauggucaagagccuggugucagccggcagcgggaagguggacaacuucaccaugggcgugcugugccucgcaauccuguuugaggaagugaugcgggggaaguuuggcaaaaagcauaugaucgccggcguuuucuucaccuucguccugcuccuguccggccaaaucaccuggcgggacauggcgcacacguugaucaugaucggcagcaacgcguccgaccgcaugggaaugggcgugacuuaccucgccuuaaucgccaccuucaagauccaacccuucuuagcacucggguuuuuccugcggaagcucaccagcagagagaaucugcugcugggcgugggacucgcgauggccacgacacugcagcuacccgaggauaucgaacagauggccaacgggauagcccuuggccugauggcgcuuaagcuaaucacccaauucgaaaucuaccagcuguggaccgcccugaucucucucacgugcuccaacaccauuuucacccugacugucgccuggcggacggccacccugauccucgccgggguaagccugcugccgaugugccaguccagcucgaugcgcaagaccgacuggcucccaauggcggucgcggcaaugggugugccgccccucccccuguucaucuucagccucaaggacacccugaagcgccgguccuggccccugaacgagggggugauggcggucggccuggucagcauccuggccaguagccugcuccgcaacgacgugcccauggcgggccccuuggucgccgggggccugcugaucgccugcuacgugaucacggggaccuccgccgacuugaccguggaaaaagccgcggacaucaccugggaggaggaagcagagcagacgggcgucucacacaaucugaugaucaccgucgacgacgacgguacaaugcggauaaaagacgacgaaaccgagaacauccucacagugcugcugaaaacggcucuacugaucgucuccggaaucuucccguacagcauucccgccacccuguugguguggcacaccuggcagaagcagacccagcgauccggcgugcugugggacguacccagcccgcccgaaacgcagaaggccgaacuggaagagggcguguaccguauaaagcaacagggcaucuucgggaagacccaagugggcgucggggugcagaaggagggcguguuccacaccauguggcacgucacccgcggcgcggugcuaacguacaacgggaagcggcuggagcccaacugggccuccgugaagaaggaccugauaagcuacggcgggggcuggcgccucuccgcucaguggcaaaagggagaggagguucaggugaucgccguagaacccggcaagaacccuaagaauuuccagaccaugcccggcaccuuccagaccacgacaggggagaucggcgccauagccuuggacuucaagcccgggaccagcggcagccccaucauuaaucgggagggcaaggucguggggcuguacgggaaugggguugucaccaagaacggcggguacguguccggcaucgcgcagaccaacgccgagccggauggccccacccccgagcuggaggaagagauguuuaagaagaggaaccucaccaucauggacuuacaccccgggagcggcaaaacucggaaguaccucccggccaucgugcgcgaagcgaucaagcgacgcuugaggacgcugauccuggcccccacccgcgucguggccgccgagauggaggaggccuugaagggacugccaauacgguaucagaccaccgcgacgaaguccgagcacaccggccgcgagauuguggacuugaugugccaugccacuuuuaccaugcggcuccugagcccaguccgcgugccgaacuacaaccugaucaucauggaugaggcccacuucacggaccccgcuuccauagccgcgcggggauacaucuccacccgcgucggaaugggggaggccgccgccauauucaugaccgcgacgccacccgggacggccgaugccuucccgcaguccaacgcucccauacaggacgaggagcgcgacauacccgagcgcagcuggaacuccgguaaugaguggaucaccgacuucgccgggaagaccguaugguucgugcccucgauaaaggcgggcaacgacaucgccaacugccuccgcaagaacgggaagaaggugauccagcugucccggaagaccuucgacacggaguaccagaaaaccaagcugaacgacugggacuuugucgugaccaccgacaucagcgagaugggcgccaacuucaaggccgaucgcguaaucgacccccggcgcugcuugaagcccgucauccugacggacggcccugagagagugauccuugccgggcccaugccggugaccgcggcguccgccgcccagcgccgggggcgcgucggacggaacccccagaaggagaacgaccaguacaucuucaccggccagccccucaacaacgacgaagaccaugcccauuggaccgaggccaagaugcugcuggauaacaucaacacucccgaggguaucaucccugcccucuucgagccagagcgcgagaaauccgccgccaucgauggcgaguaccgccugaagggcgagucccgcaagacguucguagagcugaugcggcgcggagaccuacccguguggcuggcacacaagguagccagcgagggcaucaaguacacagaucguaaauggugcuucgacgggcaacgcaacaaccagaucuuggaggagaauauggacguggagaucuggacgaaggagggagagaagaagaagcuccggccacgcuggcuggacgcccguaccuacuccgacccgcuggcccucaaggaguucaaggaguucgcagcgggccgcaagucgaucgcccuugaccuggucacggagaucgggcgcgugcccucccaccuagcccaccggacucgcaaugcgcuggacaaccuggucaugcuccacaccagcgaacacggcgggcgggccuaccgccaugcggucgaggagcugcccgaaacgauggagacgcugcuccugcuuggccuaaugauccugcugaccgggggcgccaugcuguuccugaucagcggcaaggguaucggcaaaaccucgaucgggcugauuugcgugauugccagcuccggcaugcucuggauggccgagaucccacugcaauggauugccagcgcuaucgugcuggaguucuucaugauggugcuccugauccccgagccugagaagcagcgaacgccccaggacaaucagcuugccuacguggugauaggaauacucacucuggccgccaucaucgccgcuaacgagauggggcugcucgagaccaccaaacgcgaccugggcaugagcaaagaaccgggggucgugucgcccaccuccuaccuggacguugaccuccaccccgccucagcauggacgcuguacgccgucgcgacaacggugaucacccccaugcuccggcacacuaucgagaacuccaccgccaaugucagcuuggcagccaucgccaaccaagcggucgucuugaugggccuggauaagggguggccgaucuccaagauggaccucggcgugcccuugcuggccuuagggugcuacagccaggucaacccccugacccugacggccgccgugcuccugcuaaucacgcacuacgcgaucaucggcccuggucuucaggcaaaagccacccgcgaggcccagaagcggaccgccgccgggaucaugaaaaacccgaccguggacggcaucaugacgaucgaccuggaccccgucauuuaugacuccaaauucgagaagcagcugggccagguaauguuacuugugcugugcguagugcagcuccugcucaugcgcaccagcugggcccucugcgaggccuugacccucgcgacuggccccaucacgacccucugggagggcucccccgggaaguucuggaauaccaccaucgccgugagcauggcaaacaucuuucguggcucguaccuggccggggccggcuuggccuucagcaucaugaaguccgucgggacggggaagcgaggaaccgggagccagggcgagacccucggagagaaguggaagaagaagcugaaccagcucagccgaaaggacuucgaucuuuacaagaaauccggcaucaccgagguggacaggacagaggccaaggaggggcugaagcggggcgagauaacgcaccacgcugugagucgcggauccgccaagcugcagugguuugucgagcggaacauggugaucccggaagggcgcgucaucgaccucggcugcggacgaggaggguggagcuacuacugcgcgggccugaagaaggucaccgaggugcgcggcuacaccaagggcggccccgggcacgaagaacccguucccauguccaccuacggcuggaacaucgucaaacugaugagcgggaaggacguguucuaccucccgcccgagaagugcgacacgcugcugugcgacauaggcgagucuucccccucccccaccguggaagagagccgcacaauccggguucucaagauggucgagccauggcucaagaacaaccaguucugcaucaagguguuaaaccccuacaugcccaccgucaucgagcaccuggagcgccuccagcggaaacacggcggaaugcugguccgcaacccgcugagccggaauagcacgcacgagauguacuggaucuccaauggcacgggcaacaucguugcaagugucaauauggugucccgcuugcuccugaaccgguucaccaugacccaccgcagaccgacgaucgaaaaggacgucgaccucggagccggcacccgccacgugaaugcggagcccgagacccccaacauggacaucauuggggagcggaucaagcgcauaaaagaggagcacaauagcaccuggcacuacgacgacgagaacccguacaaaacgugggccuaccacggcuccuaugaggugaaggcgacggggagugccagcagcaugaucaacggcguggucaaacugcugaccaagccaugggaugugguccccauggugacccagauggccaugacggauacaacacccuucgggcagcagaggguguucaaggagaaggucgauacccgcacgccgcggagcaugccaggcacacgccgggucaugggaaucacggcggaauggcucuggcggacccuggggcggaauaagaagccccgccuaugcacgcgugaagaguucaccaagaaagugcggaccaacgccgcgaugggggccguauucaccgaggagaaccagugggacuccgcuaaagccgcgguggaggaugaggacuucuggaagcucguuaacaaggagcgugagcugcacaagcucgguaagugcgggagcugcgucuacaacaugauggggaagcgggagaagaagcugggcgaguucggcaaggccaaggggucccgcgcuaucugguacauguggcuaggugcgcgguaccucgaguuugaggcucucggguuucugaacgaggaccacugguucagccgcgaaaauuccuacagcgguguggagggggagggccugcacaaacuuggcuacauccugcgggauaucucgaaaauccccgggggcgccauguacgccgacgacacggcagggugggacacccguaucaccgaggacgaccugcauaacgaggagaagaucacccagcaaauggauccggagcacaggcaacucgcgaaugccaucuuuaaguugacguaucagaacaagguggucaaggugcagcgccccacccccaccggcaccgugauggacaucaucagccggaaggaccagcgcggcucggggcaagucggcaccuauggguugaauacguucaccaacauggaggcccagcucauaagacagauggagggcgagggugugcugagcaaggccgaccuggagaacccccaucugcccgagaagaagaucacccaguggcuggagaccaagggcguagaacgccugaagcggauggccaucuccggcgacgacugcgucgugaagcccaucgacgaccgcuucgcgaacgccuugcuugcccucaacgacauggggaaggugaggaaggacaucccccaauggcagccaagcaagggcuggcacgacuggcaacaggugcccuucugcucccaccacuuccacgagcucaucaugaaggaugggcgcaagcugguggugcccuguaggccccaggacgaacugauuggacgugcccggaucagccaaggugcuggguggucccucaaggagacggcgugccugggcaaggcguacgcccagauguggagccugauguacuuccaccgccgcgaccucagacuggccuccaacgcgaucugcuccgccguccccgugcacugggugccgaccagucgcacuaccuggagcauucaugcucaucaucaguggaugacgacggaggauaugcugaccgucuggaaccggguguggaucgaggacaaccccuggauggaggacaaaacccccgugacgacgugggagaacguccccuaccucgguaagcgugaggaucaauggugcggcagccugaucggucugaccucccgggccaccugggcacagaacaucccgacggcgauccagcaaguccgcagccuuaucggcaacgaggaguuccuggacuacaugccuuccaugaaacgguuccguaaggaggaggagucugagggggccaucugguga

SEQ ID NO: 25871 - RNA, 9873 nt, Artificial Sequence
  derived and/or modified CDS sequence (opt11) from DENV-3__KF973476__SS-prME
accagccucugccuuaugaugauccugcccgccgcacuggcguuucaccucaccagccgugacggcgaaccccgcaugaucguggggaaaaacgaacgggguaagagcuugcuuuucaagaccgcgucagggaucaacauguguacucucaucgccauggaccugggcgaaaugugugacgacaccgugacguacaagugcccgcacaucaccgaggucgagccggaggacaucgacugcuggugcaaucugaccaguaccugggugaccuacgggacaugcaaccaggcgggcgagcacaggcgagacaagcgguccguggcguuagcuccccacgugggcaugggguuagacacccguacccagaccuggaugagcgcggagggggccuggcgccagguagagaaagucgagaccugggcacuacgucacccgggguucaccaucuuggcgcuguuccuggcacacuacauaggcaccucccucacgcagaaggucgugauauucauccugcugaugcuggucacgccaucaaugaccaugcggugcgugggggugggcaaccgugauuucgucgagggccugucuggggcgaccuggguagacgugguccuggaacacggcgggugcguaacgacgauggccaagaauaagccuacccuggacaucgagcugcagaaaaccgaggcaacucagcuggcuacauuacggaaacugugcaucgaagggaagaucacgaauauuaccaccgacucucguugccccacgcagggggaggccacccugccggaggagcaggaccagaacuacgugugcaagcauacauacgucgaucgggggugggguaacgggugcggccucuuugguaaaggcagcuuagugacaugcgccaaauuccagugccuggaaccgauugaaggcaaggugguccaguacgagaauuugaaauauaccgugaucauaaccgugcacaccggcgaccaacaccaggugggcaacgagacacaaggcgugacagcugaaauaaccccucaggccuccaccacggaggcgaucuuacccgaauacgguacgcugggguuggagugcuccccgcgcaccggccuggauuuuaacgagaugaucuugcucaccaugaagaacaaggcauggaugguucaccggcaaugguucuucgacuuaccauugcccuggaccagcggggcuaccacggagacccccaccuggaaccgcaaagaacucuuagugacguuuaagaacgcccaugccaagaagcaggaagugguuguucucgggucccaggagggcgcgaugcacacggcgcucaccggggccaccgaaauccagaacagcggagggacaucuauuuucgccggucaccugaagugcagacugaagauggacaagcucgaacugaagggcaugucguacgcaaugugcacgaacacuuucgugcucaagaaggaagucuccgagacccagcacggcaccauccucaucaaaguggaauauaaaggcgaggaugugccgugcaagauucccuucagcacggaggacggacaaggcaaagcgcacaacggcaggcuaaucaccgcgaaucccguaguaacuaaaaaggaggaacccguuaauaucgaggccgagcccccguucggggagagcaauauugucaucggcauaggugacaacgcccucaagaucaacugguacaagaagggcucgagcaucgggaagauguucgaggcgacagcgaggggcgcccgccggauggccauccugggcgauacggcgugggacuucgggucugugggcgggguccuaaacagcuuagguaagaugguccaccaaauauuugguuccgcguacaccgcacuguucagcggcguuuccuggguaaugaaaaucggcaucggagugcuccucaccuggauaggccugaacagcaaaaacaccuccaugagcuuuucaugcauagccaucgggaucauuacgcucuaucuaggcgccguggugcaggccgacauggggugcgucaucaacuggaagggcaaagagcugaagugcggcuccgggaucuucgugaccaacgagguucacaccuggaccgaacaguacaaguuccaggcggacagucccaagcgucucgccacggcgaucgcaggcgccugggaaaacggggucuguggcauccgcaguaccacccggauggagaaccugcuguggaagcagaucgcgaaugagcucaacuacauacucugggagaacaacaucaagcugaccgucgucgugggggacaucaucggugugcuagagcaaggaaaacgcacgcugacgccccagccgauggaacugaaauauuccuggaaaacaugggggaaggcaaagaucgugacugccgaaacgcaaaacagcuccuucaucaucgauggccccaacacccccgagugccccagcgucucccgggcguggaaugugugggagguggaggacuacggguucggcguuuucacuaccaacauuuggcucaaguuacgggaaguguacacccagcuaugcgaccaccgguuaaugucugcugccgugaaggacgagcgcgcuguucacgccgacauggguuacuggaucgagagccagaagaaugggucguggaaauuggaaaaggccagcuugaucgaagucaagacgugcaccuggccaaaaucccacacguuauggucaaacggcguuuuagaguccgauaugaucauccccaagucccuggccggacccauaucccagcauaaccaccggccgggcuaccacacccagacggccgggccauggcacuuaggcaaguuagaguuggacuucaacuacugcgaaggcaccaccgucgugaucaccgagaacugcgggacgcgcggccccagccugcggaccaccaccguaagugggaagcugauacacgaguggugcugccgcucuugcacccugcccccgcuccgguacaucggggaggacgggugcugguauggcauggagauccgccccauuuccgagaaagaggagaacauggucaaaagucuggugagcgccgggucagggaagguagacaacuuuaccauggggguccucugccuagcuauccuguucgaagaggugaugcgcgggaaguucggcaagaaacacaugaucgccgggguguucuucacauuuguccugcucuuguccggucagaucacauggcgugacauggcacauacucuuaucaugaucggaagcaacgcuuccgaccggauggggaugggcgugaccuaucucgcccugaucgcaaccuucaagauccagcccuuucuggcccucgguuucuucuuacgccgccugacgagccgcgaaaaccuccugcuuggugugggccucgcuauggccacgacccugcagcugcccgaggacaucgagcaaauggccaacgggaucgcccucggccugauggcgcugaagcuaaucacgcaguucgagaccuaccagcucuggacggcccugauaucacugaccuguuccaauaccaucuucacacugacagucgcguggcggacagcuacccugauccuagccggggucagccuacugccggucugucagucaaguucgaugaggaaaacugacuggcuccccauggcgguggccgccaugggggugccuccccugccgcuguuuaucuuuucucucaaggauacgcuaaagcgccgguccuggccccugaacgagggggucauggcaguuggacuugugagcauccuggccuccucucugcuccgcaacgacguccccauggcgggcccccuuguggcugggggccugcucaucgccugcuaugugauuaccggcaccagcgccgaccugacggucgaaaaagccgcggacaucaccugggaggaggaggccgaacagacaggagugagccacaaccugaugaucacgguggacgacgacgguacgaugcggaucaaggaugaugagacggagaauauccucacggucuuauugaagaccgcccuccugaucguguccggcaucuucccguauagcauccccgccacccuacucguguggcauaccuggcagaagcagacgcaacgcucuggcgugcugugggacgugcccagcccgcccgagacucagaaggccgagcuggaagaggggguguaccggaucaagcaacaggguauuuucgggaagacucaggucggcguggggguccaaaaggagggcguauuccauaccauguggcacgugacgcgcggcgcggugcucaccuacaaugggaagcggcuggagcccaacugggcuuccgucaagaaggaccugaucaguuacggugggggcuggcgccucuccgcccaauggcaaaagggugaggagguccaggugaucgcgguugagcccgggaagaacccuaaaaacuuccagaccaugcccggaaccuuccaaacgaccacaggcgagaucggcgcaaucgcccuugacuucaagcccgguaccucuggcagccccauaauuaaccggggagggaagguggugggacuguacgggaacggcguggugacuaaaaacgggggcuacguauccggcauagcccagaccaaugccgagccggacgggccuacacccgagcuggaggaggagauguucaagaaacgcaacuuaacgauaauggauuuacacccagggagcgguaagacgcggaaauaccugccggcgaucguccgggaggcgaucacccgccggcuucggacccugauccuggcccccacccgcguggucgccgccgaaauggaggaagcccucaagggucugccuauccgguaccagaccaccgcgaccaagagugagcacacagggcgcgagaucguggaccugaugugccaugccacguucaccaugcggcuccuuagcccggugcggguuccgaacuacaaccuaaucauuauggacgaagcccacuucaccgaccccgccuccaucgcggcucgaggcuacauuagcacacgcgucggcaugggugaagccgcggcgauuuucaugacggcgacgccgcccggcaccgcugacgcguucccgcaguccaaugcccccauccaggacgaagaacgagauauucccgaacggagcuggaacuccgggaacgaauggaucaccgacuuugccggaaagacggugugguucgugccgagcaucaaagcagggaacgacaucgccaacugccuccgcaagaauggcaagaaggucauccaacugucccggaagaccuucgacaccgaguaccagaagaccaaacucaacgacugggauuucguggugacaaccgacaucagcgagaugggcgccaacuucaaagccgaucgcgucaucgacccgcggcgcugccucaagcccgugauccucaccgacgggcccgagcgggugauccuggcgggcccuaugccgguaaccgcagcuuccgccgcccaacgccgggggcgcguaggacggaauccucagaaggaaaacgaucaguacaucuuuaccgggcaaccucugaauaacgaugaggaccacgcccacuggacagaggcgaagauguugcuggacaacauuaacacgcccgaggggaucaucccagcccucuuugagcccgaaagggagaaguccgccgcaguugacggcgaguaccguuugaaaggggagucccgcaagaccuucgucgagcugaugcggcgcggcgaccuccccguguggcuggcucauaaggucgcuagcgagggcauuaaguacaccgaccggaaguggugcuucgacgggcagcgcaacaaccagauccuggaagagaacauggacguggaaauuuggaccaaggagggcgagaaaaagaaacuccgaccacgcuggcuggacgcgcgcaccuacagugauccgcuggcacucaaggaguuuaaagaguucgcagcggggcgaaagucgaucgcgcuagaccuggugacagagauuggcagaguccccucccacuuggcccaccggacuaggaacgcccuggacaaccuggugaugcuccacacuagcgaacacgguggccgggcauaccggcacgcgguggaggagcugcccgaaacuauggagacccugcuuuuacuggggcucaugauacugcuuaccgggggcgcuaugcuauuccugaucucugggaaaggcaucgggaagacguccauaggccugaucugcgucaucgcauccagugggaugcucuggauggccgagauuccgcugcaguggaucgccucagcgaucguccucgaguucuucaugaugguuuuacugauacccgaacccgagaagcagcguacuccccaagacaaccaguuagcauacgucgugaucggcauuuuaacucucgcugccauuaucgcugcgaacgagaugggccugcucgagacaacuaagcgcgaccugggaauguccaaggagccgggugugguuagcccuaccuccuaccuugacguagaucuacaccccgcguccgccuggacccuguacgccguggcuaccacggugaucacccccaugcugcgacacacuaucgaaaauuccaccgccaacguaagccucgccgcuauagccaaccaggcgguaguacugaugggcuuagacaaaggcuggcccauuuccaagauggaucucggggugccacugcuggcccuaggcuguuacagccaggugaauccccugacgcucaccgccgccguccucuuacugaucacucacuacgcuaucaucggcccgggacuccaggcgaaggccacgcgcgaagcccagaaaagaacggcugcuggcauuaugaagaacccgaccguggacggaaucaugaccaucgaccuggaccccgugaucuacgacuccaaguuugaaaagcaacugggccaggucaugcuucuggugcugugcgcagugcagcuacugcugaugcgcacgaguugggcacucugcgaggcccuaacgcuggccacggggcccaucaccacccucugggaggggucccccgggaaguucuggaacacgacgaucgcgguguccauggcgaacauuuuccggggcuccuaccuggccggcgcggggcuggccuucaguaucaugaaguccgugggcacaggcaagcggggcaccggaagccagggugagacccucggcgagaaguggaaacggaaauugaaccagcugucgcgcaaggacuuugaucucuacaaaaagucggggaucacggagguggacagaaccgaggcgaaggaaggccugaagcggggcgagauaacacaucacgccguaagccggggauccgccaaacuccagugguucguggagcgcaacauggugauaccggaaggcagggucauugaucucgggugcggaagagguggcuggagcuacuacugcgccgggcucaagaaggugaccgagguaagaggauacacgaagggcgggcccggccacgaggaacccguccccauguccacuuauggauggaauaucgugaagcugauguccgggaaggacguguuuuaccucccgcccgaaaaaugcgacacacugcucugugacaucggcgagucuucgccgucccccaccgucgaggaaagcagaacgauccgcgugcugaagaugguggagccguggcucaagaacaaccaauuuugcauaaagguccugaaccccuacaugcccaccgugauugagcaucuggagcggcuccagagaaagcauggagggaugcuggugcgaaacccccugucccgcaauagcacgcaugagauguacuggaucuccaaugggaccggcaauaucgucgccucagugaauauggucagcaggcuccugcugaacagguucacgaugacccaucgucgcccgaccaucgagaaggacgucgaucucggcgcggggacccggcacgucaacgcggagccugagacgccuaacauggacgugauaggagagcgcauuaagcggaucaaggaagaacacaacagcaccuggcacuacgacgaugaaaacccguacaagaccugggcguaccacggguccuacgaaguuaaggcgaccggcagcgccucaucaaugaucaauggaguagucaagcuguugacgaagccgugggacgucgugcccauggugacccagauggcgaugacggauaccacgcccuucggucagcaacgcguauucaaggagaagguggacacccggacuccgcgcuccaugccuggaacucggcgcgucauggggaucacagccgaauggcucuggaggacguuaggccgcaauaagaagccucgccuuugcacccgggaggaguucacgaagaaggugcgcacgaaugcagcgaugggggccguguuuaccgaagagaaccagugggacuccgccaaggccgccguugaagacgaagacuuuuggaagcucguugacagggagcgcgagcugcacaagcuggguaagugcgggagcuguguguacaacaugaugggcaagcgagagaagaaacucggggaguuugggaaggccaagggcuccagggcgauaugguacauguggcugggggcccgguaccuggaguuugaagccuuggguuucuuaaacgaggaccacugguucagcagggaaaacuccuacagcggggucgaaggggagggccugcacaagcucggauacaucuuacgggauaucuccaagauccccggaggggccauguacgcggaugacacggcgggcugggacacccgcaucacggaggacgaccuccacaaugaggagaaaaucacccagcagauggauccggagcaccggcagcucgccaacgccaucuuuaaacugaccuaccagaacaagguggugaagguccagcgaccaacccccaccggcacuguaauggauauuauuagccggaaggaccagcgcggguccggccagguggggaccuacgggcucaauaccuucacuaacauggaggcccagcucauccggcagauggagggggagggcguacugagcaaggccgaccuggagaaucccuaccucccugagaagaaaauuacgcaguggcuggagaccaagggaguugaacgccuuaagcggauggcgaucagcggggacgacugcguugucaaacccaucgaugaccgcuucgcgaacgccuuauuggcccugaacgacaugggcaaggugcgcaaggacaucccucaauggcagccuaguaagggguggcacgacuggcaacaggugcccuucugcucccaccacuuucacgaacucaucaugaaggacggcagaaagcuggucguucccugcagaccgcaggacgagcugaucggacgcgcccgcauaagccagggcgcaggcuggucccucaaggagaccgcaugccuggggaaggccuaugcccagauguggagcuugauguacuuucaccggcgcgaccuccggcuggcguccaacgccaucuguagcgccgugccaguccacuggguuccgaccucccggacgacauggagcauacacgcccaucaccaguggaugaccacggaggacauguuaacgguguggaaccgggucuggaucgaggacaauccauggauggaggacaagaccccggucaccacgugggagaacgugcccuaccucggcaagcgcgaggaccaauggugcgggagcuugauaggucugacgucccgggccacuugggcccagaacaucccgaccgcgauccagcagguccgcagccucaucgggaacgaggaguuccuggacuacaugcccuccaugaagcgguuccgcaaagaggaggaaagcgagggcgccaucugguga

SEQ ID NO: 25872 - RNA, 9873 nt, Artificial Sequence
  derived and/or modified CDS sequence (opt11) from DENV-3__KF973478__SS-prME
acgagccucugccuuaugaugauccugcccgccgcacuagcguuccaccucacgagccgugacggagaacccagaaugaucguugggaaaaaugagcgcggcaaaagccuccuguuuaagacugccagcgggaucaauauguguacguugaucgccauggaccugggcgagaugugcgacgacaccguuaccuacaagugcccgcacauaaccgaagucgagcccgaggacaucgauugcuggugcaaucugacuagcacgugggugacauaugggacguguaaccaggccggagagcaucggcgugacaagagaaguguggcccucgcaccccacguuggcaugggccuggauacccgcacucaaacguggaugagcgccgaaggcgcuuggcgccagguugaaaagguggaaacgugggcacugcgccaccccggguuuaccauacucgcgcuguuccuggcccauuacaucgguaccucacucacucagaagguggugaucuucauccugcugaugcucgucacaccaagcaugacgaugcggugcgugggggugggcaaccgcgacuucgucgaggguuuaaguggggccacgugggucgaugugguucuggagcacggcggaugcgugaccacgauggccaagaacaagccgacgcucgacauugaauugcagaagaccgaggcuacacagcuugcgacgcuccggaaacugugcaucgagggaaaaauuaccaacaucacuacggacagccgcugccccacgcagggcgaggccaccuugccggaggagcaggaucagaacuacgugugcaaacacaccuacguagaccggggguggggcaacgggugcggccucuucgggaagggcagucuagugaccugcgccaaauuccagugcuuggagccgaucgagggcaagguggugcagcacgagaaucuaaaguacacugugaucaucaccgugcacacgggggaccagcaccaggucggcaacgaaacccagggggucaccgccgagaucaccccgcaggccucgacgaccgaggcgauccugcccgaguacgggaccuuagggcucgaguguagcccgcgcacgggcuuagacuuuaacgagaugauacugcucaccaugaagaacaaggccuggaugguacaccggcagugguucuucgaccugccucuccccuggaccagcggcgccaccacggagacccccacuuggaacaggaaggaacuccuugugaccuucaagaaugcccacgcuaagaagcaggaggugguugugcuagggucacaggagggcgcgaugcacaccgcccucaccggggccaccgagauccaaaacagcggcgguaccuccaucuucgcuggccaccugaaaugccggcugaagauggacaaacuugagcugaagggcaugucuuacgcaaugugcacgaacacauucguguuaaagaaggagguuuccgaaacccaacacgggaccaucuugauuaaggucgaguacaaaggcgaggacgugccaugcaagauucccuucagcacggaagacgggcagggcaaggcgcacaacggacgcuugaucaccgccaaccccgucguaaccaagaaggaagaacccgugaacaucgaggccgagccgcccuucggggagucgaacaucgucaucggcaucggagacaacgcccugaaaaucaacugguauaagaaaggguccagcauaggcaaaauguucgaggcgaccgcacgaggcgcccgccggauggccauccuuggcgacacggccugggacuucggcuccgugggaggcguccucaacagccugggaaagaugguccaccagauuuucggguccgcguacaccgcccuguucagcggcgugucuugggugaugaagauuggcaucgggguguugcucacuuggauaggccugaacagcaagaacacuucuaugagcuucuccugcaucgccauaggaaucaucacguuguaucucggcgcagucgugcaggcagacauggggugcgucaucaacuggaaaggaaaggagcugaagugcggcagcggaaucuucgugacaaacgagguacauacguggaccgagcaauacaaguuccaggcggacucaccgaagcgccucgccacggccaucgccggcgccugggagaacggggucuguggcauccgaagcaccaccagaauggaaaaccugcuuuggaagcaaaucgcuaacgaguugaacuacauccugugggagaacaauaucaagcugaccguuguggucggggacauaaucggcguguuggagcagggcaaacgcacgcugaccagucaaccaauggagcugaaguacaguuggaagacuuggggcaaagccaagaucgugacugccgaaacgcaaaacagcucauucaucauugacggcccgaacaccccagagugccccucgguuagccgggccuggaacgugugggagguggaggacuacggguucggcgucuucacuaccaacauauggcucaagcugcgcgagguguacacgcagcugugcgaucaccgguuaaugagcgcagccgugaaggacgagcgcgccguccacgccgacaugggauauuggaucgagucgcagaagaacggaaguuggaagcuggagaaggccucccugauugaagugaagacgugcaccuggcccaagagccacacccucugguccaacggcguucuggagagcgacaugaucaucccgaagucccuggcgggacccauaagccagcacaaccaccggcccggcuaccacacccaaacggccgggccguggcacuuaggcaagcuagagcuggacuucaacuacugcgagggcaccacuguggugauaaccgagaacugugggacuagaggcccaucccuccgaaccaccaccgucagcgguaagcucauucacgaguggugcugccgauccugcacguuaccgccucucagauacaugggcgaggacgggugcugguacggcauggagauccggccgauaagcgagaaggaagagaacauggucaagucccuggugagugccggcuccgggaagguggauaacuucaccaugggcguucugugccuggccauccuguucgaggaggugaugcgggguaaguucggcaagaagcacaugaucgccgggguauucuucacauucguucuucuccugagcggccagauaaccuggcgcgacauggcccacacucugauuaugaucggcuccaacgccagcgaccggaugggcaugggcgugaccuaccucgcucugauagccaccuucaagauccagccguuccuggcccucgguuucuucuuacgcaagcugacuucgcgcgagaaucuccuauugggcgugggacucgcgauggccacgaccuuacagcugccugaagacaucgagcagauggccaaugggaucgcccucggccuaauggcgcugaagcucauaacccaauucgagaccuaccagcuauggacggccuugaucucucugaccuguagcaacacaaucuucaccuugacgguugccuggcgcaccgccacccugauccucgccggggugucccuccugcccgucugccagagcucauccaugcggaagaccgacuggcucccgauggcgguagccgccaugggagugccgccacucccccuguuuaucuuuggucucaaagacacccugaagcgcagguccuggccgcugaacgagggcgucauggcugugggccucgugagcauccuggcguccagccuccuccggaaugacguccccauggcggggccccugguggccggcggguuacucaucgccuguuaugugaucaccggcaccuccgcggaccugaccgucgagaaggcggcggacaucacgugggaggaggaggcggagcagacaggggugagccauaaccugaugauuacaguggacgacgacggcaccaugcgcaucaaagacgaugagaccgagaacauccucacgguccugcucaagaccgcgcuccugaucgugagcggcaucuuccccuacuccaucccggccacucugcucguguggcacacuuggcagaagcagacgcagcgguccgggguccugugggauguacccuccccgcccgagacccagaaggccgagcuagaggaggguguguaccgcaucaagcagcaggggaucuucgggaaaacccaggugggcgugggcgugcagaaagaagggguuuuccauaccauguggcacgugacgcguggggcaguguugacauacaacggcaaacgccuggagccgaauugggccuccgugaagaaagaccugaucagcuacgggggcggguggcggcuauccgcgcaauggcagaagggcgaagagguccagguuaucgccgucgagccuggcaagaaucccaagaacuuucagaccaugccaggaaccuuccagacgaccacaggcgagauuggggcgaucgcccuggacuucaagccgggcacgagcggcagcccaaucaucaaucgcgaagguaagguggugggccuguacgggaacggcgucgugacgaagaacggggguuacguauccggcaucgcccaaaccaacgcagaacccgacgggccgacucccgaauuagaggaagagauguucaagaagcguaaccucaccaucauggaccugcaccccggcagcgggaaaacucggaaguaccugcccgccaucguccgggaggcgauaaagcgcagacuccgcacguugauccuggccccuacccgggugguggcagccgagauggaggaggcucucaagggccugcccauccgcuaccagaccacggcgaccaaauccgagcacaccgggcgggagaucgucgaccugaugugccaugcgaccuucacaaugcgccucuugagccccgugcggguacccaauuacaaucugauuaucauggacgaggcccacuucaccgacccggccagcaucgccgcucgcgguuacaucagcacccggguuggcaugggugaggcugccgccaucuucaugaccgcgacgccgcccgggacagcggacgccuucccccagagcaacgccccgauccaggacgaggaacgggacaucccggaacgcagcuggaacuccgggaacgaguggaucacagauuucgccgggaagaccgugugguucgugcccagcaucaaggccgggaacgacaucgccaauugccugcggaagaacggcaaaaaggucauccaacugucccgcaagacguucgacaccgaguaccagaagaccaaacugaaugacugggacuucguggugaccacagacauaagcgagaugggagccaauuucaaggcugaccgggucaucgacccccgccggugccucaagccggugauucugaccgacggacccgagagggucauccuggcugggccaaugccugucacugcggccucggcugcccagcggcgcgggcgggugggccgcaacccgcagaaggagaaugaccaguauaucuuuaccgggcagccucucaauaacgacgaagaccacgcacauuggaccgaggcaaagaugcugcuggacaacaucaauaccccugaaggcaucauucccgcauuguucgagcccgagcgugaaaaguccgccgcgaucgacggcgaguaccgccugaagggggagucucggaagaccuuuguggagcugaugcgccggggugaccuccccgucuggcuggcgcacaagguggccagcgagggaaucaaauacaccgaccgcaaguggugcuuugacggccagcggaacaaccagauacuggaggagaauauggauguggagaucuggaccaaagagggcgaaaagaagaaacuccgcccccggugguuagacgcccgcacguacuccgacccccuggcccucaaggaguuuaaggaguucgccgcggggcggaagaguauagcacuggaccugguuacagagaucggccgggugccgagccauuuggcccauagaacccggaaugcccuggacaaucuggugaugcuccacacgagcgagcacgggggcagggccuaccggcaugcgguggaggaacugccggagacgauggagacguugcuccugcugggguugaugauccugcugacgggcggagccaugcuauuccugaucuccgggaagggcauaggcaagaccucaauagggcuaauaugcgugaucgcuagcuccgggaugcuguggauggccgagaucccucugcaguggaucgccucggcuaucguuuuagaguuuuucaugaugguguuacugaucccggagcccgagaagcagcgcacgccacaggacaaccaacuggccuacgucguaaucggcaucuugacccuggccgcaaucaucgccgcaaaugagaugggccugcucgagacaacuaagcgggaucuggggauguccaaggagcccggcguggugagccccacguccuaucuggauguggaccuccaccccgccagcgcguggacacuguacgccguggcgacaaccgugauaacucccauguugcgccacaccauagagaacuccaccgcuaacgucagccucgcagcgaucgccaaucaggcagugguccugauggggcuagacaagggguggcccaucuccaagauggaccuaggugucccgcugcuggcccucggcuguuacagucagguaaacccgcugacccugaccgccgccgugcuccugcugaucacucacuacgccaucauuggacccgggcuucaggcgaaggcuacucgggaggcgcagaagcgcacggcagcgggcaucaugaagaaccccaccguugacgggaucaugacuaucgaccuggacccggugauuuacgacuccaaguucgagaagcagcugggccaaguuaugcuacugguccugugcgcgguacaacuccuucugaugcggaccagcugggcccugugcgaggcccugacccucgccacuggccccaucacuacccuuugggaagggagucccggcaaguucuggaacacgaccauagcggugagcauggcgaacaucuuccgcgggucauaucuggccggcgccgggcuggccuuuagcaucaugaagucugucggcaccggcaaacgcgggacggggagccagggggaaacccucggcgaaaaguggaagaaaaagcugaaccagcugucgcggaaggacuucgaucuuuacaagaaguccgggaucaccgagguggaucggacggaggcaaaggagggccuuaagcgcggugagaucacccaccacgcagucagccggggcucggcuaagcuccagugguuugucgagcgcaacaugguaauuccagaggggcgcgugaucgaucucgggugcggacgcgguggauggagcuauuacugugcgggucugaaaaaggucacugaggugcguggauacaccaaaggcgggccuggccacgaggagcccgugcccauguccacguacggguggaacaucgugaaacugaugucgggcaaggauguguuuuaccucccgccugagaagugcgacacccugcucugugacaucggcgagucuagccccagucccacuguggaggagucacgcaccauacgcguccugaaaaugguagagcccuggcuuaagaauaaccaguucuguauuaagguucugaacccuuauaugcccacggucaucgagcaccuggaacgucuccagcgcaagcacgggggcaugcuggugcggaacccccugucccgcaacagcacccacgagauguauuggauauccaacgguacuggaaacauuguggccucugucaacaugguguccaggcucuugcugaaccgcuucaccaugacgcaucggagacccacuaucgagaaggacguggaccucggagcaggaacccggcacgucaacgccgagccggagacccccaacauggacgucaucggagagcgcaucaaacggaucaaggaggagcauaacuccacuuggcacuacgacgacgagaauccguacaagaccugggccuaccacggguccuaugagguuaaggccacuggaagcgccuccucgaugaucaauggggucgugaaguugcugaccaagccuugggaugucgugcccauggugacccagauggcaaugacggacaccacccccuucggccagcagagggucuucaaggagaagguggacacgcggacaccccggagcaugccuggcacaaggcgcguaaugggaauuaccgcugaguggcuguggcggacacugggccgcaacaaaaagccucggcuaugcacucgagaggaguucacuaagaaggugcgcacuaacgccgccaugggggcgguguucacggaggagaaccagugggacucggccaaggccgccguggaggaugaggacuucuggaaacucguggaccgagagcgcgagcugcacaaguuagguaagugcgggagcuguguguacaacaugaugggaaagcgggagaagaaguuaggcgaguuugguaaggccaaaggcucccgcgcgaucugguacauguggcugggggcgcgguacuuagaguucgaggcccucggauuccugaacgaagaccacugguuuagccgcgagaacucguacagcgguguggagggcgagggucuucaccggcucgguuacaucuugcgagacaucuccaagauccccggcggggcgauguacgcggacgacaccgcgggcugggacacucggauuaccgaagacgaccuucacaacgaggagaagaucacgcagcaaauggacccggagcaccgccagcucgccaacgccaucuucaagcugaccuaucagaacaaggucgugaagguccaaagaccgaccccaacaggcacgguuauggacaucaucagccguaaggaccagcggggguccggccagguggggaccuauggccugaacacuuucaccaacauggaggcccaauugauacgccaaauggaaggugagggugugcuauccaaagccgaccuagagaacccucaucuacccgagaagaaaaucacccaguggcuggagacgaaaggcguagagcggcugaagcgcauggccaucuccggggacgacugcgugguaaagccgauugacgaucgguucgccaacgcccuccuggcacuuaaugacauggggaagguacgcaaggacaucccccaguggcagccuuccaagggguggcacgacuggcagcagguucccuuuugcucacaccacuuccaugaguugaucaugaaggauggccggaagcugguggugccgugccgcccacaggaugaacuuaucgggcgggcccgcaucagccagggcgcggguugguccuuaaaggaaacagccugccuggggaaagccuaugcccagauguggagccugauguacuuccaccgcagggaccuccgccuggccucgaacgccaucuguagcgccgugcccgugcacuggguccccaccucucggaccacguggagcauccacgcccaccaccaauggaugacuaccgaggacaugcugaccguguggaacaggguauggaucgaggacaacccguggauggaagacaagacgcccgugacuaccugggagaacgucccguacuugggaaagcgggaagaccaguggugcgguucacuaaucggccugacgucccgcgccacgugggcgcagaauauucccaccgccauccagcagguccggagccucaucgggaaugaggaguuccuggacuauaugccgaguaugaaacgcuuccguaaggaggaggagagcgagggugcaaucugguga

SEQ ID NO: 25873 - RNA, 9873 nt, Artificial Sequence
  derived and/or modified CDS sequence (opt11) from DENV-3__KF973479__SS-prME
accagucugugccuaaugaugauucugcccgcagcccuggcguuucaucucaccagcagagacggcgaaccgcguaugaucguggggaagaaugagcggggcaagagccuacuguucaagaccgcguccgggaucaacaugugcaccuugaucgcaauggaucugggcgagaugugcgacgacacggugacguacaagugcccccacaucaccgagguggagcccgaagacaucgacuguuggugcaaccugaccagcacgugggugaccuacgggacgugcaaccaggcuggcgagcaccggcgcgacaagcgguccgucgcccuugcgccucacgugggcauggggcuggacacccgcacccagacuuggaugagcgccgagggugccuggcgccagguugagaaggucgaaacaugggcccugcgacacccgggguucaccauucucgcgcuguuccuggcccacuacaucggcaccucccuuacccagaaaguggugaucuucauccuguugauguuagucacgcccagcaugaccaugcggugcguuggggugggcaaccgggacuucgucgaggggcugucgggggccaccuggguggacgugguccuggaacacggcggcuguguuaccacgauggccaagaacaaacccacccucgacaucgaacuucagaagaccgaggccacccaacuggcgacgcuccggaaacugugcaucgagggcaagauaaccaacaucaccaccgacagccgcugccccacgcagggcgaggccacccugccggaggagcaggaccagaacuacguuugcaagcacaccuacgucgaccggggcuggggcaacggaugcggccucuucgggaagggcucccuggugaccugcgcgaaguuccagugccuggagcccaucgagggaaagguaguccaguacgaaaaucucaaguauacgguaaucaucaccgugcacaccggggaccagcaccaggucggaaaugaaacccagggggugacggccgagaucacgccgcaggccagcaccaccgaggcgaucuugcccgaguacggcacccugggucucgagugcuccccacgcacgggucuugacuucaacgaaaugauccuguuaacuaugaagaauaaggcauggaugguacaucggcaaugguucuucgaccugccccugcccuggaccagcggcgcuaccacggagacaccuaccuggaaucgcaaggaacuccuggugaccuucaagaaugcacacgccaagaagcaggagguuguugucuuaggaagucaagagggcgcgaugcacaccgcccucacuggggccaccgaaauccaaaaccugggcgggacgagcaucuucgccggccaccugaagugccgguugaagauggacaagcuggagcugaaagguauguccuacgccaugugcacgaacacauucgugcucaaaaaggagguaucugagacccaacacggcaccauccugaucaaaguggaguacaagggagaggacgcgccgugcaagauccccuucagcacggaggacgggcaagguaaggcccacaauggccgccugauuaccgccaaucccguggucaccaagaaggaggagcccgugaauaucgaagccgagccgcccuuuggagaaagcaacauugucaucggcaucggggacaacgcgcugaagaucaauugguacaagaaaggcagcuccaucgggaagauguucgaggccacagcccggggcgcccgccgaauggccauccucggcgacacggcgugggauuucggcucagucggcggugugcugaacucgcugggcaagauggugcaccagaucuuugggagugcuuacaccgcccucuucuccggcguaucuugggugaugaagauaggcaucgggguucuguugaccuggauaggccucaauuccaagaacaccagcauguccuucagcugcauugccauagggaucaucacgcuguaccugggggccgucgugcaggcggauauggggugcgugaucaacuggaagggcaaggagcucaagugcggcuccgggaucuucgucacaaacgaggugcacacuuggaccgagcaguauaaguuucaggccgacagccccaagcgccuggccacggcaaucgccggcgcaugggagaacggggugugcggcauucggagcaccacccggauggagaaccugcucuggaagcagaucgccaacgaguuaaacuacauuuuaugggagaacaacaucaagcucaccgucgucgugggggacaucauuggcguccuggaacaggggaagcgcacguuaacgccccagccgauggaacucaaguauagcuggaaaaccugggguaaggccaagauagucaccgccgagacgcaaaacuccagcuucaucaucgacggccccaacacccccgagugccccuccguuagccgggccuggaacgucugggagguggaggacuacggauucggcguguucaccacgaacaucuggcugaagcugcgcgaggucuacacacaacucugcgaccaucggcugauguccgccgcgguuaaagacgagcgggccgugcacgcagacaugggcuauuggaucgagagccagaagaacgggaguuggaagcuggagaaggcgucccugaucgaggucaagacgugcaccuggcccaaaucacacacccuaugguccaauggcguucuggagucggacaugauuauccccaaaucccucgccgggcccaucagccagcacaaccaccggccgggcuaucauacacagacggcagggccuuggcacuuaggcaagcuggagcucgacuucaacuacugcgagggcaccaccguggucaucaccgagaacugcgggacgcgcgggccgucccugcgaaccaccaccgugucugggaaacucauccaugaguggugcugccgcuccugcacucugccuccccugcgauacaugggcgaggacgggugcugguacggcauggaaauccgccccaucagcgagaaggaggaaaacauggugaagucccuggucagcgccggcuccgggaagguagacaacuucaccaugggcgugcuaugcuuagcgaucuuguucgaggaagucaugcgggggaaauucgguaagaagcacaugaucgcggguguguucuucaccuuugugcuccugcugagcggccaaaucacuuggcgcgacauggcucacacccucaucaugaucggcuccagcgccuccgaccggauggggaugggggucaccuaccuggcccugaucgccaccuucaaaauucagccuuuccucgcgcucggguucuuccugcgcaagcucacaucucgggagaaccuguugcucggcgugggccuggccauggccacgacucugcagcuacccgaagacaucgagcagauggccaaugggauagcgcugggacuuauggcgcugaagcuaauuacgcaauucgaaaccuaccagcuguggacggcccucaucagcuuaaccuguuccaacaccaucuucacccugacgguggcguggcgcaccgcgacccucauccuggcgggggucucccuccucccggucugccaguccucgucgaugcggaagaccgacuggcugcccauggccgucgcggccaugggcgugccaccccucccccuguucaucuucggguuaaaggacacgcugaagcgccgcagcuggccgcucaacgaaggcgugauggccgucggccugguguccauccuggcguccagccuccugcggaacgacguucccauggccgggccccugguggccggugggcuccuuauagccugcuacgugaucacgggcaccagcgcagaccugacaguggagaaggcagcggacaucacgugggaggaggaagccgaacagaccgggguuucccauaaccucaugaucaccguggacgacgacggcaccaugcgcaucaaggacgacgaaacagagaacauccugacggugcugcucaagaccgcccugcugauaguuagcggcaucuucccguacuccauccccgccacccuucugguguggcacacguggcaaaagcagacgcagcguagcggggugcugugggacguccccuccccaccagagacucagaaggcggagcucgaggaaggcguguaccguaucaaacagcaggggaucuucggcaaaacccaaguuggggucggagugcaaaaagaaggcguguuccacaccauguggcacgucacucgcggggccgugcugaccuauaacggcaagcgccuggaacccaacugggccagcgugaaaaaggaccucauuuccuacgggggaggguggcggcuuucggcccaguggcagaagggggaggagguccaaguuaucgcaguggagcccggcaagaacccuaagaacuuccaaacgaugccggggaccuuccagacgaccaccggcgagaucggugcuaucgcccuggacuucaagcccggcaccuccggcagccccaucaucaaccgcgaggggaaggucgucggacuguacgggaacggcguggucacuaagaacgggggcuacgucagcggcaucgcccagaccaacgccgagccggaugggcccacccccgagcucgaagaggagauguucaagaagcggaaccugaccaucauggaccugcaccccggcuccgggaagacgcgcaaguaccucccagcgaucgugcgggaagccaucaagcgccgucuacggacccugauccucgcccccaccagggucguggccgccgagauggaggaggcguugaagggccugcccauccguuaccagaccacggccacuaagagcgagcauacugggcgggagaucguggaccucaugugucacgccaccuucacgaugcgccuguuaucccccguccgggugccaaacuacaaccucaucaucauggaugaggcccacuucaccgaccccgccagcaucgcagcccgcggguacauauccacccgugugggcaugggggaggccgccgcgaucuucaugaccgccaccccgcccggcaccgcagacgcuuucccgcagagcaacgccccuauucaagaugaggagcgcgacaucccugagagauccuggaacagcgggaacgaguggaucaccgacuucgcgggcaagaccgucugguucgugccauccaucaaggccgggaacgacaucgccaacugccugcggaagaacggcaagaaggugauccaacuaagccgcaaaacguucgauacagaauaccagaagacgaagcucaacgauugggacuucguagucaccacggauaucucugagaugggggccaacuucaaggccgaccgggugaucgacccgcgccggugcuugaagcccguuauucugaccgacgggcccgagcgagugauccucgcgggccccaugccggugaccgccgcuagcgccgcccagcggcgcgggcgggucggccggaacccccagaaggaaaaugaucaguauauauucacggggcagccucuuaauaacgacgaggaccacgcgcauuggaccgaggccaaaaugcugcucgacaacaucaauacgccggagggcaucaucccggcccucuucgagcccgagcgggagaaauccgccgcgaucgacggcgaguaccgcuugaagggggaaagccggaagaccuucguggaacucaugcgccggggcgaccugcccguguggcucgcccacaaagucgccuccgaggggaucaaguacaccgaccgcaagugguguuucgacggccagcggaacaaccagaucuuagaggaaaauauggacgucgagauauggaccaaggaaggggagaaaaagaaguugcgcccucgguggcuggacgcccgcacguacagcgacccguuagcccugaaggaguucaaagaguuugcggcggggcgcaagucaaucgcccuugaccucguuaccgagaucgggagaguccccagccaccuggcccacagaacacggaacgcgcucgacaaccucgugaugcugcauaccuccgagcacgggggccgcgcguacaggcacgccgucgaggagcugcccgagacgauggagacccuccugcuccuagggcuaaugauccugcuuaccggaggcgccaugcuguuccugaucagcggcaaaggcaucgguaagaccagcaucggccucauaugcgugauagccuccagcgggaugcuguggauggccgagauaccgcugcaguggaucgcguccgccaucgugcuugaguucuuuaugauggugcugcucauccccgaaccggagaagcagcggacuccccaggauaaccaacucgccuacguggugauuggcauacugacgcuggccgccaucauagcugcaaacgagaugggccugcuggagaccaccaagcgggaccucggcauguccaaagagccgggugucguaucacccacgagcuaccucgacguggaccugcaccccgccucagcauggacccuguacgcggucgccaccaccgugaucacucccaugcugcgucacaccaucgagaacagcaccgccaacgugagucuggccgccauagcuaaccaggccgucgugcuaauggggcucgauaagggcuggccgaucagcaagauggacuugggggugccccugcucgcccuggggugcuacucccaggucaacccccugacacucacggcggccgugcugcugcucaucacacacuacgcgaucauuggccccggguugcaggccaaagccacccgggaggcucagaagcgcaccgccgcgggcauuaugaagaacccaacgguggacgggaucaugaccaucgaccuggaccccgucaucuacgacagcaaguucgagaagcagcucggccaggugaugcuucuggugcucugugccguccagcugcugcuuaugcggacauccugggcccucugcgaggcccuuacccucgcgacagggcccaucaccacucugugggaggggagccccggcaaguuuuggaacaccacgaucgccguuuccauggccaauaucuuccgcgggucauaucucgccggcgccgggcucgcguucuccaucaugaaguccgugggcaccgguaagcgggggaccggaucccagggggaaacccugggggagaaguggaagaaaaagcugaaccagcucagccgcaaggacuucgaccuguacaagaaaagcgggauuacagaggucgacagaacggaggccaaggagggccugaaacgcggcgagaucacccaccacgccgugucccgagggagcgcuaaguugcagugguucguugagcgcaacauggucauaccagagggccgagugauugaccuggggugcggcagagggggcuggucauacuacugugccggccuuaagaagguuaccgagguccggggguacacaaaaggagggcccggucacgaggaacccguccccaugagcacguacggcuggaauaucgugaaacuuauguccgguaaagacgucuucuaccugccgccagagaaaugugacacccugcugugugacaucggcgagagcuccccaagucccaccguggaggagucccgcacaauaagagugcucaagauggucgagccaugguuaaagaacaaccaguucugcaucaagguguugaacccuuacaugcccaccgugauugagcaccucgagaggcugcagcgcaagcacgggggcaugcugguccggaacccccucucccgaaacuccacccacgagauguacuggaucagcaacgggacgggcaauaucguugcguccgugaacauggucucccgacugcuacucaaccgcuucaccaugacgcaucgccggccaaccaucgagaaggauguggacuuaggcgccgggacaagacacguuaacgccgagcccgagacgcccaacauggaugucaucggcgaacgcaucaagcggaucaaggaggaacacaauuccacuuggcauuacgacgacgagaauccguauaagaccugggccuaccacgggagcuacgaggucaaggcaaccgguuccgcgucuuccaugauuaacggggucgucaagcugcuaacgaagcccugggauguggugccgaugguuacacagauggcuaugacugacacuacucccuucggacaacagcgcgucuucaaagagaagguugacacgcggaccccgcgcucaaugcccggcacacggcgcgugauggguaucaccgccgaguggcuguggcggacgcugggccgcaacaagaagccccggcucugcaccagagaagaguucaccaagaaggugcggaccaaugccgcgaugggcgcggucuucacggaggaaaaccagugggacucggccaaggccgccguggaggacgaggacuucuggaagcugguggaccgggagcgcgagcugcacaagcucggcaagugcggguccuguguguacaacaugaugggcaaacgggagaagaagcugggagaguucgggaaggcgaagggcucgcgcgccaucugguacauguggcugggagcccgguaucucgaguucgaggcacugggcuuccugaacgaggaccauugguucucccgagagaauagcuacuccgggguggagggcgagggccuccacaagcugggguacauccuaagggacaucagcaagaucccgggcggggccauguacgcggacgacaccgccggcugggacacccgcaucaccgaggacgaccuccacaaugaggagaagauaacgcagcagauggacccggaacaccggcagcuggccaacgcgaucuucaagcugaccuaccagaacaagguugucaaagugcagcgccccacccccaccggaaccguaauggacaucaucucccggaaggaccagcgcgggagcggccaggucgggacuuacgggcucaauaccuuuaccaacauggaggcacagcuuauccggcaaauggagggggaaggcgugcuaucuaaggcugaccucgagaauccccaccuaccggagaagaagaucacgcaguggcuggagacgaagggcguggaaaggcucaagcggauggccaucucgggggacgacugcguggugaagcccauugacgacagguuugccaaugcacugcucgcccucaacgacaugggcaaggugcggaaggacauaccccaguggcagccauccaagggguggcacgauuggcagcaggucccguucugcagccaccacuuccacgagcugaucaugaaggacgggcgcaagcuggugguccccugccguccccaggacgaguugaucgggcgcgcgaggauaucccagggcgccggauggagccugaaggaaacugcuugccugggaaaggccuacgcgcagauguggucccuuauguacuuccaccgccgcgaccugcggcuggccagcaaugccaucugcuccgccgucccggugcacugggugccgaccagccgcacaacguggaguauccacgcucaccaucaguggaugacuaccgaggacaugcucaccguguggaaucggguguggaucgaggauaauccauggauggaggacaagacgccagugacuaccugggaaaacguccccuaucugggcaaacgcgaggaccaguggugugguucacugauuggacucaccagccgggcgacgugggcccagaacaucccgaccgcgauccagcagguccgcucccugaucgggaacgaggaguucuuagacuacaugcccucuaugaaacgguucagaaaggaggaggaguccgagggcgccaucugguaa

SEQ ID NO: 25874 - RNA, 9873 nt, Artificial Sequence
  derived and/or modified CDS sequence (opt11) from DENV-3__KF973480__SS-prME
accagcuugugucucaugaugauccugcccgcagcucuggcguuccaucucacaucccgagauggcgagccacggaugaucguggguaagaacgagagagggaagagccugcucuuuaagacagccucgggaaucaacaugugcaccuugaucgccauggaccugggcgagaugugcgaugacacggugacuuacaagugcccacacaucacggagguagagcccgaggacaucgacuguuggugcaaucugaccagcacauggguuacguaugggacaugcaaccaggccggugagcaccgacgggacaaacgguccgucgcgcuagcaccccacgugggcauggggcuggauacccguacacagaccuggaugagcgcugagggcgccuggcgccagguagagaaggucgaaacaugggcucugcgccauccgggauucacuauucucgcgcuuuuucuugcacacuacaucggcaccucacucacccaaaaagucguaaucuucacgcugcugaugcuagucacccccagcaugaccaugcggugcguggggguuggcaaccgcgacuuuguagagggccucaguggcgccaccugggucgacgugguucuagaacacggcggaugcgugacgaccauggccaaaaacaagccgacccucgacaucgaguugcagaagacagaggccacgcaguuggcgacccucaggaagcugugcaucgaggguaagauaaccaacauuacaacggacucgcguugcccgacgcagggcgaggcaacccuacccgaggagcaggaccagaacuauguaugcaaacauaccuauguagaucgaggguggggcaacgggugcggccuguucgggaagggcucccuggugaccugcgcuaaauuccagugcuuggagccgauugagggcaaagucguucaguacgagaaccucaaguacacugugaucaucacuguucacaccggggaccagcaccaggucggcaacgagacgcagggggugaccgccgaaauaacuccccaggcaagcaccacggaggcgaucuugcccgaguacggaacgcuggggcucgagugcaguccgcgcaccggccuggacuucaacgagaugauucuccuuaccaugaagaacaaagcguggaugguccaccggcaaugguucuucgaccugcccuuaccguggacuagcggagcgacgacagagacccccacauggaaucgcaaggaguuacuggugacguuuaagaacgcccacgcaaagaagcaggagguggucgugcuggggucccaggagggcgcgaugcacaccgccuugaccggcgcaaccgagauucagaacagcggcgguacguccaucuucgccggccaccugaagugucgguuaaagauggauaagcucgaacugaagggaaugagcuacgcgauguguaccaacaccuucgugcuuaaaaaggaggucuccgagacccagcaugguacgauccucaucaagguggaguauaagggcgaagacgugccuugcaaaauuccguuuucuaccgaagacgggcagggcaaggcgcauaacgggcgccugaucaccgcgaaccccgucgugaccaagaaggaggagcccgugaauaucgaggccgagccgcccuucggggagagcaacaucgucaucgggaucggagacaaugccuugaagaucaacugguacaagaaaggcaguagcaucgggaagaucuuugaggcgacugcacggggcgcucggagaauggccauucugggggacaccgcaugggacuucggauccgugggcggugucuuaaacagccugggaaagaugguccaccagauauucggguccgccuauaccgcccuguuuucggguguguccugggucaugaaaaucggcauugggguacuccugacuuggaucggccugaacagcaaaaauaccuccaugagcuucucgugcauagcaaucggaaucaucacccuguaccucggcgcaguggugcaggccgauauggggugcgucaucaacuggaagggcaaggagcugaaaugugguagcgguaucuucgugaccaacgaggugcauacguggacggagcaguauaaguuccaagcggacuccccgaagcgccucgccacggcgaucgccggcgccugggaaaauggggucugugggauccgcagcacuacucggauggagaaccugcuguggaagcagaucgcaaacgagcucaacuacauccugugggagaacaauaucaaauugacuguagucgucggagacauaaucggcgugcuagagcaagggaaacgcacccugacgccccaaccaauggaacugaaguacuccuggaagaccugggggaaggccaagaucgugacggccgagacucagaauagcucauucaucaucgacggccccaacaccccugagugccccagcgucucucgggcguggaacguaugggagguggaggauuacggcuucggcgucuucaccaccaacaucuggcucaagcuuagagaggucuacacgcaguugugcgaucaucgucucaugagugcggcugugaaggaugagcgcgcuguccacgccgacaugggcuacuggauugaaagccagaagaacggguccuggaaacuggaaaaagcuucccuaaucgaggugaagacguguaccuggccuaagucucacaccuuauggucaaauggcgugcuggaaucagauaugauaaucccaaagagccuugcgggcccgaucucccagcacaaucaccgcccuggcuaccacacgcagaccgccgggccguggcaccucggcaaacuggagcuggacuucaacuacugcgaaggaacuacgguggugaucacggagaacugcgggacccgcggccccucccuccggaccaccacggugucgggcaaguugauacacgaguggugcugccgcagcugcacacuucccccccuccgguauaugggcgaggacggaugcugguacggcauggaaauccgccccauaucagagaaggaggagaacauggucaaaagccucguuuccgcgggcaguggcaagguggacaacuucaccauggggguccuuugccuagcuauccuguucgaggaggugaugcgggggaaguucgggaaaaagcacaugaucgccgggguguucuucacauucgcgcugcuccucuccggccagaucacguggcgcgauauggcccacacgcugaucaugauagguaguaacgccuccgaucguauggggaugggcgucaccuaccucgcccugaucgccaccuucaagauccagcccuuccuugcgcucggguucuuccugcgcaagcugacgagccgagagaaccuccuacuuggcguggggcucgccauggccaccacccuacagcugcccgaggauaucgaacagauggcaaacggaaucgcgcucggcuugauggcccuaaaguuaaucacgcaguucgagacguaccagcuuuggacugcccugaucucccugaccugcaguaacacuauauuuacauugaccguggcauggcgcaccgcgaccuugauacucgcggggguaagccuccugccggugugccagucgagcucaaugcggaagacggacugguuacccauggcggucgcugccaugggagugccgccgcugccgcuguucaucuucgggcucaaagacacccugaagcgccgcagcuggccucugaaugaaggcgugauggccgucggccucgugucuauccuugcgucgucccugcuccggaacgacgugcccauggccggaccuuuagucgccggcgggcugcuuaucgccugcuacguuaucaccgggaccagcgccgaccucacaguggaaaaagccgccgacaucaccugggaggaggaggccgagcagacugggguaucccauaaucuaaugaucaccguggacgacgacggcacaaugcgcauaaaggacgacgagacggagaacauccucacuguguuacuaaaaacggcgcuacuaaucgucagcggcaucuucccguauuccaucccagcuacccugcucguauggcacacguggcaaaagcagacgcagcguagcggcgugcugugggacgucccuuccccgcccgagacccaaaaggcagagcuggaagaagguguguaccgcaucaagcagcaggggaucuucggcaagacucaggugggggucggcgugcagaaagaggguguguuccacacgauguggcacgucacacgcggggcaguccuuaccuacaacggcaagcgccuagagcccaacugggccagcguaaagaaagaccuaaucucauacggaggcggguggcggcucagcgcccaguggcagaaaggcgaggaaguacaggugaucgcgguggagcccgggaagaacccaaagaacuuucagaccaugcccgguacguuccagacaaccaccggugaaaucggggcaaucgcacuggacuucaagcccggcacauccggaagcccaaucauuaaccgcgaggggaaggucgugggccuguacggcaacggcguggucaccaagaacgggggcuacguuagcgggaucgcccagaccaacgccgagccggaugggcccacucccgagcuggaggaggagauguucaaaaagcggaaccucacgauaauggaccugcauccuggcucugggaagacucgcaaguaccugccagcgaucgugcgggaggccaucaagcgccggcuccgcacccugauacuggcucccacccgagucguggccgcggagauggaggaagcccucaagggcuugcccauccgcuaccagaccaccgccaccaaguccgagcacaccgggcgugagaucguggaccugaugugucacgccacguucaccaugcggcucuuaagccccgugagagugccaaacuacaaucugaucaucauggacgaggcccacuuuaccgaccccgcgagcauugcggcccgcggauacaucuccacccgaguugguaugggggaggcugccgcgaucuucaugaccgccacaccgcccggcaccgccgacgcauuuccgcagucgaaugccccuauccaggacgaggagagagacauaccggagcgcuccuggaacucugggaacgaauggauuaccgacuucgcgggcaagacggucugguuugugcccuccaucaaggccgggaacgauauagccaacugccugcguaagaacggcaaaaaaguaauccagcugucacgcaagacuuucgacacagaguaccagaaaaccaagcugaacgacugggacuuugucgugacgacggauaucagcgagaugggcgccaacuucaaggccgaccgugugaucgacccucgccggugucucaagcccgucauuuugaccgaugggcccgagcgcgugauucuugcgggccccaugccagugaccgcggccagcgcagcccagcggcgcgggcgggucggccgaaacccccagaaagaaaacgaucaauacaucuucaccggacagccccucaacaaugaugaagaucacgcgcauuggacggaggcaaaaaugcugcuugauaacaucaacacgcccgaggggauaaucccggcccucuuugagcccgagagagagaaaucggccgccauugacggcgaguacaggcugaaaggggaaagccggaagacauuugucgaacugaugaggcgcggcgaucuccccguguggcuagcccacaaggucgccuccgaggguaucaaguacacggaccgcaaauggugcuucgacggacaacggaauaaccagauccuugaggagaauauggacguggagaucuggacgaaggagggagagaaaaaaaaguugcgaccacgguggcuugaugcccgcaccuacuccgacccauuggcccucaaggaauucaaggaauucgcggcggggcgcaaguccauugcucuggaucuggucacagagauaggccgggugcccagccaccucgcacaccgcacccgcaacgcccuggacaaccuugugauguuacauaccucugagcacgggggcagggcguauaggcaugccgucgaagagcugcccgagaccauggagacccugcuccugcugggucugaugauucugcugaccggcggcgccaugcucuuucugaucagcgggaaaggcaucggcaagacgaguauagggcugauuugcgugauugccuccagcggaaugcucuggauggcugaaauuccgcugcaauggauugcgagugccauaguccuggaguucuucaugauggucuuacugauccccgaacccgagaagcagcgcacgccgcaagacaaucagcuggccuacguggugaucggaaucuugacuuuggccgccaucaucgcggccaaugagaugggccuguuggagaccaccaagcgggacuuggggaugagcaaagagcccggcgucguuucccccaccagcuaccuggauguugaccuccacccggccuccgccuggacucuauacgcggucgccaccacggugauuacccccaugcuccgucacaccaucgagaacagcacggccaacgugucccucgcagcgaucgccaaccaggcagucguguuaauggggcuggauaagggcuggccgaucaguaagauggaccucgggguuccacuuuuggcccugggaugcuacucccaggucaacccccuuacgcugaccgccgcgguuuugcuguugaucacccacuacgcgaucauaggucccgggcugcaggcuaaagcaacccgagaggcccagaagcgcaccgccgcgggcaucaugaagaacccgaccguggaugggaucaugaccaucgacuuagacccagugauauacgacagcaaguucgaaaagcaacugggacaagugaugcuucugguccucugcgccguccagcuccugcugaugcgaaccucuugggcccucugcgaggcccugacgcuggcaaccggcccgaucaccacccucugggaggggagccccggcaaguucuggaacacaaccaucgccguguccauggccaacauauuucgugguagcuaucuggcuggcgcaggacucgcauucuccauaaugaaauccgugggaaccggaaagcgggggaccggcucccaaggggaaaccuuaggggagaaguggaagaagaagcuuaaccagcugagccgcaaagacuucgaccuuuauaagaaguccgggaucacggagguggaccgaaccgaggccaaggaaggccugaaacgcggugagaucacgcaccacgccgugagucgggggagcgcgaaguuacagugguucguugaacgcaacaugguaaucccggagggacgggugauagaccuggggugcggccgcgggggcugguccuacuauugcgccggacugaagaaggugacggagguccgggguuacacaaagggagguccuggacaugaagaacccguccccaugagcaccuauggguggaacaucgucaagcuuauguccgggaaggacguguucuaccucccgcccgaaaaaugcgacacacuguuaugcgacauaggcgagagcucccccucucccaccguggaggagucccggacgauccgcgugcugaagauggucgaaccguggcucaagaacaaccaguucuguaucaaagugcuuaaucccuacaugccuaccguuaucgaacaucuggagcgucuccaacgcaagcacggagguaugcuggucagaaacccacugagcaggaacaguacccacgagauguacuggaucagcaacgguacagguaacauuguggcguccgucaacauggucagccggcuccugcugaacagguuuacuaugacccaccggcgcccgacuaucgagaaagacguagacuugggcgccggaacuaggcaugucaacgccgagccagagacgcccaauauggacgucauaggcgaacgcaucaagaggaucaaggaggagcacaacuccaccuggcacuacgacgacgaaaacccauacaagacuugggccuaucacgggagcuaugagguuaaggcaacgggcuccgcgucauccaugaucaauggugugguuaagcuguuaacgaagcccugggaugugguccccauggugacccagauggccaugaccgacaccacaccauucggccagcagcgcguuuucaaggagaaaguggacacccggaccccacgcagcaugcccggaacucggcgcgugauggggauaacggccgaguggcuguggcgaacccugggacguaacaagaagccccgucugugcacgcgcgaggaguucacuaagaaagugcgcacgaacgccgccaugggcgccguauucacugaagagaaccaaugggauagcgccaaggccgccguggaggaugaggacuuuuggaagcuaguagaccgagagagggagcuccacaagcucgggaagugcggaucgugcgucuacaacaugaugggcaagcgggagaaaaaacuaggugaguucgguaaggcgaaaggcagccgcgccauuugguacauguggcugggggcccgguaccuggaauuugaggcgcuaggcuuccugaacgaggaccauugguucucgagagagaacagcuacuccggggucgagggggagggguugcacaaacucggguacauauuaagagacauaagcaaaauccccggcggggccauguacgcggacgacaccgccggcugggacacgcgcaucacggaggacgacuuacauaacgaggagaagaucacccagcagauggaccccgagcaccggcagcucgcgaaugccaucuucaagcuuacauaccagaacaagguggugaaggugcagcgacccacccccaccggcacggugauggacaucauaucccggaaggaccagcgcggcagcggucaggucggaaccuacgggcucaacaccuucaccaacauggaggcgcaacugauacggcagauggagggggagggagugcuguccaaggcugaccuggaaaacccccaucucccggaaaagaagauuacucaauggcuggagaccaagggcgucgagagguuaaaacguauggcgaucagcggagaugacugcgucgugaagccuaucgacgaccgcuucgccaacgcguuauuagccuugaaugacaugggcaaggugcggaaggacaucccccaguggcaaccaucuaagggauggcacgauuggcagcaagucccguucugcagccaccacuuccacgaguuaaucaugaaggauggccgaaagcuggugguacccugccguccacaggaugaguuaaucggccgggcgcggaucucccagggcgccggauggagccucaaagagaccgccuguuuagggaaggccuacgcgcagauguggucgcugauguacuuccaucgccgugaccuccggcuagccaguaacgccaucugcuccgccguacccguccacuggguaccaaccagccgcacgaccugguccauccaugcccaucaccaguggaugaccaccgaggacauguuaacggucuggaaucguguguggauugaagacaacccauggauggaggauaagacucccgugaccaccugggagaacguccccuaccuugggaaacgggaggaccaguggugugggagccugauuggccugacgagcagagcgaccugggcucagaauaucccgaccgcaauccagcagguccguuccuuaaucgggaacgaggaguuccuggacuacaugcccaguaugaaacgguuccguaaggaggaagaguccgagggcgccauuugguga

SEQ ID NO: 25875 - RNA, 9873 nt, Artificial Sequence
  derived and/or modified CDS sequence (opt11) from DENV-3__KF973481__SS-prME
acaagccuuugccuaaugaugauccugcccgccgcacuugcuuuccaccucaccagccgggacggugaaccccggaugaucguggggaagaacgaacggggcaagagcuuacuguucaagaccgccagcgguaucaacaugugcacgcuaaucgccauggaucugggggagaugugcgacgacaccgucaccuacaagugcccccacaucaccgagguggagcccgaagacaucgacuguuggugcaaccuuaccaguaccugggugacuuacgggacgugcaaccaggccggcgagcauagaagggacaagcgguccguggcccucgcuccucacgugggaaugggccucgacacccgaacccagaccuggaugucagcagagggcgcauggcgccagguggagaagguggagacgugggccuugcgccaucccggcuucacuauccuugcuuuguuccuugcucacuauauaggcaccuccuugacgcagaagguggugaucuucauacuucugaugcuugugacgcccaguaugaccaugcggugcgugggggucgguaaccgcgacuuuguggagggcuuauccggggcgaccuggguggacguggucuuggaacacggcgggugcguuaccacgauggccaagaacaagccgacacucgacaucgaguuacagaagaccgaggccacucagcuggcgacgcuccggaaguugugcauagagggcaagauaacgaacaucaccaccgacucccggugucccacccagggcgaggccacccugccggaagaacaagaccaaaacuacgucugcaagcauacguacgucgaccgaggguggggcaacgggugcggacucuucggaaagggcucucuaguaaccugugccaaguuccagugucuggagcccauagaaggcaaggugguccaguacgagaaccucaaguauacaaucaucaucaccgugcacacaggcgaucaacaccaggugggcaaugagacccagggggucacggccgagaucacgccucaggccuccacuaccgaggcgauacugcccgaguacggcacccuggggcucgagugcuccccacgcacuggccuagauuucaacgagaugauccugcuaacgaugaagaauaaggcauggauggugcaccggcaaugguucuucgaccuuccucugccguggaccagcggggcuacaaccgagacccccacuuggaauagaaaggagcuccuggucacguucaagaaugcgcacgccaagaagcaggagguggugguccuggguucccaagagggcgcgaugcacacggcccuaaccggggccaccgagauccagaacagcggcgggacuucuaucuucgccggccaccugaaaugucggcugaagauggauaagcuggagcugaagggcaugucauacgccaugugcacaaacaccuucguguugaagaaagagguguccgagacacagcacggaaccauacuuaucaagguugaguacaagggcgaggaugugccgugcaagaucccauucagcacagaagacggucaggguaaagcgcacaauggccgccugaucacugccaacccagucgugaccaagaaggaggagcccgugaacaucgaagccgagccgccguucggugagucuaacauaguuaucggcaucggagauaacgcccugaaaaucaacugguauaaaaagggcagcucaaucgggaagauguucgaagcgaccgcacggggcgcgcgucggauggccauccugggcgauacugcaugggacuuuggguccgugggcggggucuuaaauucucuggggaagauggugcaccagaucuucggguccgcguacaccgcucucuucagcggcgucuccugggugaugaagaucggcaucgguguccuccugaccuggaucggcuugaauaguaaaaacaccucaaugagcuucuccugcaucgccaucgggaucaucacgcucuaccuaggcgccgugguucaggccgauauggggugugugauaaacuggaaggguaaggaacugaagugcgguagcgggaucuucgucaccaaugagguccacacuuggaccgagcaguacaaguuccaggcggacucccccaagcgccucgcuacggcuaucgcuggcgccugggagaaugggguuugcggcaucaggagcacuacccguauggagaaccuccuguggaagcaaaucgcgaacgagcucaauuacauccuaugggagaacaacauaaaacugaccgugguggugggagauauaaucggcguuuuggagcagggcaagcgcacgcugacuccccagccaauggaauugaaguacuccuggaaaaccugggggaaggccaagaucguuaccgccgagacccaaaauucuagcuucauaaucgacggacccaauacgccggagugcccaucggucucccgggccuggaacguuugggagguggaggacuacggauucggcguguucaccaccaacaucuggcucaaacugagagaaguguacacccagcuaugcgaccaccggcucaugagcgcggccguaaaggacgagcgggcaguacaugccgacaugggcuacuggauagagucacagaagaacgggucauggaaguuggagaaggccagccugauagagguaaagacgugcaccuggccgaagucccacacgcucugguccaacggcguacuggaauccgacaugaucauacccaagucccuggcggggcccaucucucagcacaaccaccggccgggcuaccauacccaaacggcagguccauggcacuuaggcaaacuugagcuggacuucaauuacugcgagggcacaaccgucgucaucaccgagaacugcggcacgcgcgggcccucacuccguaccacgaccguuuccgggaagcugauccacgaguggugcugucgcagcugcacgcugccaccgcucagguacaugggcgaagauggcugcugguacggcauggagauccgccccauauccgagaaggaagagaacauggucaagucacugguguccgccgggagcgggaagguggacaacuucaccgugggcguccugugucucgcgauacuauucgaggaagucaugcgggguaaguucgguaagaagcacaugauugcagggguauuuuucacuuuuguccugcuccuguccggccagauuacauggagggacauggcgcacacgcugauuaugauuggcagcaacgcguccgaucggauggggaugggagugaccuacuuagcacugauugccaccuucaagauccagcccuuccuggcccucggguucuuccuccgcaagcucaccagcagggaaaaccugcuguuaggaguugggcucgcaauggccacgacccugcagcugcccgaggauauagagcaaauggccaacggaaucgcccucggccugauggcauuaaaauuaaucacccaauucgagaccuaccaguuguggacggccuugauaagccugaccugcuccaacaccaucuucacccugaccgucgcuuggcguaccgccacccugauccuagccggugugagccuucugccagucugucaguccagcuccaugcguaaaacagacuggcucccaauggcgguagcggcuaugggcgugccgccuuugccucuguucauuuuugggcucaaggacacguuaaagcgacgguccuggcccuugaacgagggcgucauggccgugggccucgugucgauccuggcaagcucacugcuccggaacgacgucccuauggcuggcccucugguagcgggcggcuuacuaaucgccugcuaugugauuacagggaccucggccgaucugacuguggagaaggccgcggacauuacaugggaagaggaagcggaacaaacaggcgugucccauaaccugaugauaaccguggacgaugacggcaccaugcgcauaaaagacgacgaaaccgagaacauccucacgguccuguugaaaacggcucuccugaucgugagcggcauuuucccauacuccaucccagccacacuacucguuuggcacaccuggcagaaacagacacaaagaucgggcguccugugggacgugccuagcccgcccgagacccagaaggccgagcuggaggaaggcguguaccgcaucaaacagcaggguaucuucggcaagacccagguaggggucggcguacagaaggagggcgucuuccacaccauguggcacguuacgcgcggggccgucuuaacauacaauggcaagagacucgagcccaacugggccagcgucaagaaggaccugaucucauacgggggcggguggaggcucagugcccaauggcagaagggcgaggaagugcaagugaucgcagucgagccggguaaaaaccccaagaacuuucaaacaaugcccgggacguuccaaaccacuacgggcgagauaggggccaucgcauuagauuuuaagccugggaccucagggagccccaucauaaaccgcgaggggaaagugguuggguuguacgggaacggugucgugacgaaaaacggaggcuacguuagcggaaucgcccagaccaacgccgagccugacgggcccacccccgagcuggaggaggagauguucaagaagcggaacuugaccaucauggaccugcaccccgguuccggcaagacgcgcaaguaccugccggcgaucguccgggaggcaauuaagaggcggcuccgcaccuuaauccuggccccuacccgggugguggccgccgaaauggaagaggcccucaagggccugccgauccgcuaccagaccacggcgaccaagagcgagcauaccgggcgggagauugucgaccugaugugccaugcuaccuucacgaugcggcuacugucucccgugcgggugccgaauuacaaucuaaucaucauggaugaagcccacuuuaccgacccugccagcaucgccgcccgcggcuacauauccacgagaguagggaugggggaggccgcggccaucuuuaugacugcgacgccacccggcaccgccgacgcuuuuccccagagcaacgcccccauccaggacgaggagcgcgacauccccgagcgcucauggaacagcgggaacgaguggauaacugacuuugcggguaaaaccgugugguucgugccauccauaaaggcggggaacgacaucgcgaacugccuccggaagaacggcaagaaaguaauccaguuaagcaggaagacguucgauaccgaguaccagaaaaccaagcucaacgauugggauuucguggugaccacggauaucagugagaugggcgccaacuuuaaggccgaccgggucaucgacccgcgcagaugccucaagccggugauccugaccgaugggccugagcgcgugauacuagccgggcccaugccggucacugcugccagcgccgcacaaaggcgcggacgggugggucgcaacccccagaaggagaacgaucaguacaucuucaccggucagccgcucaacaacgacgaggaccacgcccacuggacagaggccaagaugcugcuggacaacauuaacacuccggagggcaucaucccagcuuuauucgagccagagcgggaaaaguccgccgcgaucgacggcgaguaccgccugaaaggggaaucucgcaagaccuucguggaacugaugcgccggggcgacuugcccguuuggcuggcacacaagguggccagugaggggaucaaguacaccgaccgcaaguggugcuucgacggacagaggaacaaccagauacuagaagaaaacauggacguggagaucuggaccaaggagggcgaaaagaagaagcuccgcccccgguggcuggacgcgcgcaccuacucggauccgcuggcgcucaaggaguucaaggaguucgccgcgggccgcaaguccaucgcccuggaccuggucacugagaucggccgagugcccagccaccucgcccaccgcacucgcaacgcccuggacaaccuggucauguugcacacuuccgaacacgggggccgcgcguaccggcacgcggucgaagaacuaccugagacaauggagacacuguugcugcugggguuaaugauccugcugaccggcggggccaugcuguuccucaucucggggaagggcauuggcaagaccucuauuggccuaauaugcgucaucgcaagcagcgggaugcucuggauggcugagaucccgcugcaguggauagccucugcgaucguacuggaguucuucaugauggugcuccugaucccagaacccgagaagcagcgcacgccccaagacaaccagcuggccuauguggucaucggcauuuugacccuggccgccaucaucgcggcuaacgagaugggccugcuagagaccacgaagcgggacuuggggaugagcaaggagccgggcgugguuucccccacgucguaucuggacgucgaccuccauccagccucugccuggacccuguacgccguggcgaccaccgugaucacccccauguuaagacauaccauagagaacucuaccgccaacguuucauuagccgccauagccaaucaggcggucguguugauggguuuagacaagggcuggccgaucagcaagauggacuuaggagucccccugcuugcgcucggcugcuacagucaagugaacccccugacccugacggccgccgugcuuuuacugaucacccacuacgccaucaucggcccuggguuacaggcgaaggcaacucgggaggcucagaagcgcaccgccgccggcaucaugaagaacccaacuguugacgggaucaugacaaucgaccuggaucccguuaucuacgacagcaaguucgagaagcagcugggacaggugaugcuccuuguuuugugcgcggugcagcuccugcuaaugcggaccuccugggccuuaugcgaggcgcuuacccuggccacgggccccaucacaacccuaugggaggggagccccggcaaguucuggaacaccacgaucgcggugucuauggccaacaucuuccgcggaagcuaucuugccggcgccggguuagccuuuuccaucaugaaguccgucggcacaggcaagcgggggaccgggucgcagggggagacccucggggagaaguggaagaagaagcugaaccagcuaagccguaaggauuucgaccucuacaagaaauccgggaucacugagguggaccggacggaggcgaaagagggccugaagagaggagagaucacccaccacgccguaucccgggggagcgcaaaguugcagugguucgucgagcggaauauggugauacccgagggucgggugauagaccuugggugcggacgcgggggcuggagcuacuacugcgcgggccuuaagaaggucaccgaagugcggggguacacuaaaggagggcccggccacgaggaacccgugcccaugaguacguauggguggaacaucgucaaguuaauguccggcaaagaugucuucuacuugccgcccgagaagugcgacacacuccugugcgacaucggcgagagcucgccuagccccaccguagaagagucccgcacgauccgcguccuuaagaugguggaaccuuggcuaaagaacaaccaauuuugcaucaagguacugaaccccuacaugcccacggucaucgaacaccuggagcgccuccagagaaagcaugggggcaugcucgugcggaacccacugagccgcaacuccacucaugagauguauuggaucagcaaugggaccggcaacaucgucgcguccgugaacauggugucccgguugcugcugaaccgcuucaccaugacgcaccggcgaccgaccauugagaaggacguggacuuaggggcggggaccagacaugucaacgccgaaccagagacacccaacauggacgugaucggugagaggaucaagcggaucaaggaggagcacaacuccacauggcacuaugaugacgagaacccguacaagacuugggcguaucaugggagcuaugaagucaaagccacgggcucugccagcagcaugauaaacggagucgugaaacuucuaacaaagcccugggauguggugcccauggugacgcagauggcaaugacugacacgacaccguucggccagcagcgcgucuuuaaggagaaaguggacacucggaccccgcgcagcaugccggguacgcggcgggugauggggaucaccgcugaguggcucuggcggacccuuggccgaaacaagaagccccgccugugcacgcgcgaggaguucaccaagaagguuaggacgaacgccgccaugggggccguuuuuacggaggagaaccagugggacagugccaaagccgcaguggaggaugaggauuucuggaagcuaguggacagggagcgagagcugcacaagcugggaaaaugcggaucaugcguguacaacaugauggggaagcgugagaagaaacuuggcgaguucgggaaggccaagggcucacgcgcgaucugguauauguggcugggggcccguuaccuggaguucgaggcccucggcuuccugaacgaggaucacugguucucucgcgaaaacagcuacuccgggguagagggcgagggccugcauaagcucggguacauacugcgggauaucagcaagauccccggcggugccauguacgccgacgauaccgcggguugggacacccgcaucaccgaggaugaccuacacaaugaggagaagaucacccagcagauggacccggagcaucggcagcucgccaacgcgaucuucaagcugaccuaccagaacaaggucgugaagguccagcgaccaacccccaccggcaccguuauggacaucauuucccggaaggaccagcgcgggagcggccaggugggcacauacggccugaacaccuucacgaacauggaggcacaguuaauccggcagauggagggagagggcguccuuagcaaagcagaccuggagaacccacaccucccggagaagaagaucacccaguggcuggaaacgaagggagucgagagauuaaagcggauggcgaucucaggggacgauugcguggugaaaccuauagaugaccgcuucgccaacgcccuccuggccuuaaacgacaugggcaagguucggaaggacaucccucaguggcaacccuccaaggguuggcacgacuggcagcaggucccguucuguagccaucacuuccacgagcucaucaugaaggacggccgcaagcuggugguccccuguagaccucaggacgaacuaaucgggcgcgcacggauaucacagggcgcgggcuggagccuaaaggaaaccgcgugucuggggaaggccuacgcccagauguggucccugauguacuuccaccgucgcgaccuccggcuggcuagcaacgccauaugcuccgccguucccguucauugggucccgaccaguagaaccacuuggucgauccaugcccaucaccaguggaugaccacugaggauauguuaaccguguggaacaggguauggauagaagacaaccccuggauggaagauaagacgcccgucaccacaugggaaaaugugcccuaccucggcaagcgugaggaccaguggugcgggucgcugauuggccuaaccagcagggccacgugggcacagaacauuccgaccgcgauacagcaagucaggagucucaucgggaaugaggaguuucuggacuauaugcccagcaugaagcgguuccggaaggaggaagaguccgagggugccauuugguga

SEQ ID NO: 25876 - RNA, 9873 nt, Artificial Sequence
  derived and/or modified CDS sequence (opt11) from DENV-3__KF973482__SS-prME
accagccuauguuugaugaugauccugcccgccgcguuagcguuccaccucaccagccgggauggggaaccccgaaugaucguggguaagaaugaacgggggaaguccuugcuguucaaaacugccuccggaaucaauaugugcacccugaucgccauggaucuuggcgagaugugcgacgacacggugacguauaagugcccccacaucacugaaguggagcccgaggauaucgauugcuggugcaaccuaacaagcaccugggugaccuacgggacuugcaaccaggccggcgagcaccggcgcgacaagcgguccguggccuuagcuccucacgugggcauggggcuagacacucgcacccagaccuggaugagcgccgagggcgccuggcgccagguggagaaaguggagacgugggcccugcgacacccgggguucacuauccuugcucucuuccuugcccauuauaucgggacaagucuaacucagaagguagugaucuucauccuacugaugcucgugacgcccagcaugaccaugcgaugcguggggguggggaaucgugacuucguugaagggcugagcggugccaccuggguggaugugguccuggagcacggagggugcgugacuacgauggcuaagaacaagcccacacuugauaucgaacugcagaagacggaagccacccaacuggcaacgcuccggaagcugugcaucgagggcaagaucacuaacauuacgaccgacaguagaugccccacgcagggcgaggccacccuaccggaggagcaagaccaaaacuauguuugcaagcacaccuacgucgaccgaggguggggcaacgguugcggacucuuugggaagggcucccugguaaccugugccaaguuucagugccuggaacccaucgagggcaaggugguucaguaugagaaucucaaguacacuaucaucaucaccguucacaccggggaccagcaccagguugguaacgagacccagggagugacggccgagaucacgccccaggcgagcaccacggaggcgauccuucccgaguacggcacccugggccuagagugcagcccgcgcacgggccuggacuuuaacgagaugauccugcucacuaugaagaacaaagccuggaugguacacaggcagugguucuucgaccugccacugcccuggaccucaggugccaccacggaaacccccacguggaaccgaaaagaacuccugguaacuuucaagaacgcccacgcuaagaaacaggagguggugguccuagggucccaggagggcgcuaugcacacugcucucacaggcgccaccgagauucagaacagcggcgggacguccauuuuugccggccaccuaaagugcagacugaaaauggacaagcucgagcuaaaggguaugagcuaugccaugugcacuaacacguucgugcugaagaaggagguauccgagacgcagcaugggaccauccucaucaaggucgaauauaagggggaggaugugccgugcaagauacccuucagcacggaggacggacaggguaaggcgcauaacggccgccugauaaccgccaaccccguggugaccaagaaggaagaacccgugaacaucgaggcugagccgcccuucggugagaguaacaucgugauuggcaucggggacaacgcgcuuaagaucaauugguacaagaaggguuccucuaucggaaagauguuugaggcgaccgcccggggagcccgccggauggcgauccugggcgacacggcaugggacuucgggagugucggcgggguacucaacucucucggcaagauggugcaucagaucuuuggcagugccuacaccgcccuguucagcggcgucuccugggugaugaagauagguaucggagugcuccuuaccuggauuggccugaauagcaagaacacuuccaugucguucucaugcauagccauagggaucaucacgcucuaucugggcgccguaguccaggccgauauggggugugugaucaacuggaagggcaaagaacuaaagugcggcucugggaucuucgucaccaacgaggugcauacuuggacggagcaguacaaauuccaggcggacucccccaagaggcuggccacugccaucgccggcgcaugggagaauggcgugugcggcauucgcagcacuacccggauggagaaucugcuguggaagcagaucgcgaacgagcucaacuacauccugugggagaacaacauaaaacugaccgucguugugggggauaucaucggcguccuggaacaaggcaagcguacuuuaaccccucagcccauggaauugaaguacucauggaaaaccugggggaaggccaagauugugaccgccgaaacccaaaacuccucauucauaaucgacgggccuaacacccccgagugccccagcguaucccgggccuggaauguaugggagguggaagacuacgguuuuggcguguucaccacaaacauuuggcugaaguuacgcgaggucuacacccagcugugcgaccaucggcucaugucagccgccgugaaagacgagagagcugugcacgcagacaugggcuacuggaucgagagccagaagaacggguccuggaagcuggagaaggcuagucucauagaggucaagacguguaccuggccgaagucgcacacacucuggagcaacggcguucuagaguccgacaugauuauuccuaagagccuggcggggcccaucucccaacacaaccaccggccagguuaccacacacagacggccgggccguggcaucucggaaagcuggagcuggauuucaacuauugcgaggguaccaccgugguaaucacggagaacugugguacuagggggcccagcuuacggaccaccaccguguccgggaaacugauccacgaguggugcugccgauccugcacgcugcccccgcuccgguacaugggcgaagaugggugcugguacgggauggagauccggcccauauccgagaaggaggagaauauggugaagucccuggucuccgccggcagcgggaagguagacaacuucacagucggcgugcugugcuuagcuauucuauucgaagaggugaugcgugggaaguucggcaagaagcacaugauagccgguguguucuucaccuucguucuguugcuguccggccagaucaccuggcgcgacauggcucacacgcuuaucaugaucggcucgaaugccuccgaccguauggggaugggugugaccuacuuagcccuaauagccaccuuuaagauacagcccuuccuggcucucggguucuuccugcgcaagcugacaagccgggagaaccuccugcugggagugggccucgcgauggcgacgacccugcagcuucccgaggacauugagcagauggcgaacgggaucgcauugggccugauggcgcugaaacuuaucacccaguucgagaccuaccagcuguggacggcucugaucucgcugaccugcuccaauaccaucuucacccugacggucgccuggcguaccgccacccugauccuggcaggagugagucugcucccggucugccaaucaucguccaugcggaagacagauuggcuccccauggcggucgcugccaugggcgugccgcccuuaccgcuuuucauuuucggucucaaagacacacugaagcggcgcagcuggccccugaacgagggcgucauggcaguggggcuuguguccauccuggccagcucgcugcucaggaaugacguccccauggcggggccucugguggccggagggcugcucauagccugcuacgugaucaccgggaccuccgcggaucugacagucgagaaggccgcggacauuacgugggaggaggaggcggaacagaccggggugucccacaaccugaugaucacgguggacgacgacggcaccaugcgcauaaaggacgacgaaacggagaacauacucacgguccuccugaagacagcacuccugaucguuagcgggaucuucccguacuccauccccgccacccugcucguuuggcacaccuggcagaaacagacgcagcggagcgggguccugugggacgugcccagcccgcccgagacucaaaaggccgagcuagaggagggcguguaucgcaucaagcagcaagggauauuugguaagacccaggugggcgugggcgugcaaaaggaaggcguuuuccacacuauguggcacgugacgcgcggggcaguguuaaccuacaauggcaagcgccuugagcccaauugggccagcgucaagaaggaucugaucucguacgggggcgguuggcggcucagcgcccaguggcagaagggcgaggagguccagguuaucgccguugagcccggcaagaaccccaaaaacuuccagacaaugccuggcacuuuccagacgacgaccggcgagauaggggcgauagcccuugacuucaagcccgggacaucaggcucacccauuaucaaucgcgaggggaaggucgucggcuuguacgguaauggggugguaaccaagaaugggggauaugugagcgggaucgcccagaccaaugccgagccugacgggccgaccccagaguuggaagaggaaauguucaagaagcggaaccucacuauuauggaccuucauccuggcuccgggaagacgcgcaaguaucugccggcgaucguccgggaagcgaucaagcgucggcucagaacccucaucuuggcucccacucgggugguggccgccgagauggaggaggcccuuaaaggccuacccauccgcuaucagaccaccgcuaccaagucggagcacacggggcgggaaaucgucgacuuaaugugccacgcgacuuucacgaugcgccuucucagucccgugcgggugcccaacuacaaccucaucaucauggaugaggcucacuucaccgacccggccaguaucgccgcgcgcggcuacaucucaacucgggucggcaugggggaggccgccgcgaucuucaugacagcgacgccgcccggcaccgccgacgccuucccgcagagcaacgcaccuauccaggaugaggagcgcgacauucccgagcgcuccuggaauagcgggaacgaauggauaaccgacuucgcuggcaagaccgugugguucgugcccuccauuaaggcggggaacgacaucgcaaacugccuccggaaaaacggcaagaagguuauucagcugagccgcaagacuuucgacaccgaguaccaaaagacaaaguuaaacgauugggacuucguggugaccacagacaucuccgaaaugggcgccaacuucaaggcggaccgugucauugacccgcgccgcugccuuaagccugucauccuuaccgacgggcccgagcgcgucauccuagccggccccaugccagucacagcggcgagcgccgcccaacgccgcgggcggguuggucgcaauccccagaaggagaacgaccaguacaucuucacgggccagccccucaauaacgacgaagaccaugcccacuggacggaagcgaagaugcugcuggacaauaucaacacgcccgagggcaucaucccggcccuguuugagccggagcgggaaaagucugcagcgaucgacggagaguaccgccugaagggggagagccggaagaccuucguggagcugaugcgccggggcgaccuccccguguggcuggcucacaagguugccucugagggaaucaaauacacugacagaaagugguguuucgacggccaacggaacaaucaaaucuuggaggagaauauggacgucgaaaucuggaccaaggagggggaaaagaagaaauugagacccagguggcuggacgccaggacguacagcgacccgcuggcgcucaaggaguucaaggaguucgccgcgggucgcaagucaaucgcacuugaccucgucaccgagaucggcagggugcccagccaccuagcucaccguacccggaaugcgcuggacaacuuagucaugcuccacacuuccgaacaugggggccgcgccuauagacacgcgguugaggaacugccagaaacgauggagacccugcuacugcugggacugaugauccuguugacaggcggagcuaugcuguuccugaucagcgggaaaggaaucgggaagaccagcaucggccugaucugcgugaucgccuccagcgggaugcuauggauggccgaaaucccacugcaauggaucgccuccgcgaucguccuggaguucuuuaugaugguccuacugauccccgagccagagaaacagagaacgccccaagacaaucagcucgcauauguuguaaucggcauccucacauuagccgcaaucauugccgcaaacgagaugggccugcucgagaccacaaagcgcgaccuggggaugagcaaagagccggggguugugucccccacgagcuaccuugacguugaccuccacccugcguccgcauggacuuuauacgccgucgcgacaaccgugauaacgccaaugcugcgccacaccaucgaaaacagcaccgccaacgucucccucgcggccaucgccaaucaggccgugguccucauggggcuggacaagggcuggccaaucaguaaaauggacuuggggguuccccuacuugcgcucggcugcuauagucaggugaacccccugacccuaacugcagccgugcuccugcuaaucacgcacuacgccauuaucggcccgggguugcaggcgaaggcuacccgggaggcccagaagagaacagccgcgggcauaaugaagaauccgacggucgacggaaucaugaccaucgaccuggaccccgugaucuacgacagcaaguucgaaaagcagcuaggccaggugauguugcugguauugugcgcgguccagcuccuacugaugaggaccuccugggcccucugcgaagcccugacacuggccacaggacccaucacaacuuuaugggaggggagccccggcaaguucuggaacaccacaauagcgguguccauggccaauauauucaggggcuccuaccuggccggggcaggguuggccuucuccaucaugaagucagucggaaccggcaagcgggggacgggcucucagggugagacccucggcgaaaaguggaaaaagaaacugaaccagcugagccgcaaggacuuugacuuauacaagaaaucaggaaucaccgaagucgaucgcaccgaagcaaaggaaggccugaagcgcggggagaucacccaccacgccgucucaagagggagcgcaaaacugcagugguuugucgagcgcaauauggugaucccggaggggcgggugauugaccuugggugcggccgcggcggcuggucuuacuacugcgccggccucaagaaggugaccgaagugcgggguuauacaaagggcggacccggccaugaagaaccugugcccaugagcacguacggauggaauaucguaaagcugaugagugguaaggaugucuuuuaccucccgcccgaaaagugcgacaccuugcugugcgacaucggggagagcucccccagcccuaccguggaagagucccgaacgauucgcguccugaagaugguggagccguggcucaagaacaaccaguucuguaucaagguacugaacccuuacaugcccacggugaucgagcaucuagaacggcuccaacgcaagcaugggggcaugcuggugcggaacccccuaagccgcaacuccacccacgagauguacuggauuaguaacgggaccggcaacaucguggccucugugaacauggugucucggcuccuucugaauagauuuacaaugacccaccgucgcccgaccaucgagaaagacguggaccucggcgcagggacacggcacguaaacgccgagccagagacccccaacauggacgugauaggugagcgcaucaagcggaucaaggaggagcacaacuccacguggcacuacgacgaugagaacccguauaagaccugggccuaucacggcucauacgagguuaaggcaacgggcuccgccagcagcaugaccaacggggucguaaaacugcugacgaagcccugggaugucgugcccauggugacccagauggcuaugacagauaccacgccuuucggccagcagcgcgucuucaaggagaagguggacacccggaccccgcgcagcaugccgggcacccggcgcguuauggggaucacggccgaguggcuuuggcggacccugggcaggaacaagaagcccaggcugugcacaagggaggaguucacuaaaaagguccguacuaacgccgccaugggcgcgguguuuaccgaggagaaccagugggacagcgccaaagccgcaguggaggacgaagacuucuggaaacucgucgaccgggaacgcgaguugcacaaacuuggcaagugcggguccuguguuuacaacaugauggggaaacgggagaagaaauuaggagaguucgguaaagccaaaggcagccgcgcgaucugguacauguggcugggggcccgguaccuggaguucgaggcuuugggcuuccugaacgaagaccacugguucucuagggaaaacucguacuccgggguggagggcgagggccugcacaagcucggguacauccugcgcgauaucagcaagauacccggcggggcaauguacgcggaugacacggcuggcugggacacucgcaucacagaggacgaccugcauaacgaggagaaaaucacccagcagauggacccugagcaccgacaacuggccaaugcgaucuuuaaacugaccuaucagaacaaagucgugaagguucagcgucccaccccuaccggcacggucauggacauaaucagccggaaggaccagagggggagcggccagguggggaccuacggcuuaaauaccuucacaaacauggaggcgcagcucauccggcaaauggaaggggaaggcgugcugucuaaggcagaccuggagaacccacaccucccggagaaaaagaucacgcaguggcucgagaccaagggggucgaaagguuaaagcggauggcgauauccggggacgacugcguggugaagccaaucgaugaccgcuuugcuaacgccuugcuggcgcugaacgacaugggaaagguccggaaggacaucccccaguggcaacccuccaagggauggcaugacuggcagcagguccccuucugcagccaccacuuccaugagcucaucaugaaggacggucgcaaacuugugguucccugccgaccccaggacgagcugauagggcgcgcccgaaucagucagggugcgggcuggagucucaaggagaccgccugccugggcaaggcuuacgcccaaauguggucucugauguacuuccaccgucgcgaccuccggcuggcgagcaacgcuaucugcuccgccgugcccgugcauugggucccgaccagccgaacuacaugguccauacacgcgcaucaucaguggaugaccaccgaagacauguuaacuguauggaacaggguguggauugaggacaaccccuggauggaggacaagacccccguuaccaccugggagaacgugcccuaccucgggaaacgcgaggaccaguggugcgggagcuugaucggccucacgagccgggccaccugggcgcagaacaucccgaccgcaauccagcaggucagaagucucaucgguaacgaggaguuccuggacuacaugccaucgaugaagcgguuccgaaaggaggaggaguccgagggcgcgaucugguag

SEQ ID NO: 25877 - RNA, 9873 nt, Artificial Sequence
  derived and/or modified CDS sequence (opt11) from DENV-3__KF973483__SS-prME
accagccucugccucaugaugauucugcccgccgccuuagcguuccaccucaccagucgggacggggagccccggaugaucguggggaaaaacgagcggggcaagagccuguuauucaaaacagccuccgggaucaacaugugcacccucaucgcaauggaccugggcgagaugugcgaugacaccgugacauacaagugcccccacaucaccgagguggagcccgaggacaucgacuguugguguaaccucacuagcaccugggugacauacgggaccugcaaucaggccggcgagcaccgacgcgacaaacgguccguggcgcuugcaccgcacguggggauggggcuggacacccgcacccagaccuggaugagcgcggagggcgccuggagacagguggagaaggucgaaacgugggcccugcgccacccgggguucaccauccucgcccuguuccuggcccacuacauugggaccucucucacucagaaaguugucauuuucauccuacugaugcucguuacgccuagcaugaccaugcguugcgugggggugggcaaccgcgacuucguggagggccuguccggugccaccuggguggacgugguccuggagcacggcgggugcgugacuacgauggccaagaacaagcccacccucgacauagagcuucagaagaccgaggcgacccagcuggcgacgcuacggaagcugugcaucgaagggaagaucacgaacaucaccacggacagccgcugccccacgcagggcgaggccacccugcccgaggagcaggaucaaaacuacgucugcaagcacacuuacgucgaccggggguggggcaauggcuguggccuuuuugggaagggcucccuggugacaugcgccaaguuucagugccuggagcccaucgaaggcaaggugguccaguaugagaaccuuaaauauacggugaucaucaccguacacacgggggaccagcaccaggucggcaacgagacccagggggucacggcggagaucacgccccaggccagcaccaccgaggcgauccuucccgaguacggcacccuggggcuggagugcuccccgcgcacgggcuuagacuuuaacgagaugauccugcugaccaugaagaacaaggccuggaugguccaccggcaaugguucuucgaccugccgcugcccuggaccaguggcgccaccacugaaacccccaccuggaaucgaaaggagcugcuggucaccuucaagaacgcccacgccaaaaagcaggagguagucguacuugggagccaggagggcgcaaugcacacggcccucacuggggccacagagauccaaaacuccggugggaccuccaucuucgccgggcaccugaagugccggcugaagauggacaaacuugagcugaagggcaugagcuacgcaauguguaccaacaccuucgugcugaagaaggagguuucagaaacccagcaugggaccauccucauuaagguggaguauaaaggcgaagacgccccgugcaagauccccuuuucuaccgaggacgggcagggaaaggcucacaauggccgacugaucaccgccaacccuguggucaccaagaaggaggagcccgugaacauagaggccgagccgcccuucggggaaagcaauauagugaucggcaucggggacaacgcgcugaagaucaacugguacaagaaaggaagcucuauagggaagauguuugaggccaccgcccggggcgcccgccggauggccauucugggagauacagcgugggacuucgguuccguaggcggugugcuuaacagccugggcaagauggugcaccagauauuugggagugccuacaccgcccuguuuagcggcguaagcugggugaugaagaucggcauaggggugcuccugaccuggaucggccugaauagucgcaauaccuccaugagcuucaguugcauugccaucgguaucauuacgcucuaccucggcgcggucgugcaggcggacauggggugcgugaucaacuggaaggggaaagaguuaaagugcggcuccgggaucuuugucaccaacgaggugcacacguggaccgagcaauacaaauuccaggccgauuccccaaagcgccuagccacggccaucgugggggccugggagaacggggucugcggaauccggagcacuacacgcauggagaaucugcuauggaagcagaucgcgaacgagcuuaacuauauuuuaugggagaacaacauaaagcugaccgugguggucggggacauaaucggcgugcucgagcaggguaagcggacucugacgccccagccaauggaguuaaaguauucauggaagaccugggggaaggcgaaaauugugaccgccgagacgcagaacaguuccuucaucaucgacggcccuaacacccccgaaugccccagcgucagccgcgccuggaacgugugggagguggaggauuacggguuuggcguauucacuaccaauaucugguugaagcugcgggagaccuacacgcaacugugcgaccaccgccucaugagcgccgccguaaaagacgagcgggccgugcaugccgacaugggcuacuggaucgaaagccaaaagaacgguaguuggaaacuggagaaggccagccugaucgaggucaagaccugcaccuggccgaagucccauaccauuuggagcaacggcgugcucgaauccgacaugaucauccccaagagucuggcugggccuaucucccagcacaaccaucggccgggcuaccacacgcagaccgcggggcccuggcaccuggggaaguuagaauuagacuuuaacuacugcgagggcaccaccguggugaucacggagaacugugguacgcggggccccagcuugcgcacuaccacgguauccgggaaacuuauccaugaguggugcugccggagcugcacccugcccccgcugagauacaugggggaggacggaugcugguacggcauggagauccggcccaucucggaaaaagaggagaacauggucaagucccucguguccgccggcagcgggaagguggacaacuucaccaugggcgugcugugucuagcaauuuuauucgaggaggucaugcgaggcaaauucggcaagaagcacaugauugcugggguguuucugaccuuugucuuacuccugucaggccagaucacguggcgggacauggcgcacacccugaucaugauuggcagcaacgccuccgacagaauggggaugggcgucaccuaccucgcccuuaucgccaccuucaagauucagcccuuccuggcccucggguucuuccugcggaagcuaacgagccgcgagaaucuccugcucgggguaggccucgcgauggcuaccacccugcagcugccggaggacauugaacagauggccaacgguauugcccucggucuaauggcgcuaaagcucauaacgcaguuugagacguaccaguuguggacggccuuaaucagccugacuuguucgaacaccaucuucaccuuaaccguggccuggcggaccgccacccuuauccuggcuggggucagccuucuucccgugugccaguccaguucgaugcgcaagacggacuggcuccccauggccgucgccgccaugggcgugccgccccucccgcuguuuaucuucagcuuaaaggacacccugaagcgccgguccuggccccugaacgagggggugauggccguuggccucgugagcauacuugccuccagccucuuacgcaacgacguacccauggcgggcccccuggucgcugggggccugcugauagcuugcuacgugauuaccgggaccuccgccgaccuuacgguggagaaggcggcggauaucaccugggaggaggaagccgagcagaccggcguaagccacaaccugaugaucacaguggacgacgacgggaccaugagaaucaaggacgacgagaccgagaacauccucaccgugcugcugaaaaccgcccuccugauaguaagcggcaucuucccuuacagcauccccgccacccuguuaguguggcacacuuggcagaagcaaacccaaagaucuggcgugcugugggacguccccucaccacccgagacccaaaaagccgagcuggaggaggggguguaucggaucaagcagcagggcaucuucgggaaaacccagguuggugucggggugcagaaggaaggcguuuuccacacgauguggcauguuacccgcggcgcggugcucacguauaacgggaagcgguuagagccgaacugggcguccgugaagaaggaucugaucaguuauggcggaggcuggcgccucuccgcccaauggcaaaaaggggaggagguacagguuauugccguggagccuggcaaaaauccaaagaacuuccagaccaugccgggcacauuccagacuaccacuggggagaucggcgcgaucgcccuggacuucaagcccgggacaagcggcagccccaucaucaaccgggaggggaaggucguaggccuguacggaaacgggguggucaccaagaacggaggguauguguccggcaucgcccagaccaacgccgagccggacggccccacccccgagcucgaggaggagauguucaagaagcgcaacuuaacgaucauggaccugcaccccggaagcggcaagacucggaaauaucugccagccaucgugcgcgaggcgaucaagcgucgccucagaacccugauccuggcccccaccagggucgucgcagccgagauggaggaagcccuaaaaggucuacccauccgguaccaaacgaccgcgaccaaguccgagcacaccggacgcgagaucguagaccugaugugccacgccaccuucacuaugcggcuccugucccccguccguguaccgaauuacaaccucaucauaauggaugaggcccacuucacggaucccgccuccaucgcggcgcgaggguauaucagcacccgcgugggcaugggcgaggcagccgcgauuuucaugacggcgacgccaccugggaccgcagacgccuucccgcagagcaaugcccccauccaggacgaagaacgagacauccccgagcggucguggaauaguggaaacgaguggaucaccgacuucgccgggaagacggugugguucgugccguccaucaaggcgggcaacgauaucgcgaacugccuccgcaagaaugggaagaagguuauucagcugucccggaagaccuucgacacggaguaccaaaagacgaaauuaaacgacugggacuuugucguaaccaccgacauuagcgagaugggcgccaacuucaaagccgaucgcgugaucgacccgcggcgcugccucaagcccguuauucucacugacggacccgaacgagugauccuagccggucccaugccgguuaccgcggccuccgccgcgcagagacgcggccgcguggggcggaacccucagaaggagaaugaccaguacauauucaccgggcagccccucaacaacgacgaggaccacgcccacuggacggaggcgaagaugcuguuggauaacaucaacacaccugagggcaucaucccggcccucuucgaaccggagcgcgagaaguccgccgccaucgauggcgaguaccggcugaagggcgagucucgcaagacuuuuguggagcugaugcggcgcggggaccugccugugugguuagcgcauaaggucgccagcgagggcaucaaguauaccgaccggaaguggugcuucgacggacaacgcaauaaccagauacucgaggagaacauggacgucgaaauuuggacgaaagagggcgaaaagaaaaagcuccggccucgguggcuugacgcacgcaccuauuccgacccacuagcccucaaggaguucaaggaguucgcagccgggagaaagucaaucgcccuggacuuggucaccgaaaucgggcgcgugccaucccaccuagcucacagaacccgcaaugcccuggacaaucuggugauguugcacacgucugagcauggagggcgggcguaccgccacgccgucgaagaacugcccgagacgauggaaacccugcuccugcuaggacucaugauccugcugaccgggggcgccaugcuguuccugauuaguggcaaggggauuggcaaaaccuccaucggacugaucugcgucaucgccuccuccggcaugcucuggauggccgaaaucccucuacaguggauagccagcgcgaucgugcuggaguucuucaugaugguucuccugauaccggaacccgagaagcagcggacgccccaagacaaccagcuggccuacguggugaucgguauccucacccuggccgccaucauagcggcgaacgagaugggucugcucgagaccacgaagcgcgaccuuggcauguccaaagagccgggggucgugucccccaccucguaucuggacguggaucuccaccccgccagcgccuggacccuguacgccgucgcgaccacggugaucacucccaugcugcgucacacgaucgaaaacuccaccgcaaacguuagccuggccgccauugccaaccaagcggucguguugaugggacuugauaagggguggccaaucuccaagauggaccuaggcgugccccuguuagcgcucgguuguuacagccaagucaacccucugacgcugaccgcagccguccuccugcuaaucacccacuaugcgaucaucggcccuggccuucaggcgaaagccacccgcgaggcccagaagcggacggcggccggaaucaugaaaaacccgacgguggacggcauaaugaccauugacuuagacccggucaucuacgauuccaaguucgaaaagcagcugggccagguuaugcuccuaguccugugcgcgguccagcuccuucugaugcgcaccagcugggcgcucugcgaggcccuaacucuggccaccggccccaucaccacccucugggagggauccccggggaaguucuggaacacgaccaucgccgugagcauggccaacaucuuucggggcuccuaccuggccggggcgggccuggccuucagcaucaugaaauccguggguaccggcaagcgcggcaccgggagccagggcgagacccuuggcgaaaaauggaaaaagaagcugaaccagcugagcaggaaggacuuugaucucuacaagaagucaggaauuacggaggucgaccgcacggaggcuaaggaggggcuuaagaggggagagaucacccaccacgccguaucacgcgguuccgcgaaacuucagugguucgucgagcguaacauggucaucccggagggccgagugaucgaucuuggcugcggucggggcgguuggagcuacuauugcgcuggccugaagaaggugacugagguccgcggauacacgaagggcggcccugggcacgaggagccagugcccaugucaaccuacggguggaacaucgugaagcuaaugagcggaaaagacgucuucuauuuaccgcccgagaagugcgauacccugcugugcgacaucggcgagucgagcccaucgcccacaguggaggagagccgcacuauccgugugcugaagauggucgagccguggcucaagaacaaccaguucugcaucaagguacugaacccuuacaugcccacagugauagagcaccuggagcgccuccagcggaagcacggagggaugcugguccgcaacccacuuucgcggaauagcacccacgagauguauuggaucuccaacggcacugggaacauuguggccagcgucaacauggucucucgccugcuauugaauagauucacgaugacccaccgacgucccacaaucgagaaggacguagaccucggcgcgggcacccgccacguaaacgccgagccagagacgcccaacauggacgucaucggggagcggaucaagaggaucaaggaggagcacaacagcacuuggcacuacgaugacgaaaacccguacaaaaccugggcuuaccacggcucuuacgaggugaaggcgaccgggucagcgagcucgaugauuaacggcguugucaagcugcugacgaagcccugggacguggucccaauggugacccagauggcgaugaccgacacuacgcccuucgggcagcagcggguauuuaaggagaaagucgacacccgcacuccgcggucaaugcccggcacccgccgggugaugggcaucacggccgaguggcucuggcgcacgcuggggcggaauaagaagccccgccucugcacccgggaggaguucaccaagaaggugcggacgaacgcagcuaugggugcgguuuucacugaagagaaccagugggacagcgcaaaagccgccgucgaggacgaggacuucuggaagcucguugaccgcgagcgggagcugcacaagcugggaaaaugcggaagcugcgucuauaauaugauggggaagagggaaaagaaacugggcgaguucggaaaggcaaaggggagccgggcaaucugguauauguggcugggcgcccgcuauuuagaguucgaagcccucggguuucugaacgaagaccacugguucagccgcgagaacucauacucaggcguagagggggagggccugcauaaacuugguuacauccugcgcgacaucuccaagauucccgggggcgccauguacgccgacgauaccgcggggugggauacgcggaucaccgaggacgaccuucacaacgaggagaagaucacccagcagauggacccggagcaccgucagcucgccaacgccaucuucaagcugaccuaucagaacaagguggucaaggugcagagacccaccccaaccggcacgguaauggacauuaucucacgcaaggaccagcggggcagcggacaggucgguacauaugggcugaacaccuuuaccaauauggaggcccagcuaauccgccaaauggaaggugagggggugcucagcaaggccgauuuagagaauccccaccucccggaaaagaagaucacgcaguggcucgagaccaagggcguggagcggcugaagcgcauggcgauuuccggagaugacugcguggugaagccgaucgacgaccgguucgccaacgcccuccuggcacugaacgacauggggaaggugcgaaaggauaucccacaguggcaacccaguaagggcuggcacgacuggcaacaaguuccguucugcucccaccacuuccacgaguugaucaugaaggacgggcggaaguugguggugcccugccgcccgcaggaugagcugauugggcgggcccgcaucagccagggggcgggguggucccuaaaggagaccgccuguuugggcaaggcuuacgcccagauguggagccuuauguacuuucaccgacgggaccuccgccuagccuccaacgccauuugcagcgcgguccccgugcacugggugccgaccuccaggacgaccuggagcauucaugcucaccaccaguggaugacaaccgaagauaugcugacggucuggaaucgcgucuggauagaagacaacccguggauggaggacaagaccccugugaccaccugggagaacguccccuaccuugggaagcgggaagaccaguggugcggcagccugaucggguuaacgucccgcgcgaccugggcgcaaaacaucccgaccgcaauccaacaggugcggagccuaaucggcaacgaggaguuccuggacuacaugcccucuaugaagcgcuuucguaaggaggaggagagugagggggcuaucugguga

SEQ ID NO: 25878 - RNA, 9873 nt, Artificial Sequence
  derived and/or modified CDS sequence (opt11) from DENV-3__KF973485__SS-prME
accagccucugucucaugaugauccugcccgccgcccuggcguuccaccucaccagccgggacggcgagccccggaugauagucgggaagaaugagcggggcaagagccuguuauucaagaccgccuccgggaucaacaugugcacccucaucgcaauggacuuaggcgaaaugugcgacgacaccguaaccuacaagugcccucacaucaccgagguagagcccgaagauaucgacugcuggugcaaccugacaagcaccugggugacauacgggacgugcaaccaggcaggggaacaccggcgcgacaagcgcagcguggcgcuggcaccccacgugggcauggggcuggauaccaggacucagaccuggaugagcgccgagggcgccuggagacagguugagaagguggagacuugggcccugcgccacccaggguucacgauccucgcgcuguuccuggcacacuacaucggcaccucccucacccaaaaaguggugaucuucauccugcucauguuggucacgcccagcaugacgaugcgcugcgucggcgugggcaaccgcgacuucgucgaggggcuuuccggggccaccuggguugaugugguccuggagcacggugggugcguaaccacgauggcaaagaacaaaccaacauuggacauugaacugcagaagaccgaggcaacccagcuggcgacgcuucggaagcugugcaucgaggggaagaucaccaacaucacaaccgacagccgcugcccgacgcagggcgaggccacacugccggaggagcaagaccagaacuacgucugcaagcacacauacguugaccggggguggggcaacgggugcggccucuucgggaaagguucccuggugaccugugccaaguuucaaugcuuggagcccauagaaggcaaggugguccaguacgagaaccugaaguacacugucaucaucaccgugcacaccggggaucagcaccaggucggcaacgagacacaaggggugacggccgaaaucacgccccaagcaagcaccacugaagcaaucuuacccgaauacgggaccuuagggcucgagugcuccccgcgaacuggccuggacuucaacgagaugauccuacugaccaugaagaauaaggccuggaugguccaccggcaaugguucuucgaccugccccugccauggaccagcggcgcuaccacggagacccccaccuggaacaagaaggagcuccuggugaccuucaagaacgcucacgcuaagaagcaggagguggucguguuagguagucaggagggcgcgaugcacacggcucucaccggagccaccgagauccagaacaguggcgggacguccauuuucgcgggccaccugaagugcagacugaaaauggacaaacuggagcugaagggcaugagcuacgccaugugcacaaauaccuucgugcugaagaaggaggucucagagacucaacacgggacuaucuuaaucaagguggaauacaagggcgaggaugugccgugcaagauacccuucucgacggaggauggacagggcaaggcgcacaacggccgccugaucacugccaaccccgucgugacgaagaaagaggagcccgugaacaucgaggccgagccgcccuucggggagagcaacaucgucaucggaaucggggacaacgccuugaagaucaacugguacaagaagggcuccagcauagggaagauguucgaggcgaccgcccgcggcgcccggcgaauggcuauccugggugacacggccugggacuucgguuccgugggcggggugcucaacagccugggcaagaugguccaccagauuuucggguccgcuuacaccgcccuguuuagcggagugagcuggguuaugaaaaucggcauuggagucuugcugaccuggauaggccucaacagcaagaauaccucgaugagcuucaguuguaucgccaucggcauaaucacgcucuaucucggugcggugguucaggccgacauggggugcgucaucaacuggaagggcaaggagcugaagugcggaagcggcauuuucgucacaaacgaggugcauaccuggacugagcaguacaaauuucaggcagauucccccaagcggcucgcaacagccaucgccggugccugggagaacggggucugcggcauccgcagcacgacacgcauggagaaccugcucuggaagcagauagcgaaugaacucaacuacauacugugggagaacaauaucaaacugaccguuguggugggggacaucaucggggugcucgaacagggcaaacggacgcugacgccgcaacccauggaguuaaaauacucuuggaagaccuggggcaaggccaaaaucgugaccgccgaaacacagaacagcuccuuuauaaucgacggccccaauacacccgagugcccgagcguuucccgcgccuggaaugugugggaaguggaggauuacggguucggcgucuucaccaccaacauuuggcugaagcugcgggaagugcacacccaauuaugcgaucaccggcugaugagcgcggccguuaaggacgagcgggcaguccacgccgacaugggcuacuggaucgagagccagaagaacggaagcuggaagcuggagaaggccagccugaucgaggugaagacauguaccuggccgaagucucacacccuuuggucuaacggcgugcucgagucggacaugaucaucccaaaaagccuggcggggcccaucucccagcacaaucaccgcccgggcuaccacacccagacggccgggccauggcaccuaggcaaacuggaguuagacuuuaauuacugcgagggcaccaccgucgugaucaccgagaacugcgggacuagaggccccagccuacggacaacuaccguguccgguaaacugauccacgaguggugcugccggagcugcacucugcccccgcugagauauaugggagaggacggcuguugguacggaauggaaauucgacccaucucugagaaggaggagaacauggucaagagcuuaguguccgccggcucggggaagguggacaacuucaccauggguguccuaugucucgccauccuguucgaggaagugaugcgcgggaaguuuggcaagaagcauaugauugccggaguuuucuucaccuucguccugcucuuguccggccagaucaccuggcgggauauggcgcacacguugaucaugauaggcagcaaugccuccgaccgcauggggaugggcgugaccuaccuagcccugaucgccaccuucaagauccagcccuuucuugcgcucggauucuuccugcgcaagcucaccagccgcgagaaccucuugcuggguguggguuuagcgauggccacgacccugcaguuaccugaggacaucgagcagauggcuaacgggaucgcacucggccuaauggcgcugaagcucaucacucaguucgagacuuaccagcuguggacggcccugaucagccugaccuguuccaacaccaucuucacccugacggucgccuggcggaccgcaacacugauccuagccggagugagcuuacugccugucugccaguccagcuccaugcgcaagaccgauuggcuccccauggcaguggccgcaauggggguuccgcccuugccgcuauucauauucggauugaaggacacgcugaagcgacgguccuggccacugaacgagggcgucauggcugugggccucguauccauccuggcuagcucccugcuccgcaacgacgucccuauggcggggccccugguggccggcgggcugcucaucgccugcuacgucauaacuggcacaagcgcggaccuuacggucgaaaaggccgcggacauaacgugggaggaggaggccgagcagacggguguuucccacaaccugaugaucaccguagaugacgacggcaccaugaggaucaaggacgacgagaccgagaauauccucacgguccugcuaaagaccgcccuccugaucgucagcggcaucuucccguauucaauucccgccacccugcucguguggcacaccuggcaaaagcagacgcagcgcucuggggugcugugggacguacccagcccgcccgaaacccagaaggccgaacuugaggagggcguguacagaaucaagcagcaagggaucuucggcaagacccaggucggggugggagugcaaaaggagggcguuuuucauaccauguggcacgugacgcguggugcggugcuaaccuacaaugguaagcggcuggagccaaauugggcaagcgucaagaaagaccugaucuccuacgggggcggauggcgccuuagcgcccaguggaagaagggcgaggagguccaggugaucgccgucgagcccggcaaaaaccccaagaauuuccaaaccaugcccgggacauuccagacgaccaccggcgagaucggggcgaucgcucuggacuuuaagcccggcaccuccgggucccccauaaucaacagggaggggaagguggugggccuguaugggaacggcgucgugacgaagaacgggggcuacgugucuggcaucgcucagaccaaugccgaaccggacgggcccacccccgagcuugaggaggagauguuuaagaaacgcaaccuaaccaucauggacuugcaccccggcaguggaaagacuagaaaguaccuaccggccaucguccgcgaggcuaucaaacggcgccuucggacgcugauucuggcccccacccgcgugguggcggccgagauggaggaggcccucaagggccugcccauccguuaccaaacaacggcaaccaaaagcgagcacaccggucgcgagaucgucgaccuaaugugucacgccaccuuuacgaugcggcuccugucucccgugcgcgugccgaacuacaacuuaaucaucauggacgaggcccacuucaccgaccccgcauccauagcugcgcggggcuauauuuccaccagggugggcaugggugaggccgccgcuauauucaugaccgcgacgccgcccggcacggcggacgcuuucccgcagagcaacgcccccauccaagaugaagaacgggauauccccgagagaucguggaauagcgggaacgaguggaucaccgauuucgccgggaagaccgucugguuuguucccucuaucaaggcggggaacgacauugcgaacugccucaggaagaacggcaagaaggucauccagcugagccguaaaacguucgauaccgaguaccagaagaccaagcugaaugacugggacuucgucgugaccacagacaucucggagaugggcgccaacuuuaaggccgaccgcgucauugacccgcgucgcugccuuaaacccgugauccugaccgacggcccagagcgggugauccuggccggccccaugccggucaccguggccagcgccgcccagcgccggggucgcgugggccggaacccccagaaagagaacgaucaguacauauucaccgggcagcccuugaacaaugaugaagaccaugcccauuggaccgaggccaagaugcuucuggacaacaucaacacacccgaaggcaucauaccagcccuauucgaacccgaacgcgagaaguccgccgccaucgacggcgaguaccggcugaaaggggagagccgcaagaccuucgucgaacugaugcggcgcggcgaccucccaguguggcucgcgcacaagguagcguccgaggggaucaaguacacugaucgaaaguggugcuucgacggacagaggaacaaucaaauacuggaggagaacauggacguggagaucuggaccaaggagggggaaaagaagaaacuucggccucgcuggcuggaugcccggacguauagcgacccgcuggcacucaaggaauuuaaggaguucgccgccgggcgcaaaagcauugcucuggaucucgugaccgagauaggccggguccccagccaucucgcacaccgcaccaggaacgcucuggacaaccuggugaugcuccacaccuccgagcacgggggccgggccuaccgccaugcgguggaggagcugcccgagacgauggagacccugcuccuccuugggcucaugauuuugcugaccgguggcgcgaugcuauuccuuaucucagggaaggguaucgggaaaacuucuaucggccugaucugugucauagccuccuccgggaugcuauggauggccgagaucccgcugcaauggaucgcuuccgccaucgugcuggaguucuuuaugauggugcuacugaucccugaaccugaaaagcagcgaacgccccaggacaaccagcuugcguacgucgugaucgggauccucacacuggccgcaauuaucgcggccaacgagaugggccugcucgagaccaccaagcgugaccugggaaugucuaaggagccgggcguggucucccccacgagcuaccuggacguggaccuccaccccgcgucugccuggacccuguacgccguggccaccaccgugaucacgcccaugcugcggcacacaaucgagaacagcacagcgaacgugagucucgcagccaucgccaaccaggccgucguccuuauggggcuugacaaaggcuggccgaucagcaagauggaucucggggugccgcuguuggcgcuaggcugcuacucucaagugaacccacugacccugacggcggccguccuccugcugaucacccacuacgccaucauagggcccgggcuccaagcgaaggcuaccagggaggcccagaaacggacagcugccggcaucaugaagaacccaacgguggacgggaucaugaccaucgaucuugaccccgugaucuacgacucuaaguucgaaaagcagcugggccaggucauguuauugguucugugcgugguccagcuucugcugaugcgcacuucaugggcacucugugaggcguugacccuggcaacgggcccuaucacuacccuuugggaagggagcccuggcaaguucuggaacacuaccaucgccguguccauggccaacaucuuccgagggucuuaccuggcgggcgccggucuggccuucaguauuaugaagucugugggcaccggcaagcgcgggaccgggagccagggggagacccuaggcgagaaguggaaaaagaagcugaaccaauugagccgcaaagacuucgaccuauacaagaaaagugggauuaccgagguggaccgcacggaagccaaggagggccuuaagcggggugagaucacgcaccacgccgugagccgggggagcgcgaaacuucagugguucguggagcggaacauggucaucccggagggccgcgugaucgaccuuggcuguggccgcgggggcuggaguuacuacugugcgggccugaagaaagugaccgagguccgcggguacaccaagggcgggcccggucaugaggagccgguucccaugucgacguacggguggaauaucgucaagcugauguccggcaaggacgucuucuaccuuccgccugagaagugcgacacccuacugugcgauaucggcgagagcucacccagccccaccguggaggaguccagaacgaucagaguacugaaaaugguggagccguggcucaaaaauaaccaguucuguauaaagguguugaaccccuacaugccgacggugauagaacaccuggaacgcuuacagcggaagcacggagggaugcugguccgcaauccguuaucccggaacuccacccacgagauguacuggaucagcaacgggaccggcaauauaguagccuccgugaauauggucagccgccuccugcucaaccgguucaccaugacgcaccgccguccgaccauagagaaagacguggaccucggcgcagggacccgccacgugaacgcagagcccgagaccccaaacauggaggucaucggcgagcggaucaaacgcaucaaggaggagcacaacuccacguggcacuaugacgaugagaacccguauaaaaccugggcguaccacgggagcuacgagguuaaggcuaccgguuccgcgaguuccaugaucaacgggguagugaagcuccuuaccaagccgugggacaugguacccauggucacgcagauggccaugaccgauaccacccccuucggccagcagcggguguucaaggagaagguggacacgcgcacuccgcggagcaugcccggcacccgccgagucauggggaucaccgccgaguggcucuggaggacucugggucguaacaagaagccccgccugugcacccgcgaggaguucaccaagaaggugcgcacaaacgcggcaaugggggccguguucacggaggagaaccagugggacagcgcgaaggccgcugucgaagacgaagacuucuggaaacucguagaucgcgaacgggagcugcacaaacugggcaagugcgggaguugcgucuauaacaugaugggcaagcgcgagaagaaacucggcgaguucggaaaggccaagggcagccgggccaucugguauauguggcugggugcacgcuaccuggaguucgaggcgcuuggguucuugaacgaggaucacugguucucccgggagaacagcuacucgggggucgagggugaaggccugcacaaacuaggcuacauccugcgcgacauaagcaagaucccgggaggggccauguacgccgacgauaccgcuggaugggacacccgaaucaccgaggaugaccugcacaaugaggagaagauaacgcagcagauggacccggagcaccgccaacuagccgacgcgaucuucaagcugaccuaccaaaacaagguugugaagguccagaggcccacuccaaccgggaccguuauggacaucauuucccgaaaggaccagcgggggagcggccaggugggcacguacggccugaacacguucaccaauauggaggcccagcucauucgccagauggagggggagggcguccuuuccaaggccgaccuggagaacccacaccucccggagaagaagaucacccaguggcuggagaccaagggcgucgagcggcugaaacgcauggccauaagcggggacgacugcguggucaagcccaucgacgauagauucgccaacgcgcucuuggcucugaaugauaugggaaagguccgcaaagacaucccccaguggcaacccuccaaaggauggcacgacuggcaacaggugccguucugcagccaucacuuccaugaacucaucaugaaagacggccggaagcugguaguacccugccgcccacaggacgagcugaucgggcgggcccguaucucccagggugcgggcuggagccucaaggagacggccugccugggaaaggcguacgcccagauguggucccucauguacuuccacagacgcgaccuccgccuggccagcaacgccauaugcucagcgguucccguccauugggugccuaccagcaggaccacgugguccauccacgcccaccaccaguggaugacuaccgaggacaugcugaccguguggaaccgcgucuggaucgaagacaacccguggauggaggacaaaacgcccgugaccacuugggagaacgugccuuaccucggcaagcgggaggaccaguggugcgggagccugaucgggcugaccagcagagccacuugggcccagaacauuccgaccgccauucagcagguccggucccuaauugggaacgaggaguucuuggacuauaugcccaguaugaagcgcuucaggaaggaggaggaaagcgaaggcgcgauaugguga

SEQ ID NO: 25879 - RNA, 9873 nt, Artificial Sequence
  derived and/or modified CDS sequence (opt11) from DENV-3__KF973486__SS-prME
accagccugugccucaugaugaucuuaccggccgcccuggcguuccauuuaaccagccgugacggagaaccccguaugaucguggggaagaacgagcguggcaagagccuucuguucaaaacugccagcggcaucaacaugugcacccucaucgccauggaccugggagagaugugugacgacaccgugaccuacaaauguccccacaucacagagguugagcccgaggacaucgacugcuggugcaaccugacgagcaccugggucaccuacggcacguguaaccaagcaggcgagcaccggcgagacaaaagaucuguggcccucgcgccccacguaggcauggggcuggacacccgcacccaaaccuggaugagcgccgagggcgcauggcgccagguggagaaggucgagacgugggcucugcgccacccggguuucaccauauuagcgcuguuccuggcccacuauaucgguaccucccucacccagaaaguggugaucuucauccugcugaugcucguuacgcccagcaugaccaugagaugcgugggcgugggaaaccgcgacuucgucgagggccuguccggggccaccuggguggacgugguccucgaacacggcgggugcgugaccaccauggccaagaacaagcccacccucgauaucgaacugcagaagaccgaagccacucagcuggcgacgcuccggaagcugugcaucgagggcaagaucaccaacaucaccaccgacagccgcugcccgacucagggcgaggccacccugccggaagaacaggaccagaacuacgucugcaagcacaccuacgucgaccggggauggggcaacggaugcggccucuucgggaaaggcucgcuggugaccugcgccaaauuccagugccuggagccgauagaagguaaggucguacaauaugagaaccucaaguacacggugaucaucaccgugcacaccggggaccagcaccaagucggcaacgagacccaggguguaacggcugagaucacgccccaggccucaaccaccgaagcuauacugcccgaguacgggacccugggccucgaaugcuccccccgcacgggccuggacuucaacgaaaugauccugcucaccaugaagaacaaggccuggaugguccaccggcagugguucuucgaccugccccugcccuggaccagcggagccaccacggagacccccaccuggaaucgcaaggagcuccuggugaccuucaagaacgcacacgcuaagaagcaagaggucgucgugcuagggucucaggagggcgcgaugcacacagcauuaaccggggccaccgagauacagaauucuggcgggaccuccaucuucgccggccaccugaagugccggcugaagauggacaagcuagaacugaaggggaugagcuacgcgaugugcacgaacaccuucguucugaagaaagaggucuccgaaacccagcaugguaccauccugaucaaagucgaguacaaaggcgaggacgugccgugcaagauccccuucagcacggaggauggccagggcaaggcccacaacggccgccugauuacggccaaccccguggucaccaagaaggaggagcccgugaacaucgaggcugagccgcccuucggugagagcaacaucgucaucggcaucggugacaacgcccuaaagaucaauugguacaagaagggcuccuccaucgggaaaauguucgaggcuaccgcccggggcgcccgacggauggccauccugggcgacacggccugggacuucgggagugugggcgggguacucaacagccugggcaagauggugcaccaaaucuuugggagugcauauacagcacuguucagcggcguguccugggugaugaagaucggcaucgggguuuuacugaccuggauaggccugaacagcaagaacaccuccaugagcuucuccuguaucgccauagggaucaucacgcucuaccugggcgccguggugcaggccgacauggggugcguaaucaacuggaagggcaaggagcuaaaguguggcagcgggauuuucgugaccaacgaggugcauaccuggaccgaacaguacaaguuccaggcugacagccccaagaggcucgccacggcgaucgcgggcgcgugggagaauggggucugcggcauccgcagcaccacccggauggagaaccuucuguggaagcagaucgcgaacgaguuaaacuacauccugugggagaacaacauuaagcuaaccgugguggucggggacaucauuggcguacucgagcagggaaagcgcacauuaacuccucagcccauggagcugaaauauuccuggaagaccugggguaaggccaaaaucgugaccgcugagacucagaacagcuccuucaucaucgacggccccaacacccccgagugccccaguguaucccgggccuggaacgucugggaggucgaagacuacggguuuggcgucuucaccacgaacaucuggcucaagcugcgcgagguguacacgcagcucugcgaccaccggcucauguccgcggccgugaaggacgagcgcgcuguccacgcggauaugggauacuggaucgaaagccaaaagaacggguccuggaagcuagaaaaggcaagccugaucgaggugaagacaugcaccuggccgaaaucccacacccucuggagcaauggcguucucgaauccgacaugaucauccccaagucucuggcggggcccaucucccagcacaaccaccggccgggcuaucacacccagaccgccggacccuggcaccucgggaagcuggagcuggacuucaacuacugugagggcaccaccgucgugauaaccgagaacugcgggacccgcggcccaucacuccgcaccaccaccguuagcgggaaacugauccacgaguggugcugccgcuccugcacgcugcccccacuccgguauaugggcgaggacgggugcugguacggcauggagauccgccccaucucugaaaaagaggagaauauggugaagagccugguguccgcgggguccgggaaaguggacaauuucaccaugggggucuugugccucgcgauccuguucgaggaggugaugcgcgggaaauucggcaagaagcauaugaucgccgggguguuuuucaccuucgugcuguuacucuccggccagauuacauggcgcgacauggcgcacacguugaucaugaucggcagcaaugcuuccgaucggauggggaugggcgugacguaccucgcccugaucgccaccuucaagauccagccauuucuggcccucggguucuuccuccgcaaacugaccagccgggagaaccugcugcuggguguuggucucgcgauggcaacgaccuugcagcugcccgaggauauagaacagauggccaacgggaucgcccucggucugauggcgcugaaacucaucacgcaguucgagaccuaccagcuguggacggcgcugauaagccugaccugcuccaacaccaucuucacccugacggucgccuggcgcaccgccacgcugauucucgcggggguaagccugcugccgguaugccaguccagcuccaugaggaaaaccgacuggcuccccauggccguggcagccaugggcgugccgccucuaccguuguuuaucuucgggcuaaaggacacucugaagcgccgcaguuggccccugaacgagggggucauggccguuggccucguauccauccuggccuccucccugcuucggaacgacguccccauggcggggccccuggucgccggcggauugcucauagcuugcuacgugaucaccggcaccuccgccgaccugacagucgagaaggccgcugacaucacuugggaggaagaggccgagcagaccgggguuucccacaaccugaugauaaccguggacgacgacggcaccaugcgcaucaaggacgacgagacggagaacauccucacuguccugcuaaagaccgcgcuccugaucgugagcggcaucuuuccguacuccauccccgccacccugcucguguggcacaccuggcaaaagcagacgcagcggucggggguccugugggacgugcccagcccgcccgagacacagaaggccgaguuagaggagggcguguaccgcaucaaacagcaggggaucuucggcaagacccaggucggggugggggugcagaaggagggcgucuuccacaccauguggcacgugacgcgcggggcugugcucaccuacaacggcaagcggcuggagcccaauugggcuucggucaagaaggacuugaucuccuacgggggcggguggaggcucagcgcucaguggcagaaaggcgaggagguccaggugaucgccgucgagcccggcaagaacccuaagaacuuccaaacgaugccagggaccuuccaaacgaccaccggagaaaucggugcgauagcacuggacuucaagccgggcacguccggcagcccaaucaucaaccgcgaggggaaaguggugggccucuacggaaacggcgucgugacgaagaacggcggguacgugagcggcaucgcccagaccaacgcugagccggaugggcccacccccgagcucgaggaggagauguucaagaaacggaaccuaaccaucauggaccugcacccuggcucaggcaagacgcgcaaguaccugccggccaucguccgugaggcgaucaaaaggcggcuccgcacccugaucuuagcccccacccgggugguggcagccgagauggaggaggcccucaagggccugccgauccgcuaccagaccacugcgaccaagagcgagcacaccgggcgggagauugucgauuuaaugugccacgccaccuucaccaugcggcucuuaucccccgugagaguuccgaacuacaauuuaaucaucauggaugaagcacacuuuacggacccugccagcaucgccgcgcgcggcuacaucuccacccgagucggcaugggcgaggcagccgcgaucuucaugaccgcgacgccgcccggaaccgccgacgccuuuccgcagagcaacgcccccauccaggacgaggagcgcgacauccccgagcgcuccuggaacagcgggaacgaauggaucaccgacuucgccggcaagaccgugugguuugucccauccaucaaggcggggaacgacaucgcgaacugucuccggaagaacggcaagaaggucauccagcugagccgcaagacguucgacacugaguaccagaagaccaagcucaacgacugggacuucgugguaaccacggacaucuccgagaugggggccaacuuuaaggccgaucggguuaucgacccgcgucggugccucaaacccgugauccugaccgacggacccgagcgcgugauucuggccgggcccaugccugugacggccgcuuccgccgcccaacggcguggccgaguuggccgcaacccccagaaagagaacgaccaguacaucuucaccgggcagccccucaauaacgaugaggaccacgcgcacuggaccgaggcgaagaugcugcuggacaauaucaacacucccgagggcaucaucccggcccucuucgagcccgaacgugagaaaagugccgccaucgacggcgaguaccgccugaagggugaaagccgaaagaccuucgucgaacugaugcgccggggagaccuccccguguggcuagcgcacaagguggccucugaggggauaaaguacaccgaccgcaaguggugcuucgauggucaaaggaacaaccagauccuggaagaaaauauggacgucgagaucuggaccaaggagggcgagaagaagaagcuccgcccacgguggcuggacgcccgcaccuacagcgacccgcuggcgcucaaggaguucaaggaauucgcugcggggcguaagucaaucgcucuggaccuggugaccgagaucggccgggugcccagccaccucgcccaccgcacacgaaacgcacuggacaaccuggucaugcuccacaccuccgagcacgggggccgcgccuaccgucacgcgguggaagagcugcccgagacgauggagacccugcuucugcuggggcucaugauacuucugacgggcggcgccauguuguuucugaucagcgggaagggcaucgggaagacaagcaucggccugaucugcguaauagcguccuccgggaugcuguggauggccgagaucccgcuucaauggaucgcauccgcgauuguccucgaguucuucaugauggugcuccugauccccgagcccgagaagcagcgcacaccccaggauaaucagcuggccuaugugguuaucggcauccucacccuggccgcgauaauugccgcuaacgagaugggccugcucgagaccaccaagcgggaccuggggaugagcaaagagccaggcguggugucccccacgagcuaccuggacgucgaccuccaccccgcguccgcguggacccuguacgcaguggcgacuacagugaucacucccaugcuucgacacacuaucgaaaacagcacggccaacgugucccucgccgccaucgcuaaucaggcggugguccuaauggggcuggauaaaggcuggccgauuagcaaaauggaucucggggcgccccuacuggcccucggcugcuacucccaggucaacccacugacccucacggccgccgugcuacugcugaucacccacuaugcgaucaucggccccgggcuccaggccaaggcgacccgggaggcccaaaagaggaccgcugcgggcauaaugaagaacccaacggucgacgggauuaugaccaucgacuuagaccccgucauuuacgacucgaaguucgagaagcagcugggccaggugaugcuccugguguugugcgccguccagcuccugcugaugcggaccaguugggcccucugcgaggcccugacacuggcgacuggccccaucacgacccucugggaggggagcccaggcaaguucuggaacacgacgaucgccguguccauggcgaauaucuuuaggggaaguuaucuggcgggcgccggccuggcauucucaaucaugaaguccgugggcacggguaagcgggggacaggcucccagggggaaacccugggcgagaaguggaagaaaaagcugaaucagcugagccgcaaggacuucgaccucuacaagaaguccgggaucacagaggucgaccggacggaggcgaaggaaggccugaagcgcggcgagaucacccaccacgccguaagccgggggagcgccaaacugcagugguuuguggagcgcaacauggucaucccggagggcaggguaaucgaccucgggugcggccgugggggcuggucauacuacugcgccggccugaagaaggugaccgagguccggggguacaccaagggcgggcccggccacgaggaaccgguaccuaugagcacguacggauggaacaucgugaagcugaugucuggcaaggacgucuucuaucucccgcccgagaagugcgacacccuccugugcgacaucggcgagucaucccccagccccaccguggaggagagcagaacuauccgcgugcugaagauggucgaaccguggcucaagaacaaccaguucugcaucaaggugcugaacccuuacaugcccacugugaucgagcaccuggagcgguuacagcgaaagcacgggggcaugcuggucaggaacccccugagccgcaacuccacgcacgagauguacuggaucagcaacgggaccggcaacauaguggccuccgugaacauggucagccggcuucugcucaaccgcuucaccaugacgcaccggcgcccgaccaucgagaaggacguggaccucggagcggggacccggcaugugaaugccgagcccgagacacccaacauggacguuaucggcgagcgaaucaagcggauaaaggaggaacacaauagcacguggcacuaugacgacgagaacccguauaagacuugggccuaccacgggaguuacgaggugaaagcuaccggcuccgcuucuuccaugaucaacggggugguaaagcugcugaccaagcccugggacgugguacccaugguaacgcaaauggccaugacggacaccacccccuucggccagcagcguguguucaaggaaaaggucgacacccggaccccccggagcaugcccggcaccagacgcgucauggggaucacugccgaguggcuuuggcggacguuaggucgcaacaagaagccucggcuaugcacccgcgaggaguucaccaaaaaggugcguaccaacgccgcgaugggugccgucuuuacggaggaaaaccagugggacagcgccaaggccgccguggaggacgaggacuucuggaagcucguggaucgggagcgcgagcugcacaagcuggguaagugcggcagcugcgucuacaacaugaugggcaagcgggagaagaagcucggcgaguucgggaaagcaaagggcagccgcgccaucugguacauguggcugggggcccgguaccuagaguucgaggcgcucggcuucuuaaacgaggaucacugguucucacgcgaaaacucuuacuccgggguggaaggggagggccugcacaagcucggguacauucuccgggacauuagcaagaucccaggcggcgcgauguacgcugacgacacagccggcugggacacccgcaucaccgaggacgacuuacacaaugaagagaaaaucacgcaacaaauggacccggaacacagacagcucgccaacgccaucuucaagcugaccuaccagaauaaggugguuaaggugcagcggccaacgcccaccggcaccgugauggacaucaucucccggaaggaccagcgggggagcggccaggucgggacguacggccugaacaccuucaccaauauggaagcccaacugauccggcagauggagggcgagggcguacuguccaaagcugaccuggagaacccccaccucccggagaagaagaucacccagugguuggaaacgaagggaguggagagauuaaaacggauggccaucagcggggacgacugcgucgugaagcccauugacgaccgcuucgcgaacgcgcuccuggcauuaaaugacaugggcaaggugcggaaggacaucccccaguggcagccauccaagggguggcacgacuggcagcagguccccuucugcagccaccacuuccaugagcucaucaugaaggacggcaggaagcugguggugcccugccgaccccaggacgagcugaucgggcgcgcucggauuagccagggcgcuggguggagccugaaggagacagccugccuggggaaggccuacgcgcagauguggucccugauguacuuucaccgccgcgaccugaggcuggccagcaacgccaucugcuccgccgucccagugcacuggguaccgaccagcaggaccacguggucgauacacgcacaccaccaguggaugaccaccgaggacaugcugaccgucuggaaccggguguggaucgaggacaacccuuggauggaggacaagacucccguaacuaccugggagaacguccccuauuuaggcaaacgagaagaccaguggugcgggagccugaucggccugaccagucgggcgacaugggcccagaacaucccgaccgccauccaacaggucaggucuuuaaucgggaacgaagaguuccuagacuacaugccaucaaugaagcgguuccgcaaggaggaggaguccgagggcgccaucugguga

SEQ ID NO: 25880 - RNA, 9873 nt, Artificial Sequence
  derived and/or modified CDS sequence (opt11) from DENV-3__FJ898458__SS-prME
accagccuaugccucaugaugauacugcccgccgcccuggcguuucaccugaccagccgcgacggggagccgcggaugaucguggggaagaacgagagggggaaaacccugcuguucaaaaccgccagcgggaucaacaugugcaccuuaauagccauggaccucggcgagaugugcgaugacaccgucacuuacaagugcccccacaucaccgagguggagcccgaggacaucgauugcuggugcaaccugaccagcaccugggugaccuacgggacuugcaaccaagccggcgagcaccgacgcgacaagcggagcguggcccucgcgccccacguuggcauggggcuggauacccgcacccagaccuggauguccgccgagggugccuggcgccaggucgagaagguugagaccugggcgcugcgccauccgggguucaccauccucgcgcuguuccuggcccacuacaucgguaccagccucacgcagaagguggucaucuucauccugcugaugcucgucacccccuccaugaccaugcggugcgugggcgugggcaaccgcgacuucgucgagggccugagcggggccaccuggguggacgugguccuggagcacggcgggugcgucacgaccauggccaagaacaagcccacccucgacauugagcuucagaaaaccgaggccacgcagcuugcgacccuccggaaacugugcaucgagggcaagaucaccaacaucaccacggauucccgcugccccacccagggcgaggccguucugccggaggagcaggaccagaacuacgucugcaagcauacguacguggaccggggguggggcaacgguuguggacucuuuggaaaaggcucauuagugaccugcgcgaaguuccagugcuuggagcccaucgagggcaaggucgugcaguacgagaaccucaaauacacggugaucaucaccguccacaccggggaccagcaccagguuggcaacgagacccagggcgucacugccgagaucacgccccaggccagcaccacggaggcgauccugcccgaguauggcacccuggggcucgagugcagcccgcgcacgggccuagacuucaaugagaugaucuuacucaccaugaagaacaaggccuggaugguccaucggcagugguucuucgaccugccccugcccuggaccucgggcgccacuacggagaccccuacuuggaaccgcaaagagcuccugguuaccuucaagaacgcccacgcuaaaaagcaggaggucguugugcugggcagccaggagggcgcgaugcauacggcccucaccggggccaccgagauccagaacaguggcgggaccagcaucuucgccggccaccugaagugccggcugaagauggacaagcucgagcuaaagggcauguccuacgccaugugcacgaacacauucguccucaagaaggaggugagcgaaacccagcacgggaccauacucaucaagguggaguacaagggcgaggacgucccgugcaagauccccuuuuccacagaggauggucacggcaaggcgcauaacggcaggcugaucaccgccaaccccguggugacaaagaaggaggagcccgucaacaucgaggccgagccgccauucggggaaucuaacaucgugaucggcaucggggacaacgcccuuaagaucaacugguacaagaagggcagcuccaucgggaaaauguucgaggcgaccgcccggggcgcccgucggauggccauccugggcgacacggccugggauuucgggagcgugggcggggugcucaacucccugggcaaaauggugcaccagaucuucgggagcgcguacaccgcccuguuuuccggcgugucuugggucaugaagaucggcaucgguguacuccugaccuggaucgggcugaacuccaagaacaccucaauguccuucucuugcaucgccaucgggaucaucacgcucuaccugggcgccgugguccaagccgauaugggcugcgugaucaacuggaaggguaaggaacugaagugcggcuccgggauuuucgugaccaaugagguccacaccuggaccgagcaguacaaauuccaggcggacagccccaagaggcucgccacggccaucgccggcgccugggagaacggggugugcggcauccgcuccacgacccguauggagaaccugcuauggaagcagaucgcgaacgagcucaacuacauccucugggagaacaacaucaaacugaccguggucgugggggacaucaucggcguucucgagcagggcaagcgcacgcugacgccccaaccaauggaguugaaguacagcuggaagaccugggggaaggccaagaucgucacugccgagacgcagaacuccagcuuuaucaucgacggccccaacacccccgagugcccauccgccucgcgggcguggaaugugugggagguggaggacuacggguucggcgucuuuaccaccaacauuuggcugaagcuucgcgagguguacacccagcugugcgaccaucggcucauguccgccgccgugaaggacgagcgcgcgguccacgccgacaugggcuacuggaucgagagccaaaagaaugggagcuggaaauuagagaaggcgucccucaucgaggucaaaacgugcacauggcccaagucccacacccucugguccaacggcgugcuggaaagcgauaugaucauccccaagucccuggcggggcccaucagccagcacaaccaccggccgggauaccacacccagacggccggacccuggcaccucggcaagcuggaacuggacuuuaacuacugcgagggcacgaccgucgugaucaccgagaacugcgggacgcgcggccccucccuucguacaacgaccguauccggcaaguugauccacgaguggugcugccgcuccugcacucugcccccgcuucgguacaugggcgaggacgggugcugguacgguauggagauccgccccaucagcgagaaggaggagaacauggucaagucucugguaucggccggcuccgggaagguugacaacuucaccaugggcguccugugccuugccauccuguucgaggaggugaugcgcgggaaguucggcaagaagcacaugauugcggggguguucuucaccuucguccugcuccugagcggccagaucaccuggcgcgacauggcccauacgcuuaucaugauaggcuccaacgccagcgaucggauggggaugggcguuaccuaccucgcccugauagccaccuucaaaauccagcccuuccuggcgcucggguuuuuccugcgcaagcugacgucccgggagaaucuccugcugggcgucggccuggccauggcaacgacccugcagcugccugaggacaucgagcagauggccaacggcaucgcguuaggccugauggcccugaaacucaucacacaauucgagaccuaccagcuguggacggcccugaucagccugaccugcucuaacacuaucuucacucugacgguggcauggcgcacugccacccugauacucgcgggggugagccugcucccggucugccagucaucgagcaugcggaagaccgauuggcuccccaugacgguggcugcuaugggcgugccgccccucccgcuguucaucuucucccucaaggacacacugaagcgccgcaguuggcccuugaacgagggugugauggccgugggccucguguccauucuggcuagcucccugcucagaaacgacguccccauggcggggccccugguggccgggggccugcuuaucgccugcuacgugaucaccgggacuuccgcggaccuaacggucgagaaggccgcggacaucaccugggaggaggaggcggagcagaccggagugagucacaaccuaaugauaacgguggacgacgacgguaccaugcgcauuaaggacgacgagacagagaacauccugaccguccugcugaagacggcccuccugaucgugagcggcaucuucccguacuccaucccggccacccugcucguguggcacacguggcagaagcagacgcagcggagcggcguccugugggacguccccagcccgcccgagacccagaaggccgagcuggaggaggggguguaccgcaucaagcagcagggcaucuucgggaagacccaggucggcgugggcgugcagaaggagggcguauuccacacgauguggcacgugaccaggggcgcggugcucaccuacaaugggaagcggcuggaaccuaacugggcgagcgugaagaaggaccugaucaguuacggcgggggcuggcggcucagcgcccaguggaagaagggagaggaggugcaggugaucgccgucgagcccggcaagaacccuaagaacuuucaaaccaugcccggcacguuccagaccaccaccggggagauaggcgcuaucgcacuggacuucaagcccgggacuaguggcucgcccaucauuaaccgcgaaggcaagguggugggucucuacggcaauggcgucguuaccaagaacggcggguacgugagcggcaucgcccaaacgaacgccgagccggacgggcccacucccgagcuggaggaggagauguucaagaagcgcaaccuaacgauaauggaccuucaccccggguccgggaagacccgcaaguaccugccggccaucguccgggaggcgaucaagcgacgacuacgcacccugauccuggcuccuacccgggugguggccgcugagauggaggaagcccucaaagggcugcccauaagguaccagacgaccgcgacuaaaagcgagcacaccggccgggagaucgucgaccuaaugugccacgccacguucacgaugcgccuccuguccccggugcgggugccgaacuacaaccugauaaucauggaugaggcccacuucaccgaccccgccagcaucgccgcgcgcggguacaucuccacccgggucggcaugggcgaggccgccgccauauucaugacggcgacgccucccgggaccgccgacgccuucccucagagcaaugcacccauccaggacgaggagcgcgacaucccggaacgcuccuggaacagcggaaacgaauggaucaccgacuucgccgggaagacggugugguucguccccuccauuaaggcgggcaacgacaucgccaacugccuccggaagaacgggaagaaggucauccagcugucccgcaagaccuucgacaccgaauaccagaagaccaagcucaacgacugggacuucguggugacgaccgacaucuccgagaugggcgcaaacuuuaaggcagaccgggucaucgacccgcgccggugcuuaaagcccgugauccuaacggacggcccggagcgcgugauccuggccgggcccaugccggucaccgcggccagcgccgcccagcggagaggccgggugggacgcaacccccagaaggagaacgaccaguacaucuucaccggccagccgcucaauaacgacgaggaccacgcccauuggacggaggcgaaaaugcugcuggauaauaucaacacccccgagggcaucauccccgcccucuucgagcccgagcgggagaagagugccgccaucgacggcgaguaccgccugaaaggcgagagccggaagacuuucguggagcucaugcguaggggggaccucccagucuggcuggcgcacaagguggccuccgagggaauaaaguacaccgaccgcaaguggugcuucgacgggcagcggaacaaccaaauccuggaggagaacauggacgucgagaucuggacgaaggagggcgagaagaagaagcuccgcccccgguggcuggacgcccgcaccuacagcgacccucuggcccuaaaggaguucaaggacuucgccgccggccgcaaguccaucgcccuggaucuggugaccgaaaucgggcggguacccagccaccucgcccacaggacccgaaaugcccucgacaaccugguaaugcuccacacgagugaacacggcgggcgugccuaccggcacgcgguggaggaacuuccggagaccauggaaacauuacuccugcugggccucaugauccugcugacagggggcgccaugcuguuccugaucagcggcaaggguaucggcaagacgagcaucgggcugaucugugugauagccagcagcgggaugcucuggauggccgagaucccucugcaguggaucgcuuccgcgauaguccuggaguucuucaugauggugcuccugauccccgagcccgagaagcagagaacgccccaggacaaucagcuggccuacgucgucaucgggauacucaccuuggcugccaucaucgccgcgaacgagaugggccugcucgagaccacgaaacgggaccugggaaugagcaaagagccggggguaguguccccgacgagcuaccuggacgucgaccuccaccccgccucugccuggacacuguacgcuguggcgaccacggugaucacccccaugcugcgccacaccaucgagaauagcaccgccaauguuagccucgccgccauagcaaaccaggcggugguacugaugggccuggacaagggguggccgaucagcaagauggaccuaggcgucccucugcuggcccucgggugcuacagccaagugaacccccugacgcuaaccgccgccguguuguuacugaucacccacuacgcaaucaucggacccggccuccaggccaaggccacccgggaggcccagaagcgcacugccgccgggaucaugaagaauccgacugucgacggcaucaugaccauagaccuggaucccgugauuuaugacagcaaguucgaaaagcagcugggccaggugaugcuccugguccugugcgcgguacaacugcuccuaaugcggaccuccugggcccucugugaggccuuaacgcuggcuacaggccccaucaccacccucugggagggcagccccgggaaguucuggaacacgaccauugcggugaguauggcaaacaucuuccgcggcagcuaccuggcuggggccggccuggccuucucuauuaugaaguccgucgggaccggcaagcggggcacggggucccagggcgagacccucggggagaaauggaaaaagaagcugaaccagcugagccgcaaagaauucgacuuauacaagaaguccgguaucacggaaguggaccggaccgaggcgaaggaaggccugaagcgcggcgagaucacacaccacgcaguuucccgcggcagcgcaaaacugcagugguucgucgaacgcaacauggugauaccggaggggcgagugaucgaccugggcugcgggcggggcgggugguccuacuacugcgcgggcuuaaagaagguaaccgaggugcggggcuacaccaagggcgggccugggcaugaagagccuguacccaugagcaccuacggauggaacaucgugaagcugauguccgggaaggauguguucuaccucccgcccgagaagugcgauacccugcugugcgacaucggcgagagcucccccagccccacgguggaggagucccgcacgauccgcguccugaagaugguggaaccguggcucaagaacaaccaguucugcaucaaggugcugaaccccuacaugcccaccgucaucgagcaccuggagcggcuccagcgcaagcacggcgggaugcuggugcggaacccccugagccgcaacuccacccacgagauguacuggaucagcaacggcaccgguaacaucguggcuuccgucaacauggugucccggcuccugcuaaaccgcuucacgaugacucaccggcgcccgacuaucgagaaggacguggaccucggcgcgggcaccaggcacgucaacgccgagccugaaacgcccaacauggacgugaucggggagcgcaucaagcggaucaaggaggagcacaacuccaccuggcacuacgacgaugagaaccccuacaagaccugggccuaccacggcagcuacgaagugaaggccacgggguccgccagcuccaugaucaacggcgucgugaagcugcugacgaagcccugggacgucguacccaugguuacccagauggcgaugaccgacaccacaccauucggucagcagagggucuucaaggagaagguggacacccggaccccgagaagcaugcccggcacccggcgcguaaugggcaucacugccgaguggcuuuggcgaacccuggggcguaacaagaagccccggcugugcacccgcgaggaguucacgaagaagguccgaacgaacgccgcuaugggcgcgguguucaccgaggagaaccagugggacagcgccaaggccgccguggaggacgaggacuucuggaagcucgucgacagggaacgcgaacugcacaagcuggggaagugcggcuccugcguguacaacaugauggggaagcgugagaagaagcucggcgaguucggcaaagccaaggggagccgugcgaucugguacauguggcuaggcgcccgguaccuggaguucgaggcccucggguuucugaacgaggaccacugguucucccgcgagaacagcuauuccggcguggagggggagggccugcacaagcucggcuacauccugcgggacaucaguaagauacccggaggcgccauguacgccgacgacaccgccgggugggacacccgcauuacggaggaugaucugcacaacgaggagaaaauuacccagcagauggaccccgagcaccgucagcucgccaacgccaucuucaagcugaccuaccaaaacaaggucgucaaggugcaacggcccaccccuaccgggacugugauggauaucaucucccggaaggaccagagaggcucagggcaaguggguaccuaugggcugaacaccuucaccaacauggaggcccagcucaucaggcagauggagggcgaaggagugcuguccaaggcugaccuggagaacccccaccucccggagaagaagaucacgcaguggcuggagaccaaaggcgucgagcgccugaaacggauggcgaucagcggcgacgacugcguggugaagccaauugacgaccgcuucgccaacgcucuccuggcccugaacgacauggggaagguucggaaggacaucccccaguggcagcccuccaagggcuggcaugacuggcagcaggucccguucugcagccaccauuuccacgagcucaucaugaaggacgggcgcaagcuggugguccccugccggccccaggacgagcugaucggccgcgcccggaucucccagggggcgggcuggucgcugcgcgagaccgccugccugggcaaggccuacgcccaaauguggucccugauguacuuccaccgccgggaccuccgccuggcgagcaacgccauuuguuccgcggugcccgugcacugggucccuaccucacggacgaccugguccauccacgcccaccaccaguggaugaccaccgaggacaugcugacaguguggaaccgcguguggaucgaggacaaccccuggauggaggauaagacgcccguuaccaccugggagaacgugcccuaccucgggaagagagaggaccaguggugcggcagccugaucgggcugacaagccgcgccacaugggcgcagaauaucccgaccgccauucagcaaguucggucccucaucggcaacgaggaguuccuggacuacaugcccagcaugaagcgcuuccggaaggaggaggaguccgaaggcgccaucugguga

SEQ ID NO: 25881 - RNA, 9873 nt, Artificial Sequence
  derived and/or modified CDS sequence (opt11) from DENV-3__KJ189256__SS-prME
acaagccugugccucaugaugauacugcccgccgcccuggcauuccaccucaccagccgggacggggagccccggaugaucguggguaagaacgagcggggcaagucucuccuguucaagaccgccuccgggaucaacaugugcacccucaucgccauggaccugggggagaugugugacgacacuguaacuuacaaaugcccccacauuaccgagguggagcccgaggacauagacuguuggugcaaccugaccagcaccugggugaccuacgggacaugcaaccaggccggcgagcaucggcgcgacaagcgguccguggcccucgcgccucacguggggaugggguuagacacucgcacccagaccuggaugagcgccgagggggccuggcgccaaguggaaaagguggagaccugggcgcugcgccacccggguuucaccauccucgcgcuguuccuggcccacuacauuggcaccucccugacucagaaagucgugaucuucauucuguugaugcucguaacgcccucgaugaccaugcggugcgucggggugggcaaccgcgacuucgucgaaggucugucgggugccaccugggucgacguuguccuagagcauggagggugcgugacuacgauggccaagaacaagccgacccuagauaucgaguugcagaagaccgaggccacucagcuagcgacuuuacggaagcugugcaucgagggaaagaucaccaacauaacgacagacagccgcugcccuacgcagggcgaggccgugcugccagaggaacaggaccagaacuaugucugcaaacacaccuauguggaccggggcugggguaacggaugugggcucuuugggaaaggcucccuggugaccugugccaaauuccagugccucgagcccauugagggcaagguugugcaguacgagaaccucaaguacaccgucaucauaacaguccacaccggggaucagcaucaaguuggcaacgagacccagggcgucaccgcugaaaucacgccucaggccagcaccaccgaggcgaucuuacccgaguacggcacccuggggcuugaguguuccccgcgcaccggacuggacuucaacgagaugauccugcuuaccaugaagaacaaggcuuggaugguccaucgccagugguucuucgaccugccccugcccuggaccagcggcgccaccaccgagacgcccacauggaaccgaaaggagcuccuggugacauucaagaacgcccacgccaagaagcaggaggucgugguccuggggucccaggagggcgcgaugcacaccgcacucacgggggccaccgaaauacagaacagcggcgggaccuccauuuucgccggacaccucaagugccggcugaagauggacaagcucgagcugaagggcaugucguacgccaugugcaccaacacguucguccugaagaaagagguguccgagacccagcacgggaccauccucaucaagguggaguauaagggcgaggacgugccgugcaagauccccuucaguaccgaggacgggcacggcaaagcgcacaacggccggcugaucacggccaaccccgugguuaccaagaaggaggagcccgucaacaucgaggccgagccgcccuucggggagagcaacaucgugaucggcaucggggacaaugcucuaaagauaaacugguacaagaaaggcuccuccaucgggaaaauguucgaggcgaccgccagaggggccaggcgcauggccauccugggggacaccgccugggacuucgguuccguaggcgggguccugaacagcuugggcaagauggugcaccaaauauuuggguccgcguauacggcucuguuuagcggaguguccugggucaugaagauaggaaucggagugcuacugacauggaucggccugaacagcaagaacaccuccaugagcuucuccugcaucgccaucgggauuaucaccuuauaucugggcgccgugguccaggccgacauggggugcguaauaaacuggaagggcaaggagcugaagugcggaagcggaaucuucguuacuaacgagguccauaccuggaccgagcaguacaaguuccaggcggacuccccuaagagacucgccaccgccaucgccggcgccugggagaauggggugugcggcauccgcagcacgacccggauggagaaccugcuuuggaagcaaaucgcgaaugagcucaauuacauccugugggagaacaauaucaagcugaccgugguagugggggacaucaucggcgugcucgagcagggcaagcgcacccugacgccccagccgauggagcugaaguacuccuggaagaccugggggaaggccaagaucguuaccgccgagacccagaacucguccuuuaucaucgacggcccuaacacgcccgagugccccagcgccuccagagcguggaacgugugggaaguggaggacuauggguuuggcgucuucaccacgaacaucuggcucaagcugcgcgagguguacacccaacugugcgaccacagguuaaugucagcggccgugaaggaugaacgcgccguucaugccgacaugggcuacuggaucgagagccaaaagaacggguccuggaagcuggagaaggcgagccugaucgaggugaagaccuguacguggccuaagucgcauacguuauggagcaacggcgugcuggaguccgacaugaucaucccgaaaucacuugcggggccaauaucccagcacaaucacagaccgggcuaccacacccagaccgccgggcccuggcaccugggaaagcuggagcuggacuucaauuauugcgagggcacgacggucguaaucacugagaacuguggaacccgcggccccucacuccggacgacgaccguguccgggaagcuaauccaugaguggugcugccgcucaugcacgcugccuccgcuccgguauaugggcgaagacgggugcugguacgggauggaaauucgccccaucuccgaaaaggaggagaacauggucaagagccugguguccgccggcagcgggaagguggacaacuuuaccaugggcguccugugcuuggccauccuguucgaggagguaaugcgcgggaaguucggcaagaagcacaugauugcggggguguucuucacguucguccugcuccuguccggucagaucacauggcgcgacauggcccauacccugaucaugaucggcagcaacgccuccgaucguauggggaugggcguuacguaucucgcucugaucgccacguucaagauacagcccuuccuggcgcucggauucuuuuuacgcaaacuuaccucccgggagaaccuccuguuaggcgugggcuuggcaauggccaccacgcuccaguuacccgaggacaucgaacagauggccaacggaauagcacucggacugauggcccugaagcucauaacccaguucgagacauaccaacuguggaccgccuugaucagucucacuuguuccaacaccaucuucacccugacggucgcauggcgcacggcaacacugauucuggcgggaguuagccugcugccggucugucagagcagcuccaugagaaagaccgacuggcuccccauggcuguggccgccaugggcgugccgccacuaccgcuguuuaucuucucccucaaggacacccugaagcgccgcucguggccccugaacgagggggucauggccguuggccucgugagcauccuggcguccucccuuuuaagaaacgacguacccauggccggcccgcugguggcagggggccugcucauagccugcuacguaaucacagggaccucggccgaccugacagucgagaaggcggccgacaucaccugggaggaagaggcugagcagacaggcgugagccauaaccugaugaucaccguugacgaugacggcacuaugcgcauuaaggacgacgaaacggagaacauccucacugucuuacuaaagacugccuugcugaucguguccggcaucuucccauacagcauucccgccacccugcucguguggcacaccuggcagaaacagacacagcgguccggcguccugugggaugugcccagcccgccagaaacucagaaggcggaguuagaggagggcguguaccgcaucaagcagcagggcaucuuugggaagacccaggucgggguugggguccagaaggagggcgucuuccacacgauguggcaugugacccggggcgccguuuugacuuacaacgggaaacgccuggagcccaacugggcaucugucaagaaggaucuuaucagcuauggcgggggcuggcggcucucagcccaguggcagaagggggaggagguucaaguuaucgcggucgagccuggcaagaaccccaagaacuuucagaccaugccggguaccuuccagaccacgaccggggaaaucggcgcuaucgcccuggacuucaagcccggaaccagcggcagccccauaaucaaccgcgagggcaagguggugggguuguacggcaacggggucgugaccaagaacggcggguacguguccggcaucgcccagacgaacgccgagcccgacggccccacccccgagcuggaggaggagauguucaagaagcggaacuuaaccaucauggaccugcaucccggaagcggcaagaccagaaaguaccugccggcgaucguucgggaggcuaucaaacgccggcucaggacgcugauccuugcccccacccgggugguggcagccgagauggaggaagcccucaaggggcugcccauucgcuaccaaaccacggccacgaaguccgagcacacuggaagggaaaucguagaccugaugugucaugccaccuucaccaugcgccugcugagccccgugagaguuccgaacuacaaccuaaucauuauggacgaggcccacuuuacugaccccgccuccaucgcggcccgcggauauaucagcacccgggucgggaugggcgaggcugccgcgauuuuuaugaccgccacgccgcccgggacggccgacgcguucccgcaguccaacgcccccauacaagaugaggagcgcgacauccccgagagaagcuggaacuccggcaacgaguggaucaccgacuucgcggggaaaaccguuugguucguucccagcaucaaggccggcaacgacaucgccaacugucuacguaagaacgggaagaaagugauccagcuguccaggaaaaccuuugacacggaguaucagaagaccaagcugaacgacugggacuuuguggugacaaccgacaucagcgagaugggagccaacuuuaaggcagaccgggucaucgacccgcgccggugccucaaacccgugauccugacggauggccccgaacgcgugauucuggcggggcccaugccggucacagccgccuccgcagcccagcgccgcggccgggugggccgcaacccccagaaggaaaacgaccaguacauuuucaccggccaaccccucaacaacgaugaagaccacgcgcacuggaccgaggcaaagaugcugcuggacaacaucaauacccccgaggggaucaucccggcucucuuugaacccgagcgggagaaguccgccgcgaucgauggcgaguaccgccugaagggcgaaucccggaagacguucguggagcugaugcgccgcggggaccucccugucuggcuggcccacaaggucgcgagcgagggcaucaaguacaccgaccgcaaguggugcuucgacgggcagcggaacaaucagauccuggaggagaacauggacgucgagauuuggaccaaagagggcgaaaagaagaagcuccgcccgagauggcuggacgcccgaacauacuccgacccgcuugcgcucaaggaguucaaggacuucgcagcugguaggaaaagcaucgcccuggaccuggugacggagaucgggcgggugcccucccaccucgcccaccgcacccgaaacgcgcuggacaaccuggucaugcuccacaccagcgagcacggcgggcgcgcguaccggcacgccgucgaggagcuaccagagaccauggagacacugcuccugcugggccucaugauccuccugaccggcggugcaaugcuguuccugaucagcggcaaagggaucggcaaaaccuccauugggcugaucugcgugauugccagcucaggaaugcuuuggauggccgagauaccuuuacaauggaucgcauccgcaaucguccuggaguucuucaugauggugcuacugauccccgagcccgagaagcagcgcacgccccaggacaaccagcuggcuuacguggucaucgggauccucacccuggccgcuaucauagcggccaacgagaugggccuacuggaaaccaccaagcgggaccuuggcaugaguaaggagccgggagucgucagccccaccuccuaccuggaugucgaccuacacccagccagcgccuggacguuauacgcgguggccaccaccgugaucacacccaugcugcgccacacgaucgaaaacagcaccgcgaacgucagccucgccgccaucgcgaaccaggccgugguccugaugggccuggacaagggauggccuaucucuaagauggaccucggcguaccacuguuggcacucggcugcuacagccaggugaacccccugacccugaccgccgccgugcuccugcugauuacgcacuacgcgaucaucggcccgggccuacaggccaaggccacccgggaggcucagaagcgcaccgccgcgggcaucaugaagaaccccaccguugacggcaucaugacgaucgaccucgaccccgugauauacgacuccaaauucgaaaagcagcugggccagguaaugcuccuggucuugugcgccguccaguuacugcugaugcggaccagcugggcucucugugaggcccugacgcuagcaacaggccccaucacgacacucugggaggguucccccggaaaguucuggaauaccacaaucgcagugagcauggccaacaucuuccgcgguucauaccuggcaggggccggccuggcguucagcaucaugaaguccguaggcacggguaagcggggcaccgggagccagggcgagacccucggggagaaauggaagaagaagcugaaccaguugagccgcaaggaguucgaccucuacaagaaguccggcaucaccgagguugaccgcacagaagccaaagaggggcuaaagaggggcgaaaucacgcaucacgccguaagccggggcuccgccaagcuccagugguucguagagcggaacauggugauaccggaggggcgggugaucgacuuaggcugcgggcgcggcgguuggucuuacuacugugcuggccugaagaaagucacugaggugcggggcuacacgaagggcggucccgggcacgaggagcccguacccaugucaaccuacggcuggaauauugucaaacugauguccggaaaggacguguucuaccucccgcccgagaagugugacacacugcugugcgacaucggcgaguccagcccgucccccaccguagaggagucccgcaccauccguguccugaagaugguggagccguggcucaagaacaaccaauucugcaucaagguguuaaaccccuacaugccgaccgugaucgagcaccuggagcgucuccaacgcaagcacggagggauguuggugcggaacccccuaucccgcaacagcacgcacgagauguacuggauuucuaacgguaccgggaacaucguggcaagcgucaacaugguaucccggcuccuguugaaccgcuucaccaugacccaccggagaccgaccauugagaaggacgucgacuugggcgcgggcacccggcacgucaacgcugagcccgagacacccaauauggacgugaucggggagcgcaucaagcggaucaaggaggagcauaacagcacauggcacuacgacgacgaaaacccguacaagacgugggccuaccacgguuccuacgaggugaaggcgaccgguagcgcguccagcaugaucaacggcguggugaagcugcugaccaagcccugggacgucguucccaugguuacucagauggccaugaccgacaccaccccauucgggcagcagcgcguuuucaaggagaagguggacaccaggacgccgcgcagcaugcccggcacccggcgcgugaugggcaucaccgccgaguggcucuggcggacccuggggcguaauaagaagccacggcugugcacgcgggaggaguucacgaagaagguacgcaccaaugcugcgaugggagccguguucaccgaggaaaaccagugggacucugccaaggcagcgguggaggacgaggacuucuggaaacuugucgaccgggagcgcgagcugcacaagcugggcaagugcggcagcugcguguacaacaugaugggaaagcgggagaagaagcucggcgaguucggcaaggcgaaggggucccgagccaucugguacauguggcugggcgcgcgguaccuggaguuugaggcccuaggguuccugaacgaggaccauugguucagccgcgaaaauuccuacagcgguguggagggggagggucuccauaaacuuggcuacauccugcgggacaucuccaagauacccgggggcgccauguacgcggaugacacggccgggugggacacccgcaucacugaggacgaccugcacaacgaggagaagaucacccaacagauggacccggaacacagacagcucgccaacgccaucuucaagcucacguaccagaacaaggucguuaaggugcagcgccccaccccaaccggcaccgucauggacauaaucagccgaaaggaccagcgcggauccggccaaguaggcaccuacgggcugaauacguucaccaacauggaggcccaacucauccggcagauggagggcgagggggugcugagcaaagcggaccuggagaacccccaccucccggaaaagaagaucacccaauggcuggagaccaaaggcgucgagcgccugaagcggauggccaucuccggcgacgacugcguaguaaaacccaucgacgaccguuucgccaacgcccuccuagcccugaacgacauggggaagguacggaaggacaucccucaguggcagcccagcaagggcuggcaugacuggcagcagguaccuuucugcagccaccacuuucacgagcucaucaugaaggacgggcgcaagcuggucguccccugucggccacaggacgagcugaucggacgcgcgcgcauaucacagggggccggcuggucccuacgcgagacggccugccuggguaaagccuacgcacaaauguggagccugauguacuuccacaggcgcgaccuccgucuggccuccaacgccaucugcagcgccgugcccgugcacuggguaccgaccucccggaccaccuggaguauccacgcccaccaccaguggaugacgaccgaggacaugcugacaguguggaaccgcguguggaucgaagacaaccccuggauggaggacaagacccccgucacuacuugggagaaugugcccuaucucgggaaacgggaggaccaguggugcggcagcuuaaucgggcugaccucccgcgcgaccugggcccagaacauaccgacggccauccagcagguccggucgcucaucggcaacgaggaguuccuggacuacaugcccuccaugaagcgcuuccgaaaggaggaggagucggagggggccaucugguaa

SEQ ID NO: 25882 - RNA, 9873 nt, Artificial Sequence
  derived and/or modified CDS sequence (opt11) from DENV-3__KJ189257__SS-prME
accagccugugccucaugaugauccugcccgccgcccuggcguuucaccuaaccagccgggacggggagccgcggaugaucgugggcaaaaacgagcggggcaagagccugcuguucaagacggccaguggcaucaacaugugcacacuuauagccauggaccugggcgaaaugugcgaugacaccgugaccuacaaguguccgcacaucacggaggucgaacccgaggauaucgacuguuggugcaaucugacaucgacgugggugaccuacgggacgugcaaccaggccggcgagcaccggcgcgacaagagauccguggcucucgcgccgcaugugggcauggggcuggacacccgcacccagacuuggaugagcgccgagggcgccuggcgccagguugagaagguggagacgugggcccugcgccacccgggguucaccauacucgcgcuauuccuggcacauuacaucgggaccucccucacccagaagguugugaucuucauccugcugaugcucgucacgcccagcaugacaaugcggugcgugggggugggcaacagagauuucguagaaggccugaguggggccacuuggguggacgugguccuggagcacggcgguugcgugaccacgauggccaagaacaagcccacccuagacaucgagcugcagaagaccgaggccacccagcuggcgacgcuccggaagcuguguaucgaaggcaagauuaccaacaucaccaccgacaguagaugccccacccagggggaggccguguugccggaggagcaggaccagaacuacguaugcaagcauaccuauguggaccggggguggggcaacggaugcgggcucuucgggaagggcagucuggugaccugcgccaaguuccagugccucgagcccaucgagggcaaggucgugcaguacgagaaccucaaguacaccguaaucaucacggugcacaccggagaccagcaccaggugggcaaugagacccagggggucaccgccgagaucacgccccaagccagcaccaccgaggccauuuugcccgaauauggcacauuaggacucgaaugcuccccacgcaccggccuggacuucaacgagaugaucuugcucacuaugaagaacaaagccuggauggugcaccggcaaugguucuuugaccugccccugcccuggacaagcggcgccaccacugagacgcccacguggaacaggaaggagcuccuggugaccuucaagaacgcccacgcgaagaaacaggaggucguggugcuggggucccaggaaggcgcgaugcacaccgcccucacgggggcgaccgagauccagaacagcggcgggaccuccaucuucgccggccaccugaagugccggcugaagauggacaaacucgagcugaagggcaugagcuacgccauguguaccaauaccuucgucuugaagaaggagguguccgagacgcagcacgggaccauccucaucaagguggaguacaagggcgaagaugucccgugcaagauaccauuuagcaccgaggacggacacggcaaggcgcauaacggccgccugaucacagccaaccccguagugaccaagaaagaggagcccgucaauaucgaggccgagccgcccuucggggagucaaacaucguaauaggcauaggggauaacgcccugaagaucaacugguacaaaaagggcuccagcaucgggaagauguucgaagcgaccgcccgaggcgcccgccggauggccauucugggcgacaccgcuugggauuucgggagcguaggcgggguccucaacagccuuggcaagaugguacaccagauuuucgggagugcguacacggcccuauucagcggcguuuccugggucaugaaaaucggcauuggggugcuccugacuuggauaggcuuaaacagcaagaacaccuccaugagcuucucgugcauugccaucggcaucaucacccucuaccugggcgcugugguccaggccgacaugggcugugugaucaacuggaagggcaaggagcugaagugcggcagcggaaucuucgugacaaacgaaguccauaccuggaccgagcaguacaaguuccaggcagacucccccaagcgccuggccacggccaucgccggcgcgugggagaacgggguaugcggcauucgcagcacgacccgaauggagaaccugcuguggaagcagaucgccaacgagcuuaacuacauccugugggaaaauaacaucaaguuaaccgucgucgucggggacaucauuggcguguuggaacaaggcaagcgcacucugacgccucagccgauggaguugaaauacuccuggaagaccugggggaaggccaagauagucacagcugaaacucagaauagcuccuucaucauugacggccccaacacgccugagugccccagcgcaagccgggcguggaacgugugggagguggaggacuacggguucggagucuucaccaccaacauauggcuaaagcuccgcgagguguacacccagcugugcgaccacaggcuuaugagcgccgcggucaaggaugagcgugccguccaugcagacaugggcuacuggaucgaaucgcagaagaacggguccuggaaacuggaaaaagcuagcuuaaucgaaguuaagaccugcacguggccgaaaucccacacccucuggagcaacggcgugcuggaauccgacaugaucauccccaagagccuggccgggcccaucucccaacacaaccaccggccgggcuaccacacccagaccgccgggcccuggcaccucggcaagcuggagcuggacuucaacuauugcgagggcaccacuguagugaucaccgagaacugcggcacccgcggcccaagccucagaacgaccaccguguccgggaaguuaauccaugaauggugcugccgcagcuguacccugcccccgcuccgguacaugggcgaggacgggugcugguacggcauggaaaucagacccauauccgagaaggaggagaacauggucaagagccuggucuccgccggcucggggaagguggacaacuucacgaugggcguccugugccucgcgauccuguucgaggaggucaugcgggggaaguucggcaagaagcacaugaucgcggggguguucuucaccuucgucuugcuacuguccgggcagaucaccuggcgcgacauggcccacacccugaucaugaucggcagcaauacgagcgaccggauggggaugggcgugaccuaucucgcccugaucgccacuuucaagauacagcccuuccuagcauuaggguucuucuugaggaagcugaccucacgggagaacuugcuccugggcgugggccucgcgauggccacgacccuacagcugcccgaggacaucgagcagauggccaaugggauagcccucggccuuauggcgcugaaacuuaucacccaguuugagaccuaucagcuguggacggcccuuaucucacugaccuguuccaacacgaucuucacccugacggucgccuggcgcaccgccacccugauccuugcuggggugucucugcuaccggucugccaguccagcuccaugcggaagaccgauuggcuccccauggcggucgccgcuaugggcgugccaccccucccgcuguucaucuuuagccucaaggacacgcuuaagcgcaggucguggccccugaaugagggggucauggcggucggccucgugagcauccuggcguccagccugcuccggaacgacgucccgauggcgggcccccugguugcgggugggcugcucauagccugcuacgugaucacggguaccuccgcugaccugacggucgagaaagccgcggacaucacgugggaagaggaggccgagcagaccggcgugagccacaacuuaaugaucaccguugacgacgacggaaccaugcgcaucaaggacgacgagaccgagaacauccuuacgguccuguuaaaaaccgcccuccugaucgucuccggaaucuuuccguacuccauacccgccaccuugcuggucuggcacacauggcagaagcagacgcagcgguccgguguccugugggacguucccagcccgcccgaaacgcagaaggccgagcuggaggaggggguguaccgcaucaagcagcaagguaucuucgggaagacgcaggucggggugggggugcaaaaagaaggcgucuuccauaccauguggcacgugacgcggggcgcggugcucaccuacaacgggaagcggcuggagcccaacugggcauccgucaagaaggaccugaucagcuauggcgggggcuggcggcuauccgcccaguggcaaaaaggagaggagguccaggugaucgccgucgagcccggcaaaaaccccaagaacuuccagaccaugcccggcacuuuccagacgacuaccggggagaucggggcuaucgcccuggacuuuaagcccgggaccagcggcagccccaucaucaaccgcgagggcaaggugguggggcuguauggaaacggagucguuacuaagaacgggggguacguguccggcauugcgcagaccaacgccgagccggauggccccacccccgaguuggaggaggagauguucaagaagcguaaccucaccauuauggaccugcaccccgggagcggcaagacgcgcaaauaccugccggccaucguccgggaggcgaucaaacgccgguugcgaacccugauccuggccccuacucgggugguggccgccgagauggaggaggcccucaagggucugcccauccgauaccaaaccacugcaaccaaguccgagcacaccggacgggagauagucgaucugaugugccaugccaccuucacgaugcgccuucugagucccgugcgggugccaaauuauaaucugaucaucauggacgaggcccacuucaccgacccggcguccaucgccgcccgcggguacaucucgacccgagucgguaugggugaagccgcugccaucuuuaugacugcgacgccgcccgggaccgccgacgccuucccgcagucaaacgcccccauccaggacgaggagcgcgacauccccgagcgaucguggaacuccggcaacgaguggauaaccgacuuugcggggaaaaccgugugguucgugcccuccaucaaggcgggcaaugauaucgcgaacugccuccggaagaacgggaagaaggucauccagcugucucgcaagacguucgacaccgaguaccagaagaccaagcugaacgacugggacuucguggugacaacggacaucagcgagaugggugccaacuuuaaagccgaccggguuaucgacccgaggcgaugccucaagcccgugauccugaccgacggccccgagcgcgugauccuggccggccccaugccggucaccgccgccucagccgcacagcgacggggccgggucgggcgcaacccccagaaggagaacgaccaauacauauuuaccggccagccccucaacaacgacgaggaccacgcccacuggaccgaggcgaagaugcugcuggacaacaucaacacgcccgaggguaucauaccggcccuuuucgagccagagcgggagaaguccgccgccaucgacggugaguaccgccugaagggagaaagccgaaagaccuucgucgagcugaugcgccgcggggaucuccccgucuggcuggcacauaaaguggccucggaggguauuaaguacaccgaccgcaaguggugcuuugacggucagagaaacaaccagauccuggaggagaacauggacgucgaaaucuggaccaaggagggcgagaagaagaagcuccgcccccgguggcuggacgcacgcacguacuccgacccgcuggcccugaaggaguucaaggacuucgccgcgggccgcaagucgaucgcccuggaccuggugaccgagaucggucgggugccgucccacuuagcucaccgcacucggaacgcccuagauaaccuagucaugcuccacaccagcgagcacggcgggcgggcauacaggcacgccguggaggagcugcccgagacgauggagacacuacuccuucugggucucaugauucugcugaccgggggcgccaugcuguuccugaucagcggcaaggggauugggaagacaucaaucggacuaaucugcgucaucgccagcuccggcaugcucuggauggcugagaucccgcugcaguggaucgccagcgcaaucguccuggaguucuucaugaugguucuccugauccccgagcccgagaagcagcgcacgccccaggauaaucagcuggccuacgugguuaucgggauccucacccuggccgccaucaucgccgcgaaugagaugggccugcuagagaccaccaagagagaccuaggaaugucaaaggagccaggggucgugagccccacgucuuaccuggacguggaucuccaccccgccagcgccuggacacuguacgccguggcgaccaccgugaucacgccaaugcugagacacacgaucgaaaacuccaccgccaaugucagccucgccgccaucgccaaccaggcggugguccugaugggccuggacaaaggguggccgauaucaaagauggaccucggcgucccgcugcuggcccucggauguuacagccagguaaaccccuugacccugacggcugcgguguuucuucugauuacccauuacgcgauaaucggccccggccugcaggcaaaggccacccgggaggcccaaaagcgcacagccgccggcaucaugaaaaacccaacggucgacggcaucaugaccaucgacuuggauccugugaucuacgacuccaaguucgagaagcaacugggccagguaaugcugcugguccuaugcgcggugcagcuccuccugaugcguaccagcugggcccugugcgaggcccucacacuggccacgggcccuaucaccacccugugggagggguccccugggaaauuuuggaacaccacgaucgcggugagcauggccaacaucuuccgcggcuccuaccucgcgggugccggccuggccuucaguaucaugaaguccgucgggaccggaaagcggggcaccgggagccagggcgaaacucugggggagaaguggaagaaaaaacuaaaucaacuaucgagaaaggaguucgaccuguacaagaaguccgggauaaccgagguggaccggacggaggcuaaggagggguugaagcguggagagaucacccaccacgccgugagccggggaucggccaagcugcagugguucgucgagcgaaacauggugaucccggagggccgcgugauugacuugggaugcgggagaggcggauggagcuacuacugcgccggccucaagaaggucaccgaagugcgcggauacaccaagggcggucccgggcacgaggagccggugccaauguccacguacggcuggaauaucgucaagcugaugagugggaaagacgucuuuuaccugccacccgagaagugcgacacgcuccugugcgacaucggcgagaguagccccucacccaccguggaggagagccgaaccauccgaguccugaagaugguggagccauggcugaagaacaaccaguucugcaucaagguucucaaccccuacaugcccacggucauugagcaccuggagcggcugcagcgcaagcacggcgggaugcucgugcggaacccccugucccgcaacaguacccaugaaauguacuggaucuccaacggcaccggaaacaucguggccagcgucaacauggugucccggcugcuccugaaucgcuucaccaugacgcaccgucgcccgaccaucgagaaggacguggaccugggcgccgguacccggcacgucaacgccgagcccgagacgcccaacauggaugugaucggggaacgcaucaagaggaucaaggaggagcacaacaguacguggcacuaugaugacgagaacccguacaagacgugggcguaccacggguccuacgaggugaaggccaccgggagcgccuccucgaugauaaacggcgucguaaagcuucugaccaaacccugggacgucguuccaauggugacacaaauggcgaugaccgacaccacccccuucgggcagcagcgcgucuucaaggagaagguggacacgaggaccccucgcagcaugcccggcacccggcgcguaaugggcaucaccgccgaguggcuguggcggacuuuggggaggaauaagaagccccggcuguguacgcgugaggaauuuaccaagaagguccgcaccaacgccgccaugggcgcgguauuuacagaggagaaccagugggacuccgccaaggccgccguggaagacgaggacuucuggaaacuggucgaccgggagcgcgagcuccacaagcuggggaaaugcggcagcugcguguacaauaugauggggaaaagggagaagaagcugggcgaguucggcaaggccaaggggagccgcgcuauaugguacauguggcucggcgcccgguaccuggaguucgaggcuuugggguuucucaacgaggaccauugguucagucgcgaaaacuccuacagcggaguggagggggagggccugcacaagcuggguuauauuuuaagggauaucuccaaaauccccggcggcgccauguacgccgacgacaccgcgggcugggauacacgcaucaccgaggacgaccugcacaacgaggaaaagaucacgcagcagauggaccccgagcaccggcagcuggccaacgccaucuuuaagcucaccuaucaaaacaaggucguaaaggugcaacgcccaacucccaccggcacugucauggacaucauuagcagaaaagaucaacguggcaguggccaggugggcacauauggguuaaauaccuucacuaacauggaggcacagcugauccggcaaauggaaggcgagggagugcucucuaaggcugaccuggagaacccucaccuccccgaaaagaagaucacccagugguuggagacgaagggcgucgagagacugaagcggauggccaucuccggcgacgacugcguggucaagccuauagaugaucgcuucgccaacgcccuccucgcccugaacgacauggggaagguccggaaggacauaccgcaguggcagcccagcaagggcuggcacgacuggcaacaggucccguucuguucccaccacuuccacgagcugaucaugaaggacgguaggaagcucguaguccccugccguccacaggacgaacugaucggccgcgcccggaucagccagggcgcgggauggagccugcgcgagacugccugccucggcaaggccuacgcccagauguggagucugauguacuuucaccgccgggauuuacgccuugcauccaacgccaucugcucugccgugcccgugcacuggguaccgaccucacguaccaccuggucaauccacgcccaccaccaguggaugaccaccgaggacaugcugaccgucuggaaccggguguggaucgaggacaaccccuggauggaggacaagacgccggucacaaccugggagaacgugcccuaccuggggaagcgggaggaccaguggugcggcagccucauagggcugaccagucgcgcuacgugggcgcagaacauuccgaccgcaauccagcagguccggaguuugaucggaaacgaggaguuccucgacuacaugccuuccaugaagagauuccggaaggaggaggagagcgagggggccaucugguga

SEQ ID NO: 25883 - RNA, 9873 nt, Artificial Sequence
  derived and/or modified CDS sequence (opt11) from DENV-3__KJ189262__SS-prME
accagccucugucuaaugaugauacuuccugccgcacuggcguuccaccucaccuccagggauggcgaaccccgaaugauaguggguaaaaacgaacgcggaaaaucccuucuauuuaaaacagccuccggaauaaacauguguacccuuaucgccauggaucugggcgaaaugugugaugauaccgugaccuacaaaugcccgcacaucaccgaaguggaacccgaagacaucgauugcuggugcaaucuaaccuccacaugggugacauacgggaccugcaaccaagccggggaacaccgccgcgacaaaagguccguagcccuggccccucacgucgggauggggcucgacaccagaacucaaacguggaugagugcugaaggggcguggcgacaaguagaaaaagucgaaacaugggcacuaagacacccgggcuuuacgaucuuagcccuauuccuggcacacuauauuggaaccucacuuacccaaaaaguaguaauauuuauucugcuuaugcuaguaaccccuucaaugacaaugagaugcguuggaguuggaaaccgagacuucguagaagggcugagcggggcgacuuggguggaugucgucuuagaacacggcggcugcgugacgacgauggccaaaaauaaaccgacacuggacaucgaacuccagaaaacggaagccacucaauuggcgacgcugcggaaacuaugcaucgaagguaagaucacaaauauuacaacugacagucgaugcccgacccaaggggaagccguccugcccgaggaacaagaccaaaacuacguuugcaagcacaccuacguagaucggggauggggcaacggaugcggacucuucggaaagggaucacugguuacuugugccaaauuccaaugccuagaacccauagaagggaagguagugcaauaugagaaccucaaauauacugugauaauaacgguacauacgggcgaccaacaccaggugggaaacgagacgcagggcgucacagcagagauaacaccacaagcaucgaccacggaagcaauccuccccgaguacgggacgcuaggccuagagugcuccccaagaacgggacuagacuucaacgagaugauauuacuaacuaugaaaaauaaggcauggaugguacauagacagugguucuucgaccugccacuaccauggacaagcggggcaacaacagaaacuccuacauggaaccggaaagagcucuuaguaaccuucaaaaaugcacacgccaagaaacaagaagucguaguacuaggcucgcaagagggugccaugcacacugcgcuaacgggggcuaccgagauacaaaacagcgguggaaccuccauauucgccgggcaccuaaagugccgacugaaaauggauaaacucgaacugaaaggaaugucuuacgcaaugugcacaaauacauuuguucuaaagaaagaggucuccgaaacgcagcauggaacgauacugaucaagguagaauacaaaggugaagauguccccugcaagauacccuucucaacagaggacggacacgguaaagcgcauaacgguagauugauaacagccaauccgguaguaacuaagaaagaggagcccguaaauauagaagcagaaccaccauucggcgaaucaaauauugugaucggcaucggcgauaacgccuugaaaaucaacugguacaagaaaggaaguuccauaggaaagauguucgaggccacggcccgaggugcaaggagaauggccauccugggcgauacagcgugggacuuugggagugucggaggcguauuaaauagccuaggcaaaaugguacaucaaauauucggauccgcauauaccgcauuauuuaguggcgugagcugggucaugaaaaucgggaucggaguccugcucacauggaucggacuaaacuccaagaacaccagcaugagcuucucuugcaucgcaauagggaucaucacucuauaucugggugcggucguccaagcagacauggggugcguaauaaacuggaaagggaaagaacuaaaaugcgggagcggcaucuucgucacaaaugagguucauacauggacggaacaauacaaguuccaagcggacuccccgaaacgacuggccaccgccauugcaggggcgugggaaaaugguguuugcgguaucagaagcacgacuagaauggaaaaccuacuauggaaacaaauagccaaugaacucaauuacauacugugggaaaacaauauaaagcucacaguggucguuggcgauauuaucggaguccucgaacaaggcaaaagaacccugaccccgcagccuauggaacuuaaauacuccuggaaaacgugggguaaggcgaagaucguaacggcagaaacccaaaacagcucguucaucauagacggcccaaacaccccugaaugucccagcgcgagcagggcguggaacgugugggagguggaagacuacggcuucggcguuuucacaacaaauaucugguugaaacuucgggaaguauacacccaacuaugcgaccaccgucuuaugucagccgcugugaaggacgagcgagccguacacgcugacaugggcuauuggaucgaaucacagaaaaacggcucguggaaacuagagaaagccagccuuaucgaagucaaaacuugcaccuggcccaaaucgcauacucucuggucuaacggggugcuggagucagacaugaucauaccgaaaucacucgccgguccgauaagccaacacaaccaucggcccggcuaccacacacagacagccgggccguggcacuugggaaaauuggaacucgauuucaauuauugugaggggaccaccgucguaaucacugagaacugcgggacgcguggaccaagccugcgaacgacuacugucagcggcaaacuaauccacgaauggugcugccggucaugcacccuucccccacucagguauaugggagaagacggaugcugguacggcauggagaucagacccauuagcgaaaaagaagaaaauauggucaaaagucucguaagcgcaggcagugggaaaguggacaacuucaccaugggaguucuaugucuggcuauauuauucgaggagguaaugagaggaaaguuuggaaagaaacauaugauagcagggguguucuuuacguuugugcuacucuuaagcggucaaauaaccuggcgggauauggcacacacucuuaucaugaucggcagcaaugccagugaccguauggguaugggaguuacauaccuagcacuuauagcaacauuuaaaauacaaccauuucuagcgcuuggguuuuuccucaggaaguugacgagccgggagaaucuucuucugggcguggggcuggcaauggcgaccacucuccaacuaccagaggacauagaacagauggcaaacggcauugcgcuaggucucauggcccuaaagcuaauaacacaauucgaaacauaccaacucuggacagcacucaucagccugacaugcagcaacaccaucuucaccuuaacgguagccuggagaacagccacacugauauuagcuggagugucacuacugccgguaugucagucgucgucgaugcguaagacagacuggcuccccauggcugucgcugcaaugggcgucccaccgcugccccuguuuauuuucucgcuaaaggacacucuaaaaagacgaucguggccguugaacgagggaguaauggcgguggggcucgucagcauccuugcaucaagccuacuucgcaaugauguccccauggcagggccauuggucgccggaggccucuuaauagccugcuaugucauaacgggcaccucagcugaccuuacagucgaaaaggcggccgacauaacgugggaggaagaagcagaacaaacaggugugucgcacaaccugaugaucaccgucgacgacgacggcacgaugcgaaucaaagaugacgagaccgagaacauauugacagugcuacuaaagacagcacuucucauagugagcggcauuuuccccuacaguauacccgccacgcucuuaguauggcacacauggcagaaacaaacgcagcgaagcggaguccugugggacguaccgucgccuccagaaacucaaaaagcagaguuggaagaagguguauaccgcauuaagcaacaaggcauauucgggaagacacaaguaggcgucggagugcaaaaagaaggaguauuucacaccauguggcauguaacccgcggagcaguccucaccuacaacgggaaacgucucgaacccaacugggcgagcgucaagaaagauuuaauuucguacggaggaggauggagacuaagcgcacaauggcagaaaggugaagaggugcaaguaauagccauugagccaggcaagaaucccaagaacuuccagaccaugcccgguacguuucagaccacaacgggggaaaucggggcaauugcauuagauuucaaaccuggcacaucagggagcccaauaauaaacagagaaggcaagguaguaggccuauacggaaacggcgucguuacaaagaauggcggguacguuagcggaauagcccaaacgaacgcugagcccgacggucccacaccggaacuggaggaagaaauguucaagaaacgcaaccuaacgaucauggaccuacaccccggaagcgguaaaacuaggaaauauuuaccagcgaucguccgcgaggcgauaaaacgaagauugcgaaccuugauccuggcaccaacccgcgugguggcugcagaaauggaagaggcgcuaaagggacugccaauacgcuaccagacaaccgcgacaaaaagugagcauaccggaagggaaaucguagaccucaugugccacgcaacuuucacuaugcggcuguuaaguccggucagagugcccaacuacaacuuaauuauaauggacgaagcgcauuucaccgacccagcaagcaucgccgcacgaggguacaucucaaccaggguaggaaugggggaagcagcagcuauauuuaugacugccacgcccccugggacugcggacgccuucccccaaagcaacgcgccaauccaggacgaggaaagggacauaccggagcgguccuggaacagcggaaacgaauggauaacggacuucgccggcaagaccgucugguucguaccuagcaucaaagcagggaaugacaucgcaaacugucuucggaagaacgguaagaaagucauucagcucagucgcaagacuuucgacacggaauaccagaaaacgaagcugaacgacugggacuucguggucacuaccgacauaucggaaaugggcgcaaauuucaaggccgacaggguaauagauccgcgacgcugccuaaaaccgguuauucuaaccgacggaccggaacgcguaauacuagcgggaccgaugccgguuacagcagccuccgcugcgcaacggagagggagagucgggcgaaacccucaaaaggaaaacgaccaauauaucuucaccgggcagcccuuaaauaacgacgaggaccacgcccauuggacagaagccaaaaugcuacucgacaacauaaacacaccagaagggauaaucccggcgcucuuugagccagagagagaaaagucagcggcgauagacggcgaguaccggcucaaaggagagucccggaaaaccuucgucgagcucaugagacgcggagaccugccaguauggcucgcgcauaaaguagccagcgaagggaucaaguauacagacagaaaguggugcuucgacgggcaacguaacaaccagauucucgaggaaaauauggauguggaaaucuggaccaaggaaggagagaagaagaaacugagaccccgcuggcucgacgcccgaaccuacagcgacccgcucgcauuaaaagaguucaaggauuuugcagcaggacguaaaaguauagcccuagaccucgucaccgagauuggaagaguccccucccaccucgcucaucgcacucgcaaugcccuagacaacuuagucaugcuccacacaucugagcauggcgggcgggcguaccgacaugcuguagaggaacuaccggaaaccauggaaacacuuuuacugcucggccugaugauacuauuaacagguggagcgaugcuauucuugauaagcggaaaggggaucgggaaaacaucaaucggccucauaugcguuauugcaucuuccggaaugcuguggauggccgaaaucccacugcaauggauagccuccgccauagugcuagaguucuucaugaugguacuucucauccccgagccagaaaaacagaggacaccacaagauaaccagcucgcguauguagucauaggcauacucacguuagcggcaauaaucgcagcaaacgaaaugggccuucucgagaccacaaaaagggacuuagggaugucuaaagagccaggggucguauccccaaccuccuaccuagacguugacuugcaucccgcgagcgcauggacgcucuaugcaguagcgacgacagucauaacaccgaugcuccggcauaccaucgagaacucgaccgcaaacguaucacucgcugcgaucgcgaaucaagcagucgugcuuauggggcucgacaaggguuggccgauaucaaaaauggacuuggguguccccuuacuggcgcuaggauguuacagccaagucaacccccucacgcuaacggcagccguccugcuacuaauaacccauuacgcgaucauuggcccuggccuccaagcuaaggccacacgcgaggcgcagaagagaaccgcggcugguauaaugaagaacccaaccguugacggcauuaugaccaucgaccucgacccugucauauacgauuccaaauucgaaaagcaacuuggccaggugaugcuauuaguacuaugcgccguccagcuccuacucaugaggacaagcugggccuugugcgaggcgcuaacccuagccaccggaccgauaacuacccuaugggaagggucuccagggaaauucuggaauacuaccaucgcaguguccauggcaaacauauuccgaggcuccuaccuugccggugccggacuagcauuuucgaucaugaaaucagucgggaccggaaaacgcggcacggggagucagggcgagacauugggggaaaaguggaaaaagaaacucaaucagcuaagcaggaaggaguucgacuuguacaagaaaucgggaauuacagaagucgaccgcacagaagccaaagaaggccuaaaacgcggagagaucacgcaccaugccgucagucgaggaucggccaaacugcagugguucguggagcgaaacaugguuauccccgagggcagaguaauagaucucgggugcgggaggggcggcuggagcuacuacugcgcagguuuaaagaaagucacagaagucagaggauacacgaaaggcggcccuggccacgaagaacccguccccauguccacuuacgguuggaauaucgucaaacuaaugucgggcaaagacgucuucuaccuacccccagaaaagugugacacgcugcuuugugacauaggcgaguccagcccaucaccaacagucgaagaaucacggaccaucagaguacuaaagaugguggagcccuggcucaaaaacaaccaauucugcaucaagguauuaaacccauacaugccuaccguaauagagcaccuggagcguuuacaaagaaaacacggcgggaugcugguacgaaacccccuaucacguaacagcacccacgaaauguacuggaucuccaacgguacaggaaacauuguagcuuccgugaacauggugucccgccucuugcugaaucgcuucacuaugacacaucgccgccccacaauugagaaagacgucgaccuaggggcaggaacacggcacgucaacgccgagcccgagaccccuaacauggacgugauaggagaacgaaucaaacggaucaaggaagaacacaacucaacauggcacuaugacgacgaaaacccguauaaaacaugggcauaccacggcagcuaugaggucaaggccacgggcuccgccuccaguaugaucaacgggguggugaagcuccugacgaaaccaugggacgugguaccaaugguaacccaaauggcaaugaccgacacgaccccguucggacaacaacgcguauuuaaggaaaaagucgacacacggacacccagguccaugccaggcacaaggagaguaauggggaucaccgcggaauggcuauggcggacccuaggaagaaacaaaaagccaagacuauguacgagggaggaguucacgaagaaaguaagaacuaacgccgccaugggcgcaguauucacggaggagaaccaaugggacagcgcgaaggcggcaguggaagacgaagacuucuggaagcuaguagacagagaacgagagcuacacaaauuaggaaaaugcggaagcuguguauacaacaugauggggaaaagagaaaagaaacugggcgaguucggaaaagccaagggcaguagggcaaucugguauauguggcucggagcaagauaucuagaguucgaagcacuaggauuccuaaaugaggaucacugguucucgcgugaaaacucauacucuggagucgagggagagggucuacacaaauuaggcuacauacugcgcgacauaagcaagaucccuggaggcgccauguacgcugacgacacggcagggugggauacacgaauaacggaagacgaucugcauaacgaggaaaagauaacucagcaaauggaccccgagcacagacagcucgccaacgccaucuucaagcuaacguaucagaacaaaguagugaaagugcaacggccaacgcccacagggacagugauggacauuaucucacgcaaagaccaacgagggucaggccaaguggggaccuacgggcucaauacauucacgaauauggaggcccaacucauccgccagauggagggcgagggaguccucucaaaggcagaccuugaaaacccccaucuaccggagaaaaagauaacccaguggcuagagacaaaaggugucgaacgacucaagaggauggcgauaucgggagacgacugugucgucaaaccgaucgacgauagauuugcaaacgcucuccuagcucucaaugacauggggaagguacgcaaggauaucccccaauggcagccaucuaagggguggcaugacuggcaacaagucccauucugcucccaccacuuccacgaacuaaucaugaaggacggacggaagcugguugugccgugccggccccaagaugagcuaauuggucgcgcuaggaucucacaaggcgcaggcuggagccuucgggaaaccgcuugccuggggaaggcuuacgcucaaauguggagccuaauguacuuccauagacgcgaucuacggcuggcaagcaacgcgaucugcucagccguuccgguacacugggugccgaccagccgcacaacaugguccauccaugcucaccaucaauggaugacgacggaggacaugcucacuguauggaacaggguauggaucgaggacaaccccuggauggaagacaaaacaccagucacaacuugggagaacguuccguaccucggaaagagagaagaucaaugguguggcagcuuaauuggauuaacaagccgagccacgugggcgcaaaauauaccaacagcuauccagcaaguacgaagccuuaucgggaaugaagaguucuuggacuacaugccuucgaugaaaagauuccgaaaagaagaagagagcgaaggcgccauaugguag

SEQ ID NO: 25884 - RNA, 9873 nt, Artificial Sequence
  derived and/or modified CDS sequence (opt11) from DENV-3__KJ189263__SS-prME
accucuuuaugucucaugaugauacugcccgccgcgcuggccuuccaccuaaccagccgggauggagagccccgaaugauaguggggaagaacgagcgcggcaagagcuuacuguuuaagacggcauccggcaucaacaugugcacccucaucgcgauggaucugggcgaaaugugcgacgacaccgugaccuacaagugcccccacauuacggagguggagccggaggacauugacugcuggugcaaccugaccucaaccugggugaccuacgggacgugcaaccaggcuggcgagcaccggcgggacaagcgguccguggcccuagcgccucacgugggcauggggcuggacacgcgcacccaaaccuggaugagcgcugagggugcuuggcggcaggucgagaagguggaaacgugggcccugcgccacccgggcuucaccauucucgcgcuguuccuggcccacuacauuggcaccagccucacucaaaaggucgugaucuuuauucuucugaugcucgugacgccaagcaugacaaugcggugcguggggguaggcaaccgcgacuuuguggagggucuguccggugcgaccuggguggacgugguccuggagcacggagguugcgugaccaccauggcuaagaacaagcccacccucgacauagagcugcaaaagaccgaggccacccaguuagcgacguugcggaagcucuguaucgagggcaagaucaccaacaucaccaccgauagccgcugccccacacagggggaggcugugcugccugaggagcaagaccaaaauuacgucugcaagcacaccuacguggaccgaggguggggcaacgggugcggccucuucgggaagggcucccugguaaccugcgcuaaauuccagugccuggagccuaucgagggcaaggucguacaauaugagaaccucaaguacaccgugauuaucaccgugcacaccggggaccagcaccaggucggcaaugagacacagggggucaccgccgagaucacaccccaagccagcacaaccgaggcgacgcugccugaguacggcacucuggggcucgagugcuccccgcgcacaggccuggacuucaacgagaugauccugcucaccaugaagaacaaagccuggaugguucacagacagugguucuucgacuugccacugcccuggacaagcggggccaccacggaaaccccuaccuggaaccgcaaggagcuccuggugaccuucaaaaacgcccacgccaaaaagcaggaggucguuguguugggaucccaagaaggcgcuaugcacacugcccucaccggggccaccgagauccaaaacagcggcgggaccuccaucuucgccggccaccugaagugcaggcucaagauggauaagcucgagcugaagggcaugagcuaugccaugugcaccaacaccuucgugcugaagaaggagguguccgagacccagcaugggaccguucucaucaagguugaguacaagggcgaggacgugcccugcaagauucccuucucgaccgaagacgggcacgggaaggcgcauaauggccgccugauuaccgcuaaccccguggucacaaagaaagaggagccagugaauaucgaagccgagccgcccuucggggagagcaacaucgugaucggcaucggggacaacgccuugaagaucaacugguauaagaagggcuccagcaucgggaagauguucgaggcgaccgcccggggugcccggcggauggccauacugggcgacacggcaugggacuucggguccgugggcggagugcuaaauagccuuggcaagauggugcaucagaucuucggguccgcguacacagcccuguucagcggaguuuccugggugaugaagauuggcaucgggguccuccugaccuggaucggucugaacucgaagaauaccuccaugagcuucuccugcauugccauugggaucauuacguuauaccugggugccgucguacaagccgacaugggcugcguaaucaacuggaagggcaaggaguugaagugcgguagcgggaucuucgucaccaacgagguucacaccuggacagaacaguauaaguuccaggccgauagccccaagcgccucgccacggccaucgccggggccugggagaaugggguguguggcauucgcagcaccacccggauggagaauuugcuguggaagcagaucgcuaacgagcucaacuacauccugugggagaacaacaucaagcucaccgucguggugggggacaucauaggcguucucgagcaaggcaagcgcacgcuuaccccccaaccgauggagcugaaguacuccuggaagacuuggggcaaggcgaagaucguaaccgcugagacgcagaauagcuccuucaucaucgacggccccaacacccccgaaugucccagcgccucccgggcuuggaacgugugggaggucgaggacuacggguuuggugucuucaccaccaacaucuggcuccgccugcgggaaguguauacccagcugugcgaccaccgccucaugagcgcggccgucaaagacgagcgggcgguacacgccgacauggguuacuggaucgagucucagaaaaacggguccuggaaauuagagaaggcgagccugaucgaaguuaagacuugcaccuggccgaaaucccacaccuuauggagcaacggcguccuggaauccgacaugaucauccccaaaucgcuggccgggcccaucucccagcauaaccacaggccgggcuaccacacccagacggccggaccauggcaccucggcaagcuagaacuagacuucaacuacugcgaaggcacaaccguggucaucaccgagaacugugguacgcggggccccaguuugcgcaccaccaccgucuccgggaagcugauucacgaguggugcugucgguccugcacgcugccgccccuccgcuacaugggcgaggacggaugcugguacggcauggagauccgccccauauccgagaaggaagagaauauggucaaaagucuugugucugccgguagcggaaaggucgacaacuucaccauggggguauugugccucgccauccuguucgaggaggugaugcgcgggaaguucggcaagaagcacaugauagcaggggucuucuucacguucguguugcuccuguccggccaaaucaccuggcgcgacauggcccacacacugaucaugaucggcagcaacgcauccgaccgcaugggaaugggcgugaccuaucucgcccuaaucgccaccuuuaagauacagcccuuccuggcgcucggguuuuuccugcggaaguuaaccagcagggagaaucuccugcugggggucggcuuagccauggccacgacccugcaguuaccggaagacaucgagcagauggccaacgggaucgcccucggccugauggcucugaagcucaucacccaguuugagaucuaucaacuguggacagcccugaucagucuuacgugcuccaacaccaucuucacccugaccguggccuggcggacggcaacccugauacucgcaggggucagccugcugccggugugccaguccagcuccaugcgcaagaccgacuggcuccccauggccguagccgccaugggggugccuccucucccgcuguuuaucuucagccucaaagauacccuaaaacgccgguccuggccccugaacgaggggguuauggccgugggcuuagugucuauccuagcguccagccugcugcgcaacgacgugcccauggccggcccccugguggccggggggcugcucaucgccugcuacgucaucaccgggaccucugccgaccugaccguagagaaagcggcagacaucaccugggaggaagaggcugagcaaacgggcgugucucacaaccuuaugaucacugucgacgacgacgggaccaugaggaucaaagacgacgagacugagaacauucucaccgugcugcugaagacggcgcuccugauaguuuccgggauuuucccguacagcauaccggcuaccuugcuugucuggcacaccuggcagaagcagacucagcgcagcggugugcuaugggacguccccaguccgcccgagacgcagaaggccgagcuggaggagggggucuaccggaucaagcaacagggcaucuuugggaagacucagguagguguggggguccagaaggagggcguguuccauaccauguggcacgucacacgcggcgccguacucacuuacaacgguaagcgguuggagcccaacugggcauccgugaagaaggaccuuauaagcuauggcgggggcuggcgccucuccacccaguggcagaagggggaggaggugcaggucauugccguggaacccggcaagaauccaaagaacuuccaaaccaugcccggcaccuuccagacgaccaccggggagaucggcgcgauagcguuggacuuuaagcccgggaccuccggcagccccaucaucaaccgggaagggaaaguggucggccuguacggcaacggcgucgugacuaagaauggcggcuacgucuccgguaucgcccagacgaacgccgagccggacggcccuacccccgagcuagaggaggagauguucaagaaacgcaaccucacgaucauggaccugcaccccgggagcgguaagacgcggaaguaucugccggcgauaguucgcgaagccauuaagcggcguuugagaaccuuaaucuuagcacccacccgcgugguagccgccgagauggaggaggcccuaaaaggucuacccauccgguaccagacaacagcgaccaaauccgagcacacuggccgcgagaucguggaucugaugugucacgcaaccuucacgaugcggcuccugucccccgugaggguaccgaacuauaaucugaucauuauggacgaggcccacuucaccgaccccgccuccaucgccgcgcggggcuacaucaguacccgcguuggcaugggcgaggcggccgccaucuucaugacggcgaccccgcccgggaccgccgacgccuucccgcaaucuaacgcucccauccaggacgaggagcgcgauauacccgagaggagcuggaacuccgguaacgaguggaucacugauuucgccggaaagaccgugugguuugugcccagcaucaaggcggguaacgacaucgccaacugccuccgcaagaacggcaagaagguaauccaguugucgcggaagacguucgauaccgaguaucagaagacgaagcugaacgacugggauuucguggucaccacggacaucagcgagaugggcgccaacuucaaggccgaucgcguaaucgacccgcggaggugccucaagccggugauacugaccgacggccccgagcggguaauccuugccgggccaaugccgguuacggcggccucugccgcccagcgccggggucgcguggggcggaacccccagaaggagaacgaucaguacaucuucaccggacagccgcugaacaaugaugaagaccacgcccacuggaccgaggcgaagaugcugcuggacaacaucaacacgccggaggggauuaucccggcucucuucgagcccgagcgcgaaaagagugccgcuaucgacggagaauaccgguuaaagggcgagucccgcaaaaccuuugucgagcugaugcggcgcggggaccucccggugugguuggcacacaaggucgccagcgagggcaucaaguauaccgaccggaaauggugcuucgaugggcaacgcaacaaccagauccuugaggagaacauggacguggagaucuggacuaaagagggcgagaaaaaaaagcucaggcccagguggcucgacgcccgcaccuacuccgacccguuagcccucaaggaguuuaaggacuucgcggcgggccgcaagagcauugcccucgaccugguaaccgaaaucgggcgcguccccucccaccucgcccaccggacccgcaaugcccuggacaaccuggucaugcuccauaccagcgagcacggcgggcgggccuaccgucacgcgguugaggagcugcccgaaacgauggagacccuccuucugcuaggucucaugauccugcugaccgggggcgccauguuauuccucaucagcgguaaggggaucggcaagacauccaucggccugaucuguguuauugcuagcuccggcaugcucuggauggcugagaucccgcuacaguggauugccucggcgaucguguuagaauucuucaugaugguacuccugauccccgagccggagaagcaacggacgccccaggauaaccaacuggccuacgucgugaucgguauccucacccuggccgccaucaucgccgcgaaugagaugggacuucuggagacuaccaagcgcgacuugggcaugucuaaagagccugguguagucuccccaacguccuaucuagacguggaccuccaccccgccucggccuggacccuguacgccguggcgaccaccguuauaacgccuaugcugcgccacaccaucgagaacuccaccgccaacgugagccucgccgccaucgccaaccaggcggugguccugaugggccuggacaagggcuggccgaucuccaagauggaccucggagugccccugcuugcucucggguguuacucucagguaaacccccuaacgcugacugccgccgucuuacugcugauaacccacuacgccaucauaggcccaggacuccaggcgaaagcgacccgcgaggcacagaaacggaccgccgccgggaucaugaagaacccgacgguggacggcauaaugaccauagauuuagacccugugauauacgacuccaaguucgagaagcagcugggucaggucaugcuccuggugcuuugcgcugugcagcuccuccugaugcguaccagcugggcgcucugugaggcccugacgcuggccacggggccuauaacuacgcucugggaaggcuccccgggcaaguuuuggaacaccacaaucgcggucagcauggccaauaucuuccggggcuccuauuuggccggcgccggccuggcguucagcaucaugaagucugugggaacaggcaagcgcggcaccgggucucagggcgagacucucggggagaaguggaagaaaaagcugaaccagcugagccgaaaggaguucgaccucuauaagaaguccgggaucacugagguggaccgaacugaggcgaaggagggucugaagcggggcgagaucacucaccaugccgucucgcgcgggucugccaagcugcagugguucguggagagaaacauggugaucccggaggggagagucaucgauuugggaugcggccgggguggguggagcuacuacugcgccggcuuaaagaaggugaccgaggugcggggcuacacaaagggcgggcccgggcacgaggagcccguccccaugucaacguacggcuggaauaucguaaagcugaugagcgggaaggacguguucuaucucccucccgaaaagugcgacacccucuuaugcgacaucggcgagaguucacccucccccaccguugaagagagccgcaccauucgggugcuuaagauggucgagccauggcucaagaacaaccaguucugcauuaaggucuugaacccguauaugccuacggugaucgagcaucuugaacgccuccaacgcaagcacggggguaugcuggucagaaacccccugucccggaacucaacccacgagauguacuggauuucaaacggcaccggcaacaucguugccucugugaacaugguaucccgccuacuucugaaccgguuuaccaugacucaccgccggccgacgaucgagaaggacgucgaucucggggcgggcacccgccacgugaacgccgagcccgagacgccgaacauggacguaauaggggagcggauaaagcgcauuaaggaggagcacaacucaacguggcacuacgacgaugagaacccguacaagaccugggcguaccacggcuccuaugagguaaaggccaccgggagcgcguccagcaugaucaacgggguagucaagcuucugaccaagcccugggacgugguuccuauggugacgcagauggcgaugacugauaccacuccguucgggcagcaacggguauuuaaggagaaaguggacacgcguaccccgcggagcaugcccggcacccgccgggucaugggaaucaccgccgaauggcuauggcgcacgcucgggaggaacaagaaaccccgccugugcacacgcgaggaguucacgaagaagguccguaccaacgcagccaugggggcuguguucacggaggaaaaccaaugggacuccgcgaaggccgccgucgaggacgaggacuucuggaagcucguggaccgggagcgcgagcugcacaagcuggggaaguguggaagcugcguguacaacaugauggggaagcgcgaaaagaagcucggcgaguuuggcaaggcaaagggaucacgggcgaucugguauauguggcuaggcgcccgauaccuggaguucgaggcccuaggauuccuaaacgaggaccacugguuuagccgggagaacuccuacucggguguggagggggagggccugcacaagcucggcuacauccugcgagacaucuccaaaaucccggggggcgcaauguaugccgacgacaccgccgggugggacacccgaaucaccgaggacgaccuucauaacgaggagaagaucacacagcagauggacccggagcaccgccaacucgcaaaugccaucuucaagcugaccuaucaaaauaaaguggugaagguccagcggcccaccccgaccgggaccgugauggauaucaucucucgcaaagaccagcggggcuccggccaggugggcacauacgggcuuaacaccuucaccaauauggaggcccaauuaaucagacaaauggagggcgaggggguuuuaagcaaagccgaucuggagaauccccacuugccagagaagaagaucacacaguggcucgagacgaagggcgucgagcggcuaaagcgcauggcuaucuccggagacgauugcguggucaagcccauagacgaccgcuucgccaacgcccugcuugcccugaacgacauggggaagguucgcaaggacauaccgcaguggcagccuucaaagggcuggcaugacuggcagcaagucccguucugcucgcaccacuuccacgaacucaucaugaaggaugggcgcaagcugguaguacccugccgcccccaggacgagcugauagggcgggcacgcaucagccaaggcgcgggcuggucccucagagagaccgccugccuaggcaaggccuacgcccagauguggagcuugauguacuuccaucggcgcgauuugcggcuggcguccaacgccauuugcagcgcgguacccguccacugggugccgacgucccgaaccacguggaguauccacgcccaccaccaguggaugaccaccgaagacauguuaaccguguggaaccgggucuggaucgaagacaaccccuggauggaggacaaaacgcccgugacgacaugggagaacgugccguaccucgggaagcgcgaagaccaguggugcgggagccugaucgggcugacgagccgggccacgugggcccagaacaucccgaccgccauccagcagguccgcagccucauaggcaacgaagaauucuuagacuacaugcccuccaugaaacgguuccgcaaagaggaggagagcgaaggggccaucugguaa

SEQ ID NO: 25885 - RNA, 9873 nt, Artificial Sequence
  derived and/or modified CDS sequence (opt11) from DENV-3__KJ189265__SS-prME
acaagccugugucucaugaugauacuuccggcggcccuagcguuccaccucacuagccgggacggggaaccacgcaugauuguggggaaaaaugagcggggcaagagcuuacuguuuaagaccgcauccgggaucaacaugugcacccucauagcuauggaucuaggcgagaugugcgacgacaccguaaccuacaaaugcccccacauuacggagguggaacccgaggacauagauugcuggugcaaccugacauccaccuggguuacuuacgguacaugcaaucaggcaggcgagcaccgacgcgacaaacgcucggucgcccuagcuccccacgugggcauggggcuggauacucggacccagaccuggaugagcgccgagggugccuggagacagguggagaagguggagacgugggcccugcgccauccgggguucaccauccucgcguuguuccuggcccacuauaucggcacuucccucacccaaaagguggugauauucauacuucugaugcucgucacuccgagcaugaccaugcggugcgugggcguaggcaacagggacuucguggagggcuuaucgggugccaccuggguagacguaguccuggaacauggcggcugcgugaccacgauggccaagaauaaacccacccucgacaucgagcugcagaagaccgaagccacacaacuggcgacguuacggaaguugugcaucgagggaaagaucaccaauauuaccaccgacagccgcugccccacccaaggcgaggcuguguuaccggaggaacaggaccagaacuacgucugcaaacacacguacguggaccggggguggggcaacgggugcggucucuucgguaagggcagucuggugacaugugccaaguuucagugccucgagccaauugagggcaagguagugcaguacgagaacuugaaguacaccgugaucaucaccgugcacacgggagaccaacaccaagucggcaacgagacgcaggggguuacggccgagaucacgccccaggccucgacuacggaggcgauuuugcccgaguacggcacccuggggcucgagugcuccccacguacgggccuggauuucaacgaaaugauccugcucacgaugaagaacaaagccuggaugguacaucggcagugguucuucgaccuuccgcuccccuggacgucaggcgcaaccaccgagacgcccaccuggaaccgcaaggagcuauuagugaccuucaagaacgcgcacgccaagaaacaggaggucguggugcugggcucccaggagggcgcgaugcacaccgccuuaacgggggcaaccgaaauucagaauagcggcggaaccuccauuuucgccgggcaccugaagugccgacugaaaauggacaagcucgagcugaaggguaugucuuacgccauguguaccaacaccuuuguccugaagaaagaaguuagugagacccagcacgguaccauccucauuaaggucgaguauaagggcgaggacgugccuugcaagaucccguucucuacagaggacgggcacggcaaagcgcacaacggccgccuuaucacggccaacccuguaguuaccaagaaggaggagccggucaauauagaggccgagccgccuuucggggagagcaacaucgugaucggaaucggcgacaacgcccugaagaucaacugguacaagaagggcagcucaauagggaaaauguucgaggcuacagcccggggcgcucgccggauggcuauccugggcgacacggccugggauuucggguccguaggggguguucucaauagccucggcaagauggugcaccagaucuucggguccgcguauacggcuuuauuuagcggcguguccugggucaugaagaucggcaucggcgugcuccugaccuggauuggucugaauagcaaaaacaccuccaugagcuucuccugcaucgcgaucgggaucaucacucucuaccucggggccguaguccaagccgacaugggaugcgugaucaacuggaaaggcaaggagcugaagugcggcagcggcaucuuugugacgaaugagguccacacuuggaccgagcaguauaaguuucaagcggacaguccaaagcgccucgccacagccaucgccggcgccugggaaaacggggugugcggcauccgcucaacaacccggauggagaaccugcuguggaagcagaucgcgaacgagcucaacuacauccugugggagaacaauauaaaacugacgguggucgugggggacauuauaggcguguuagagcaugggaagcgcacacugacgccgcagccgauggagcugaaguauuccuggaaaaccugggggaaggccaagauugucaccgcagagacacagaauagcucauucaucauugacggccccaauacacccgagugccccagcgccucccgggcuuggaaugugugggagguggaggacuacgguuucggggucuucaccaccaacaucuggcucaaguuacgugaaguauacacccaguuaugcgaucaccgacuaaugagcgcggccguaaaggaugaacgcgccguccaugccgacaugggcuacuggaucgagagccaaaagaauggguccuggaagcuagagaaggcuagccugaucgaggugaagaccugcacguggccaaagucccacacguuguggagcaauggcgugcuggaguccgacaugaucauuccaaagagccuggccggccccauaucccagcacaaccaucggcccggcuaucacacccagacugccgggcccuggcaucucggaaaguuggaguuagacuucaacuacugcgagggcacgaccgucguaaucaccgagaacugcggaacccgcggccccagccucagaaccaccaccguguccgggaagcugauucacgaguggugcugccgaagcugcacguugccuccacucagguacaugggcgaggacgggugcugguacggaauggaaauccgcccaaucuccgaaaaggaggagaacauggugaaaagccugguguccgccggcagcggaaagguggacaacuuuacgaugggcguuuugugccucgccauccuguucgaagaagugaugcgcggaaaauuuggcaagaaacacaugaucgcggggguuuucuuuaccuucgugcugcuccuguccggucaaauaacuuggcgcgacauggcccacacucugaucaugaucgguagcaacaccuccgacagaaugggaaugggggugaccuaccucgcccucaucgcuaccuucaaaauccagcccuuccuggccuuaggguucuuccugcgcaagcugaccagccgagagaaccuacuguugggcguuggucucgcuauggccacgaccuugcaguuacccgaggacaucgaacaaauggccaacgggauagccuugggacuuauggcgcugaagcugauaacgcaauucgaaacguaccagcuguggacggcccugaucagccugaccugcaguaacaccauauucacccugacggucgccuggcguacugccacuuuaauauuggcuggugugucacugcugccggucugccaguccagcuccaugcggaagacggacugguuacccauggcgguggccgccaugggcgugccuccccucccgcuauucaucuucagccugaaggacacccugaagcggcgcuccuggcccuugaacgaagggguaauggccguuggccucgucuccauuuuagcguccagccugcuucggaaugacguccccauggcgggcccacugguugcagggggccugcucaucgcguguuacgugaucaccgggacguccgccgaccugacgguugagaaagccgcgaacaucacuugggaagaggaggccgagcagacaggggugagccacaaccugaugaucaccguagaugacgaugggaccaugcgcaucaaggacgacgagaccgagaauauccuaacggucuuacugaagacugcccuccugaucguguccgggauauucccauauucaauccccgcuacccugcucguguggcacacauggcagaagcagacgcagcgaucugguguccugugggacguacccagcccgccugagacccagaaagccgagcucgaagagggcguguaucgcaucaagcaacagggcaucuuugggaagacccaggucggcgugggggugcaaaaggagggcgucuuccacaccauguggcaugucacgcggggcgcgguucuuaccuacaacgggaagaggcuggagcccaacugggccuccgucaagaaagaccugauaagcuacggaggaggguggaggcucuccgcccaguggcagaaaggggaggaaguccagguuaucgcgguugagccuggcaaaaaccccaagaauuuccagaccaugcccggcaccuuccagacaacuacaggggagaucggcgcuaucgcgcuggauuucaaacccggcaccagcggcucacccaucauuaaucgcgaaggcaaggucguggggcuguauggcaacggggucgugacgaagaacggcggguauguguccggcaucgcucagacuaacgccgagccggauggccccacgcccgagcuggaagaggagauguuuaagaagcggaaccucacgaucauggaccuacaccccgggagcggcaaaacgcggaaauaccugccggcuaucguccgggaggcgaucaagcggcgccuucgcacucugauccucgccccuacccggguuguggcggccgagauggaggaggcgcucaaggggcugccuauccgcuaccagaccacggcgaccaaauccgagcacacaggccgggagauugucgaccucaugugccaugcaaccuucaccaugaggcuccugagccccgugcgggugccgaauuacaaccucauaauaauggacgaggcccacuucaccgaccccgccucgaucgccgcgcgcggguacauaucgaccagagucgguaugggcgaggcagccgcuauuuuuaugacggccacgccgcccgggaccgccgaugccuucccgcaguccaacgcccccauccaggacgaggaacgcgacauccccgagcgcucauggaacaguggcaacgaauggaucacggauuuugccggcaagacagugugguuugugcccaguaucaaggcugggaaugacauagccaacugccuccggaagaacgggaagaaagucauccagcugucgcgaaagacguucgacacagaguaccagaagacaaagcugaacgauugggauuucgugguuaccaccgacauaucugagaugggcgccaacuucaaagccgacagagucaucgacccgcgacgcuguuugaagccgguaauccugacagauggcccagaacgcgugauccuggccggccccaugccggucacugcggccagugccgcacagcgccgcggccggguggggcgaaacccccagaaggagaacgaccaguacaucuucaccggccagccgcucaauaaugacgaggaucaugcucacuggaccgaagcgaagauguuacuggacaacaucaacacgccugaggggaucaucccggcccucuuugaaccggagcgggagaaguccgcagccauagacggggaguaccgccugaaaggcgagucccggaaaaccuuuguggagcugaugcgacgcggggaucuuccugucuggcucgcgcauaaaguagcaucagagggcaucaaauacaccgaccgcaaguggugcuucgacgggcagaggaacaaccagauccuugaagagaacauggacguagagaucuggaccaaggagggggagaagaaaaaguugcgcccccgauggcuggacgcccgcacguacucugacccgcuggcgcucaaggaguucaaagauuucgccgcgggccgcaaaagcauugcccuagaccuggucaccgaaaucggacguguuccaucccaccucgcucaccgcacccggaacgcucuugauaaucucguaaugcuccacaccagugagcacggcgggcgcgccuaccgucacgcaguggaggaacugccugaaacgauggaaacccugcuccuacugggacuaaugauccugcuuaccggaggcgccaugcuguuccucauaagcggcaaagggaucggcaagaccuccaucgguuugaucuguguaauagcaucauccggaaugcucuggauggccgagaucccucugcaguggaucgccagcgcgaucguccuggaguucuuuaugauggugcuccugaucccggagccggaaaagcagcgcacgccccaggacaaccagcuggccuauguggucaucgggauccucacacuugcugcgaucaucgcagcuaaugagaugggauuacucgagaccacuaagcgggacuuagggauguccaaggagccgggcgugguuagccccacguccuacuuggacguugaccuccacccagccagcgcguggacccucuacgccguggcgaccacugugaucacgcccaugcugcgccauacaaucgaaaauuccaccgcgaaugugagccucgccgcaaucgccaaccaggcaguggugcugaugggccuggacaagggcuggccgauauccaagauggaccucggagucccccugcuugcacucgggugcuauagucaggugaacccccugacccuuacggccgcggugcuacuacugaucacucacuacgcuauaaucggccccgggcuccaggcgaaggccacacgggaggcccaaaagcgcacagccgccgggaucaugaagaacccaacggucgacgggaucaugaccauugaccuggaccccgugaucuacgauucuaaguuugaaaagcagcuuggucaggugauguuauugguccugugcgcuguacagcuccugcugaugagaaccagcugggcccucugugaagcacugacccuugccacgggcccuauaaccacgcucugggaaggcucccccggaaaauucuggaauaccacgaucgcggugagcauggccaacauuuuucgcggcucguauuuagccggggcgggccuggcguucagcaucaugaaguccguuggaaccggcaagcggggcacagggagccagggcgagacgcucggggagaaguggaagaagaagcuaaaucaacuaucgcggaaggaguucgaccucuacaagaaguccggcauuacggagguggaucggacggaggcaaaggaggggcugaagcgcggggagauaacccaucaugcagugucucgaggguccgcaaagcugcagugguucgucgagcgcaauauggucaucccggaagggagagugauagaccucggcugugggcgcggaggguggagcuacuacugcgcaggccugaagaaagucacugaggugcggggcuauaccaagggcgggcccgggcacgaggagccgguacccaugucuacguacggcuggaacaucgucaagcucaugagcgggaaggaugucuucuacuuaccgcccgagaagugcgacacucugcugugugacauuggcgaaucgagccccagccccaccguggaggagucacguaccaucagaguacugaagaugguggagccguggcucaagaacaaucaguuuugcaucaaggugcugaaucccuacaugccaacggucaucgagcauuuagagcggcuacagcgcaagcacggcgggaugcugguacgcaacccucugagccgcaacagcacucacgagauguacuggauauccaacgguacaggcaacaucguagccagcgucaacauggugucccgucuccugcugaaccgcuucaccaugacgcaccggcgcccgacuaucgaaaaagauguagaucucggcgcaggcacccggcaugucaacgcggagccggaaacccccaacauggacgucauaggcgagaggaucaagagaauaaaggaggagcacaacagcacguggcacuacgacgacgagaacccguauaagaccugggccuaccacggcucuuacgaggugaaggcgaccgguucugcguccagcaugaucaacggggucgugaaauugcugaccaagcccugggacgucgugccgauggugacucagauggcgaugacugacaccacccccuuugggcagcagcgcguuuucaaggagaagguggacacgcggaccccgcgcagcaugccuggcacccggcgcgugaugggcaucaccgcagaguggcucuggcgcacacugggucgaaauaaaaagccccgacucugcacacgggaggaguucacuaagaagguccgcaccaaugcagcuaugggcgcgguguucacggaggaaaaccaaugggacuccgcgaaggccgcuguggaggacgaggacuuuuggaagcucgucgacagagagcgcgagcugcacaagcugggaaagugcgguucauguguguacaacaugauggguaaacgggagaagaagcucggcgaguucggaaaggcuaaaggguccagagcaaucugguauauguggcugggcgcacgguaccuggaguuugaggcccucggguuccucaacgaggaccacugguuuagccgcgagaacagcuacagcggcgucgagggggaggggcugcacaagcugggcuacauacugcgggacaucuccaagauccccggcggcgccauguacgccgacgacaccgcggggugggacacgcguaucaccgaagacgaccugcacaacgaggagaagaucacgcagcagauggacccggagcacaggcagcucgccaacgccaucuuuaagcugaccuaccagaacaaggucgugaaggugcaaagaccuaccccgacgggcacugucauggacaucauuagcaggaaagaucagcgcggcuccggccaggucggcacguaugggcugaacaccuucaccaacauggaagcccaacucauccggcaaauggagggcgaggggguguugagcaaggccgaucuggagaauccccaccuuccugagaaaaagaucacccaguggcuggaaacaaagggcgucgagcgucugaaacggauggcgaucucuggggaugacugcguugugaagcccaucgacgaccgcuuugccaacgcacugcucgcccucaacgacaugggcaagguccggaaagacauuccgcaguggcagcccucgaagggcuggcacgacuggcagcaagugccguucugcucgcaucacuuccaugagcucaucaugaaggacggccgaaagcuggucguucccugccguccccaggacgagcugauuggccgcgcccggaucagccagggggcgggcuggucccuccgcgagaccgccugucugggcaaggccuacgcacaaauguggagucugauguacuuccaucgccgggaccuccgucuugcgucgaacgccauauguuccgccgugcccguccacuggguuccgaccagccguacgacauggagcauacacgcccaccaccaauggaugacaaccgaggauaugcugaccguguggaaucgugucuggaucgaagacaaccccuggauggaagauaagaccccuguuaccacaugggagaacguacccuaccucgggaagagagaggaccaauggugcgguagccugaucggucugaccucccgcgccacgugggcgcaaaacaucccaacagccauucagcaaguccguagucucaucggaaacgaggaauuucuggacuacaugcccuccaugaagcgcuuccggaaggaggaggagagcgagggagccaucugguga

SEQ ID NO: 25886 - RNA, 9873 nt, Artificial Sequence
  derived and/or modified CDS sequence (opt11) from DENV-3__KJ189266__SS-prME
accagccugugucucaugaugauccugcccgccgcacucgcguuucaccucacuucccgggacggcgaaccccggaugaucgugggaaagaacgaacggggcaagagcuuacuguucaagacagccagcggcaucaacaugugcacccugaucgcaauggacuugggagagaugugcgacgauacuguaaccuacaaaugcccgcacaucaccgagguagagcccgaggacauagacugcuggugcaaccugacgagcaccugggugaccuacgggaccugcaaccaggccggggaacaucgccgcgacaagaggucgguugcccucgcgccccaugugggcaugggucuggauacccguacccagaccuggaugagcgccgagggugccuggcgccagguggagaaagucgagacgugggcucugcgccacccgggcuucaccauccuagcgcucuuccucgcccauuacaucggcacaucgcucacccagaaggucgugaucuucauccugcuuaugcucgucacacccucgaugaccaugcggugcguggggguggggaaucgcgauuuugucgaaggcuuauccggggccaccuggguagacgugguucucgagcacggcgggugcgucaccacgauggccaagaacaagcccacccucgacaucgagcugcagaagaccgaggccacgcagcuagcaacgcucagaaagcugugcaucgagggcaagaucacgaacaucaccaccgacagccgcugccccacgcagggcgaggcuguucugccagaggagcaggaccagaacuacgucugcaagcacaccuacgucgaccggggcugggggaacggguguggacuguucgggaagggcucccuggugacuugcgccaaguuccagugccuggagcccauagaaggcaaggucguccaguacgagaaccucaaauauacggugauuaucacgguccacaccggggaccagcaccagguggggaacgagacccagggggucaccgccgagauuacgccccaggccaguaccaccgaggcgauccugcccgaguacggcacccuggggcucgagugcucuccgcgcaccgggcuggacuucaacgagaugaucuugcucacgaugaagaacaaggccuggauggugcaccgacaaugguucuucgacuuaccccugcccuggacuucaggcgccaccaccgaaacgcccacauggaaccgcaaggagcuccuggugacuuucaagaacgcccacgccaagaagcaggaggucgucgugcuggggucccaggagggcgcgaugcacacggccuugacgggggccaccgagauccagaacagcggagggaccuccaucuucgccggccaccucaagugccgucugaagauggacaaacucgagcugaagggcaugagcuacgccauguguaccaauacguucguucugaagaaggagguguccgagacccagcaugggaccauccucaucaaggucgaguacaagggcgaagacgucccguguaagauccccuucagcaccgaggacgggcacgggaaagcgcauaacggccgucugaucacggcuaaccccgucgugaccaaaaaggaggagcccgucaacaucgaggccgagccgccauucggggagagcaacaucgugaucggcaucggggacaacgcccugaaaauuaacugguacaagaagggcaguagcaucgggaagauguucgaggcaaccgcccggggcgcgcgccggauggcuauccugggugacaccgcgugggacuucgggagcguaggcggaguccucaauagccuggggaaaauggugcaccagaucuucggguccgcguauacggcucuguucagcggcgucucaugggucaugaaaaucggcaucggggugcuccugaccuggaucgggcugaacagcaagaacaccuccaugagcuucuccugcaucgccauugggaucaucacgcucuaccugggcgccgugguccaggccgauauggggugcgugaucaacuggaaagggaaggagcugaagugugguagcggcaucuuugugacgaaugaaguccauaccuggaccgagcaguacaaauuccaggcggacucccccaagcgccucgccaccgccaucgcgggcgccugggaaaacggggugugcgggauacgcagcacaaccaggauggagaaccugcuguggaagcagauugccaacgagcucaacuacauccugugggagaacaacaucaaacugaccgugguagugggggacaucaucggcgugcuggagcagggcaagcgcacucugacgccccagccgauggagcugaaguacuccuggaagaccuggggcaaggccaaaaucgucaccgccgagacccagaauagcuccuucaucaucgacggacccaacacgcccgaaugcccuagcgcuucgcgugcguggaacguuugggaaguggaggacuauggauucggcgucuuuacaacgaauaucuggcucaagcugcgcgaaguguacacccagcugugcgaccaccggcucaugagcgcagcugugaaggaugagcgcgccguccaugcagauaugggguacuggauagagagccagaagaacggguccuggaagcuggagaaggcgucacugaucgaggugaagaccugcacguggccgaagucccauacacuguggucaaacggcgugcuggaguccgacaugaucauccccaaaucgcuggccggaccaaucucacagcauaaccaccggccgggauaccauacccaaacugcugggcccuggcaucucggcaaacuagagcuugacuucaacuacugcgagggcacgaccgucgugauaaccgagaacugcgggacacgcggccccagucuccggacgaccaccguguccggcaaacugauucacgagugguguugucgcucaugcacccugccaccacuccgguacaugggugaggacgggugcugguacggcauggagauccgccccaucuccgaaaaggaggagaauauggucaagucccuggugucugccggcagcgggaaggucgacaacuucaccaugggcguccuuugucucgccauccuguucgaagaggugaugcgagguaaguuuggcaagaagcacaugaucgcggggguguucuucaccuuugucuuacuccuuuccggccagaucaccuggcgcgauauggcccacacccugaucaugaucggguccaacgccucggaccguauggggaugggcgucacguaccucgcccugaucgccaccuucaaaauccaacccuuccuggcgcuaggguucuuccugcguaagcugaccagccgggagaaccuccugcugggcguuggcuuagccauggccaccacgcugcagcugcccgaggacaucgaacagauggccaaugggaucgcgcuaggccuaauggcucugaagcucaucacacaguucgaaaccuaccagcuguggaccgcccugaucucacucacgugcuccaacaccaucuucacccugaccgucgccuggcgcacggccacucuuauccuagcgggggugagcuugcugccggugugccaguccuccuccaugcggaaaaccgacugguugcccauggcaguggccgccaugggugugccuccccucccucuguucaucuucagccucaaggacacucugaagcgccgcucuuggccccugaaugaggggguaauggccguggggcucgugagcauucuggcguccagccugcuucggaacgacguaccuauggcggguccccugguggcuggggggcugcucaucgccugcuacgugaucacggggaccuccgccgaccugaccgucgagaaggcggcggacaucacgugggaggaggaggcagagcagacaggcgugagccacaaucugaugaucaccguggacgacgacgggaccaugcgcaucaaggacgacgagaccgagaacauccucacaguccuguugaaaacggcccuccugaucguuucgggcaucuuuccguacagcauuccggcgacccugcucguguggcacaccuggcagaagcagacccagcguuccggcguccugugggacgugccgagcccgcccgagacgcagaaggcggaacuggaggaggggguguaccgcaucaagcaacaggggaucuucggaaagacucaggucggagugggggugcagaaggaaggcguguuccacaccauguggcaugugacccggggcgcgguacucaccuacaacgggaagcgccuggagcccaacugggccucagucaagaaggauuuaaucucuuacggcgggggcuggcgguuguccgcccaguggcagaaaggggaggaaguccaggugaucgcgauagagcccggcaagaaccccaagaacuuccaagcgaugccgggcaccuuucagaccaccacgggggaaaucggcgcgauagcccuggacuuuaagcccgggaccucuggcagccccaucauaaaccgcgagggcaaggucguggggcuguacggcaacggggugguaaccaagaacggcggguacguuagcggaaucgcccagaccaacgcugaaccggacgguccuacgcccgagcucgaggaggaaauguucaagaaacguaaccucacgaucauggaccugcaccccggguccggcaagacccgcaaguaccugccggccaucguccgggaagccaucaagcgccggcuacgcacccugaucuuggcccccacgcgggucguggccgcggagauggaggaggcacucaagggccugcccaucagauaccaaacaaccgcuaccaagagcgagcauacuggccgagagaucguggaccugaugugccacgccacuuucaccaugcgccuccugagcccaguccgggugccgaacuacaaccugaucaucauggacgaggcccacuucaccgacccggcguccauagccgcccgcggguacaucagcacgcggguggguaugggcgaggccgcugccaucuucaugaccgccacgccgcccgggaccgcugacgccuucccgcagucuaaugcaccuauccaggacgaggagcgcgauauccccgagcgcuccuggaacucgggcaacgaguggaucaccgacuucgccggcaagacgguuugguucguacccucaaucaaagccggcaacgacauugcaaacugccuacggaagaacgggaagaaggugauccaauuguccagaaagaccuuugacaccgaauaccagaagacgaagcugaacgauugggacuucgucgugacuaccgacaucucagagaugggugccaauuucaaggcggaccgggugaucgacccacgccggugcuuaaagccugucauccugaccgauggacccgagcgcgugauucuggccgggcccaugccggugacggccgccuccgccgcacagagacgcggccggguagggcgcaacccccagaaggagaacgaccaguacauuuucaccggccaaccucucaacaacgacgaggaccacgcccacuggaccgaggccaaaauguuacuggacaacauuaacacacccgaagggaucaucccggcccuuuucgaaccugagcgggaaaagagugcggccaucgacggcgaguaccgccugaagggcgaaucccggaagacauucguggagcugaugcgacgcggggaccuucccguguggcuggcccacaagguggccagcgagggcaucaaguacacggaccgcaagugguguuuugacggacagcggaacaaucaaauacuggaggaaaacauggacguggaaaucuggaccaaggagggcgagaaaaagaagcuccgcccccgguggcuagacgccagaaccuacagcgacccgcuggcgcucaaggaguucaaagacuucgccgccggccgcaagucuauagcccuggaccuggugaccgaaaucggacggguucccucccaccuugcccauaggacgcggaacgcgcuggacaaccuggucaugcuacacaccagcgagcacggcgggcgcgccuaccggcaugccgucgaggagcugcccgagaccauggagacccugcuccugcugggccuuaugauucuacugacgggcggggccaugcuauuccugaucagugggaaggggaucggcaagacguccaucgggcugaucugcgugaucgcgagcuccggcaugcucuggauggccgagaucccgcuucaguggaucgccuccgccaucguccuggaauucuucaugaugguccuccuuauccccgagcccgagaagcagcgaacaccccaggacaaccaacuggcuuacgugguaaucgguauccucacccuggcagcgaucauagccgccaacgagaugggccugcucgagacgaccaagcgugaccuggguauguccaaggagccgggggucgugagccccaccucguaccuggauguggacuugcacccugccagcgccuggacccuguaugccgucgccacgacugugaucacccccaugcugcgccacacgaucgagaacucuaccgccaacgugagccuugccgcgaucgccaaccaggccgucgugcucaugggccuggacaagggguggccgaucuccaagauggaccucggcgugccacugcuggcccuagggugcuacagccaggucaacccccugacucugaccgcugcggugcuccugcugaucacccacuacgccaucaucggccccggccuccaagccaaggccacgcgggaggcccagaagcgcaccgccgcggggaucaugaagaauccgaccguagacggcaucaugaccaucgaccuggaccccgucaucuacgacagcaaguucgagaagcagcugggccaggugaugcuccuugugcugugcgccguccagcuccuguuaaugcggacgagcugggcccucugcgaggcgcugacccuggcaaccggcccgaucaccacgcucugggagggcuccccuggaaaguucuggaacaccacaaucgcugugucaauggcuaauauauuccgcggcuccuaccuagcuggggcaggccucgccuucagcaucaugaaguccgugggcaccggcaagcgagguacggggucacagggagaaacccucggggagaaguggaagaagaagcugaaucagcugagcagaaaggaguucgaccucuacaagaaguccggcauuaccgaggucgacaggaccgaggcgaaggaagggcugaagagaggcgagauuacccaccacgccgugagccggggcuccgccaagcugcagugguuuguugagcgcaacaugguuaucccagaggggcgggugaucgaccucgggugcgggcgcggcggguggagcuacuacugcgcgggccugaaaaaggugacggagguacgcggcuauaccaagggcggccccgggcacgaggagccuguccccauguccaccuacggcuggaacaucgugaagcugaugagcgguaaggacgucuuuuaucuuccgcccgagaagugcgacacccugcugugcgacaucggcgaguccagccccagcccuacgguggaggagagccgcaccauccgcguucugaaaauggucgagccguggcucaaaaacaaccaguucuguauuaagguucugaaccccuacaugcccaccgugaucgaacaccuggaacgacuccaacgaaagcacggcgggaugcugguccggaacccccugucccguaacagcacccacgagauguacuggaucuccaacggcacgggcaacauaguggccuccgugaacauggucagccgguuacugcugaaccgcuucacaaugacccacagacgcccgaccaucgaaaaagacguggaccucggcgccggcacgcggcaugugaaugccgagcccgagacccccaacauggacgucaucggggaacgcauuaagcggauaaaggaggaacacaauucgacauggcacuacgacgaugagaacccguacaagacaugggcuuaccacggcuccuacgagguaaaggcgacgggaagcgccuccaguaugaucaacggcgugguuaagcugcugaccaaacccugggacgugguccccauggugacgcagauggccaugaccgauacgacccccuuugggcagcagcgcguguucaaggagaaggucgacacccggaccccucgcaguaugccuggcacgcggagaguuaugggaaucaccgccgaguggcucuggcggacgcuuggucgcaauaagaaaccgcggcugugcacaagagaggaguucacgaaaaaggugcggaccaaugccgccaugggcgcagucuucaccgaggagaaucaaugggacucagcuaaggcagcaguugaggacgaggacuuuuggaaguuaguggaucgggagcgcgagcugcacaaguuagggaagugcggcagcugcgucuacaacaugauggggaagagggagaagaagcucggagaauucggcaaggcaaaggggucccgcgccaucugguacauguggcugggcgcccgguaccuagaguuugaggcgcucggguuccugaacgaagaccacugguucagccgggagaauuccuauagcggcguggagggggagggccugcacaagcucggauacauccugcgggacaucuccaagauucccggaggcgcgauguacgccgacgacaccgccgggugggacacucgcaucaccgaggacgaccugcacaacgaggaaaagaucacccagcagauggauccggagcaccggcagcuagcgaaugccaucuucaagcugaccuaucagaacaagguggucaagguucaacgcccaacgcccaccggcaccgucauggacauaaucagccggaaggaucagcgcggauccgggcaggucggcacuuacggguuaaauaccuucacgaauauggaggcgcagcucauccggcagauggaaggcgagggggugcugagcaaggccgaccuagagaacccacaccucccggagaagaagauaacccaguggcuggaaaccaagggcguggagcgccugaagcggauggcaauauccggcgacgacugcgucgugaaacccaucgacgaccgcuucgcaaaugcccuccuggcucugaaugacauggggaaggugagaaaggacauuccccaguggcagcccagcaaaggcuggcacgacuggcagcaggucccguucugcucccaucacuuccacgagcucauuaugaaagacgggcgcaagcugguggugcccugucggccccaggacgagcugaucgggcgcgcucguaucagccagggggccggcuggucccucagagagaccgccugccuugguaaggcguacgcucagauguggagccugauguacuuccaccgcagggaccuucgccuggccuccaacgcuaucugcagcgccguccccgugcacugggugcccaccucccgcaccaccuggagcauccacgcgcaccaccaguggaugaccacggaggacauguugaccgucuggaaccgcguguggaucgaggacaaccccuggauggaggacaagacccccgugaccacuugggagaacguccccuaccucgggaagcgugaagaccaguggugcggcagccugaucgggcugaccucccgcgcgaccugggcucaaaacaucccgacugccauccaacaaguccggagccucaucgguaaugaggaguucuuggauuacaugccuucgaugaagcgcuuccggaaggaggaggagagcgagggggcuaucugguga

SEQ ID NO: 25887 - RNA, 9873 nt, Artificial Sequence
  derived and/or modified CDS sequence (opt11) from DENV-3__KJ189268__SS-prME
accagccucugccucaugaugauccugcccgccgccuuggcguuccaccucaccagcagagacggggagccccggaugaucguggggaagaacgaaaggggcaagagccugcuguucaagaccgccuccgggaucaacaugugcacccucaucgcuauggaucugggcgagaugugcgacgauaccgugaccuacaagugcccccacaucaccgagguggagcccgaagacaucgauugcuggugcaaccugaccagcaccuggguuaccuacgguaccugcaaccaggcaggcgagcaccggcgcgauaagcgguccguggcccucgcgccccacgugggcauggggcuggacacccgcacucagacauggaugagcgccgagggcgccuggcgccagguggagaaggucgaaacaugggccuuacgccacccgggcuuuaccauucucgcgcuguuccuggcccacuauaucggcaccucccucacucagaaggugguaauauucauccugcugaugcucgucacgccaagcaugaccaugagaugcgugggggugggcaaccgcgacuucgucgagggccuguccggggccaccuggguggacgugguccucgagcacggcggaugcgugaccacgauggccaagaacaagcccacccucgacaucgagcuacagaagaccgaggccacccaguuggcgacacuccggaaacugugcauugagggcaagaucaccaacaucaccaccgacagccgcugccccacgcagggcgaggccgugcugccggaagagcaggaccagaauuacgucuguaagcacaccuacguggaccggggguggggcaacgggugcgggcucuucgggaagggcucccuagucaccugcgccaaguuucagugccuugagcccaucgagggcaaggucgugcaguaugagaacuugaaauacaccgugaucaucacgguucauacgggcgaccagcaccaggugggcaacgaaacacagggagucaccgccgagaucacuccacaggccagcaccaccgaagcgacucugcccgaauacggcaccuuaggccucgaguguuccccgcgcacggggcuggacuuuaacgaaaugauccugcucaccaugaagaacaaggccuggauggugcaccggcagugguucuucgaccugccccugcccuggaccaguggcgccacuacggagacccccaccuggaaccgcaaggagcuucugguuaccuucaaaaacgcccacgccaagaagcaggaggucguggugcuggggucccaagaaggcgcgaugcauacugcccucacaggggccaccgagauccaaaacagcggcgggaccuccaucuucgccggccaccuuaagugucgguuaaagauggauaagcucgagcugaaaggcaugagcuacgcgaugugcacgaacaccuucguccugaaaaaagagguguccgagacccagcacgggaccauccucauaaagguggaguauaagggcgaggacgcgccgugcaagauccccuucagcacggaggacggucacggcaaggcccacaacggccgcuuaaucaccgccaaccccgucgucacuaagaaggaggagcccgugaacaucgaggccgagccacccuucggggagagcaacaucgugaucgggaucggggacaacgcgcugaagaucaacugguacaagaagggguccucgaucgggaaaauguucgaggccacagcccggggcgcccgccguauggccauccugggcgacacggcgugggacuucggauccgugggagggguacucaacagcuuaggcaagaugguccaccagaucuucggguccgccuacaccgcccuguucagcggcguguccugggugaugaagaucggcaucgggguccuccugaccuggaucggccucaacagcaagaacaccuccaugagcuucuccugcaucgcaaucgggaucaucacgcucuaccugggcgccguugugcaggcggacauggggugcgucaucaauuggaagggcaaggagcugaagugcggaagcgggaucuucgugaccaacgaggugcacaccuggaccgagcaauacaaguuccaggccgacucccccaagcgcuuagccacggccaucgccggcgcgugggaaaacggggucugcggcauccgcagcaccacccggauggagaaccugcuguggaaacagaucgccaacgagcucaacuacauccugugggagaauaacauaaagcugaccgugguggucggugacaucaucggcgugcucgagcaggguaagcgcacucugacgccccagccgauggagcugaaguacuccuggaagacaugggggaaggccaaaaucgugaccgcggagacgcagaacucuuccuucauuaucgauggcccgaacacccccgagugcccuagcgcgucucgggcuuggaaugucugggagguggaggauuauggguucggaguguucaccaccaacaucuggcuucgccugcgggaggucuacacgcagcugugcgaccaucgccucaugagcgccgccguaaaggacgagcgggcugugcacgcggacaugggcuacuggaucgagagccagaagaacggguccuggaagcucgaaaaggccucacuaaucgaggucaagacgugcacguggcccaagucccacacccuuuggagcaacggcgugcuggaguccgacaugaucauccccaagagccuggccgggcccauaucccagcacaaucacagaccgggcuaucacacccagacggcugggcccuggcacuuagggaagcuggagcuggacuucaacuacugcgagggcaccaccgugguaaucacggaaaacugcgggacgcggggccccagccuccgcacgaccaccgugucugggaaacugauccaugaguggugcugccgcuccuguacgcugcccccgcuccgcuacaugggcgaggacgggugcugguacggcauggagauccgucccaucuccgagaaggaggagaacauggucaagagccuggucuccgccgguucugguaagguggacaacuucaccaugggugugcuuugccucgcaauccuguucgaggagguuaugcgcgggaaguucggcaagaagcauaugaucgccgggguguucuucaccuucguacugcuacuguccgggcagaucaccuggcgggacauggcccacacccugaucaugaucggcagcaacgccuccgaucgcaugggcaugggcgugacauaccucgcccugaucgcgaccuucaagauccaacccuuccuggcccucggguucuuccugcguaaguugaccucacgcgagaaccuccugcugggcguaggcuuggccauggccacgacccugcagcugcccgaggacaucgagcagauggccaaugggaucgcccucggccugauggcucugaaauugaucacccaauucgagacguaccagcuguggacagcuuugaucagccugaccugcuccaacaccaucuucacccugacgguggccuggcggacagcgacccugauacucgccggcgucagccugcugccggugugccaguccagcucuaugcgcaagaccgacuggcuccccauggccgucgccgccaugggagugccgccccucccgcuguucauuuucucucucaaggauacgcugaaacgccgguccuggccccuaaaugagggggugauggcggucggccuagugagcauccuggccuccagccuucugaggaacgacgugcccauggccggccccuuagucgccgggggccugcucaucgccuguuacgugaucacaggaaccuccgccgaccuaaccguggagaaggccgccgacauuacuugggaggaggaagccgagcagaccggcgucagccacaaccuuaugaucaccguagacgacgacgggaccaugcggaucaaggacgacgagaccgagaacauccucacugugcugcugaagaccgcccucuugaucgucuccggcaucuucccguauagcauccccgcgacccuacucguguggcacaccuggcagaaacagacgcaacgcuccgguguacugugggacguccccagcccgcccgagacgcagaaggccgagcuggaggaggggguguaccggaucaagcagcagggcauuuucgggaagacccaggugggcgucggggugcagaaggagggcguguuccacaccauguggcauguaacgcgcggcgcggugcucaccuacaaugggaagcggcuggaacccaacugggccucggucaagaaggaucugaucagcuacggcgggggcuggcgccucuccacccaguggcagaagggggaagagguccagguaaucgcgguggaacccggcaaaaaccccaagaacuuccagacaaugcccggcacguuucagaccaccaccggggagaucggcgccaucgcccucgacuucaagccagguacgagcggcucaccgaucaucaaccgggagggcaaggucguggggcuauacggcaaugggguggucaccaagaacggcggguacgugagcggcaucgcccaaaccaacgccgagccggacggucccacgcccgaguuggaggaggagauguucaagaagcgcaaccucacgauaauggaucugcaccccggcagcggcaagacccggaaguaccugccggcgaucgugcgagaggcgaucaaacggcgccuccggacccugaucuuggcccccaccagagucguggccgccgagauggaggaggcgcucaaggggcugcccauccgguaccaaacgacggcaaccaaguccgagcacaccggccgcgagaucguugaccugaugugccacgccacguucaccaugcggcuccugagccccguccgcgugcccaacuacaaccugaucauaauggacgaggcccacuucaccgaccccgccuccaucgcggcccggggguacaucagcacccgcgugggcaugggcgaggccgccgcgaucuuuaugacggccacgccgcccgggaccgccgacgccuucccgcaguccaacgcccccauccaggacgaggagcgcgacauucccgagcggagcuggaacuccggcaacgaguggauuaccgacuucgcggggaagacggucugguucgugccuagcaucaaggccggcaacgacaucgccaacugccuccgcaagaacgggaagaaggugauccagcugucgcggaagaccuucgacaccgaauaccagaagaccaagcugaacgacugggacuucgucgugacgaccgacaucagcgagaugggcgccaauuucaaggccgaccgcgugaucgacccgcggcgcugcuugaaacccgucauucugaccgacggccccgagcggguaauccuggcagggcccaugccggugaccgccgcguccgccgcccagcgccggggcagagucgggaggaacccccagaaagagaacgaccaguacaucuucaccggacagccccucaacaacgaugaggaccacgcgcacuggacggaggccaagaugcugcuggacaauaucaacacccccgaggggaucaucccggcccucuucgagcccgaacgagagaaauccgcugcaaucgauggcgaguaccggcugaagggcgagucccgcaaaaccuucguggagcugaugcggcgcggggaccuccccgucuggcuggcccacaaggucgccagcgagggcaucaaauacaccgaccgaaaauggugcuucgacgggcagcgcaacaaccagauucuggaggagaacauggacguggagaucuggacgaaggagggcgagaagaagaagcucaggccucgcuggcuagacgcgcgcacauacuccgacccgcuggcccucaaggaauucaaggauuucgcggccggccgcaagagcaucgcccuggaccuggucacugagaucgggcgcgugcccucccacuuagcucaucggaccaaaaacgcccuggacaaccuggugaugcuccauacgucggaacacggcgggcgcgcguaccggcacgccguggaggagcugcccgaaaccauggagacccugcuccuguuaggccucaugauccugcugaccgggggcgccaugcuguucuugaucagcggcaagggaaucggcaagacgagcaucgggcugaucugcgugauagccagcuccggcauguuguggauggcagagaucccgcugcaauggaucgcgagcgccaucgugcuggaguucuucaugaugguccuacugauccccgagccagagaaacaacguacgccacaggacaaccaguuagcuuacguggugaucgggauccucacccuggcugccacuaucgcggccaacgagaugggccugcuagagacgaccaagcgggaccuggguaugucuaaggagccgggggucgugagcccaaccucuuaccuggacguggaccuccaccccgccagcgccuggacccuuuacgcggucgccacgacggugauaaccccgaugcugcgccacaccaucgagaauuccacggccaacgugagccucgccgccauagcuaaccaggccgugguucuaaugggccuggacaaggguuggccgaucuccaagauggaccucggagugccccugcuggcccucgggugcuacucgcagguaaacccucugacccuuaccgccgccguacuccugcugaucacccauuacgcgauuaucggaccgggccuccaggccaaggccacgagggaggcccagaaacgaacagccgcgggcaucaugaagaacccgaccguggacggcaucaugaccauugaucuggaccccgucaucuacgauuccaaguucgagaagcaacugggccaggugaugcuccucgugcugugcgccguccagcuccuguuaaugcguacgagcugggcucucugcgaagcccuuacacuggcgacagggcccaucaccacgcucugggagggcuccccugggaaguuuuggaacaccaccaucgccgugagcauggccaacauauuccgcggcucuuaccuggccggggccggccuggcguucagcaucaugaagucuguggggaccggcaagcggggcaccgggagccagggcgagacgcucggggagaaguggaagaaaaagcuaaaccaacugagccgcaaggaguucgaccucuacaagaagucugguaucaccgaggucgaccggacagaggccaaagagggacugaagcgcggagagaucacccaccacgccgugagccguggcuccgccaaacuucagugguucguggagcgcaacaugguuauaccggaagggcgcgucaucgaccucggaugcgggagaggcgguuggagcuauuacugcgccggccugaagaaggugacugagguccggggcuacaccaagggcgggcccgggcacgaggagcccgugcccauguccaccuacggcuggaacaucgugaagcugaugucggggaaagacgucuucuaccuaccgcccgagaagugcgacacgcugcugugcgacauuggcgaguccagcccgucccccacgguggaagagagucgcacuaucagagugcugaagaugguagagccauggcucaagaacaaccaguucugcaucaaggugcugaaccccuauaugcccaccgugauugagcaucuggagcggcuccagcguaagcacggugggaugcugguccggaacccccugucccgcaacagcacgcacgagauguacuggaucuccaacggcacggggaacaucguggcgagcgugaacauggucucucggcuccugcugaaccgcuucaccaugacccaccgucgcccgacgaucgagaaggacgucgaccucggcgccggaacgcggcacgugaacgccgagcccgagacccccaacauggauguaaucggggagcgaauaaaacgcauuaaggaggagcacaacagcaccuggcacuacgacgacgagaacccguacaagaccugggccuaccacggcucauacgaggugaaggccacugggagcgcaucaagcaugauuaaugguguggucaagcugcugaccaaacccugggacguggucccaauggugacccagauggccaugacagacacgacccccuucgggcagcagcgcguguucaaggagaaggucgacacccggaccccgcguagcaugcccggcacgcggcgcgugaugggcaucaccgccgaguggcucuggcggacccuggggcgcaacaagaagccccgguugugcacccgagaggaguucacgaagaaggugcgcaccaacgcagcgaugggcgccgucuucaccgaggagaaccagugggacuccgccaaggccgccguggaggacgaggacuucuggaagcucgucgaccgggagcgcgagcugcacaagcuggggaagugcggcagcugcgucuacaacaugauggggaagcgggaaaagaagcucggcgaguucggcaaggcgaaggggucccgcgccaucugguauauguggcugggcgccagguaccuugaauucgaggcccucggcuuccuuaacgaggaccacugguucagccgcgagaacuccuacagcggcguggagggggaggggcugcacaagcucggguacauccugcgggacaucuccaagauccccgggggcgccauguacgcugacgacaccgccgggugggacacgcgcaucaccgaggacgaccugcacaacgaggagaagaucacccaacagauggacccggagcaccggcagcucgccaacgcuaucuucaagcugaccuaccaaaacaagguggucaaggugcagcgccccacccccacgggcaccgugauggacaucaucagccggaaggaccagcgaggcuccgggcaggucggcaccuacgggcugaacaccuucacgaacauggaggcccagcucauacggcagauggagggcgaagggguacugagcaaggcggaccuggagaacccccaccucccggagaagaagaucacccaguggcuggagaccaagggcguggagcgcuugaagcggauggccaucuccggcgacgacugcgucgugaagccaaucgacgaccgcuucgccaacgcccuccuggcccugaacgacauggggaagguccggaaggacaucccccaguggcagcccagcaagggcuggcacgacuggcagcaggucccuuucuguucccaccacuuccacgaacucaucaugaaggacggucgcaagcugguggugcccugccggccccaggaugagcugaucggcagagcgcggaucagccagggagccggcuggucccuccgugagaccgccugccugggcaaggcauacgcgcagauguggucucugauguacuuccaccgccgggaccuccgcuuggcaagcaacgccaucugcagcgccguccccgugcacugggugccgacguccaggaccaccuggagcauucaugcccaccaucaguggaugaccacggaggacaugcugaccguauggaaccgcguauggauugaggacaaccccuggauggaggacaagacccccgugaccacgugggaggacgucccauaccuggggaagcgggaggaccaguggugcggcucucugaucgggcugaccucccgcgcgaccugggcccaaaauaucccgacagcaauccagcagguacggagccucauuggcaacgaggaguuccuggacuacaugcccuccaugaagcgcuuccggaaggaggaggagucagagggggccaucugguga

SEQ ID NO: 25888 - RNA, 9873 nt, Artificial Sequence
  derived and/or modified CDS sequence (opt11) from DENV-3__KJ189271__SS-prME
acgucacugugccucaugaugauccugcccgccgcccuggcguuccaucucaccagccgggacggggagccgcgcaugaucguagggaagaacgagcggggcaagagccuguuauucaagaccgccuccgggauaaacaugugcaccuugaucgccauggacuuaggggagaugugcgacgacaccgugaccuauaagugcccccauaucacggaaguggaacccgaggacauugacuguuggugcaaccucaccagcaccugggugaccuacgggaccugcaaccaggccggcgaacaucgacgagacaaacgguccguggcucucgcgccccauguggguauggggcuggauacccgcacccagaccuggaugagcgccgagggcgccuggcgccagguagagaaggucgagaccugggcccuucgccauccgggguucacaauccucgcgcuguuccuagcgcauuauaucggcaccucccuuacucaaaagguugugaucuucauccugcugaugcucgucacccccagcaugacuaugcgaugcgugggggugggaaaccgcgacuucguugaggggcucuccggagccaccuggguggacgugguccuggagcacggcgggugcgugaccacaauggccaaaaacaagcccacccucgauaucgagcuccaaaagacggaggccacccagcuggcgacgcuccggaaguuaugcaucgaaggcaaaaucaccaacaucaccaccgauagccgcugcccgacgcagggcgaagcuguacuaccggaggagcaagaccagaacuacgucugcaagcacacauacguggaccggggguggggcaacggguguggccucuucgggaagggcuccuuaguaaccugcgcaaaguuccagugccuggagccaaucgagggcaaggucgugcaauacgagaaccucaaguacaccgugaucauaaccgugcacaccggggaccagcaccaggugggcaacgagacccagggcgucaccgccgagaucacgccucaggccagcaccaccgaggcgacccugcccgaauacgguacccugggucucgagugcuccccgcgaacgggguuagacuucaaugagaugauccugcucaccaugaagaacaaggcauggauggugcaccggcagugguucuuugauuugccauugcccuggacuagcggcgcgacuacugagaccccuaccuggaaccgaaaggaacugcuagugaccuucaagaacgcccacgccaagaagcaagaagucguggugcuggggagucaggagggcgcgaugcacacggcccuuaccggggccaccgagauacagaacagcggcgggacuucgaucuucgccggccaccuaaagugucggcugaaaauggacaagcucgaacugaaaggcauguccuacgcaaugugcacgaacaccuucguccugaagaaggagguguccgaaacacagcacgggacuauucuuaucaaggucgaguacaagggcgaggacgcgccuuguaagauucccuucagcacagaggacgggcacggcaaggcccacaacggaaggcugaucaccgcgaacccuguggugaccaaaaaggaggagcccgugaauauagaggcugaaccgcccuucggggagagcaauaucgucauaggcauuggggacaacgcgcugaagaucaacugguacaagaagggcuccagcauagggaagauguucgaggccaccgcacggggagcccgccggauggccauccugggcgacacggcgugggacuucgggucgguaggaggggugcucaauucucuggggaaaaugguccaucagaucuucggguccgccuacacagcccuauucucaggaguguccugggugaugaagaucggaaucgggguccuccugaccuggaucggccugaacagcaagaauaccuccaugucauucuccugcaucgcgaucggcauuaucacgcucuacuuaggcgccgugguacaggcggauauggggugcgugaucaacuggaagggcaaagagcugaagugcggcagcgguaucuucgugaccaacgaggugcacaccuggacggagcaguacaaguuccaggccgacucccccaagcgacucgccacagccaucgcaggcgccugggagaacggugucugcggcauccgaucaaccacacggauggagaacuuacuuuggaaacaaaucgccaacgaguuaaacuauauucugugggagaauaacaucaaacugaccgucguggucggcgauaucaucggaguguuggagcaaggaaagcgcacgcugacgccucagccgauggaacugaaguacuccuggaagaccugggguaaagcaaaaauaguuaccgccgagacgcagaacagcucuuucauaaucgacggucccaauacgcccgagugccccagcgcgucccgcgccuggaacgucugggagguagaagacuacggguucgggguguucaccaccaacaucuggcuccgccugcgagaggucuacacccaacugugcgaucaccgcuuaaugagcgccgcugugaaggacgagcgggccgugcaugcggauaugggauacuggauagagagccaaaagaacggguccuggaagcuggagaaggcgagccugaucgaggucaagacguguaccuggccgaagucccacaccuuguggucuaacggagugcuggaguccgacaugaucauccccaaaucacuggccgggcccaucucccagcacaaccaccgcccuggguaccacacccagacugccgggccguggcaccucggcaagcuggagcuggacuucaacuacugcgagggcaccaccgugguaaucaccgaaaauugcgggacgaggggcccuagccuccggaccaccacagugucugggaagcugauccacgagugguguugcaggagcugcacucucccgccacuccgcuacaugggcgaggacggcugcugguacggcauggaaauccgccccaucuccgagaaggaggagaacauggucaagagccuugucagcgccggcucugggaaaguagacaacuucacaaugggcguccugugcuuagcgauccucuucgaggaggugaugcgcgggaagcugggcaagaaacauaugaucgcagggguguucuucaccuucguguuacugcuuuccggccaaauuaccuggcgggacauggcccacacgcucaucaugaucggcucgaacgcguccgaccggauggggaugggcgugacguaccuggcacugaucgccaccuucaaaauccagcccuuccucgcccugggguuuuuccugcggaagcucaccucucgugaaaacuuguuacuuggcgugggcuuagccauggccacaaccuugcagcuccccgaagacaucgagcagauggcgaacgggaucgcccugggccugauggcccucaaacugauuacccaguucgaaacuuaccaauuguggacagcgcucaucucguuaacuugcuccaauacuaucuucacguuaacggucgccuggaggaccgcgacccucauucuggccggcgucagccugcucccggucugccaguccagcucaaugcgcaaaaccgauuggcuucccauggccgucgccgccaugggcgugccgccucugccgcuguucaucuucagccuuaaagauacgcuuaagcgccgguccuggccguuaaacgaaggggugauggcgguuggucugguaagcaucuuggccuccucacuccugcguaaugacguacccauggccggcccgcugguugccgggggccuccugaucgccugcuaugugaucaccggcaccuccgcggaccuuaccguggaaaaggcggccgacaucacaugggaggaggaggcugagcagaccggcgucagccauaaccucaugauuaccguggacgacgacggcaccaugcggauaaaggacgacgagaccgaaaacauccugacgguguuacucaagaccgcccuguuaaucguuuccggcaucuucccauacuccaucccugcaacccugcuuguguggcacaccuggcagaagcagacccagcgguccggcguacuaugggacgucccuuccccgcccgaaacccagaaggccgagcucgaggaggggguguaccggaucaagcagcagggcauauucgggaagacucaagugggcgucggggugcagaaggagggcguguuccacaccauguggcauguuacgagaggcgcugugcugaccuacaacgggaagcgucuggaacccaacugggcuagcgucaagaaggaccucaucuccuacggcgggggcuggagacuguccacgcaguggcagaagggcgaagagguccaggucaucgcgguggagcccgggaagaaccccaagaacuuccagaccaugcccggcacuuuucagacuaccacgggugagaucggcgccauagcccuggacuucaagccgggaacuagcggcagccccauuaucaaccgggaggggaaggucgugggguuauacggcaacgggguggucaccaagaacggcggguacguguccggcauugcucagaccaacgccgagccggacggccccaccccggagcucgaggaggagauguucaagaaacgcaaccugacgaucauggaucugcaccccggguccgguaagacucggaaguaccucccugcgaucgugcgggaggccaucaagcggcgccugcggacccugaucuuggcccccacccgcguaguggccgccgaaauggaggaggcgcugaaaggacugccuauucgguaccagaccaccgccacaaaguccgagcacacggggcgggagauuguugaccucaugugccacgccacguuuaccaugcggcuucucagccccguccgcgucccgaauuacaaccucauaaucauggaugaggcccacuucaccgacccugccuccaucgcggcgcgcggguauaucagcacaagagugggcaugggcgaggccgcggcgaucuucaugacggccacgccgcccgggaccgccgacgccuucccgcaauccaaugcaccuauccaggacgaggagcgugacauccccgaacggagcuggaacagcggcaacgaguggaucacggacuucgcggggaagacggugugguucguucccagcaucaaggcgggcaacgacaucgccaacugccuacgcaaaaacgggaagaaagugauccagcugaguagaaagaccuucgauaccgaguaucagaaaacuaaacucaacgacugggacuucgucgugacgaccgacaucagcgagaugggcgccaauuucaaggccgaccgcgugaucgauccgcggcgcugccugaagcccgucauccugacugauggccccgagcgggugauccucgcggggcccaugccggugacagccgccuccgcagcccagcgccggggccgagucgggcggaacccccagaaggagaacgaccaguacaucuucaccggccagccccugaacaacgaugaagaccacgcccacuggaccgaggccaagaugcugcucgacaacaucaacacucccgaggggaucaucccggcacuguuugagccagagcgcgagaagucagccgcgaucgacggagaguaccgguuaaaaggcgaauccagaaagaccuucguggagcucaugcggcguggggaccugcccguguggcuggcccacaaggucgccagcgaggggaucaaguacacagauagaaaguggugcuuugacggucaacgcaacaaccagauccucgaggagaacauggacguggagauuuggacgaaagaaggcgagaagaagaagcugcggccccgcugguuggacgccaggaccuacuccgacccgcuagccuugaaagaguucaaggauuucgccgcuggccgcaagagcaucgcccucgaccuggucaccgagaucgggcgagugcccucccaccuggcgcaccggacgcgcaacgcccuggacaaccucgucaugcugcacacuagcgagcacggcgggcgggccuaccgacacgccgucgaggaguuaccagagaccauggagacccuguugcugcucggucuuaugaucuuacugacaggaggcgccaugcuguuccugaucagcgguaaggggaucggcaagacgagcauugggcucaucugcguuaucgccaguagugggaugcucuggauggccgaaaucccgcugcaguggaucgcgagcgccauaguacucgaguuuuucaugaugguccugcugaucccagaaccagaaaagcagcggaccccacaggacaaccaguuagccuauguggugaucgggauccugacccuggccgccaucaucgcugcuaacgagaugggccuccuggaaaccacgaagcgcgaccugggcauguccaaggagccaggggucgugagccccaccuccuaccucgacguggaccugcauccagccagcgcuuggacucuguacgcggucgccaccacgguaauaacccccaugcuccggcauaccauugaaaauuccaccgcgaacgugagccucgccgccaucgcgaaucaggcugucgugcugaugggccucgacaaaggauggccgaucuccaagauggacuugggcgugccgcugcuugcccucgggugcuacagucaggucaaccccuugacgcucacagccgccgugcugcugcucaucacgcacuacgcgaucaucggcccaggcuugcaggccaaggcuacccgcgaggcccagaagcggacggccgcgggcaucaugaagaacccgaccguggacgguaucaugacaaucgaccuggaccccgucaucuacgacuccaaguucgaaaagcagcucggccaagugaugcugcucguauuaugcgccgugcagcugcuauugaugcgcaccagcugggcccuaugcgaggcucugacgcucgcgaccggccccaucaccacccugugggaggggucccccggcaaguuuuggaacacuaccaucgcuguaagcauggccaacaucuuccggggcuccuaccuggccggggcaggccucgcauuuagcaucaugaagucaguggguaccggcaagaggggcacugggagccagggcgagacccugggggagaaguggaagaagaaguugaaccagcucucgagaaaggaguuugaucuguacaagaaaagcggcaucacggagguugaccgcaccgaggcaaaagagggacuaaagcggggcgaaaucacccaccacgcugugagccgcggcucugccaaacuccagugguucguggagcggaauauggucaucccggaggggcgagugaucgaccugggcugcgggaggggcggcuggagcuacuauugugccggccugaagaaaguaaccgagguccgcggcuacacgaaaggcgggcccgggcacgaggagcccguacccaugucaaccuacggcuggaacauagugaagcucaugucugggaaggaugucuucuaccugccgcccgagaagugcgacacccugcugugcgacaucggcgaauccagccccucccccacuguggaggaaagccggacgauacgggugcuaaagaugguggagccguggcugaagaauaaccaguuuuguauaaaggugcugaaccccuacaugcccaccguuaucgagcaccucgagcgccugcagcggaagcacggugggaugcuuguccgcaacccccucucccguaacagcacccacgagauguacuggaucucaaacggaacagggaacaucguggccagcgugaacaugguaucccgccugcugcucaaccgguucacgaugacacaccgccggccaaccaucgaaaaggacguggaccugggcgccggcaccaggcacgugaacgccgagccggagacgcccaauauggacgucaucggcgaacggaucaagcgcauuaaagaggagcacaacagcaccuggcacuaugacgaugaaaacccguauaagaccugggccuaucaugggucguacgaggugaaggccacggggagcgcguccagcaugauuaacggcguggucaaacuucugacgaaacccugggacgugguccccauggugacccagauggccaugacggacaccacccccuucgggcagcagcggguguuuaaggagaaggucgacacccgcacaccccggucgaugcccggcacucgucggguuauggguaucacagccgaguggcuguggcgcacucugggacggaacaagaagccacgucuaugcaccagagaggaguucaccaagaagguucggacuaacgccgcuaugggcgccgucuucaccgaagaaaaccaaugggacuccgccaaggccgccguggaggacgaggacuucuggaagcuggucgaccgcgagcgggagcugcacaaacucgggaaguguggcagcugcgucuacaacaugaugggaaagcgcgagaagaagcugggagaguucggcaaggcgaaaggcucccgggcuaucugguacauguggcugggcgcccguuaucucgaguucgaggcgcugggguuccuaaaugaggaccacugguucucuagggaaaacuccuauagcggcguggaaggggagggacuccauaagcugggguacauacuacgugacaucuccaagaucccaggaggggccauguacgcggacgacacggccgggugggacacccggaucacagaggacgaccuccacaacgaggagaagauuacccagcagauggacccggaacacagacagcuggccaacgccauuuucaagcucacauaccagaacaagguagugaagguccagcggccuacccccaccggcaccgucauggacaucaucucccgaaaggaccagcgggggucuggucaggucgguacauacgggcucaacacguucaccaacauggaggcccagcugaucagacagauggagggcgaaggggugcugucgaaggcggaucuugagaauccacaccucccggagaagaagaucacgcaguggcuggagaccaaggggguggagcggcugaagcgcauggccaucuccggcgacgacuguguugugaaacccaucgacgaccgauuugccaacgcccugcuggcccucaacgauauggggaaggugcgcaaggacaucccacaguggcagcccagcaagggcuggcacgacuggcaacaggucccguucugcucccaucacuuccacgagcugaucaugaaagaugggcggaagcugguggugcccugccguccccaggacgagcucauuggucgggcgcgcaucucucagggugccggcuggucccugcgcgagacggccugccugggcaaggccuacgcgcagauguggagccucauguacuuucaccgucgcgaccugcgguuggccucgaacgccaucugcagcgccgugcccguucacugggucccaaccagucgcacuaccugguccauccacgcccaccaccaguggaugacaacagaggacaugcucacgguguggaaccggguguggaucgaggacaaccccuggauggaagacaagacccccgugaccaccugggaggacguccccuaccuggggaaacgcgaggaccaguggugcggcagccuuaucggguuaacuucccgcgcgaccugggcgcaaaacauaccgaccgccauccagcagguucgcagccugaucggcaacgaggaguuccuugacuacaugcccuccaugaagcgguuucgcaaggaggaggagagugagggggccaucugguga

SEQ ID NO: 25889 - RNA, 9873 nt, Artificial Sequence
  derived and/or modified CDS sequence (opt11) from DENV-3__KJ189272__SS-prME
accagccucugccugaugaugauccugcccgccgcgcuggcguuccaccucaccagccgggauggcgaaccucggaugaucguugguaaaaacgagcgcggcaagucccugcuauucaagaccgcuagcgggaucaacaugugcacucucaucgccauggaccugggcgagaugugcgacgauacagugaccuauaagugucccuauaucaccgagguggagcccgaagacaucgacugcuggugcaaccugacaagcaccugggugaccuaugggaccugcaaccaggccggcgagcaccggcgcgacaagcgauccguagcccucgcuccacacgugggcauggggcuggauacccgcacccagaccuggaugagcgccgagggcgccuggagacaaguggaaaaggucgagacgugggcccugagacacccgggguucaccauucucgcccuguuucuggcucacuacaucggcaccucccugacccaaaagguugugauauuuauccugcugaugcucgucacgcccagcaugaccaugcggugcgugggggugggcaaccgcgauuucgucgaaggcuuauccggggccacuuggguggacguagucuuagagcacggcgggugcgugaccacgauggccaagaauaagcccacucucgauaucgagcugcagaagacggaggccacacaacuggcgacgcugcggaagcugugcaucgaaggcaagauuaccaacaucaccaccgacagccgcugccccacgcagggugaagccgugcugcccgaggaacaggaccagaacuacgucuguaagcacaccuacguggaccggggguggggcaacgggugugggcucuucgguaagggcucuuuggugaccugcgccaaguuucagugccucgagcccaucgaaggcaagguagugcaguacgagaaccuuaaauacacagugaucaucacaguacauaccggugaucagcaccaaguggguaacgagacccagggggucacagccgagauuacgccccaggccaguaccaccgaggcgacccugcccgaguacggcacucuugggcuagagugcucaccgcgcacgggccuagacuucaacgagaugauucugcucaccaugaaaaacaaggccuggaugguacaccggcagugguucuuugaccugcccuuacccuggaccagcggcgcuaccacggagacucccaccuggaaccgcaaggagcuccucgugaccuucaaaaaugcacacgccaagaagcaggaggucguggugcuggggucccaagagggugcgaugcacacggcccucacaggagccaccgagauucagaacagcggcgggaccuccaucuuugccggccaucugaagugccggcugaagauggacaagcucgagcugaaggguaugucauacgccaugugcacgaacaccuucguccugaagaaagaggugagcgagacccagcacgggaccauccucauuaagguggaguacaaaggcgaggacgcgccgugcaagauacccuucagcacagaagacggacaugggaaggcccacaacggccgccugaucaccgccaaccccgucguuaccaagaaggaggaacccgugagcaucgaggccgagccgcccuuuggggaguccaacaucgucaucggcauuggggacaacgcgcugaagauaaacugguauaagaagggcaguuccaucgggaagauguucgaggcuaccgcucggggcgcccgccggauggccauucuaggcgacacggcuugggauuuugggagcgugggcggggugcucaauucccugggcaagauggugcaccagaucuucgggagcgccuacacggcccuguucuccggcguaagcugggucaugaagaucggcaucgggguccugcugaccuggaucggccugaacuccaaaaauaccagcauguccuucagcugcauagccaucgggaucauaacgcuguaccugggcgccguggugcaggccgacauggguugugucaucaacuggaaaggcaaggaacuuaagugcggcagugggauuuucgugaccaacgaagugcacaccuggaccgaacaguacaaguuucaggcugacagcccaaagcgcuuagccacggccaucgcaggcgcgugggaaaacggggucugcggcauccgcaguaccacccggauggagaacuugcuguggaagcagauugccaacgagcucaacuacauccugugggagaacaauaucaagcugaccgugguggugggcgauaucauuggcgugcucgagcagggcaagcgcacgcugacgccccagccuauggaacugaaguacuccuggaagaccuggggaaaggccaagaucgugaccgccgaaacgcaaaacuccucguucaucaucgacggccccaacacacccgagugcccgucggcgagccgggccuggaacgucugggagguggaggacuacggguucggcguguucaccacgaacaucuggcuccgccugcgggagguguauacccagcugugugaccaccgcuugauguccgccgcgguaaaggacgagcgggccgugcacgcggauaugggcuacuggauugaaucccagaagaacgggagcuggaagcuggagaaggccucccugaucgaagugaagacgugcaccuggccaaagucccacacuuuauggucuaacggcgugcuggagagcgauaugaucauccccaagagcuuggccgggcccaucagccagcacaaccaucgcccgggcuaccacacccagacggccgggcccuggcaccucggcaagcuggaguuggacuucaacuacugcgagggcaccaccgucgucaucaccgaaaauugugggacgcggggccccucccuccgcaccaccaccguuagcgggaagcugauccacgaauggugcugccgguccugcacacugcccccacucagauacaugggagaggacggcugcugguacggcauggagauccgccccaucagcgagaaggaggagaacauggugaagucccucgugagcgccggcuccgggaagguagacaauuucacaaugggugugcugugccucgcgauccuguucgaggagguuaugcgcgggaaauucggcaagaaacacaugaucgccgggguguuuuucaccuuuguucuacuccugucgggccaaaucaccuggcgggauauggcgcacacgcugauaaugaucggcagcaacgccagcgaccgcauggggaugggcgucacguaccucgcccugaucgcgaccuucaagauccaacccuuccuggcgcucggguucuuccuacgcaaguuaaccagccgcgagaaucuccuauuaggcgugggccucgccauggccacaacccugcagcugcccgaggacaucgaacaaauggcuaacgggaucgcccucggccugauggcccucaaacucauaacccaguucgagacguaucagcuguggacggcccugaucucgcugaccugcagcaacaccaucuucacccugacaguggcguggcggacggcaacccugauccucgccgggguuucacugcugccggugugccagagcagcagcaugcgcaagacagacuggcuccccauggccgucgccgccaugggcgugccaccccucccguuguucaucuuuucccucaaggacacgcugaagcgccggucauggccccugaacgaagggguuauggcgguaggccucguguccauccuggcuagcagucugcuacgcaacgacgugcccauggccgguccccucgucgccgggggccuucuaaucgccugcuacgugaucaccgggacuagcgcggaccugaccguggagaaggccgcagauauaacgugggaggaggaggcagagcagaccggaguaucccauaacuuaaugauuaccguggaugacgauggaacgaugcggaucaaggacgacgagaccgagaacauacucacggugcugcugaagaccgccuuacugaucgucuccggcaucuucccguauuccauacccgcuacccugcucguguggcacacauggcagaagcagacacagcgcaguggcgugcuaugggauguacccagcccgcccgaaacccagaaggccgagcuggaggaggggguguaccggauaaagcaacagggcaucuucgggaaaacccaggugggcgucggcguucagaaggagggcguauuucacaccauguggcacgucacgcgcggcgccguguuaacuuacaacgggaagcgucuggaacccaacugggccuccgugaagaaggaucugaucuccuacggcgggggcuggcgccucucaacccaguggcaaaagggggaggaaguacaggugaucgcgguagagcccggcaaaaacccuaagaacuuccagacgaugcccggcacguuccagaccacaaccggcgagaucggcgcaaucgcacuugacuucaagcccgggacuucgggcucucccaucaucaaccgggagggaaaagucguugggcuguacggaaacggggucguaacuaaaaacggcggguacgugagcggcaucgcgcagaccaacgccgagccggacggccccacucccgagcuggaggaggagauguucaaaaagcgcaaucucacgaucauggacuugcaccccggguccggcaagacacggaaguacuugccggcgaucgugcgggaggccauuaagcgacgccuucggacguugauccuggcccccacccgcgucguggccgcagagauggaggaggcacugaaggggcugccaauacgguaccagacgaccgccacuaagagcgagcauaccggccgcgaaaucgucgaccugaugugccacgccaccuucacgaugcggcuccugucuccuguccgcgugccgaacuacaaccugaucaucauggacgaagcccacuucaccgaccccgccucaaucgcggccaggggguacaucuccacccgcguggguaugggcgaggccgccgcgaucuucaugacggccacgccgcccgguacggcggacgccuucccgcagaguaaugcccccauccaagacgaggagcgcgacauccccgagcgguccuggaacagcggcaaugaguggauaaccgacuucgcggggaagacggucugguucgugcccuccaucaaagccggcaacgauaucgccaacugcuugcggaagaaugggaagaaggugauccagcugucucgaaagaccuucgacaccgaguaucagaagaccaagcugaacgacugggacuucgucgugaccacagacaucuccgaaaugggcgcuaacuucaaggcagaccgcgugaucgacccgcggcgcugccugaaaccagucauccugaccgauggcccagagcggguuauccuggcggggcccaugccggugaccgcggccagcgccgcccagcgccggggccgcguaggucggaacccucagaaagagaacgaccaguacaucuucaccggacagccccucaacaacgacgaggaucacgcgcacuggacggaggcgaaaaugcuacuggacaauauuaacacccccgaggguaucaucccugcccucuuugaacccgagcgcgagaaguccgccgcgaucgacggggaguacagauugaagggcgagagccgcaagaccuucgucgagcugaugcggcguggggaccuccccgucugguuagcccacaaggucgccuccgaggguaucaaguauaccgaucggaagugguguuuugacgggcagcgcaacaaccagauccuugaggaaaacauggacguggagauuuggacgaaggagggcgagaagaagaagcuccggccccgcuggcuggaugcccgaaccuacagcgauccguuggcccucaaagaauucaaggacuucgcggccggccggaaauccaucgcccuggaccuggucaccgagaucgggcgcgugcccagccaccucgcccaccggacccgcaacgcccuggacaaccuggugaugcuacacacgagcgaacacggcgggcgagcguaccgccaugccguggaggaguugcccgagacaauggagacccuacuccugcugggccucaugauccugcugacagggggcgccaugcuuuuccugaucucuggcaaggggaucggcaaaacgagcaucgggcugaucugcgugauugccuccucggggaugcuuuggauggccgagaucccacugcaguggaucgcaucagccaucgugcuggaguucuucaugaugguccuacugauacccgaacccgagaagcagcguacgccccaggacaaccaguuagccuacgugguaauagggauacucacccuggccgcuaucauugcggcgaaugaaaugggccugcucgagacuacgaagcgcgaccugggcaugaguaaggaaccgggagucguuucccccacuagcuacuuggacguggaccuccaccccgccucugccuggaccuuauacgcgguugccaccaccgugaucacucccaugcugcggcacaccaucgagaacucgaccgccaacguuucccucgccgccauugcgaaccaggccgucgugcugaugggccuggacaagggguggcccaucucuaagauggaccucggcgugccccugcucgcccuggggugcuacucccaggucaacccacucacgcugaccgccgcggugcucuuacugaucacccacuacgcuaucaucggccccggacuccaagccaaagccacccgcgaggcccagaagcggacggccgcggggaucaugaagaacccgacagucgacggcaucaugacuauugaccuggacccggucauauacgauaguaaguucgagaagcagcucggccaggugaugcucuuggugcugugcgcgguccagcucuugcuaaugcgcaccuccugggcccuuugcgaggcacugacucuggcgaccggccccaucaccaccuuaugggagggcagccccgggaaguucuggaacacgaccaucgccguuuccauggccaacaucuucagaggcagcuaccuggcuggggcuggccuggcguucucaaucaugaaguccguaggcaccggcaagcgcggcaccgggucucagggcgagacacucggggagaaguggaagaaaaagcugaaccaguugucccggaaggaguucgaccucuacaagaaauccggcaucacggaggucgaccgcaccgaggccaaggaggggcugaagcggggcgagauuacccaccacgccgugucccguggcagcgcaaaguuacagugguucguggaacggaauauggucaucccagaaggacgcgugaucgaccucggcugcgggcggggcggaugguccuacuauugcgcgggccugaaaaagguaaccgagguccgcggcuacacgaagggcgggcccgggcacgaagagcccguacccaugagcaccuacggcuggaacaucgugaagcugauguccggcaaggaugucuuuuaucucccgccagagaagugcgacacccugcugugcgacaucggugagagcucuccaagcccaaccguggaggagagucguacgauccgggugcugaagauggucgaaccguggcucaagaacaaucaguuuuguaucaaggugcugaaccccuacaugcccaccgugaucgagcaccuggagcgccugcagcggaagcauggcggcaugcuagugaggaacccccugucacggaauuccacccacgagauguauuggauuucgaacggcaccgggaacaucguggcguccguuaacauggucagccgucucuugcuaaaccgguucacgaugacccaccgacggccgaccaucgagaaggauguggaccucggagccggaacccgccacgugaacgccgagcccgagacgcccaacauggaugucaucggggagcggaucaagcguaucaaggaggagcacaauuccaccuggcacuacgacgacgagaacccguacaagacgugggcauaccauggcagcuacgaggugaaggcgaccggguccgcauccagcaugaucaacggcguggucaagcugcugacgaaacccugggacgugguccccauggugacccaaauggccaugaccgacaccacgccuuucgggcagcagcggguguuuaaggagaaggucgacaccaggaccccgcgguccaugcccggcacccgccgggugaugggaaucacggccgaguggcucuggaggacccuggggcgaaacaaaaagccgcgacuguguacccgcgaagaguucaccaagaaagugcggacgaaugccgccaugggcgcggucuucaccgaggagaaccagugggacagcgccaaggcggccguggaggacgaggacuucuggaaguugguggaccgugagcgagagcugcacaagcugggaaagugcggcuccugcguuuauaacaugauggggaagcgcgagaagaaacugggcgaguuuggcaaggcaaaagggagccgagccaucugguacauguggcuaggcgcucgcuaccuggaguucgaggcccucggguuccugaacgaagaccacugguucucccgggagaacucguauuccggugucgagggggagggucugcacaaacucggcuacauccugcgcgauaucagcaagauucccgguggcgccauguaugcagacgacaccgccgggugggacacccggaucacugaggacgaccugcauaacgaggagaagaucacccaacaaauggacccggagcaucgccaguuagccaaugccaucuucaagcugacuuaccagaauaagguggucaaggugcagcggccgaccccaaccggcacggugauggacaucaucucccgcaaggaccagcggggcagcgggcaggucgguaccuacggacugaacaccuuuaccaacauggaggcccagcuuauccgccagauggagggcgaggggguguuguccaaggcggaccuggagaacccccaccucccggagaagaagaucacgcaguggcuggagaccaagggcguggagcggcugaagcgcauggccaucagcggugacgauugcgucgugaagccaauagacgaucguuucgcaaacgcccucuuagcccugaacgacauggggaaagugcgcaaggacaucccccaguggcagcccuccaaaggcuggcacgacuggcagcaggucccguucugcagccaccacuuccacgagcucaucaugaaggacgggaggaagcugguggugcccugccgcccgcaggacgaacugaucgggcgggcccgcaucucacagggggccggguggagccuccgcgagaccgccugccugggcaaggccuacgcacagauguggucccugauguacuuccaucgacgcgaucuccggcuggcuagcaacgccaucugcuccgcaguccccgugcauugggugccgaccagccgcacgaccuggagcauccacgcucaccaccaguggaugaccaccgaggacaugcugacggucuggaaccgaguguggaucgaggacaaccccuggauggaggacaagacgcccgugaccaccugggaggacguccccuaccucgggaaacgcgaggaccaguggugcgguucccuuaucgggcugacgagccgggcgaccugggcgcagaacaucccgaccgccauccagcagguccgcucccucaucggcaacgaggaguuccuggacuacaugccaagcaugaagcgguuccgaaaggaggaagaguccgagggggccaucugguga

SEQ ID NO: 25890 - RNA, 9873 nt, Artificial Sequence
  derived and/or modified CDS sequence (opt11) from DENV-3__KJ189273__SS-prME
accagccuuugcuugaugaugauccugccggccgcacuggcguuucaccucaccagccgagacggggaaccccggaugaucguggggaaaaacgagcggggcaagagccugcuguucaagaccgccuccgggaucaacaugugcacccucaucgccauggaccugggagagaugugcgacgauacagucaccuacaagugcccccauaucacggaaguggagccggaggacaucgacugcuggugcaaucugaccagcaccugggugacauacgggacuugcaaccaggcgggcgagcaccgaagggacaagcgguccguggccuuagcgccccacguaggcauggggcuggacacccgcacccagacuuggaugagcgccgagggcgcguggcgccaaguggagaagguggaaaccugggccuugcgccauccgggguucacaauccucgcgcuguuccuggcccacuacaucggcaccucccucacgcagaaggucgugauuuucaucuuacuaauguuggucacccccagcaugaccaugcgcugugucggagugggcaauagagacuuugucgagggccuuuccggggcuaccuggguggacgucguuuuggagcauggcgggugugugaccacgauggccaagaacaagccaacccucgacaucgaacugcagaagaccgaggccacucagcuggccacgcuccggaaacugugcaucgagggcaaaaucaccaauaucaccaccgauagccgaugccccacgcaaggugaggccgugcugccggaagagcaagaccagaacuacguaugcaagcacacauacguggaccguggguggggcaacgggugcggccucuucgggaagggcuccuuagugaccugcgccaaguuccagugccuggagccgaucgaggggaaaguagugcaguacgagaaucucaaauacaccguaauuaucaccguccacaccggggaccagcaccagguuggcaacgagacccaggggguuaccgcugagaucacgccccaggccagcaccaccgaggugacccugcccgaauacggcacacugggguuggaguguuccccacgcacgggacuggacuucaacgagaugauccugcugaccaugaagaauaaggcguggauggugcaccggcagugguucuuugaucugccccugcccuggaccucuggcgccacgacggaaacccccaccuggaaucgcaaggagcuccuggucaccuuuaaaaacgcccaugcaaagaaacaggagguggugguccuggggucccaggagggugccaugcacacggcgcucaccggagccacagagauccagaacagcggcgggaccuccaucuucgccggccaccuaaaaugccggcuaaagauggacaagcucgagcugaagggaaugucauacgccaugugcacgaacaccuucgugcugaaaaaggagguguccgaaacccaacacgggacaaucuugauuaaggucgaguacaagggcgaggacgccccgugcaagauccccuuuagcacggaggacggucacggcaaggcacacaacgggcgccugauaacagcaaaccccguggugaccaaaaaggaagagcccguuaacauagaggcggagccacccuucggggagagcaacaucgugaucggcaucggagacaacgcccugaagauaaacugguacaagaaggggucaagcauagggaagauguuugaggcgaccgcccggggcgcccgccgaauggcaauucugggcgacaccgccugggacuucgggucggugggcggggucuugaacagccugggcaagauggugcaccagauauucgggucggcguacaccgcccuguucagcgggguguccugggucaugaagaucggcauuggggugcuccugaccuggaucggccugaauagcaaaaacacauccaugagcuucagcugcauagcaauugggaucaucacccucuaccugggcgcgguggugcaagcggacaugggauguguuauaaacuggaagggcaaagagcugaaaugcggcagcggcaucuuugugacaaacgagguccauacguggacugagcaauacaaguuccaagcggauucccccaagcgccuugccacagccaucgccggggccugggagaauggggugugcggcauccgcucgacaacgcggauggagaaucuguuguggaaacagauugcgaacgagcucaacuacaucuugugggagaacaacauaaagcugaccguggucgugggggacauaaucggcguccucgagcaggggaagcgcacgcugacgccccagccgauggagcucaaguacucuuggaagacaugggggaaggcaaagaucgucaccgccgagacucagaacucguccuucaucaucgauggcccaaacacccccgagugccccagcgcuucccgcgcguggaaugugugggaaguggaggauuacggguucggcgucuucaccaccaacauauggcuccgccuucgggaaguguauacccagcugugcgaccaccgccucaugagcgccgccgugaaggacgaacgggccguccacgccgauaugggcuacuggaucgagagccaaaagaacggguccuggaaacuagagaaggcgucgcugaucgaggugaaaacgugcaccuggccuaagucccacacucucuggaguaaugguguguuagaguccgacaugauuauccccaagagccuggccgggcccaucucccagcacaaccaccgcccuggcuaccacacacagacggccggucccuggcaccucggcaagcuugagcuggacuucaacuauugugagggcacaaccgucgugaucaccgagaacugugguacgcggggccccagucuccgcaccaccaccguaagcggcaagcugauccacgaguggugcugccggagcugcacuuugcccccucuccgcuacaugggagaggacgggugcugguacgguauggagauccggcccauuagcgagaaggaggagaacauggucaagucgcugguguccgcaggcucaggcaagguggacaacuucaccaugggcguccugugccucgccauccuauuugaggaggugaugcgggggaaguucggcaagaagcacaugaucgcgggaguguucuucaccuuuguccuguuacuguccggccagaucaccuggcgggacauggcccacacucugaucaugauuggcagcaacgccucggaccgaaugggaaugggcgucaccuaccucgcucugaucgcaacauucaaaauccaacccuuccuugcgcucggguucuuccugcguaagcugaccagccgcgaaaaccuccugcugggcgugggguuggccauggccacgacccugcaacugcccgaggacauagaacagauggcaaacgggaucgcgcuugggcucauggcucugaaguuaaucacccaauucgaaaucuaccagcuguggacugcccugaucucguuaacauguuccaacaccaucuucacgcugaccgucgccuggaggacugccacacugauucucgcagggguaucacugcugccggucugccaguccagcuccaugcgcaagacugacuggcuccccauggccguggccgcaaugggcgugccgcccuugccgcuguucaucuucagccucaaggacacucugaaacgccgauccuggccacuuaacgagggagucauggcgguggggcucguguccauccuggccuccucucugcuccgaaacgaugucccaauggccgguccccuuguggcaggcggccuacucaucgccugcuacguaaucacuggcaccucugccgaccuaaccgucgagaaggcugccgacaucaccugggaggaggaggcggagcagacgggugugagccacaaucuaaugaucacaguagacgaugacggcaccaugcggaucaaagacgacgagacggagaacauccucaccguccugcugaagacggcccuccuuaucguguccgguauuuuccccuauagcauccccgccacccuacucguguggcacaccuggcaaaagcagacucagcgcuccggaguccugugggacguccccucgccacccgaaacucagaaggccgaacuggaggaggggguguaccggaucaagcagcaaggcaucuucgggaagacccaggucggcgugggggugcagaaggagggcgucuuccacaccauguggcaugucacccgcggcgccgugcucacguacaacggaaagagacuggaaccuaacugggccucuguaaagaaagaccucauaucuuacggcgggggcuggcgccucagcacccaguggcagaaaggcgaggagguccagguuaucgcgguggagcccggcaagaaccccaagaacuuccagaccaugcccggcaccuuccagacgaccaccggggaaaucggcgcgauagcucuggacuucaagccggggaccagcggaucccccaucaucaaccgggagggcaaggugguugggcuguacggcaauggggucgugacgaaaaacggcggguacgugucuggaaucgcgcaaacgaacgcggaaccagacggcccuacgcccgagcuggaggaggagauguucaagaagaggaaccucacgaucauggaccugcaccccgggucuggaaagacgcggaaguaucuuccagccauagugcgcgaagcgaucaagcggcgccuccggaccuugauccucgcucccacgcggguuguugcugccgagauggaggaagcgcugaagggacugcccauucgauaccagaccacagcgaccaaguccgagcacacgggucgcgaaaucgucgaccugaugugccaugccaccuucacgaugaggcuccugucgcccguacgggugccgaacuacaaccugaucaucauggaugaggcccacuuuacugacccagcuuccaucgccgcgcggggguacaucagcacccgcguuggcaugggggaggccgccgccauuuucaugaccgcgacaccucccgggaccgcggacgccuucccgcagaguaaugcaccaauccaggacgaggaacgugauauccccgagaggagcuggaauuccggcaacgaauggaucaccgacuucgccgggaagacagucugguucgugcccagcaucaaggcgggcaacgacaucgccaacugucuccgcaagaacgggaagaaagucauccagcuuucccggaagacguucgauaccgaauaucagaagaccaagcugaacgacugggauuucgugguuaccacggacaucagcgaaaugggcgccaauuuuaaagcagaccggguuauugacccgcggcgcugucuuaagccagugauucugaccgacggccccgagagagucauucuggccggccccaugccggugacggccgcuuccgccgcccagcgccggggacgaguagggcggaauccccaaaaggagaaugaucaguauaucuucaccggccagccccucaacaacgacgaggaccacgcccacuggaccgaggcgaagaugcugcuggauaauauuaauacgcccgaggggauaaucccggccuuauuugagcccgaacgcgaaaaauccgccgccaucgacggagaguaccggcugaaaggcgagagccguaagacguucguggagcugaugcggcgaggggaccuccccgucuggcuggcgcacaaggucgccagugaaggcauaaaguacaccgaucggaaguggugcuucgacgggcagcgcaacaaccagauccuggaggagaacauggacgucgagaucuggaccaaggagggcgagaagaagaagcuccggccgcgguggcuggacgcuagaacguacuccgacccgcuggcucuaaaggaguucaaggacuucgccgcgggccgcaagucuaucgcguuggaucuugugaccgaaaucggccgcgugcccucccaccuugcccaucggacucgcaacgcgcuggacaaccuggucaugcuccauaccagcgagcacggcgggcgggccuaccgucacgcgguggaggagcuaccagagacgauggaaacccugcuccuacugggccucaugauacuccugacgggcggcgccaugcuguuucuaauuagcggaaaggggaucgggaaaacgagcauuggguuaaucugcguuaucgcuagcuccggcaugcuguggauggccgaaauccccuuacaguggaucgccuccgcuaucguucuggaguucuucaugauggugcuccugauccccgagccggagaagcagcggacgccucaggacaaccagcuggccuacguggucauugggauccucacccuggccgcaaucauugccgcgaacgaaaugggucugcuagagaccaccaaacgugaccugggcauguccaaggaacccggggucguuagcccgacauccuaucuggacguugauuugcaccccgccagcgcuuggacccuguacgccguagcgacuaccguaauaacgcccaugcugcggcacacgaucgagaauuccaccgccaacgucagccuggccgccaucgcaaaccaggccguggugcugaugggccuggauaagggguggccgaucuccaagauggaccucggcgucccccuacuggcucucgggugcuauucacaggugaauccccugacccugacagcagccgugcuacugcugaucacccauuacgcaaucauuggccccggccuccaggcgaaggcaaccagagaggcccagaagcggacagcggccgguaucaugaaaaacccgacgguggacggcaucaugacgaucgaccuggaccccgugaucuacgauuccaaguucgagaaacagcugggccaggugauguugcuggucuugugcgcggugcagcuccuguuaaugcgcacuagcugggcccucugcgaggcccugacccuggccacgggccccaucacuacccugugggaaggcagucccgggaaguuuuggaacacuacgaucgccgugaguauggccaacaucuuucggggcuccuaccuugccggggcuggauuagccuucagcaucaugaaauccgucgguaccggcaagcgcggaacggggagccagggagagacccucggugagaaauggaagaagaagcugaaccagcuuagccgaaaggaguucgaccucuauaaaaaguccggaaucaccgagguggaucgcacugaggcgaaggaggggcuaaagcggggcgagaucacccaccacgccgucucacgcggcucagccaaacugcagugguucguugagcggaacaugguaaucccagaggggcgaguaaucgaccucggcugcggccggggcggguggagcuauuauugcgccggccugaagaaggucacggaggugagaggcuauaccaagggcgggcccgggcacgaggaacccguucccauguccacguacggcuggaacaucgucaagcuaaugagcgggaaagacgucuucuaccucccacccgagaagugugacacgcugcuaugcgacauuggcgaauccuccccaucccccaccguggaggagagcagaaccaucagaguccugaagaugguagagccguggcucaagaacaaccaguuuugcaucaagguguugaacccuuacaugccuacggucaucgaacaccuggaacgccuccaacggaagcauggugggaugcuggugcguaaccccuuaucccggaacuccacccacgagauguacuggaucuccaacggcaccgggaacauaguugccucagucaacaugguuucccgcuugcuucugaacagauucaccaugacgcaccgccggcccaccaucgagaaggacguggacuuaggcgcggggacacgccacgucaacgccgaacccgagacgccgaacauggaugucaucggugagcggauaaaacgcaucaaagaggagcacaacagcacguggcacuacgacgacgaaaacccguauaagacgugggcguaccacggguccuacgaggugaaggcgacugggagcgccuccagcaugaucaacggcgucgugaagcugcugacgaagcccugggacguggugcccauggugacgcagauggcaaugaccgacaccaccccauucgggcagcagcgggucuucaaggaaaaaguggacacgcggaccccgaggagcaugcccggaacccgccggguuaugggcaucaccgccgaguggcuauggcgcacacuggggcggaacaagaagccccgacuaugcacccgcgaggaguucaccaagaagguccggacuaacgccgccaugggagcgguguuuacggaggagaaccagugggacuccgcgaaggccgcgguggaggacgaagacuuuuggaaacucguugaccgcgagcgggagcuacacaaacuggggaagugcggcagcuguguguacaauaugauggggaagcgcgagaagaagcucggcgaguucgggaaagcgaaggggagccgggcaaucugguacauguggcugggcgcacgcuaucuugaguucgaggcccuaggguuccucaacgaggaccauugguucagccgggagaacuccuacucaggcguggagggggagggccugcacaagcucggcuacauccugcgggacauauccaagauccccgguggcgccauguacgcggacgauaccgcggggugggacacccggauaaccgaggacgaccugcacaacgaggagaagaucacccagcaaauggacccggagcacaggcagcucgcuaacgccaucuucaagcugacauaccagaacaaggucgucaaggugcagcgccccaccccgaccggcacugucauggacaucaucagccgcaaggaccagcgaggcuccggccaggugggcaccuacggccugaacacuuucaccaacauggaggcccaguugauccgccagauggagggcgagggggugcugagcaaggccgacuuggaaaauccccaccuuccggaaaagaagaucacccagugguuagaaacgaagggcgucgagcggcucaagagaauggcgaucuccggcgacgacugcguggucaagcccaucgacgacagguucgcuaacgcacuccuggcgcugaacgauauggggaagguccgcaaggacauuccccaguggcagcccagcaagggguggcacgacuggcagcaggucccguuuugcucccaccacuuccacgaguuaaucaugaaagacggacggaagcugguggugccgugucgaccccaagacgagcugauuggacgggcacgcauaagccagggggcgggcuggucccuucgcgagacggcuugccugggcaaagcguacgcccagauguggagccucauguacuuccaccggcgcgaccuccggcuggcgucaaacgccaucuguagcgccguuccggugcacugggucccgaccuccagaacgacguggagcauacacgcccaccaccaauggaugacuaccgaggacaugcugaccgucuggaaccggguguggauagaggacaaucccuggauggaggacaagacgccgguuaccaccugggaggacguuccguaccucgggaagcgcgaggaccaguggugcggcucucugaucggucugaccucccgcgccacgugggcccagaacauuccgaccgccauucagcaaguccgaagccucaucggcaacgaggaguuucuggacuacaugcccuccaugaagcgguuccgcaaggaggaggagagcgagggggccauaugguga

SEQ ID NO: 25891 - RNA, 9873 nt, Artificial Sequence
  derived and/or modified CDS sequence (opt11) from DENV-3__KJ189274__SS-prME
accaguuugugccuuaugaugauccuccccgccgcccuugcguuccaccucaccagcagagauggggagccccggaugaucguggggaaaaacgagcggggcaagagcuugcuguucaagaccgccuccgggaucaacaugugcacccugauagccauggaccugggggagaugugcgaugacaccgugaccuacaaguguccccacaucacggagguggagcccgaggacaucgacugcuggugcaaccugaccagcaccugggugacauacgggacgugcaaccaggccggugagcacagacgcgacaagcgguccguggcccucgcgccccacgugggcauggggcuggauaccaggacccagaccuggaugagcgccgagggggccuggcgccaaguggagaagguugagacgugggcccugcgccaccccggguucaccauccucgcacucuuccuggcccacuacaucggcaccucccucacccagaagguggugaucuucauucucuuaaugcucgucacgcccucaaugaccaugcggugugugggggugggcaaccgugauuucgucgaagggcugucuggggccaccuggguagacgugguccuggagcauggagggugcgucaccacgauggcgaagaacaagcccacccucgacaucgagcugcagaagacugaggccacgcaguuggcaacguugcggaagcugugcauagagggcaagaucacaaacaucaccaccgauucgcgcugcccuacgcaaggagaggccgugcugccggaggaacaggaccaaaacuacgucugcaagcacacuuacguggaucggggguggggcaacgggugcggucucuucgggaagggcucccuggugaccugcgccaaguuccagugccuggagcccaucgagggcaaggucgugcaguacgagaaccucaaguacaccgugaucaucacgguccauaccggggaccagcaucaggugggcaacgagacccagggcguuaccgccgagaucacgccacaagccucgaccaccgaggcgacccuucccgaguauggaacccugggucucgagugcuccccacgcacaggccuggacuuuaacgagaugauccugcuuaccaugaagaacaaggccuggauggugcaccggcagugguucuuugaccugccgcugccauggaccagcggcgcgaccacggaaacgcccacuuggaaccgcaaggagcuccuggugaccuuuaaaaacgcccaugccaagaagcaggaggucguggugcugggaucccaggagggagcgaugcacacggcucucaccggggccaccgagauccagaacagcggcgggaccaguaucuucgccgggcaccugaagugccgguuaaagauggacaagcucgagcugaaggggaugagcuacgccaugugcacgaauaccuucguccugaagaaggagguguccgagacccagcacgggacgauacucaucaagguggaguacaagggcgaggacgcgccgugcaaaauccccuucucgacggaggacgggcacggcaaggcccacaacggccgccugaucaccgccaaccccgucgugacaaagaaggaggagcccgugaacaucgaggccgagccgcccuucggggagagcaacaucgucaucggcaucggagacaacgcgcugaagaucaacugguacaaaaagggcuccagcaucgggaaaauguucgaagcaaccgcccggggcgcccgccguauggcgauccuaggcgauaccgcgugggauuucggguccguaggcggggugcucaacagccugggcaagaugguccaccagaucuucgggucggccuacacggcucuguucagcggcguguccugggugaugaagaucggcauuggggugcucuugaccuggaucggccugaacagcaagaacacgagcaugagcuucuccugcaucgccaucgggaucaucacgcucuaccugggcgccguggugcaggcggauauggggugcgucaucaacuggaagggcaaggaacuaaagugcggcucugggauauucgucaccaacgaggugcacacuuggacagagcaguauaaguuccaggccgacucccccaagcgccucgccacggccaucgccggggcgugggagaacggggucugcggcauccgcagcaccacccggauggagaaccugcuguggaagcagauagccaacgagcuaaacuacauucugugggagaacaacauaaagcugaccgugguagucggggacauaaucggcgugcucgagcagggccggcggacgcuuacgccgcagccgauggagcugaaguacuccuggaagaccugggggaaagccaagaucgugacagccgagacgcaaaauagcuccuucaucauugacggccccaacacccccgaaugccccagcgcgucccgcgccuggaacgucugggagguggaggacuacggguucggcguuuuuaccaccaacaucuggcuccggcucagggaggucuacacccagcugugcgaccaccggcucaugucagcagccgugaaggaugagagggccguacacgcugacaugggcuacuggaucgagagccagaagaacggcuccuggaagcucgagaaggccagccugaucgaggucaagacuugcaccuggccaaaaucccacacccucuggagcaacggcgugcuggaguccgauaugauuauccccaagucgcuggccgggcccaucucucagcacaaccaccggccgggcuaccacacccagacggccgggcccuggcaccucggcaagcuggagcuggacuucaacuacugcgagggcacuaccgucguaaucaccgagaacugcgggacgcguggcccuagccuccggaccaccaccguguccgggaaacuuauccacgaguggugcugccgcagcugcacgcugccuccgcuccgguauaugggcgaggaugggugcugguacggcauggagaucagacccaucuccgagaaggaggagaacauggucaagagcuuaguauccgccggcagcgggaagguggacaacuuuaccaugggcgugcugugccucgcgauccuguucgaggaggucaugcgggggaaguucggcaaaaagcacaugaucgccgggguguucuucaccuuugugcugcuccugucaggccaaauuaccuggcgcgacauggcacacacgcugaucaugauaggcagcaacgcauccgaucggauggggaugggagucacuuauuuggcccugauugcgacauucaagauccagccauuccuggcccucggguucuuccugcgcaagcugaccagcagggagaaccuccugcugggagugggucucgcaauggccacgacucugcagcugccagaggacaucgagcagauggcgaacgggaucgcccucggccugauggcccucaagcucauuacccaguucgagaucuaccagcuguggaccgcccugaucagccucacgugcaguaauaccaucuucacccugacggucgccuggcggacggcgacccuaauccuugcuggggugucccugcugccgguaugccagucaaguuccaugcgcaagaccgacuggcuccccauggcagucgccgccaugggcgugccaccccucccgcuguucaucuucagccucaaggacacccugaagaggcgcuccuggccacugaaugaggggguuauggcggucggccucgugagcauccuggccuccagccugcuccggaacgacgugccgauggccggcccccugguggccgggggccuccucauagccugcuacgugaucacggggaccucugcggaccucacuguggagaaggccgccgacaucacuugggaggaggaagccgagcaaacgggcgucagccacaaucugaugaucacuguggacgaugacgggaccaugcgcaucaaggacgacgagacagagaacauacucaccgugcuucugaagacggcccuccugauagucuccggcaucuucccuuacagcauuccagcgacccuccucguguggcacaccuggcagaagcagacacagagguccggcgugcugugggaugucccgagcccgcccgagacgcagaaagccgagcuggaggaggggguguaccgcaucaaacagcagggcaucuucggaaaaacccaggugggcgucggggugcagaaagagggcguguuccauaccauguggcacgucacccggggcgcagugcucacuuacaacgguaaacgccuggagccgaacugggcauccgucaagaaagaccugaucuccuacggcgggggcuggcggcucuccacccaguggcagaagggggaggagguccaagugaucgcgguggaacccggcaagaaccccaagaacuuccagaccaugccuggcaccuuucagacgacgaccggugagaucggcgccauagcccuggacuucaagcccgggaccagcggcagccccauaaucaaccgcgagggcaaggucguggggcuguacgggaacgggguggucacgaaaaacggcggguacguguccggcaucgcccagaccaacgccgagccggacggccccacccccgagcuggaggaggagauguucaagaagcggaaccucaccauaauggaccuccaccccggcagcggcaagacgcgcaaguaccugccggccaucgugcgggaggccaucaagcgccggcuccgcaccuuaauccuggccccuaccagggucguggccgccgagauggaggaggcgcucaaggggcugcccauccgcuaccagaccacagccaccaaguccgagcacaccggccgggagaucguggauuuaaugugucacgccaccuuuacgaugcgcuugcugucgcccguccgggugccgaacuacaacuugaucaucauggacgaggcacacuuuaccgaucccgccuccaucgcggcuagaggguacaucagcacccgagugggcaugggcgaggccgccgcgaucuucaugaccgcaacgccgcccgggaccgccgacgccuuuccgcaguccaacgcccccauccaggacgaggaacgggacauaccggagcgcagcuggaacuccggcaacgaguggaucaccgacuucgccgggaagaccgucugguucgugcccagcaucaaggccggcaacgacaucgccaacugccuccggaagaacgggaagaaggugauucagcugucaagaaagacguucgacaccgaauaccagaagaccaagcuaaacgacugggacuucgucgugaccacggacaucagugagaugggcgccaacuucaaggccgaccggguuaucgauccgcgccggugccucaagcccgugauccugaccgacggccccgagcgcgucauacuggcggggcccaugccugugaccgccgccagcgcggcccagcgacgcggccgggucgggcgcaauccccagaaggagaacgaccaguacaucuucaccggccaaccccuaaacaacgacgaggaucacgcgcacuggaccgaggccaagaugcugcuggauaacaucaacacgcccgaggggaucauuccggcccucuucgagcccgagcgggagaaguccgccgcgauagacggcgaguaccgccugaagggcgagucccggaagacauucguggagcucaugcgccgcggggaccuccccguguggcuggcccacaaggucgccagcgagggcauaaaguacaccgaccgcaaguggugcuucgacgggcagcgaaacaaccagauccuggaggagaacauggacgucgagaucuggaccaaggagggcgagaagaagaaacuccgcccccgauggcuggacgcucggacguacuccgacccgcuagccuuaaaggaguucaaggacuucgcggcgggucgcaagagcaucgcccuggaccuggucaccgagaucgggcgggugcccucccaccucgcccaccgcacccggaacgcucuggacaaccuggugaugcuccacaccagcgagcacggcgggcgagcguaucggcacgccgucgaggaacugcccgagacgauggagacucugcuccugcuuggccucaugauacugcugaccgguggcgcgaugcuguuccucaucagcggcaaggggaucggcaagaccuccaucgggcugaucugcgugaucgccaguuccgggaugcucuggauggccgagaucccgcugcaguggaucgcuagcgccaucgugcuggaguucuucaugaugguccuccugaucccggagcccgaaaagcagcgcacgccccaagacaaccagcuggccuacgugguuaucgggauccucacucuugccgcaaucaucgcggccaacgagaugggccugcucgagaccaccaagcgggaccuggguauguccaaggaaccgggggucgugagccccacguccuacuuagauguggaucuccacccggcuagcgccuggacccuguacgcggucgccacgaccgugauaacgcccaugcugcgccacaccaucgaaaauucgaccgccaacguaagccucgccgccaucgcgaaccaggccgucguucugaugggccuggacaagggcuggcccaucuccaagauggaccucggcgugccccugcucgcccucgggugcuacucucaggucaacccccugacccugacggccgcggugcuccugcuuaucacccacuacgcgauaaucggcccuggauuacaggccaaggccacccgggaggcccagaagcgcacagccgcgggcaucaugaagaaccccacgguggacggcaucaugaccaucgaccuggaucccguaaucuacgauuccaaguucgagaagcagcugggccaagugaugcuccuggugcugugcgcgguccagcuccuguugaugcggaccagcugggcccugugcgaggcccugacccuggcgacgggacccaucaccacacucugggagggcucccccgggaaguucuggaacacgacgaucgcugugagcauggccaacaucuuccgcggcuccuaccuggccggggccggccuggcguucagcaucaugaagucagucgggaccggcaagcggggcaccgggucucagggcgaaacccucggggagaaguggaagaagaagcugaaccagcucagcaggaaggaguucgaucucuacaagaaauccggcaucaccgagguagaccggacggaggccaaggaggggcugaagcgcggcgagaucacccaccacgccgugagccggggcuccgccaaacugcaaugguucguggagcgcaacauggucaucccggagggacgggugaucgaccucgguugcgggcgcggcgguuggagcuacuacugcgcgggccugaaaaaggugaccgaaguccgcggcuacacuaagggcggacccggccacgaggaacccgugcccauguccaccuacggcuggaacaucgugaagcucaugucuggaaaggacgucuucuaccucccgcccgagaagugcgacacccuacugugcgacaucggcgaguccagccccucccccaccguagaggagagccggaccauccgcguguugaagauggucgagccguggcucaaaaacaaucaguucugcauaaaggugcuaaaccccuacaugcccacggugaucgaacaucuugagcggcuccagcgcaagcacggcgguaugcugguacggaacccccugucccgcaacagcacccacgagauguacuggaucuccaacggcacagggaacaucguggcaagcguaaauauggucucccggcuuuuauuaaacagauuuaccaugacgcacaggcgcccgacaaucgaaaaggauguggaccucggcgccgggacccgucacgugaacgccgagccugagacccccaacauggacgucaucggggagcgcauaaagcggauccgcgaggagcacaacucaacguggcacuacgacgacgagaacccguauaagacaugggccuaccacggcuccuacgaggugaaggccacagggagcgcguccagcaugaucaacggcguugucaaguugcugaccaagcccugggacguugucccgauggugacgcagauggccaugaccgacaccacgccauucgggcagcaacggguguuuaaggagaaagucgacacgcgcaccccgcggagcaugcccggcacgcgccggguaaugggcaucaccgccgaguggcucuggcgcacgcugggucgcaacaagaagccccggcugugcacccgagaggaguucaccaagaaggugaggaccaacgccgcuaugggcgccgucuucacggaggagaaccagugggacuccgccaaggccgccguggaagacgaggauuuuuggaagcucguggaccgcgagcgggagcugcacaagcucggaaagugcggcagcugcgucuacaacaugauggggaagcgcgagaagaaguugggcgaguucggcaaggcgaaaggaucccgggccaucugguacauguggcugggcgccagauaccuggaguucgaggcccuuggcuuccugaacgaggaccacugguucagccgggaaaacuccuacagcggcguggagggggagggccugcacaagcucggcuacauccugagggacaucaguaagauacccggcggcgccauguacgcggacgacaccgccgggugggacaccagaaucaccgaggaugaucugcacaacgaggagaagaucacgcagcagauggacccggagcaucgccagcucgccaacgcaaucuucaagcugaccuaucagaacaagguagucaaggugcagcggcccaccccuaccggcacagugauggacaucaucagccgcaaggaccaaagaggcuccggacaggucggcacguacgggcugaauacuuuuacaaacauggaagcucaacucauccgacagauggagggggaggggguccugagcaaggcggaccuggagaacccccaucuccccgagaagaagaucacccaguggcuggagacgaagggcguggaacggcugaagcgcauggccauuaguggagacgacugcgucgugaagcccaucgacgacagauucgccaacgcgcuccuggcccugaaugacaugggaaaggugcguaaggacaucccccaauggcagccaucaaagggauggcacgacuggcagcagguaccguucugcucccaccacuuccaugagcucauaaugaaggacgggcggaagcugguugugcccugccggccccaggacgagcugaucggacgcgcgcggaucagccagggggccgguuggucccuccgugagaccgcuugcuugggcaaggccuacgcgcagauguggagccuaauguacuuccacagacgcgaccuucggcuggccuccaaugccaucugcagcgccgucccugugcacugggugccgaccuccaggaccacguggagcauucacgcgcaccaccaauggaugaccaccgaggacaugcugaccgucuggaaccggguuuggaucgaggacaaccccuggauggaggauaaaacgccugugacaaccugggaggacgugcccuaccucgguaagcgggaggaccagugguguggcagccugaucgggcugacgucccgggcgacaugggcccagaacaucccgaccgccauccagcaggucaggagccucauaggcaacgaggaguuccuggacuauaugcccuccaugaagcgcuuccgaaaggaggaggagagugagggggccaucugguga

SEQ ID NO: 25892 - RNA, 9873 nt, Artificial Sequence
  derived and/or modified CDS sequence (opt11) from DENV-3__KJ189275__SS-prME
accagccucugccucaugaugauccugccggcagcccuggccuuccaccucaccagccgagacggagagccacggaugauaguggggaagaacgagcggggcaaaagccugcuguucaagaccgcauccgggaucaacaugugcacccuuaucgccauggaccugggcgagaugugcgacgacaccgugaccuacaagugcccccacaucaccgagguggagccggaagacaucgauugcuggugcaaucugaccaguacuugggugacuuacggaaccugcaaucaggccggcgagcaccggcgagacaagcgguccguagcccuggcuccccacgugggcauggggcuggacaccaggacacagaccuggaugagcgcggaaggagccuggcgccagguggagaaggucgagacgugggcccugcgccacccgggguucacuauccucgcguuguuccuggcgcacuacaucggcacuucacucacgcagaagguggugaucuucauacugcugaugcucgucacgcccagcaugacaaugcggugcgugggggugggcaaucgcgauuuugucgagggccugucuggggccaccuggguggacgugguccuggagcacggcggcugcguaaccacgauggcgaagaacaagcccacccucgacaucgagcugcaaaagaccgaggccacccagcuggcgacacugcggaagcugugcaucgaggggaagauaaccaacaucaccacagacagccgcugucccacgcagggcgaggcuguguuaccggaggagcaggaccagaacuacgucugcaagcacacguacguggaccggggguggggcaacgguugcggccucuucgggaaaggcucccucgugaccugcgcuaaguuucagugccuggagccgaucgagggcaaagucgugcaguacgagaaccucaaguacaccgugaucaucacgguccacacgggagaucagcaucaggugggcaacgagacccagggggucaccgcggagaucaccccucaggccagcaccaccgaggcgacccugcccgaguacggcacccugggccucgagugcucuccgcgcacgggucuggacuucaacgaaaugauccuucucaccaugaagaacaaagccuggauggugcaucggcagugguucuucgaccuaccccuucccuggacuucuggcgccaccacggaaacacccaccuggaaccgcaaggaacugcuggugaccuuuaagaacgcacacgccaagaagcaggaggucguggugcuggggucccaagagggcgcaaugcacacggccuugaccggggccacugagauccagaacaguggcgggaccuccauauucgccggccaccugaagugccggcugaagauggacaagcucgaacuuaagggcaugagcuacgccaugugcacaaacaccuuuguccugaagaaggagguguccgagacccagcacggaacgauccucaucaaaguggaguauaagggcgaggacgcgccaugcaaaauccccuuuagcacggaggaugggcacgggaaggcucauaacggccgccugaucaccgccaaccccgucgugaccaagaaggaggagccagugaacauagaggccgagccgcccuucggggaaucgaacaucgucaucgguaucggggacaacgcacugaagaucaacugguacaagaagggcuccagcaucgggaagauguucgaggccaccgcccggggcgcccgccggauggcgaucuuaggcgacacggcuugggauuucggguccguuggcggggugcucaacagccugggcaagaugguccaucagaucuucgggucagccuacaccgcccuguucaguggcguauccuggguuaugaagaucggcaucgggguucuccugaccuggauaggucugaacagcaagaacaccuccaugucguucuccugcaucgcaaucgggaucauuacguuguaccucggcgccguugugcaggcggacaugggaugugucaucaauuggaaaggcaaagagcuaaaaugcggcagcgggaucuucguuaccaacgagguccauaccuggaccgagcaguauaaguuccaggccgauucacccaagagauuagccacggccaucgccggcgcgugggagaacggggucuguggcauccgcagcaccacgcggauggagaaccugcuguggaaacagaucgccaaugagcucaacuacauccugugggagaacaacaucaagcugaccguaguggugggggauaucaucgguguguuggagcaagggcgacggacacugacgccccagccuauggagcugaaguacuccuggaagaccugggggaaggccaaaaucgugaccgcggagacgcaaaacagcuccuucaucauugauggcccaaacacgcccgagugucccagcgcgucccgcgccuggaacgucugggaggucgaggacuauggguucggcguguucacuaccaacaucuggcucagacugcgcgaggucuacacacaacugugcgaccaccggcucaugagcgccgccgugaaggacgaacgcgccgugcacgcggacaugggauauuggaucgagagucagaagaacggguccuggaagcuggagaaggcaagccucaucgagguuaagacgugcacguggccgaagucccacacccucuggucaaauggugugcuagaguccgacaugauuauccccaagucacuggccgggccaaucucccagcacaaccaccggccgggcuaccacacccagacggcugggcccuggcaccucggcaagcuggagcuggacuucaauuauugcgagggcacaaccguagucaucaccgagaauugcgggacgcgaggccccucguugcggaccaccaccguguccgggaagcugauacacgagugguguugucgcagcugcacgcugcccccacuccgguacaugggcgaggacgggugcugguacggaauggagauccgaccgaucucagagaaggaggagaacaugguuaagagccuggucuccgccggcagcgggaagguggauaacuucacuaugggcgugcugugccucgcuauccuguucgaggaggucaugcgggggaaauuugggaagaaacacaugaucgcggguguguucuucaccuucgugcugcuccuguccggacagaucacauggcgcgacauggcccacacgcugaucaugauuggcagcaacgccuccgaccggauggggaugggcgucaccuaccucgcccuaaucgcgaccuucaagauucagcccuuccuggccuuagguuucuuucugcggaagcugaccagccgggagaaucuccugcugggcgugggccucgccauggccacgacacugcagcugcccgaggauaucgagcaaauggcuaacgggaucgcccuaggauuaauggcccugaagcucaucacccaguucgagacuuaccagcuguggacggcccugauaagccugaccugcucaaacaccaucuucacucugaccguggccuggcggacagcgacccugauacucgccgggguaagccugcugccggugugccaaucgucuuccaugcgcaaaacagacugguuacccauggcuguagccgccaugggcgugccgccucucccgcuguucauuuucagcuugaaggauacgcugaagcggcgcuccuggccccugaacgagggggugauggcugucgggcuagugagcauccuggccuccucucuccuccggaacgacgucccuauggccggaccccuggucgccgggggccuucucaucgccugcuacgugaucaccgggaccuccgcggaccugaccguggagaaggccgccgacauaacgugggaggaagaggccgagcagaccggagucagccacaaccugaugaucaccguggacgacgacgggaccaugcgcaucaaggacgacgagacagagaauauccucacugugcugcugaaaaccgcccuccugaucgucuccgguaucuucccguauagcauccccgcgacccugcucguguggcauaccuggcagaagcagacgcagcgguccggcgugcugugggacguccccagcccccccgagacucagaaggccgagcuggaagaggggguuuaccgcaucaagcagcagggcaucuucgguaagacccaggugggugucggggugcagaaggagggaguguuucauaccauguggcacgucacacggggugccgugcucaccuacaaugggaagcgcuuagagcccaauugggccuccguaaagaaggaccugaucucguacggcgggggcuggcgucucucuacccaauggcagaagggggaggagguccaggugaucgcgguggagcccggcaagaaccccaaaaacuuccagaccaugcccggcacauuccagaccaccaccggggaaauaggcgccaucgcccuggacuucaagcccgggacgagcggcagccccaucaucaaccgcgaaggcaagguggucgggcuguacggcaacgggguggucacaaagaacggcgguuacgucuccggcaucgcccagacaaacgccgagccggacggacccacccccgagcuggaggaggagauguucaagaaacggaaccucacgaucauggaccugcaccccgggaguggcaagacccgcaaguaccugccggcuauuguccgggaggcaaucaagagacggcuccgcacccugauccuggcccccacgcgggucguggccgccgagauggaagaggcgcucaaggggcugccgauccgcuaucagacgacagccacgaagucggagcacaccggccgggagauuguggaccugaugugccacgccacguuuaccaugcgccuccugagccccguccggguuccgaacuacaaccugaucaucauggacgaggcccacuucaccgaccccgccuccaucgcagcccgcggguauaucagcacccgcgugggcaugggcgaggccgccgcgauauucaugacggcgacgccgcccgggacagccgacgccuucccucaguccaacgcccccauccaagaugaggagcgggacauccccgagcgcagcuggaacuccggcaaugaguggauuaccgacuucgcggggaaaacggucugguucgugcccagcaucaaggcaggcaacgacaucgccaauugcuuacggaagaacgggaagaaagugauucagcugucccgcaagaccuucgacaccgaguaccagaagacaaagcugaacgacugggacuucgucguaacgaccgacaucagcgagaugggcgccaacuucaaagccgacagagugauagauccgcgccggugccucaagccugucauacugaccgacggccccgaacgcgugaucuuagcuggucccaugccggugaccgcagcauccgccgcgcagcggcgcggccgaguagggcgcaacccgcagaaggagaacgaccaguacaucuucaccggccagccccucaacaacgacgaggaccacgcgcacuggacggaggccaagaugcugcuggauaacauuaacaccccugaagggaucauuccagcccucuuugagcccgagcgggagaagucugccgcgaucgauggcgaguaccgccugaagggagagagccggaagacuuucguggagcugaugcgccgcggggaccuccccgucuggcuggcccauaagguggcuagcgagggcaucaaguacaccgaccgaaagugguguuuugauggacagcggaacaaucagauucucgaggagaacauggacguggagaucuggacgaaggagggcgaaaagaagaaguuacgaccccgcuggcuggacgcccggaccuacuccgacccgcuggcccucaaggaguucaaggacuucgccgccggccgcaagagcauagcacuggaccugguuaccgagauuggccgggugcccagucaccucgcacacaggacccggaaugcucuagacaaccugguaaugcuccauacgagcgagcacggaggccgcgcauaccgccacgccgucgaagagcugccggagaccauggaaacccugcuccugcucggccuaaugaucuuacugaccgggggcgcaaugcuguuccugaucucgggcaaggggaucgggaagacgucuaucggccugaucugcgugaucgccagcucuggcaugcuguggauggcggaaaucccgcugcaguggauugcgagcgcuaucguguuggaguucuucaugaugguccuccugauccccgagcccgagaagcaacgcacgccccaggauaaccagcuggcauacguggugaucgggauccucacccuggccgccauaaucgcggcuaaugagaugggucugcucgaaaccacgaagcgggaccugggaauguccaaggaaccgggcguugugagccccacguccuaccuggacguggaccuccaucccgccagcgcauggacccuguacgcggucgccacgacugugaucaccccuaugcugcgccacacaauugagaacuccaccgccaacguaucacucgccgccaucgcaaaccaggccgucgugcuaaugggccuggauaaaggguggccgaucuccaagauggaccucggcgugccgcuauuagcccucggguguuacagccaggucaauccccugacacugaccgccgccgugcuccugcugaucacccacuaugcgaucauaggcccgggccuccaggcgaaagccaccagggaggcccagaagcgcacggcagcugggauaaugaagaacccgacuguggauggaaucaugaccaucgacuuggaccccgucaucuacgacuccaaauuugagaagcaacugggccaggucaugcuccuggugcugugcgcgguccagcuccugcugaugcggacgucaugggcccuaugcgaagcccugacgcuggcaaccggccccaucaccacccucugggagggcucccccgggaaguucuggaacacgaccauagccgugagcauggcgaacaucuuccgcggguccuaccuggccggggccgggcuggcguucucuaucaugaaguccguggggaccggcaagcguggcacagggagccagggcgagacacucggggaaaaguggaagaaaaagcugaaccagcugagccgcaaggaguuugaccucuacaagaaguccggcaucacggagguagaucggacggaggcgaaggagggccugaaacgaggcgagaucacccaccaugcggugagccguggcuccgccaagcugcaaugguuuguggagcgaaacaugguuaucccugaggggcgggugaucgaccucggauguggacgcggagguuggucauacuacugcgcaggccugaagaaagugaccgaggucaggggcuacacaaaaggcgggccugggcacgaggaacccgugcccauguccacguacggcuggaacaucgugaaguugauguccgggaaagacgucuucuaccuuccgccggagaagugcgacacccugcugugcgacaucggcgaguccagccccucccccaccguggaggagagccggacgauccgcgugcugaagauggucgagccguggcucaagaacaaccaguucugcaucaagguacugaaccccuacaugcccaccgucauagagcaccuggagcgucuccagcgcaagcacggcgggaugcugguaaggaacccccugucccggaauagcacccaugagauguacuggauuucuaacggcaccggaaacaucguggcgagcgugaacauggucucccggcuccugcugaaucgcuucacaaugacccaccggaggccgacgaucgagaaggacgucgaccucggugccgggacccgucacgugaacgccgagccggagacuccgaacauggacgucauaggggagcgcauuaagcggauccgcgaggagcauaacagcaccuggcacuacgacgacgagaacccguacaagaccugggccuaccacggcuccuaugaggugaaggccacagggagcgcguccaguaugauuaacggcguggucaaacucuuaacgaaaccaugggacgugguacccauggugacacagauggccaugaccgacaccacgcccuucgggcagcaacggguguucaaagagaaggucgacacccgcaccccgcggagcaugcccggcacccggcgggucaugggcaucacggcggaguggcucuggcgcacccucgggcgcaacaagaagccccggcugugcacccgcgaggaguucaccaagaaggugcggaccaaugccgcuaugggcgcagucuucaccgaagaaaaccagugggacucagccaaggccgccguggaggacgaggacuucuggaaguuagucgaccgcgaacgggagcugcauaagcuggggaagugcggcagcugcguauauaacaugauggggaagcgcgagaagaagcucggcgaguucggcaaggcgaagggguccagggccauaugguacauguggcugggcgcacgauaccuggaguuugaagcccucggcuuccucaacgaggaccacugguucagccgggaaaacuccuacagcggcguggagggagagggacugcauaagcucggauacauccugcgcgacaucucuaagaucccaggcggcgccauguacgcggacgacacggccgggugggacaccaggaucacggaggacgaccugcacaacgaagagaagauuacccagcagauggacccggagcaucgccagcucgcaaacgccauauucaagcugaccuaccagaacaaagugguuaaggugcagcgucccacccccaccggcaccgugauggacaucaucagccgcaaggaccaacggggauccgggcagguggggaccuacgggcugaacaccuucaccaacauggaggcucaacucauccgccagauggagggagaggggguacugagcaaggcggaucuggagaacccacaccucccggagaaaaagauuacgcaguggcuggaaacaaagggaguggagcggcugaaacgcauggccaucuccggcgacgacugugucgugaagcccaucgaugaccgguucgccaaugcccuccuggcccucaacgacauggggaaggugcgcaaggauauaccacaguggcagccuagcaaaggauggcacgacuggcaacaggucccguuuugcucccaccauuuucaugagcuuaucaugaaggacgggcguaagcuggugguacccugccgcccucaggacgagcugaucggccgcgcgcggaucagccagggggcaggcuggagccucagggagacggccugccugggcaaggccuaugcacagauguggagccugauguacuuccaccggcgcgaccuccggcuggccuccaacgccauuugcagcgccgucccuguacacugggugcccaccucccgcaccaccuggagcauacacgcccaccaccaauggaugaccaccgaggauaugcucaccgucuggaaccguguguggaucgaggauaaccccuggauggaagauaaaacccccgugaccacuugggaggauguccccuaccucggcaagcgcgaggaccaguggugcgggagccuaaucgggcugacauccagagcgaccugggcccagaacauuccgacagccauccaacagguccgcagccugaucggcaacgaagaauuucuggacuauaugcccaguaugaagcgguucagaaaggaggaggagagcgagggggcgaucugguga

SEQ ID NO: 25893 - RNA, 9873 nt, Artificial Sequence
  derived and/or modified CDS sequence (opt11) from DENV-3__KJ189276__SS-prME
accagccucugccuaaugaugauccuacccgcggccuuggcguuccaucugaccagccgggacggggagccccggaugauagugggaaagaacgagcgcggcaagagccugcuauucaagacggcuagcgggauaaacaugugcacccucaucgcaauggacuugggagagaugugugacgacaccgugaccuacaagugcccccacaucacugagguggagcccgaggacaucgacuguugguguaaccugaccagcaccuggguaaccuacgggacgugcaaccaggccggcgagcaccgucgcgacaagcguuccgucgcguuagcgccucaugugggaauggggcuggacacccgcacccagacguggaugagcgcagagggcgcauggcgacaaguagagaaggucgagacgugggcacugcgccaccccgguuucacgauccucgcgcuguuccuagcccacuacaucggcaccucccucacccagaaggucgugaucuucauacugcugaugcuggugacgccaucaaugaccaugcgcugcgugggcgugggcaaccgcgacuucgucgagggccuguccggggccacauggguggacgugguccuggaacacggcgggugcgugaccacgauggcuaagaacaagccgacccuagacaucgagcugcagaagaccgaggcuacccaacuggcgacccuccggaagcuuugcaucgagggaaaaaucacuaauaucaccacggacagccgcugccccacucaaggcgaggccguguuaccggaggagcaagaccagaacuaugucugcaagcacacauacguagaccggggguggggcaacggguguggucucuuugggaagggcucccuggugaccugcgccaaguuccagugccuagagcccaucgaggggaaggucguucaauacgagaaccucaaguacaccgucauaaucacgguccacaccggggaccagcaccaggucggaaacgagacgcagggggucaccgccgagaucacgccgcaggccucaaccaccgaggccacccugcccgaguacggcacccuggggcuccaaugcuccccacgcacgggccuggacuucaacgagaugauccuguugaccaugaagaacaaggccuggauggugcaccggcaaugguucuucgaccugccccucccauggacuucgggcgcgacguccgagacgccaacguggaauagaaaggaguuacuagugacuuucaagaacgcccacgccaagaagcaggaggucguggugcuggggucacaggagggcgcgaugcacaccgcccucacgggggccaccgagauccagaacuccggcgguaccucaaucuucgccggccaccugaaaugccggcugaaaauggacaaguuagaguuaaaaggcaugaguuaugccaugugcaccaacacauucguccugaagaaggagguuagcgaaacccagcacggcacgauucucauuaaaguggaguauaagggcgaggacgcgccgugcaagauacccuuuagcaccgaggauggucacggcaaagcgcacaauggccgacugaucacggcgaaccccgucgugaccaagaaggaggagcccguuaacaucgaggccgagccgcccuucggggaguccaacaucgucauuggcaucggcgacaacgcgcugaagaucaacugguauaagaagggcagcuccaucgggaaaauguucgaggccacugcccguggagcucgccggauggccauccuuggugauaccgccugggacuucgggagcgugggcgggguguugaacucacugggcaaaaugguccaccagauuuucgguagugcauauacugcucuuuucuccggcguaagcugggugaugaagaucggcauuggaguacugcugaccuggaucggccuuaacuccaaaaacaccaguauguccuucagcugcaucgccaucggaaucaucacccucuaccuaggggccguuguccaagccgacauggggugcgucauuaacuggaaaggcaaggaguugaagugcggauccgggaucuucguaacgaacgaggugcacaccuggaccgagcaguacaaguuccaggcggacagcccgaagcgccucgccaccgcuaucgcuggggcgugggaaaacggggucugcgggauccgcuccacgacccggauggagaaucuacucuggaaacaaaucgccaacgagcucaacuacauccucugggagaauaauaucaaacugaccguggucgucggggacaucauaggcguacucgaacagggcaagagaacccucaccccccagccgauggagcugaaguacagcuggaagaccugggggaaggcgaagaucgucacugccgaaacgcaaaacaguagcuucauaaucgacggccccaacacacccgagugcccguccgcgucacgcgcauggaacgucugggagguggaagacuacggauuuggcguuuuuacaacaaacaucuggcuccgccuacgggaagucuacacccagcuuugcgaccaccgcuugaugagcgcagccgugaaggacgagcgggccgugcaugccgauaugggcuauuggaucgagagucagaagaacgggagcuggaagcuggagaaggccucccugaucgaagucaagaccugcaccuggcccaagucccacaccuuaugguccaacggcgugcuagagagcgauaugaucaucccgaagucccuggccggacccaucagccagcacaaccacaggccgggcuaucacacccagacggcagggcccuggcaccucgggaaacuggagcuggacuucaacuacugcgagggcacgaccgugguuaucaccgagaacugcgggacccggggcccgucgcuccggacgacaaccguaagcgggaagcuaauccacgagugguguugccgguccugcacccugcccccgcucagauacaugggugaggaugguugcugguacggaauggagauccgcccuaucagcgaaaaggaggagaacauggugaagucccuggucagcgccggcucugggaagguggacaauuucacgaugggcguacugugccucgcgauccuguucgaggaggucaugcgcgggaaauuuggcaagaaacauaugaucgccgguguauucuucacuuucgugcuucuccucagcggucaaauaaccuggagagacauggcgcacacccugaucaugaucggcuccaacgccagcgaucgcauggggaugggcguaacguaccucgcacucaucgcgaccuucaagauucagcccuuccuagcccucgguuucuuccugcggaagcugacuucacgcgagaaccuccugcugggcguugggcucgcuauggccaccacgcugcagcuacccgaggauaucgagcagauggccaacgggaucgcccucggccucauggcgcugaagcucaucacccaguucgaaacauaucagcuguggaccgcccugaucucccucacgugcucuaauaccaucuucacccugaccguggccuggcgaacugcgaccuuaauccucgccggggucucccugcucccggugugccagaguuccaguaugagaaagaccgacuggcuccccauggccgucgccgcuaugggugugccgccccucccgcuguucaucuucucucucaaggacaccuugaagcgccggagcuggccccugaacgaggggguuauggcggucggccucguauccaucuuagcgucgucccucuugcgcaaugacgugcccauggccgggcccuuggucgccgggggccugcuuaucgccugcuauguuaucaccgggaccagugcggauuuaaccguggagaaggccgccgacaucaccugggaggaggaagcggagcagaccggcgucucucacaaucugaugaucaccguggacgacgacgguacaaugcgaaucaaggacgacgagacugagaacauucucaccguguugcugaagacugcccuccugaucgucuccggaaucuucccguacucuauccccgcgacccuguuaguguggcauacauggcagaaacaaacccaacgcucuggcgugcugugggacguccccagcccgccggagacgcagaaggccgagcuggaggaggggguuuaucgaaucaagcaacaaggcaucuuugguaagacccaggugggcgucggggugcaaaaggaggggguguuccacaccauguggcauguuacccgcggugccgugcucaccuacaacgggaagaggcuagagcccaacugggcgaguguaaagaaggaucugaucuccuauggagggggcuggcgccucagcacccaguggcagaagggugaggaaguccagguaaucgcaguggagcccggcaaaaacccaaaaaauuuucagacaaugcccggaacuuuccagacgaccaccggggagauaggcgccaucgcccuggacuucaagcccgggacguccggcucccccauaauuaaucgggagggcaaggucguggggcuguacggcaacggagugguaacgaagaacgggggguacgugagcggcaucgcccagacaaaugccgagccggauggccccacccccgagcucgaggaagagauguucaagaagcguaacuugaccaucauggaccuacaccccgggagcgguaagacucgaaaguacuugccggcaauagugagggaggccaucaagaggcgccuccggacccuaauacuggccccgacccgugucguggccgcugagauggaagaggcgcucaaggggcugcccauccgcuaccagaccacagcaacuaagagcgagcauacaggccgcgagaucguggaucugaugugccacgccaccuucacgaugcggcugcuaucccccguccgcgugccgaacuacaaccugaucaucauggacgaagcccauuucaccgaucccgccagcaucgcggcccggggguacaucucaacccgcguggggaugggcgaggcagccgcgauuuucaugaccgccacgcccccggggaccgcagacgccuucccccagagcaacgcccccauccaggacgaggagcgcgacauacccgagcgguccuggaacagcggcaacgaguggauaacggacuucgcggggaagaccguaugguucgugccaucuaucaaagcuggcaaugacauugcuaacugucuccgcaagaauggcaagaaggucauccagcugagccggaagacguuugacacggaguaucaaaagaccaaguuaaacgauugggacuuugucgugacgacugacaucagugaaaugggcgccaacuucaaggccgaucgugugauugacccgcggcguugccucaagccugucauccugaccgauggccccgagcgugugauccuggcggggcccaugccggugaccgcagccagcgccgcccagcgccgaggucgugucgggcggaacccgcagaaagagaacgaccaguauaucuucacuggccaaccccucaacaaugacgaggaccaugcacacuggaccgaggccaagaugcugcuggacaacaucaacacucccgagggcaucaucccagcccucuucgagcccgagcgggagaagucugcugcgaucgacggcgaguaccggcuaaagggugaaagccgcaaaacguucgucgaguuaaugcgaagaggcgaccuccccguguggcucgcccacaaagucgccuccgagggcaucaaguacaccgaucggaaguggugcuucgacgggcaacgcaauaaccagauccuggaggagaacauggacguggagaucuggacgaaggaaggcgagaagaaaaagcuccggccccgcugguuggacgcccgcacguacagcgacccgcuggcccucaaagaguucaaggauuucgcggccggcagaaaguccaucgcucuggaccuagucaccgagauagggcgcgugcccagccaccucgcccaccggacccgcaacgcccuggacaaucuggugaugcuccauacaagcgagcacggcgggcgggcuuaccgccacgcggucgaagagcugcccgagacaauggagacucugcuacuucuuggccuaaugauccuucugacugggggcgcaaugcuauuccuaaucuccggcaaggggaucggcaagacgagcaucgggcugaucugugugaucgccuccagcggcaugcucuggauggccgagaucccguuacaguggaucgccagcgccaucgugcuggaguucuucaugaugguccucuugauacccgagccugagaaacagcggacgccacaggacaaucagcuggccuacgugguaaucgggauccuuacauuggcagcgaucauugcggccaacgagaugggccugcuggagacaaccaagcgcgaccuggggaugagcaaagagccgggagucguuucccccacgagcuaccuggauguggacuugcauccagccuccgccuggacccuguacgcggucgccacaaccgugaucacccccaugcugcggcacaccaucgagaacagcaccgccaacgugucccucgcugcaaucgcgaaccaggccgucguuuuaaugggccuagacaagggguggccgauaagcaagauggaccucggcgugccccugcuggccuuggggugcuacucucaggucaacccucugacucugacggccgcugucuuacuguuaaucacccacuacgcgauaaucggcccgggacuccaggccaaggccacccgcgaggcacagaagcguacagccgcggggaucaugaaaaacccgaccguggacggaaucaugaccauagaccuggaccccgucaucuaugacagcaaguuugagaagcaguuaggucaggugaugcuccuggugcugugugccguccagcuccuucugaugcgcacaaguugggcauugugcgaggcacugacguuagcgacgggaccaaucacuacccucugggaggguagccccgggaaguucuggaacacaacgaucgccgugaguauggccaacaucuuccgggguagcuaccuugccggggccggauuggcguucuccaucaugaaaaguguggguaccggcaagcgcggcaccgggagucagggugagacccucggggagaaguggaagaaaaagcugaaccagcuguccagaaaagaguucgaccucuacaagaaguccgguaucacugaagucgaccgcaccgaggcaaaagagggacugaaacggggcgagaucacccaccacgccguguccagggguagcgccaagcuacaaugguucguggaacggaacauggucauucccgaggggcgcgugaucgauuuaggcugcgggcggggaggguggagcuacuacugcgcuggacugaagaagguuacagagguccgcggcuacaccaaaggugggcccgggcacgaggagccagugccuaugagcacguacggcuggaacaucgugaagcugauguccggcaaggacguguucuaccucccgcccgagaaaugugauacccugcugugcgacaucggcgagucuagccccagcccuaccguggaggagucccgcacgauccgcguucugaaaauggucgagccuuggcucaagaacaaccaguucugcaucaaggugcucaaccccuauaugcccacagucaucgagcaccuggagcgccuccagcgaaagcauggcgggaugcugguuaggaacccccugucacggaacuccacccacgagauguacuggaucuccaacggcaccgggaacaucguugcguccguuaauaugguuagccgccuccugcugaacagguucaccaugacgcaccgcagaccgaccaucgagaaggacguggaccucggcgccggcacccgccacgugaaugccgagcccgagacccccaacauggacgugauuggggagcggaucaagcgcaucaaggaagagcacaauuccacuuggcacuacgaugacgagaacccguauaagaccugggccuaccacggcagcuaugagguaaaagccaccggguccgcgagcucgaugaucaaugggguggucaaacuacugaccaagcccugggacguggucccuauggugacucagauggccaugaccgauacaacgcccuuuggccagcagcggguguucaaggaaaaggucgacacgcgcaccccgcgguccaugccuggcacacggcgggugaugggcauuaccgcagaguggcuguggagaacgcugggacggaacaagaagccccgccugugcacacgcgaggaguucaccaagaagguucgaaccaacgccgcgaugggugccgucuucacugaggagaaccaguggaacagcgcaaaggccgcgguggaggacgaggacuuuuggaaguugguugaccgcgagcgggagcugcacaagcugggcaagugcggcuccugcgucuauaacaugauggguaagcgcgagaagaaguugggagaguucgguaaagcgaaggggagcagggccaucugguacauguggcucggcgcacgcuaucuggaguucgaggcccuugguuuucugaaugaggaccacugguucucgcgggagaacagcuacuccggcguggagggggagggccugcacaagcucgguuacauucugcgcgacaucagcaagauccccggaggcgccauguacgcggacgacacggcagggugggacacucgcaucacugaggacgacuuacauaacgaggagaagaucacgcagcagauggacccggagcaccgccggcuggcuaacgccaucuucaagcuuaccuaccagaacaagguggucaaggugcagcgccccacaccaacuggcaccgugauggacaucaucucccggaaagaccagcgcggcagcgggcaggugggcacuuacgguuugaacaccuucaccaacauggaggcccagcuaauccggcagauggaaggagagggggugcuguccaaagcggaccuggagaacccccaccucccagagaagaagauaacucaauggcuggagacgaagggcguggagcgccugaagcggauggccaucagcggggacgacugcgucgugaagcccaucgaugaccgcuucgcaaacgccuugcuggcccugaacgacauggguaaggugcguaaggacaucccccaguggcagcccuccaagggcuggcacgacuggcaacagguuccguucugcagucaccacuuccacgagcucaucaugaaggacggucgcaagcuaguggugcccugccggccacaggacgagcugaucggcagggcgcgcaucucccagggagccggcuggucuuugcgggagaccgccugccugggcaaggccuacgcgcagauguggucccugauguauuuccaccggcgagaccuccgccuggccucaaacgcuaucuguuccgccguccccguacacugggugccgaccagucggaccacguggagcauucacgcccaccaccaguggaugaccaccgaggacaugcugacagucuggaaccgcguguggaucgaggauaaucccuggauggaggacaagacgcccgugaccaccugggaggacguaccauaccucgggaagcgggaggaccaguggugugggucccugauugggcugaccagccgcgcgacgugggcccagaacaucccgacggccauccagcagguccggucucuaaucgggaacgaggaguuccuggauuacaugcccagcaugaagagauuucggaaggaggaagaguccgagggagccaucugguga

SEQ ID NO: 25894 - RNA, 9873 nt, Artificial Sequence
  derived and/or modified CDS sequence (opt11) from DENV-3__KJ189277__SS-prME
accagccuuugucucaugaugauccuccccgccgcccuugccuuccaccucacgagccgagacggggagccucggaugauagugggcaagaacgaacgaggcaaaaguuuacuuuuuaaaacggccagcgggauaaacaugugcacccuaauugcuauggaccugggggagaugugcgacgauacgguaaccuacaaaugcccacacaucacggagguggagcccgaagacaucgacugcuggugcaacuugaccucuacgugggucacguaugguacauguaaccaagccggugaacaccgucgcgacaagcgcuccguggcccuugccccucaugucggcauggggcuggacacccgcacgcaaaccuggaugagcgcugaaggggcguggaggcaaguugaaaaagucgaaacaugggcccuacggcaccccggguucaccauuuuggcacuguuccuagcacacuacauaggaacaucccuuacacaaaagguggucaucuuuauccuauuaaugcugguaacgcccagcaugacaaugcggugcguggggguggguaaccgcgacuucgucgagggucuguccggggccaccuggguugacguaguccuggagcacggggguuguguuacgacgauggccaagaacaagcccacgcucgacaucgaguuacaaaagacagaggccacucaacuggcgacgcuacguaagcugugcauagaggguaagauuaccaacauuacgacagauucuagguguccgacccaaggagaggccguccugccagaggaacaagaccagaacuacgucugcaagcacaccuauguagaucggggguggggcaacgguugcggccuuuucggaaagggcagccuggugaccugcgcaaaauuccagugccuggaacccauagagggcaaagucgugcaguacgagaacuugaaguacacagucaucauuacuguucacacgggugaccagcaucagguaggcaaugaaacccaaggggucacagcagagaucacgccccaggcuucgaccaccgaagcaacucugcccgaauacggcacccuggggcuacagugcucuccacgcacgggacuugacuuuaacgaaaugauucuucucacuaugaagaacaaagcauggaugguacaccggcaaugguuuuucgaccugccccugcccuggacuucgggcgccaccuccgagacgccgaccuggaaccgcaaagagcuguuggucacguuuaagaacgcccacgccaagaagcaggaggucgucguacuggggagccaagagggugccaugcacacggcccuuacgggcgccaccgagauccagaacagcggcgggaccagcauauucgcggggcacuugaaaugccgccugaagauggacaagcuggagcucaagggcauguccuacgcgaugugcaccaacacuuucgugcugaaaaaggaagugagugaaacccagcacgggaccauucugaucaagguagaguacaagggcgaagacgcucccugcaagaucccuuucaguacagaagacgggcacgguaaagcccacaacggaagguuaaucaccgccaacccugucguaaccaagaaagaagaacccgucaauaucgaggccgaaccgccauuuggggaguccaauaucguuauagggauaggcgauaacgcauugaaaaucaauugguacaaaaagggcuccucuauaggcaagauguucgaggccaccgcccgcggcgcgcgccguauggccauccucggcgacaccgcuugggacuuugggucggugggcgguguguuaaacagucuggguaaaauggugcaccagauauucggcagcgcguacacugcccuuuuuagcggcguguccugggugaugaaaauaggcaucgguguccuucuaacuuggauugggcugaacuccaagaauacgucaaugaguuucuccuguaucgcgauaggcauaauuaccuuauaccugggcgccguugugcaggcggauauggggugcgucaucaacuggaaagguaaagagcugaaguguggcaguggaaucuuugugacaaaugagguccacaccuggaccgagcaauacaaguuccaagcagacagccccaagcgccucgcaaccgcaauagccggcgcgugggagaauggcgugugcgggauacgcuccacgaccaggauggagaacuuacuguggaagcagaucgccaaugaacucaacuauauacuuugggaaaacaacaucaaacuaacagugguggugggggacaucauuggcgugcucgagcagggcaagcgaacucuuacgccgcagccaauggagcuaaaguauucguggaagacauggggcaaagcgaaaaucguaacugcagagacucagaacuccagcuucauaauugauggcccaaauacgcccgagugucccucagccucacgcgccuggaauguuugggagguagaagauuaugguuucgggguauuuaccaccaauauuuggcuccgccuccgcgaggccuacacacagcugugcgaucaccgccucauguccgccgcagucaaagaugagagggcgguucaugcugacaugggcuacuggaucgagagucagaaaaacggaaguuggaaacuugaaaaggccucccucauagagguuaagacaugcaccuggccaaagucccacaccuugugguccaacggcgugcuggaaagugacaugauuaucccgaagucccucgccggccccaucagccagcacaaucaucguccggguuaccacacucagaccgcgggcccauggcaccuaggcaagcuggagcuggacuucaauuacugugagggcacaacaguugucaucaccgaaaacugcgggacccgggguccaucccuucgcacuaccaccguaagcggcaagcucauucacgaauggugcugucggucgugcacccuacccccguugagguacaugggggaagaugggugcugguauggcauggagauucgaccaauuagugagaaggaagagaacaugguuaagagucucgucuccgcgggcucagggaagguggacaacuucacgaugggcguguugugccucgccauccuguucgaggaggugaugcgcgguaaauuuggaaagaagcacaugaucgccgguguauucuuuacauucguacuucucuuaagcggccagaucaccuggagagauauggcccacacacugaucaugauuggauccaaugcgagcgaucgcaugggcaugggcguaacuuaccuugcacuuaucgcgaccuucaagauacaacccuuucuagcauuaggguucuuucugaggaaguugaccucaagagagaaccucuugcugggaguuggccuggccauggcuaccacccuccaguuaccggaggacaucgagcaaauggccaacgggauagcccucgggcuaauggcccucaaacuuauaacgcaguucgagaccuaucagcuauggaccgcgcuuauuucacucacgugcaguaauaccaucuucacacugacuguggcguggagaacagccacccucauacuugccgggguuucccuccugccugucugucagagcuccuccaugaggaaaacugauuggcugcccauggccguggcggcgaugggagugccaccccucccgcucuuuaucuucuccuuaaaggauacccugaagcgacggagcuggccccugaacgaggggguaauggcugugggccugguguccauuuuagcuagcucccugcugcgcaacgacgugcccauggcuggcccuuugguggccgguggccugcucaucgcuuguuacgugauaacggggaccagcgcugaccuaacggucgagaaagcagccgacauaaccugggaggaggaggccgaacagaccggcgucucccacaacuugaugaucacagucgacgaugacggcacuaugcguauaaaagacgacgagaccgaaaauauacugaccgugcuccugaagacggcccuccugauuguaucaggcauauuuccauacuccaucccugcaacgcugcucgucuggcacacauggcagaaacagacgcagcguaguggcguucucugggacgucccaagcccgcccgagacucagaaggcugagcuugaggaaggagucuaccggauuaaacagcaagggauauuuggaaagacccagguaggcguggggguccaaaaggagggcguguuccauaccauguggcacgugacacgcggcgccguccucacguauaacggcaaacggcuugagcccaacugggcgagcgugaagaaggaccugaucucguacggcgguggcuggcgucuuagcacccaauggcagaagggggaagagguccaggucauagcgguggagccuggcaaaaaccccaagaauuuccagacaaugccgggcaccuuccaaacaacaacaggugagauuggagccauugcguuggauuucaagcccgguacgagcggcucucccaucaucaaccgcgaaggcaagguggucggguuguauggcaacgguguagugacgaagaacggcggguaugucagcgggaucgcccaaacaaacgcggagccagacgguccuacgcccgaacuggaggaagagauguucaagaaacggaaccuuacuaucauggacuuacacccugggagcggcaagacacguaaguacuuaccugccaucguuagagaggcgauaaagcgcagacuccggacccugauucuagcgcccaccagagucguagccgcagagauggaagaggcgcucaagggguuaccgauccgauaccagaccaccgcgaccaaaagcgagcacaccggccgcgagauuguugaccucaugugccacgcaacauucacgaugcggcuccugucccccgugcgcgucccgaacuacaaucuuauaauaauggacgaggcccauuuuacugaccccgcuucuauugccgcccggggguacauauccacccgcguaggaaugggcgaggcggcggcgauuuuuaugaccgcgacucccccgggcacagcggacgccuuuccgcaaucaaaugcgccaauccaggacgaggagcgagacauacccgagagauccuggaacagcgguaaugaguggauaaccgauuucgcaggcaaaacaguaugguucguccccuccaucaaggcgggaaacgauaucgccaacugccuacgcaagaacgggaagaaggugauucaacuuucacggaaaacguuugacacagaguaucagaaaaccaaacuaaacgacugggacuucguugugacgacggacaucuccgaaaugggcgcgaacuucaaagcggacaggguuaucgacccgcggcggugccucaagccugugauucuuacggauggcccggagcggguaauucuggcugggccuaugccuguuaccgcagccucagcugcccagcgcagggggcgcgucggccgaaacccgcaaaaggagaacgaucaguauaucuuuacagggcagccccucaacaacgacgaagaccacgcccacuggaccgaggccaagaugcugcuggauaacaucaacacuccagaaggcauuaucccagcucuguuugaaccugagagggagaagucugcugcaauagauggcgaauaccggcugaaaggagagagcagaaagacguucgucgagcuuaugcggcguggagauuugcccguaugguuggcgcacaaaguggcauccgaggggauuaaguacaccgaccguaaguggugcuucgaugggcagcgcaauaaucagaucuuagaggaaaauauggacgucgagauauggacuaaggagggagaaaagaagaaguugaggccucgguggcuggaugcgcgaacguauucggacccccuggcccucaaagaguucaaagacuuugcggccggcaggaagucgaucgcucuggaccuggugaccgaaauugggcgcgucccaagccaccucgcccacaggaccagaaacgcgcuggauaacuuagugauguugcacaccucggagcacggcgguagagcguaccgucacgccguggaggaguugcccgagacgauggagacccugcuucuucugggcuugaugauucuccugaccggcggcgccaugcuguuccugauaucggggaagggaaucggaaagaccucgauaggguuaauaugcguaauugccuccagcggcauguuauggauggcggagauuccgcugcaauggaucgccucugcgauuguccuggaauuuuucaugauggugcugcugauuccggagccugaaaaacaacguacgccccaggacaaccagcuggccuaugugguuaucgguauccucacgcuggcggcgauaauugcagccaaugaaaugggcuuacuugagacuaccaagcgagaccuuggcaugagcaaggaaccaggaguggugucccccacgucauaccuggacguggaccuccacccagccuccgcguggacccuguacgccguggccaccaccgucaucacgcccaugcuaaggcacacuaucgaaaacagcaccgccaacguauccuuggcggcgaucgcgaaccaggccgucguccugaugggucuagacaagggguggccgaucagcaaaauggauuugggcgugcccuuacuggcccuagguugcuauucacaggugaacccccugacacucacagccgccguacuccuacucauuacucauuacgccaucauuggcccaggacuacaggcuaaggcuaccagggaagcccagaagcggaccgccgcaggcauuaugaaaaaucccacgguggacgguaucaugaccaucgauuuagaccccgugauuuacgacagcaaguuugaaaagcaauuagggcaggucaugcuccuggugcugugcgcaguccaacuacugcugaugcgcacaucaugggcccucugugaggcucugacucuggcuacgggcccgaucacgacccugugggagggcagccccgggaaauuuuggaauaccacgaucgccgucuccauggccaacaucuuucguggcagcuaccuggccggcgcagggcuggccuucuccauuaugaaauccgugggcaccggcaagcgaggcaccggcucccagggagagacccugggcgagaaguggaagaagaaacugaaccagcugucacggaaggaauuugaucuauauaagaagucagggauaacggaaguggaccgaacggaagccaaggaaggguuaaaacggggugaaauuacucaccacgcugucagucgcggaagcgccaagcugcagugguucguagagcggaauauggugauaccggaagggagagucaucgaccucggaugcggaagaggggguugguccuacuacugugccgggcuuaagaaagugacagagguacgggguuauaccaaaggagggcccggacacgaggaacccguccccaugagcaccuacgguuggaacaucgucaagcugauguccggcaaggauguguuuuaccucccacccgagaagugcgacacauuauugugcgauauuggcgaaaguucgccgagccccaccgucgaagaaucgaggaccauccggguacugaagaugguggaacccuggcucaagaacaaccaguuuuguauaaaaguacucaaccccuacaugcccacgguaaucgaacaucuggagcggcugcagcggaagcacggagguaugcuaguccgcaacccucuauccagaaauucuacucacgagauguacuggauuuccaacggcaccgggaacaucguugccagugugaacauggugucccgccuccuuuuaaaucgauucacgaugacgcaccgccguccuaccauugaaaaggauguggaccucggcgcuggcacacgacaugugaacgccgaacccgagaccccuaacauggauguaaucggggagagaauaaagcgcauuaaggaggaacacaacucgacauggcauuacgaugacgagaacccauacaagaccugggcuuaucacggcagcuaugaggucaaggcaaccggaucugcaagcucuaugaucaauggaguugucaaguugcugaccaagcccugggacgucguccccaugguuacgcagauggcgaugaccgacaccaccccauucgggcagcaacggguguucaaagagaagguagacacgcgcacuccgcgcuccaugcccggcacccgccgggucaugggcaucaccgccgagugguuguggcgcacgcugggcagaaauaagaaaccccgccuguguacccgcgaggaguucacuaaaaagguacggacgaacgcggccaugggagccguguuuacggaggagaaccaguggaacagcgccaaggcggccgucgaggaugaagacuucuggaaauugguggaucgggagcgagagcuacauaagcugggcaagugcggcuccugcguauauaacaugaugggaaagcgugagaagaagcucggcgaguuuggcaaagcgaaaggcucacgggccaucugguauaugugguugggcgcucgguacuuagaguucgaggcgcugggcuuuuugaaugaggaucauugguucuccagggaaaacucauacuccggcguagaaggugaaggccugcacaaacuaggcuacauacugcgcgacaucucgaagauacccggaggcgcaauguaugccgacgacaccgccggcugggacacacggauaaccgaggacgaccuacauaacgaggaaaagauaacgcagcagauggacccggaacaccgucgccuagcuaacgcaauauucaaguugaccuaucagaauaagguugugaaaguccagcgcccuacccccacuggcacaguuauggacaucauaucgaggaaggaccagcgcggcucuggccaaguaggaacauauggauugaacacauucacgaacauggaggcccagcuuauccgccagauggagggcgaggggguacugucuaaggcugaucuggagaauccgcaccuacccgagaagaaaaucacccaauggcuagaaacuaagggcguggagcgucugaaaagaauggcaauaagcggcgacgacugcguugucaagccgaucgacgaccgguucgccaacgcucuccuagcacuaaacgauauggggaaagugcgcaaggacauaccccaauggcaaccaucuaaaggcuggcacgacuggcagcaagucccguucugcagccaccacuuccacgaacucauuaugaaggacgggcggaagcuggucgugcccugucgaccgcaagacgaacugaucggucgcgcgagaaucucacagggcgccggcuggagcuugcgggagaccgccugcuuggggaaggcuuaugcccagauguggagucugauguacuuccaucgccgggaucugcgccuagccagcaacgccauauguagcgcggugcccguccauugggugccuacuucccggaccaccuggucuauccacgcgcaucaccaguggaugacgaccgaagauaugcuuacgguuuggaaccgagucuggaucgaggacaaucccuggauggaagacaaaacgcccgucacgacuugggaagaugucccauaccucggaaagcgcgaggaucaauggugcggaucccugaucggccugaccucacgagcgacaugggcgcagaacauuccuaccgccauccaacagguccggaguuugaucgggaacgaagaguuccuggauuacaugccgucaaugaagagguuccggaaggaggaggagucugagggagcgauuugguga

SEQ ID NO: 25895 - RNA, 9873 nt, Artificial Sequence
  derived and/or modified CDS sequence (opt11) from DENV-3__KJ189278__SS-prME
accagccucugucuuaugaugauccuccccgccgcccuugcguuccaccucaccagccgggauggggagccccggaugaucguggggaagaacgagcgaggcaagagccuacuauucaagaccgccuccgguaccaacaugugcacccucauugccauggaccugggcgagaugugcgacgacaccgugaccuacaagugcccccacauuaccgagguggaaccugaggacaucgacugcuggugcaaccugaccagcacuugggucacauaugggaccugcaaucaagccggcgagcaccggcgcgacaagcgguccguggcccucgcgccccacgugggcauggggcuggacacccgcacccaaacauggaugagcgcagagggcgccuggcgccagguagaaaagguagaaaccugggcccugcgucacccgggguuuaccauccucgcgcuguuucuggcccacuauauaggaacgagccucacgcagaagguggugaucuucauccugcugauguugguaacccccagcaugaccaugcggugcguaggggucggaaaccgcgacuucguagaaggucuguccggggccaccuggguggacguaguccuggagcacggcggaugcgucacgaccauggcaaagaacaagccuacgcucgacauugaauugcagaagaccgaggccacgcagcuugcgacguugaggaagcuguguaucgaggggaagaucaccaacaucaccacggacagccgcugccccacucaaggcgaagccguccuuccggaggagcaggaccagaacuacguuugcaaacauaccuacguggaccguggguggggcaacgggugcggccucuucgguaagggcucuuuaguuaccugcgcgaaguuucagugccuggagcccaucgagggcaaagucgugcaauacgaaaaccucaaguacacggugaucaucaccguccacaccggagaucaacaccaggugggcaaugagacccagggggucacggccgagaucacgccccaggccucuaccaccgaagcgacccugccggaauaugggacgcugggacucgagugcuccccgagaaccggccuagacuucaacgagaugauccugcucaccaugaagaacaaggccuggauggugcaccgccagugguucuuugaccugccccugccuuggacuucgggcgcuacgacagagaccccaaccuggaaccgcaaagagcuccuggucacuuucaaaaacgcccacgccaaaaagcaggaggucgugguccugggaucccaggagggggcgaugcacaccgcucuaacuggggccaccgagauccagaacaguggcgggacgaguaucuuugccggccaccugaaaugccgucugaagauggacaagcucgagcugaaggggaugagcuacgcgaugugcaccaacacuuucguccugaagaaggagguauccgagacccaacacgggacgauacucaucaaaguggaauacaaaggagaagacgcgccauguaagauccccuucuccaccgaggacgggcacggcaaggcccauaacgguagacugaucacagccaaccccgucgugaccaaaaaggaggagcccguuaacauagaggccgagccgcccuucggcgaaagcaauaucgucaucgggaucggggacaacgcccugaagauaaacugguacaagaaaggcuccaguaucgggaagauguucgaagcgaccgcccggggagcccggcggauggccauccugggcgacaccgcgugggacuucgguuccgugggcgggguucucaacucccugggcaagaugguccaccagaucuucggguccgccuacaccgcgcuguucucuggcguguccugggugaugaagauuggcauugggguccucuugaccuggaucggccuuaacuccaagaacacguccaugagcuuuuccuguaucgccaucgggaucaucacccuauaccugggcgccgugguacaagcggacauggggugcgugaucaacuggaagggcaaggagcuaaaguguggcaguggcaucuucgucaccaacgaggugcauaccuggacggagcaauauaaauuccaagccgacucgccuaagcggcucgccaccgccaucgccggcgcgugggagaacggggucuguggcauccgcaguaccacgagaauggagaaucuguuauggaagcagaucgcuaacgagcucaauuacauccugugggagaacaacgugaaacugacgguggucgugggggacauuaucggcgugcucgagcagggcaagcgcacccuaacgccgcagccgauggagcugaaguacuccuggaagaccugggggaaagccaagauagucacagccgagacccagaauucguccuucaucaucgacggccccaauaccccagagugccccagcgcgucccgggccuggaauguaugggagguugaggacuacggguucggugucuucacaaccaacauauggcuucgccugcgggaaguguacacgcagcucugcgaccaccgccuaaugagcgcggccgugaaagaugagcgggccguacacgcggauaugggcuacuggaucgagagccagaaaaacggguccuggaagcuggagaaggcgagccugaucgaggugaagacaugcaccuggcccaagucccacacccucuggagcaacggcgugcuggaguccgacaugaucauccccaagucguuagcugggcccauuucgcaacacaaccaccgcccgggcuaccauacgcagaccgccgggcccuggcaucucgguaagcuggagcuugacuuuaauuacugcgagggaaccaccguugugaucacggagaacugcgggaccaggggucccagccuccgcaccaccacgguuucggggaaguuaauccacgaguggugcugccggagcugcacccugcccccgcuccgcuacaugggcgaggauggcugcugguacggcauggagauccgccccaucuccgagaaggaagagaauaugguaaagagccuggugucugccggauccgggaagguggacaacuucacgaugggcguccugugccucgcgauccuguucgaggaagugaugcgugggaaguucggcaagaagcacaugaucgcggggguguuuuucaccuucgugcugcucuuguccggccagauaacguggcgugacauggcccacacccugaucaugaucgguucgaacgccucugaccguauggguaugggugugaccuaccucgcucugaucgccaccuucaaaauccagccguuccuggcccucggguuuuuccugagaaagcugaccagccgcgagaaccuccugcugggcgugggccucgcgauggccaccacccugcagcugcccgaggacauagaacagauggcgaacggcaucgcccucggacugauggcccugaagcucaucacccaguuugagacguaccagcuguggaccgcacugauaagccugaccuguuccaacaccaucuucacgcugaccgucgcuuggcggacggcgacucuaaucuuggccggcguaagccugcugccggucugucaguccucuucaaugcgcaaaacggauugguugcccauggccguggcagccaugggcgugccgccccucccgcuguucaucuuuagccucaaggacacuuuaaagcgcagauccuggccgcugaacgagggggugauggcggugggccugguguccauccucgccuccucucugcuucggaacgacgucccgauggccggcccccugguggcggguggcuuacuaauugcaugcuacguaaucacugggaccucagcugaccuaacgguugagaaagcagccgauaucaccugggaagaggaggcugagcagaccggugugagccacaaccugaugauaaccguagacgaugacgggaccaugcggaucaaggacgacgagacugaaaacauccucacaguccugcugaagaccgcccugcuuauaguuuccgguauauucccguacucuauuccugcgacgcugcuaguauggcacacguggcagaagcagacgcagcgcucgggcgucuuaugggacgugcccucaccgcccgagacacagaaggccgagcuggaggaggggguguaucggaucaagcagcagggcaucuucggcaagacccaggucggggugggggugcagaaggagggcguguuccacacgauguggcacgucacccgcggcgccgugcucacauacaacgggaagcggcuagagcccaacugggcaucugucaagaaggaccucaucuccuacggcgggggcuggcgccucucuacccaguggcagaagggggaagagguccaggugauugcggucgaacccgguaagaacccgaagaauuuccagacaaugcccggcaccuuccagacaaccacgggggagaucggcgccaucgccuuggacuucaagccagggaccuccgggagcccaauuaucaaccgggagggcaagguggucggccucuacggcaacgggguagugaccaagaacggcggguacguguccggcaucgcucagaccaaugcagagccggacggaccgacgcccgagcuggaagaggaaauguucaagaaacgcaaccucaccaucauggacuugcaccccggguccggcaagacccggaaguaccucccagcgaucguucgcgaggcaaucaaaaggcgccuccgaacccuuauccuggcccccacgagaguuguggccgccgagauggaagaggccuugaaggggcugcccauccgguaucagaccacagcaaccaaguccgagcacaccggccgcgagaucgucgaucugaugugccaugcgaccuuuaccaugagacuccugagcccugugagggugccgaauuacaacuuaauaaucauggaugaggcgcacuucacggaccccgccucaaucgcugcccgaggauacaucucuacgagagucggaaugggcgaggccgcagcgaucuucaugaccgccacgccgcccgggacggccgacgccuuuccgcaauccaacgcccccauccaggaugaggagcgcgacauccccgagcguagcuggaacuccggcaacgaguggauaacagacuucgcggggaagaccgugugguucgugcccagcaucaaggccggcaacgacaucgccaacugccuccgcaagaacgguaagaaggucauccagcugucccggaagaccuucgacaccgaguaccagaagacaaagcugaaugacugggacuucguggucacaacagacaucucagagaugggugcuaacuucaaagcagaccgugucaucgauccgcggcggugccucaagcccgugauccugaccgacggcccggagcgggugauacucgcugggccuaugccggucaccgccgcuuccgccgcccagcgccggggacgcguggggcggaacccccaaaaggaaaacgaccaauacaucuucacgggccagccauugaacaacgacgaggaccacgcgcacuggaccgaggccaaaaugcugcuggacaacaucaacacaccugaagggauaauaccugcccucuucgagccagagcgcgagaaguccgcagcuaucgacggcgaguaccgacuuaagggcgagucccgcaagaccuucguggagcugaugcggcgcggggaccuccccgucuggcuggcccacaaaguggcgagcgaaggcaucaaguacacggaccggaaguggugcuucgacgggcaacggaacaaccagauccucgaagagaacauggacgucgaaauuuggaccaaggagggcgagaagaagaagcuccggccccguuggcuugaugccagaaccuacagcgacccgcuggccuugaaagaguucaaggauuucgcggccggccgcaagucgauagcccuggacuuggugacggagaucggacgcgugcccucccaccuagcccaccggacgcgcaacgcacuggacaaccugguuaugcuacacaccagugaacacgggggucgggcguaccgccaugccguggaagagcugccugaaaccauggagacccuguugcuguugggccucaugauccugcuuacgggcggagccaugcuguuccugauuagcgggaaggggaucgguaaaaccucgaucgggcucauuugcgucaucgccagcuccggcaugcucuggauggccgagauuccgcugcaguggaucgcgagcgcgauaguccuggaguucuucaugauggugcuccugauucccgagccggagaagcagcgcacgccucaggacaaccaacuggccuacguggucaucgggauucucacccuggcagccaucaucgcggcgaacgagaugggccugcucgagacgacgaagcgcgaccugggcaugagcaaggagccagggguggucagccccacaucguaucuugacgucgaccuacacccggcuagcgccuggacacuguaugcgguggcuacuaccgucauaaccccgaugcugcgucacaccauugagaacuccacugcuaacgucagccucgccgccauagcuaaucaggcuguggugcugaugggccuggacaagggguggcccaucuccaaaauggaucucgguguuccccugcuggcccucgggugcuacagccaggugaacccccugaccuuaaccgccgccgugcuccuguuaauaacccacuacgcgaucaucggccccggccuccaggcgaaggccacgagagaagcccagaagcguaccgccgcggggauaaugaagaacccuaccgucgacggcaucaugacuaucgaccuggaccccgugaucuacgacagcaaguucgagaagcagcugggccagguuaugcuauugguacugugcgccgugcagcugcuguugaugcgcaccucaugggcccucugcgaggcgcugacccuugcgaccggcccgaucaccacgcuaugggaaggcucccccgggaaguuuuggaacaccaccauagccguaagcauggccaacaucuucaggggcuccuaccuggccggggccggccuggcguuuagcaucaugaaguccguuggcaccggcaagcgcggcacggggagccagggcgagacgcuuggggagaaguggaagaagaagcugaaccagcugucuaggaaggaguuugacuuguacaagaagucaggcaucaccgagguugaucgcaccgaagcuaaggaaggucugaaacggggcgagaucacccaccacgccgugagccgcggcuccgccaaacugcagugguucgucgagcgaaacauggugaucccggagggucgcgugaucgaccucggcugcggaaggggcggguggagcuauuacugcgccggccugaagaagguaacggaaguccggggguacaccaagggcgggcccgggcacgaggaaccggugcccauguccaccuacgguuggaauauagucaaacugaugagcgggaaggacguguucuaccugccgcccgagaagugcgauacccuucugugcgauaucggagaguccagccccagucccacgguggaggagagccgcaccauccggguccugaagaugguggagccguggcuaaaaaacaaccaguucugcauuaaaguccugaaccccuacaugcccaccgucaucgagcaccuggagcgccuccagaggaagcauggcggaaugcuggugcgcaacccccugucucggaauagcacgcacgagauguauuggaucuccaacggcaccgggaacauaguggcaagcgucaauauggugucccgcuuacuccuuaaccgguucaccaugacacaccgccggccgaccaucgagaaggacguggaccucggcgccggcacgcgacacgucaacgccgaacccgaaacccccaauauggacgugaucggugagcgaaucaagcguaucaaggaggagcacaacagcaccuggcacuacgacgaugagaauccguacaaaaccugggccuaccacggcuccuacgaggugaaggccacgggaagcgcgucuaguaugaucaacgggguagugaagcugcugaccaagcccugggacgucgugcccauggugacacagauggcaaugacugacacgaccccguuuggucagcagcgugucuucaaggagaagguggacacgcgaacgccgcgaagcaugcccgguacgcgccgggugaugggaaucaccgcagaaugguuguggcgcacacuggggcguaauaaaaagccgcggcugugcacccgcgaggaguuuacgaagaagguccggaccaacgccgcgaugggcgccguguucaccgaggaaaaccagugggacagugccaaagcugccgucgaggacgaggacuuuuggaagcuagucgaccgcgagcgggagcugcacaaguuaggaaaaugcgguagcugcgucuacaacaugauggggaagcgggaaaagaagcucggcgaauuugguaaggcgaaggggucgcgagccaucugguacauguggcugggcgcucgcuaccuugaguuugaggcacugggauuccucaacgaggaucauugguuuagccgggaaaacuccuauucuggcguggagggggagggucugcacaagcugggcuacauccugagggacaucucuaaaauacccggcggcgccauguacgcggacgacaccgcggggugggacacgcggaucaccgaagaugaucugcacaacgaggagaagaucacccagcagauggacccggagcaccggcaguuggccaacgcgaucuuuaagcugacauaccaaaacaaagucgucaaggugcaacggccuacccccacgggcaccgucauggauauuaucagccgcaaagaccaacguggauccgggcaggugggcacguacgggcugaacacuuucacgaacauggaggcccaacucauccgccaaauggaaggggagggggugcugagcaaggccgacuuagaaaacccccaucucccagagaagaagaucacccaguggcucgagacuaagggcgucgaacggcugaagcgcauggcgaucuccggcgacgacugcguugugaaacccaucgacgaccguuucgccaaugcccucuuagcccugaacgacauggggaagguccgcaaggauaucccccaguggcagccaagcaagggcuggcacgacuggcagcaggucccguucuguucccaucacuuccacgaacucaucaugaaggacgggaggaagcucguggucccgugucgcccgcaagacgaguuaaucggacgggcgcgcaucucccagggggccgguuggucgcuccgcgagaccgccugccugggcaaagcauacgcgcagauguggagccugauguacuuccaucggcgcgaccuccggcuggccuccaacgcaaucugcagcgccgugcccguucacugggugccuacgucccgcaccaccuggagcauccacgcccaccaccaauggaugaccacggaggacaugcuuacaguguggaaccggguguggaucgaggauaaccccuggauggaggauaaaaccccugucaccacaugggaggacguacccuaccucggcaagcgcgaggaccaauggugcggcucucugaucggacugacguccagagccaccugggcccagaacaucccgacugccauacagcagguccgcagucucaucgggaaugaggaguuccucgacuacaugcccucuaugaagcgcuuccgcaaggaggaggagagcgagggggcuaucugguga

SEQ ID NO: 25896 - RNA, 9873 nt, Artificial Sequence
  derived and/or modified CDS sequence (opt11) from DENV-3__KJ189279__SS-prME
acaucacucuguuuaaugaugauccuacccgccgcgcuagcauuccaucucaccucccgcgauggcgaaccacgaaugaucgucgguaaaaaugaaagaggaaaaagucugcuguucaaaacagcuuccggaauaaacaugugcacauugauagcaauggaucugggagaaaugugugacgacacaguuaccuauaaauguccgcacauaaccgaaguggaacccgaggacauugauugcuggugcaauuuaacguccacaugggugacauacggcaccuguaaccaagcaggagagcacaggcgggauaaacgcagcguggcucuagcaccccauguuggaaugggccuggauacaagaacacaaacauggaugagcgccgagggggccuggaggcaaguggaaaaaguagagaccugggcacuccggcaccccggcuuuaccauccucgcccuauuccucgcgcacuacaucgggacgagucuaacccaaaaggucgucaucuucauccuacuuaugcucgucacgccauccaugacuaugaggugcguagguguggguaacagggacuucgucgaaggccuaucaggcgcaaccuggguagaugucguccucgaacacgggggaugcgucacaacaauggcgaaaaauaaaccgacucuggauaucgaacugcaaaagacagaagcaacacaauuggcaacccuacgaaagcuauguaucgaggggaaaauaacgaacauaacgacagacucaaggugccccacacagggcgaagcagugcuccccgaagaacaagaccagaacuacgucuguaaacacacguacgucgaccgaggauggggcaacggaugugggcuauucgggaaggggucccuaguuacaugcgccaaauuccaaugcuuggaaccaaucgaaggcaaagucguucaauacgaaaaccucaaauacacagugauaauaaccguacauacgggagaucagcaccaaguaggaaaugaaacccaaggcgugacagcagagauaacaccacaagccuccacuaccgaagugacccucccagaguacgggaccuuagggcuggaaugcucaccccgcacuggccuggacuucaacgaaaugauccuacucacaaugaaaaacaaagcguggauggugcaccgacaaugguucuucgaucuuccacuaccguggaccucuggcgcgaccacugagacaccaacauggaaccgcaaagaauuacuugugacguucaagaacgcacacgccaagaaacaagaaguaguaguccuugguucucaggaaggggcaaugcauaccgcucuaacgggcgcaaccgagauacaaaauagcggcggcacaucgauauucgcagggcaccuaaaaugucgcuugaaaauggacaaacucgaguuaaagggcaugucuuacgcgaugugcacgaacacguucgugcuuaagaaagaaguaagugaaacacaacacgguaccauauuaauuaaaguggaguauaaaggugaagaugcgccgugcaagauaccauuuucaacagaggacggccacggaaaggcucauaacgggagacuaaucacggcaaacccagugguaacuaaaaaggaagaacccgugaacauagaagcggaaccgcccuucggagaaagcaacauuguaauaggcaucggcgacaacgcacugaaaauaaacugguacaagaagggcuccagcauagggaaaauguucgaagccaccgcgcgaggcgcgcgucggauggccauccuaggcgacacagccugggacuuuggaagcguagguggaguacuaaacagucuggggaaaaugguccaccaaaucuucggaagcgcauacacggcccuauucucaggagugagcugggugaugaaaaucggcauaggaguccugcucacauggaucggacuaaacuccaaaaacacaagcaugucuuuuucaugcauagcuauaggcaucaucaccuuguaucugggagccgucgugcaagcagacauggggugcgucauuaacuggaaagggaaagagcuaaaaugcggcaguggcaucuuuguuacgaaugagguccacaccuggacggagcaauacaaauuccaggcggacagcccaaaaagacuagcaacggcaaucgccggcgcaugggagaacgggguuugcggaaucagaucaaccacaagaauggaaaaccuacucuggaagcagauagcgaacgaguuaaacuacauacucugggaaaacaauauaaaacuaacaguggucguuggagacauaauaggugugcuagagcaaggcaaaaggacacuaacgccacagccgauggagcuuaaauauagcuggaagaccuggggaaaggccaagauagucaccgccgagacccaaaacagcagcuucaucaucgacggaccgaacacgccugagugccccagcgcaagcagagcuuggaacgugugggaaguagaggacuauggguucggcguguucacaacgaacaucugguuacgacuacgagaagucuacacccagcucugcgaucacagacuaaugucagccgcgauaaaagacgaacgggcaguccaugcugauaugggcuacuggauagaaucgcagaaaaacggcagcuggaaacuugaaaaggccucguuaaucgaagucaaaacgugcacauggccaaagucacacacccucuggucuaacgggguguuagaaucagacaugauuauacccaagagccuagcaggacccauaucacagcauaaccacagacccgguuaccauacucagaccgcaggacccuggcaccucggcaaacucgagcuagacuucaacuauugcgaagggacuacaguuguaauaaccgaaaacugcgggacccgagggccgagccuacgaacgacaacggucaguggcaaacucauccacgaauggugcugccgcagcuguacucuaccgcccuugcgcuauaugggagaagacgguugcugguacgggauggagauccgcccgauuagcgaaaaagaagagaacaugguaaaaucgcucguaagugcuggcagcggaaaagucgauaauuucacaaugggaguccuaugccuagcaauccuauucgaagagguaaugcgcggaaaguucggcaagaaacauaugauagcaggcgucuucuucacauuugucuuacuccucagcgggcaaauaacauggcgcgacauggcgcauacgcugaucaugaucggaucuaacgccagcgaccggauggguaugggcgucacuuaccuagcacuuaucgcgaccuucaagauacagcccuuucuugcgcuuggauuuuuccuacggaaacuuacgucacgcgaaaaccuacugcugggaguuggucuggcuauggccacgacccuccagcugccagaagauauugaacagauggccaacggcauagcgcugggguuaauggcccugaaauugaucacccaauucgagacguaucagcuauggacagccuugauaucgcucaccuguaguaacacgauuuucacccucacaguagcauggcggaccgccacgcuaauccuagccggcgucagccuucugcccgugugccaaagcaguucaaugcggaagaccgacuggcuuccaauggccgucgccgcuauggguguaccuccauugccucucuucaucuuuucacuaaaagauacccuaaaacgccggagcuggccccucaacgaagggguuauggccguagggcuagucucuauauuggcauccucacuacuccgaaacgacguaccgauggcagguccccuaguugcuggcggacuccucauugcgugcuaugucauaaccggcaccagugcugaccucaccguggaaaaagcugcggauaucaccugggaagaagaggccgaacaaaccggcguuucgcacaacuugaugaucacugucgacgaugacggaaccaugcggauaaaggacgacgagacggagaacauccugacgguacuacuaaagacagcacuacugauugucucugggaucuuucccuacagcauucccgccacucuacuugucuggcauacauggcagaagcagacacaacgcagcgggguccuaugggacguaccaaguccaccggaaacacaaaaggccgaacucgaagaaggagucuaccgaauaaaacagcagggcaucuucggaaaaacgcagguaggugucggggugcagaaagagggugucuuucacacaauguggcacgucacgcgcggggcuguccugacauauaacggaaaacgacuagaacccaauugggcgaguguaaagaaggauuugauuuccuacggagguggguggaggcuuucgacacaauggcaaaagggagaggagguccaaguaaucgcaguugagccuggcaagaauccgaaaaauuuccaaaccaugcccggaacguuucaaaccacaacgggcgagaucggggccauagcgcucgacuuuaaaccaggaaccucaggaucaccaaucaucaacagggaaggaaaaguaguaggauuauauggcaacggagucgugaccaagaacgggggauacgucagcggaauagcacagaccaacgcggaaccggauggacccacccccgaacuggaagaggaaauguuuaagaaaaggaaccucaccaucauggaccuucacccuggcaguggaaagacccguaaguacuugcccgcaaucguacgugaagcgauaaaacgccgccugagaaccuugauccuagcgccgacccgcgucguugcagccgagauggaagaagcucugaaggggcuuccgauccgguaccaaacgacugcaacgaaaucggaacacacaggcagagagaucguagacuuaaugugucacgcaacauucaccaugagacuacuaucccccguucgcguucccaacuacaaccuaauuauuauggaugaagcccacuucacagaccccgcgucuauagcagcgagaggcuacaucaguaccagaguggguaugggagaggccgcagcuauauucaugaccgcgacaccacccggcacagcagaugcauucccacagucaaacgcaccgauucaggaugaggaacgagacauccccgagcgaagcuggaauagcggcaaugaauggaucaccgauuucgcagguaaaaccgugugguuuguaccaucgauaaaagcgggaaaugacaucgcaaacugucucaggaaaaacggaaagaaagugauacaacuuucgcgcaagaccuucgacacggaauaccagaaaacgaaacuaaacgacugggauuucguugucaccaccgacaucucggaaaugggcgccaacuucaaagcagaucgaguuaucgacccacgccgcugccucaaacccgucauccucacggacggaccggagagagugauacuagcaggacccaugccuguaaccgcagccagcgccgcccaacgaagaggucguguaggacggaauccacaaaaagaaaacgaccaauacauauucaccggccagccgcucaauaacgacgaggaccacgcccacuggacugaagcaaagauguuacuugauaacauaaacacgccagaaggcauuauuccggcauuauuugaaccggagcgagagaaaagcgcagccauugacggagaauacagguuaaaaggagaaaguagaaaaaccuucguugaacucaugaggcguggggaccugccaguauggcucgcacauaagguagcguccgaaggcauuaaguacacggaucgcaagugguguuucgauggccagcgcaacaaucaaauacucgaggagaacauggacgucgaaauauggaccaaagaaggcgagaagaagaaacuacgcccccgcuggcuagacgcacgcacauacuccgacccgcuagcccuaaaggaguucaaagacuucgccgcaggcagaaaaucaauagcccuagaccuaguaaccgaaauaggcagaguaccuagccaucuggcacaccgcacaagaaacgcacucgacaaucuagucaugcuacacacguccgaacacgguggacgagcauacagacacgccguggaagaacuccccgagacuauggagacccuguuauugcuugggcugaugauacuccuaacaggcggagcuaugcucuuucuaaucuccggaaaaggcaucgguaagaccagcauuggguugauaugcgucaucgccagcagcggcaugcuuuggauggcagaaauuccacuccaauggauugcauccgcgauagugcuagaguucuucaugaugguacuacuaaucccagaaccagaaaagcagcguacgccccaagacaaccaacucgcauauguagucauagggauauugacccuagccgccauaaucgccgcgaaugaaaugggucuccuagaaaccaccaagcgcgaccucgggaugagcaaggaaccgggaguaguaagucccacaagcuaucuggacgucgaucugcauccugccagcgccuggacgcucuacgcugucgcaaccaccguaaucacuccaaugcugcggcacacgaucgaaaacucaacggcaaacguaucguuagcggcuauagcuaaucaagcagucguacucaugggccuggauaaaggcuggccgaucucaaagauggaccucggcgugccucuacuggcacuggguuguuacucacaagugaacccucugacccugacagccgcugugcucuuacucauaacgcauuacgcgauaauugggccaggccuucaagcgaaggcuaccagggaagcacagaaaagaacagcagccgguauuaugaaaaauccgaccgucgacggcauaaugacuauagauuuggacccugucauuuaugacucaaaauuugaaaaacagcucggccaaguuaugcuauugguacucugcgcggugcaacucuugcugaugagaacaagcugggcgcugugcgaagcccugacacuagcgacgggccccaucacuacauuaugggaaggcaguccagggaaauucuggaacacuacgaucgcgguuucaauggcuaacauuuuccgcgguuccuauuuggcgggcgcugguuuggcauuuagcauuaugaagucgguaggaacuggaaagcguggcaccggaagccagggggagacccugggcgaaaaauggaagaagaaacucaaccaacucucgaggaaagaguucgacuuauauaagaaguccgggauaaccgagguggaccggacggaggccaaggaaggccugaagcgaggagaaaucacacaccacgcagucucccgcgggucggcgaagcuacaaugguuuguagaacggaacaugguaauaccugaggguagagucaucgaccuaggaugcgggagaggggguuggucguacuauugugccggauugaagaagguaacagagguccguggcuacaccaaagggggcccaggucacgaggaaccaguccccaugagcaccuacggcuggaacauagucaagcuaaugucugguaaggauguuuucuaccucccaccagaaaagugugacacccuccucugcgacaucggcgagagcagcccaucaccaaccguagaggaaucacggaccauucgcguccucaagaugguggaaccguggcugaaaaacaaucaauucugcaucaaggucuuaaaccccuauaugcccacaguaaucgaacaccuagaaaggcugcaacgaaaacauggaggaaugcuggugcgcaacccucuaucgaggaacagcacgcaugagauguauuggauaagcaacggaaccggaaacaucguugcgucaguaaacaugguaucccggcuccuucucaacagauucaccaugacacacaggaggccaaccaucgaaaaagacguagaccucggggcgggcacacgacacgucaaugcagaaccagaaacuccuaacauggauguaaucggagaacgaauuaagcgaauaaaagaggaacacaacaguacguggcacuacgacgacgaaaauccguauaaaaccugggcauaucacggaucauacgaggugaaagccaccggaagcgcaaguucuaugauaaacggaguggugaagcucuugaccaaaccaugggacguagucccaaugguuacacagauggcaaugacagacacaacgccauucgggcagcaacgaguuuucaaagagaaaguugacacccgcacaccccggagcaugccaggcacucgucguguuaugggaauaaccgcagaauggcuauggcgaacacuuggacggaacaagaaaccccgucuuuguacacgcgaagaguucacgaagaaagugcgaaccaacgccgcuaugggggcuguauucacagaagaaaaucagugggacagcgcaaaagcggccguugaagacgaagacuucuggaagcuagucgaucgagaacgcgaacugcauaaacucggcaaaugcggcucaugcguguauaauaugaugggcaaacgugagaaaaaguuaggagaauuugguaaggcaaaaggaucaagagcgauaugguauauguggcuuggcgcuagauaccuggaauuugaagcgcuuggguuuuugaacgaagaccacugguucucgagagaaaacagcuacagcggcguugaaggcgaagggcuucacaagcucggauauaucuugcgagacauaaguaaaaucccgggcggcgcgauguacgccgacgauacugcagguugggacacucgcauuacugaggacgaccuccacaacgaggaaaagauaacucaacaaauggacccagagcaccgccagcuagccaacgcaaucuucaagcuaaccuaccagaacaaggucgugaaagugcaacgccccacgcccacagguacugucauggacauaauaucccgaaaagaucaacggggcucggggcaaguaggcaccuacggacucaacacuuuuaccaacauggaagcacaacucauaagacagauggaaggagaaggagugcuguccaaggccgaccucgaaaauccccaucuaccggagaagaaaauaacccaauggcucgaaacgaagggagucgaaagacugaaacgcauggcaauuuccggagacgacugcguaguuaaacccaucgaugaccgguucgcgaacgcccugcuagcgcuaaacgacauggguaaaguccggaaggacauuccucaguggcaaccgagcaaaggauggcaugacuggcaacaaguucccuuuugcagccaucauuuucacgaacucauaaugaaggacggcagaaaacuugugguaccgugcagaccacaagacgaacugaucggccgagcgaggaucagccaaggggccggauggagccucagggaaacagccugccucggaaaagcauacgcccaaauguggagcuugauguacuuccaccggagggauuuaagacucgcaagcaacgccauauguagugcagugcccguucacuggguacccacaagccgcaccaccuggucaauacacgcgcaccaccaauggaugaccacagaagacaugcugacagucuggaaucgagucuggauagaagacaaccccuggauggaagacaaaacgccggugacaaccugggaagacguaccauaucuaggcaaaagagaggaucaguggugcggcuccuuaaucggccucacaucccgagcaaccugggcgcagaacauaccaacggcgauccagcaaguuagguccuuaauagggaacgaggaguuccucgacuacaugccaagcaugaaaagauuuagaaaagaagaggaaagugaaggggccaucugguga

SEQ ID NO: 25897 - RNA, 9873 nt, Artificial Sequence
  derived and/or modified CDS sequence (opt11) from DENV-3__KJ189280__SS-prME
accagccucugccuaaugaugauucugcccgcggcccuggcauuccaccucacaucaagggauggggagccccggaugaucguggggaagaacgagcgcggcaagagccugcuguucaagacggccuccgggauuaacaugugcacuuugaucgcgauggauuuaggcgagaugugcgacgacaccguaacguauaaaugcccacacaucacggagguggagcccgaggacaucgacugcuggugcaaccugaccagcaccugggugacuuacgggaccuguaaccaggccggcgagcaccggcgagacaagcggucaguagcuuuagcgccccacguggguaugggacuggacaccaggacccagacguggaugagcgccgagggcgcuuggcgccaaguggagaaggucgagacgugggcucugcgccacccgggguucaccaucuuggcgcuguuccucgcccacuacaucggcaccucgcucacccagaagguggucaucuucauauugcuaaugcucgucacgcccagcaugaccaugcggugcguggguguggggaaucgcgacuucgucgaaggccugucuggggccacuuggguggauguggucuuggagcacggcggaugcguuaccacgauggcgaagaacaagccuacccucgacauagagcugcagaaaaccgaggccacccaguuagccacccuccggaagcugugcauagagggcaagaucaccaacauaaccaccgacagucguugccccacgcagggcgaggccgugcugccggaggaacaggaccagaacuacgucugcaagcauaccuacguggaccguggguggggcaauggguguggccucuuugggaagggcagucuggugacgugcgccaaauuccagugcuuggaacccaucgaggggaagguaguacaguacgagaaccucaaguacaccgugaucaucacgguccacaccggcgaccagcaccagguuggcaacgagacccagggggugaccgccgagauuaccccccaagccagcaccaccgaggcgacccucccggaguauggcacccugggucucgagugcuccccgcgcacggggcuggacuucaacgaaaugauccugcucacaaugaagaacaaggccuggauggugcaucggcagugguucuucgaucucccccugcccuggaccagcggcgccaccacggagacccccaccuggaaccgcaaagagcucuuagugacguucaaaaacgcccacgcgaagaagcaggaagucguggugcuagggucccaggagggcgcgaugcacacugcucucacgggggccaccgagauccagaacagcggcggcacauccaucuucgccgggcaccugaagugcagacugaagauggauaagcucgagcugaagggcaugagcuacgccaugugcacuaacacuuucgucuugaagaaggagguauccgagacccagcacggcacgauccucaucaagguggaguacaagggcgaagaugcgccgugcaagauccccuucagcacagaggauggccacggcaaggcccacaacggccgccuuauaaccgccaauccgguagugaccaagaaggaggagcccgucaauauagaggccgagccgccguucggagagagcaacaucgucaucggcauaggcgacaacgcgcugaagaucaauugguauaagaagggcuccuccaucgggaagauguucgaggccaccgcacggggugcccgucguauggccauccugggcgacacggcaugggacuucggaaguguggggggggugcucaauagccugggcaagaugguccaccagaucuucggguccgcguacaccgcccuguucucggggguauccugggugaugaaaaucggcauugggguacuccugaccuggaucggccugaauagcaagaacaccuccaugagcuucuccugcaucgccaucgggaucaucacgcucuaccugggcgccguggugcaggcggacauggggugcgucauaaacuggaagggcaaggaacugaagugcggcucggggaucuucgugaccaacgaggugcacaccuggaccgagcaguacaaguuccaggccgacucccccaagcgucuggccacggccaucgcgggcgcaugggagaacggggucugcggcauccgaucuaccacucguauggagaaccugcuguggaaacaaauagccaacgagcucaacuacauccugugggagaauaacaucaagcugaccgucguggucggggacauaaucggugugcucgagcagggcaagcgcacgcugacgccccagccgauggagcugaaauacucuuggaaaaccugggggaaagccaagaucgugaccgcagagacgcagaacagcagcuucaucaucgacggccccaacacacccgaguguccaagcgcgucccgagccuggaacguaugggagguggaggacuacgguuucggcguguucacaaccaacaucuggcuccgccugcgggaggucuacacucaacucugcgaccaccgacucaugagcgccgcagugaaggacgagcgggccguccacgcggauauggguuacuggaucgagagccagaagaauggguccuggaaacuggagaaggccucacugaucgaagucaagacgugcaccuggccgaagucacauacccucuggucgaacggcgugcuggaguccgacaugaucauccccaaaagcuuggccgggccuaucucccagcacaaccaccgcccgggcuaccacacacagacugcggggcccuggcaccucggcaaacuggaacuggacuucaauuauugcgagggaaccacggucgucaucaccgagaacugcgggacgcggggacccucgcuccgaaccaccaccguguccgggaaacugauccacgagugguguugccggagcugcacguuaccgccgcuucgcuacaugggcgaagacggaugcugguauggcauggagauucgccccaucucugagaaggaggagaacauggucaagucuuuagucuccgccggcuccgggaagguggacaacuucaccaugggcgugcuuugcuuggcgauccuguucgaggaggucaugcgcgggaaauucggcaaaaagcacaugaucgccgggguuuuuuucacuuucgugcuguuacugagcggacagauaaccuggagagacauggcccacacgcugaucaugauuggcagcaaugccagugaucgcaugggcaugggcgucaccuacuuggcacugaucgcgaccuucaagauccagcccuuucuggcccucggauucuuccuccggaagcugacaagccgcgaaaaccucuuauugggcguaggccuagccauggcaaccacccugcaguugccagaagacauugagcagauggcaaauggcaucgcccucggccugauggcucugaagcucaucacccaguucgaaaccuaccagcuguggacugcccugaucucgcugaccugcuccaauaccauauuuacucugacgguggccuggcguacugcgacccugauacuugccggggucucacugcugccgguuugccagucuucgucgaugcgcaaaaccgauuggcuacccauggccguagcagccaugggcgugcccccacucccccuuuucaucuucagccucaaagauacgcugaagcgcagauccuggccccugaacgagggcguuauggcggucggccucgugagcauccuggccucaagucuccuccggaacgaugugcccauggccggaccccuggucgccgggggccugcucaucgccugcuacgugaucaccgguaccuccgcugaccugacgguggagaaagccgcagacaucacaugggaggaggaggccgagcagaccggcgucagccacaacuugaugaucacuguggacgacgacgguacuaugcggaucaaggacgacgagaccgagaauauccucacgguccugcugaaaaccgcacuccugaucgucucgggcaucuuccccuacagcaucccagcaacgcugcuuguguggcacaccuggcagaagcagacucagcgguccggcgugcugugggacgucccgucuccgccggagacacaaaaggccgaacuggaggaggggguguauagaaucaagcagcaaggcaucuucgggaagacccaggugggcguaggggugcagaaggagggcguguuccauacgauguggcacgucacgcggggagccgugcucaccuauaaugggaagagacuggagcccaauugggcguccgugaagaaagacuugaucagcuacggcgggggcuggcgccucuccacacaguggcagaagggggaggagguccaggugaucgccguggagccaggcaagaaucccaagaacuuucagaccaugcccggcacguuccagaccacaacaggcgagaucggcgccauagcccuggacuuuaaacccggcacgagcgguagcccaaucaucaaccgggaggguaaaguuguggggcuguacggcaacgggguagucaccaagaacggcgguuacguaucggguaucgcccagacgaacgccgaaccggacggccccaccccagagcuggaggaagagauguucaagaagaggaaccucacgaucauggaccugcacccaggcucgggcaagacccguaaguaccugccggcgauagugcgcgaggccaucaagcggcgccuccggacguugauccuggccccgacccgcgucguggccgccgaaauggaggaggcguugaaggggcugccgauccgguaccagacgacugcaaccaaguccgagcacaccgguagggaaaucguggacuuaaugugccaugccacguucaccaugcgacucuuaucccccguccgcgugccgaacuacaacuuaaucaucauggacgaggcccacuucaccgacccugcaucuaucgcagcccggggguauauaagcacacgcguggggaugggcgaggccgccgcgauuuucaugacagccacgccgccagggacggccgacgcauucccgcaauccaaugcccccauccaggaugaagagcgcgacauccccgaacggagcuggaacucaggcaaugaauggauaaccgacuucgcggggaagacggucugguucgugccuucaaucaaggccggcaacgacauugccaauugccuccgcaaaaacgggaagaaggugauucagcugucccggaagacuuucgacacugaguaccagaaaaccaaguuaaaugacugggacuucgucgugacgacugauaucagcgagaugggcgcaaacuucaaggccgaucgcgucaucgacccgcggcguugccucaagcccgucauccugaccgacggaccagaaagagugauccucgcaggucccaugccggucacugccgccuccgccgcccagcgccgggggcgagucgggcggaacccccagaaggagaacgaccaguacaucuucaccggccagccccuuaauaaugacgaggaccacgcccacuggacggaggccaagaugcugcuggauaacaucaacacccccgaggggauaaucccagcccucuucgagccggagagggagaaguccgccgccaucgauggcgaauacagacugaagggugaaagucgcaagaccuuuguggagcugaugcgaagaggggaccucccagucugguuagcccauaaggucagcuccgagggcaucaaguacacugaccggaaguggugcuuugacggucagcggaacaaucagauccuggaggagaacauggacguggagaucuggacaaaggagggcgagaagaaaaaacucagaccuagguggcuggacgcccgcacguacagugauccgcuggcuuugaaggaguucaaggacuucgccgcgggccggaaaucaaucgcccuggaccuggucaccgaaauagggcgcgugccaagucaucuggcccaucgcacccgcaaugcccuggacaaccugguaauguugcacacgagcgaacacggggggcgggccuaccgucacgcggucgaggaguugcccgaaaccauggagacccuucuacugcucggccuuaugauauugcucacagggggcgcgauguuguuccuuaucuccggcaaggggauaggaaagacgucaaucgggcugauuugugugaucgccuccagcggaaugcuauggauggccgaaaucccguuacaguggaucgccucggcgauuguguuagaguucuucaugaugguccuauuaauacccgagcccgagaaacagcggacgccccaggacaaccagcuggccuauguggugaucgguauccucacucuggccgccaucaucgccgcgaacgagaugggccugcucgagaccacgaagcgcgaccugggaaugagcaaggagccgggcgucgugucuccuaccaguuauuuagacguggaccuccaccccgcuuccgccuggacccuguacgccgucgcaacuacggugaucacgccuauguuacggcacaccaucgagaacucgaccgccaacguaucgcucgccgccaucgcaaaccaagcggucgugcugaugggucuggacaagggguggccgaucagcaagauggaccuaggcgugccccuguuggcgcuaggguguuauucccaggucaauccccugacgcugaccgccgccgugcugcuguugaucacgcacuaugcaaucaucggcccaggccuccaggcgaaagccacccgcgaagcccagaagcggacggcugccgggauuaugaaaaacccgaccguggacggcaucaugaccaucgaccuggaccccguuaucuacgacagcaaguucgaaaaacaacugggccaggugaugcuccuggugcugugugcgguccagcuccugcugaugcgcaccuccugggcccuuugcgaagcgcugacgcuggccacaggccccaucacaacucuuugggagggcuccccagggaaguuuuggaacaccacgaucgcgguguccauggccaacauauuccggggcagcuaucuggccggugccggacucgcauucucgaucaugaaguccguggggaccgguaagcgcggcaccgggagccaaggcgagacccucggggagaaguggaaaaagaagcugaaccagcugucccggaaggaguucgaccucuacaagaagaguggcaucacggaggucgaccgcaccgaagccaaggagggacucaaacgaggugagauuacccaccacgccgugucacgcggcagcgcaaagcugcagugguuuguggagagaaacauggugaucccggaggggcgggugaucgaccucggcugcgggcggggcggcuggucguacuacugugccgggcuaaagaaggugaccgagguccgcggcuacacgaagggcggucccgggcacgaggaacccgugcccaugucgaccuacggauggaauauugugaagcugaugagugggaaggacguuuuuuaccucccgcccgagaagugcgauacacuacugugugacaucggcgagagcucccccagcccuaccgucgaggagucccguacaauucggguucucaaaauggucgagccguggcucaagaacaaccaguucugcaucaagguguuaaaccccuacaugccaaccgugaucgaacacuuagaacgccuccagcggaagcacgguggaaugcugguccgcaacccccuauccaggaacuccacacaugagauguacuggaucuccaacggcaccgggaacaucguagccucagugaacauggucagccgccuccuguugaauagguucacgaugacccacagacggccaaccauagagaaggacgucgaucuuggcgcuggcacccgccaugugaacgccgaaccagagacgcccaauauggacguaaucggggagcggaucaagcgcaucaaggaggagcacaacuccacguggcacuacgacgacgagaacccguacaagaccugggccuaccacgguuccuaugaggugaaagcgaccggguccgccagcagcaugaucaacgggguggucaagcugcucaccaagcccugggacgugguacccauggucacgcagauggcaaugaccgacaccacgcccuuugggcagcagcggguguucaaggagaaggucgacacucguaccccucgguccaugccugguacccgacggguuauggggaucacagcugaauggcucuggcggacccugggccggaacaagaagccccgccugugcacccgcgaggaguucaccaaaaaagugaggacgaacgccgcgaugggugcggucuucaccgaagaaaaccaaugggacucagccaaagcggccguggaggacgaggacuucuggaaacucgucgaucgcgagcgggagcuucacaagcuugggaagugcggcuccugcguuuacaauaugauggggaagcgcgagaagaagcucggugaguucggcaaagccaaggggagccgggcaaucugguacaugugguugggcgcucgcuacuuagaauucgaagcccucggguuccucaacgaggaccacugguucucccgugagaacucguacuccggaguggagggggagggcuugcauaagcucggguauauacugcgcgacauuucgaagauccccgggggagccauguacgccgacgacaccgcugggugggacacacguaucacugaggaugaccugcacaaugaagaaaagauuacacaacagauggaccccgaacaccggcaacucgccaacgccauauucaaacucaccuaucagaacaagguggucaagguacagagacccacccccaccggcaccgucauggacaucaucucgcgcaaggaccaacguggcagugggcaggugggcaccuauggauuaaacaccuuuaccaacauggaagcucagcuaauaaggcaaauggagggggaggggguucugagcaaggcagaucuugagaacccgcaccucccggagaagaagaucacccaguggcuggagaccaagggaguggagagguuaaagcgcauggcgaucagcggugacgacugcgucguuaagcccauagacgaccgguucgcgaaugcccuccuggcucugaacgacauggggaaggugcgcaaggauaucccgcaguggcagcccuccaaaggcuggcaugacuggcagcaggugccguucugcagucaccacuuucacgagcucauaaugaaggacgggcggaaacuggugguucccugccgcccccaggacgagcuaauagggcgagcucgcauuucccagggggcgggguggagccuacgcgaaacagccugccucggcaaggccuacgcccagauguggucccugauguacuuccaccggcgcgaucuacgcuuagcgucgaaugccauuugcuccgcagugccagugcacugggugccgaccagccgcacgaccuggucaauccacgcccaucaccaguggaugacgaccgaggauaugcugacggucuggaaccgaguguggaucgaggacaaccccuggauggaagauaagacccccgugaccaccugggaagacguccccuaccucgggaaaagggaggaccaguggugcggcucccuuauugggcuuacuagccgagccaccugggcgcagaauauaccgacugccauccagcagguccgcucccuuauaggcaacgaagaguucuuggacuacaugcccagcaugaagagguuccggaaagaggaggaguccgagggggccaucugguga

SEQ ID NO: 25898 - RNA, 9873 nt, Artificial Sequence
  derived and/or modified CDS sequence (opt11) from DENV-3__KJ189281__SS-prME
accagccucugccucaugaugauccugccggcugccuuggcguuccaccucaccucccgggacggggagccccggaugaucguggggaagaacgagcggggcaagucccugcuguucaagaccgccagugggaucaacaugugcacgcugauugccauggaccugggggagaugugcgacgacacggugaccuacaagugcccccacaucaccgagguggagcccgaggacauagacugcuggugcaaccugaccagcaccugggugaccuaugggaccugcaaccaagccggcgagcaucggcgcgacaagcgguccguggcucucgcgccccacgugggcaugggacuagacacgcgcacccaaacguggaugagcgcugagggcgcuuggcgccagguggagaagguggagacgugggcccugcgccacccgggguucaccauccuagccuuguuuuuggcccacuacaucggcaccucccucacccagaagguggugaucuucauccugcuuaugcucgugacgcccagcaugaccaugcggugcguggggguggggaaccgagacuucgucgagggccuguccggggccaccuggguugacguuguacuggagcacggcgggugcgucacgacgauggcuaagaauaagcccacccucgacaucgagcugcagaagaccgaggcuacccagcuggcgacgcuccggaagcuguguaucgagggcaagaucacuaacauaaccaccgacagccgcugucccacccagggcgaggccguccugccugaggagcaggaccagaacuaugucugcaagcacacguacguggaccggggguggggcaaugggugcggacucuucgggaagggaucccuggugaccugcgccaaguuccagugccuggagcccaucgaagggaaggucgugcaguacgagaaccucaaguacaccguaaucaucacgguccacaccggggaccagcaccaggugggcaacgaaacccagggggucaccgccgagaucacgccccaggccagcacaaccgaggcgacguugcccgaguacgggacccuggggcuagagugcucccccaggacuggccuggacuucaacgagaugauacugcucaccaugaagaauaaggccuggauggugcaccggcagugguucuucgaccugccccugcccuggaccagcggcgccaccacggagacccccaccuggaaccgcaaggagcuccuggucaccuucaagaaugcccacgccaagaagcaggaggucguggugcuggggucucaggagggcgcgaugcacacggcccucaccggcgccaccgagauccagaacagcggcgggaccuccaucuucgccggacacuuaaagugccggcugaagauggacaagcucgagcugaagggaaugagcuacgccauguguacgaauacauucguccugaagaaggaagugucagagacccagcacgggaccauccucaucaagguggaauacaaaggcgaggacgcgccguguaagauccccuucagcacggaggacgggcacggcaaggcccacaacggccgacugaucaccgccaacccggucgugaccaaaaaggaggagcccgugaacauugaggcggagccacccuucggggagucgaacaucgucaucggcauuggggacaacgcgcugaagaucaacugguacaagaagggcucgagcaucgggaagauguuugaggccacugcccggggcgcccgccggauggcaauccugggcgacacugcgugggacuucggauccguaggagggguccucaacagccucggcaagaugguccaccagaucuucgggucagcauacaccgcccuguucaguggcguguccugggugaugaagaucggcaucgggguucuccucaccuggauaggccugaacagcaaaaacaccagcaugagcuucuccugcaucgccaucggaaucaucacgcucuaccugggcgccguggugcaggcggacauggggugcguaauuaacuggaagggcaaggagcugaagugcggcagcgggaucuucgugacuaacgaagugcacaccuggacugaacaguacaaguuccaggccgacucccccaagcgccucgccaccgccaucgccggcgcgugggaaaacggagucugcggcauccggagcaccacacggauggagaaccugcuguggaagcaaaucgccaacgagcucaacuacauccugugggagaacaauaucaagcugacggugguagucggggacaucaucggugugcucgagcagggcaagcgcacgcugacgccccaaccgauggagcugaaguacuccuggaaaaccuggggcaaggcaaagaucguaacggccgagacgcagaacucauccuucaucaucgacgggcccaacacccccgagugcccgucggcgucccgugccuggaacgucugggagguggaggacuacggguuuggcguauucacgaccaacaucuggcuacgccugcgggaggucuacacgcagcuaugcgaccaccgccugaugagcgccgccgugaaggacgagagagccgugcacgcggacaugggcuacuggaucgagagccagaagaacggguccuggaaacuggagaaggccucgcucaucgaagucaaaacaugcaccuggccgaagucccacacccucuggagcaacggcgugcuggaguccgacaugaucauccccaagucgcuugccggccccauaucccagcacaaccaccgcccgggcuaucacacccagaccgccgggcccuggcacuugggaaaacuugagcuggacuucaacuacugcgagggcaccacuguggucaucaccgagaauugcgggacgcggggccccucucuccgcacgaccaccguguccgggaagcuaauccacgaguggugcugccggagcugcacgcugcccccgcuacgcuacaugggcgaggacgguugcugguacggcauggagauccggcccaucuccgagaaggaggagaacauggucaagagccuggucucugcaggcagcgggaagguggauaacuucaccaugggcgucuuaugccucgcgauccucuucgaggaggucaugcgcgggaaguucggcaagaagcacaugauugcugguguguucuucaccuucgugcugcuccuguccggccagaucaccuggcgggacauggcccacacgcugaucaugaucggcagcaacgccuccgaccgcauggggaugggcgucaccuaccucgcccugaucgcuaccuucaagauccagcccuuccuggugcucggguucuucuugagaaagcugaccagccgcgagaaccuccugcugggcgugggccucgccauggccacgacccugcagcuucccgaggacauagagcaaauggccaacgggaucgcucuaggccugauggcccugaagcucauaacccaguuugagaccuaccagcuguggaccgcccuaaucagccugacaugcaguaacaccaucuucacccugacgguugccuggcggaccgccacccugauccucgcgggggugagcuuacucccggucugccaguccucuuccaugcgcaagaccgacuggcuccccauggccguggccgccaugggcgugccaccccuaccgcuguucauauucagccucaaagacacguugaagcgccggucauggccccuuaacgaggggguaauggccgugggccucgugagcauccuggcauccagccugcuucgcaacgacguccccauggccggcccccugguggccgggggccugcucaucgccugcuacgucaucaccgggaccuccgccgaccugaccgucgagaaggcggccgacauaacgugggaagaggaggccgaacagaccggcgugagccacaaccuuaugaucaccguggacgacgauggcaccaugcggaucaaggacgaugagacugagaacauccucacgguccugcugaagaccgcccuccugaucguguccggcaucuucccguacagcauucccgccacccugcucguguggcacaccuggcagaagcagacgcagcgcuccggcgucuuaugggacgugcccucaccacccgagacccaaaaggcggagcuggaggaggggguguaccggaucaagcagcaaggcaucuucgggaagacccagguaggcgugggagugcagaaggagggcgucuuucacaccauguggcacguaacucgcggcgccgugcuaacguacaacgggaagcgccuggagcccaacugggccucagucaagaaggaccugaucagcuauggcgggggcuggcgccuauccacccaguggcagaagggcgaggagguccaggugaucgcggucgagcccggcaaaaaccccaagaacuuccagaccaugcccggcacguuccagacuaccaccggagagaucggggccaucgcgcuggacuucaagcccgggacgagcggcagcccuaucaucaaccgugagggcaaggugguggggcuguauggcaacggagucgugacaaagaauggcggcuacguguccggcaucgcccagaccaacgccgagccggauggccccaccccugagcuggaagaggagauguuuaagaagcgcaaccucacgaucauggaccugcaccccgggagcggcaagacccggaaguaccuuccggccaucguccgcgaggcgauuaagcggcgccuccggacucugauccucgcccccacccgcgugguagccgccgagauggaggaggcccucaaggggcugcccaucagauaccagacgaccgcgacgaaguccgagcacacuggcagggagaucgucgaccugaugugccacgccacguuuaccaugcggcuccugagccccgugcgcgugccgaacuacaaucugaucaucauggaugaggcccacuucaccgaccccgccuccauagccgcgcgggguuacaucagcacccgcgugggcaugggcgaggccgccgccaucuucaugacggccacgccgcccggcaccgccgacgccuuuccgcaguccaacgcccccauccaggaugaggagcgcgacauccccgagcggagcuggaacuccggcaacgaguggaucaccgacuucgcugggaagaccgugugguucgugcccagcaucaaggcgggcaacgacaucgccaacugccuccgcaagaacgggaagaaggucauccagcugagccggaagaccuucgauaccgaguaccagaagacgaagcugaaugacugggauuucguggugacgaccgauaucagcgaaaugggggccaacuucaaggccgaucgcgucauagacccccggcgcugucucaagccgguuauccugaccgacgggcccgagcggguaauucuggccgggcccaugccggucaccgcggccagugccgcccagcgcagaggccgcgucgggcgaaacccccagaaggaaaacgaccaguacaucuucaccgggcagccccucaacaacgacgaggaccaugcccacuggacggaggccaagaugcugcuggacaacaucaauaccccugaggguaucaucccggcacucuucgagcccgaacgcgagaaguccgccgcgaucgauggcgaguaccgacugaagggcgagucccgcaagaccuucgucgaguugaugcggcgcggggaccuccccgucuggcuggcccacaagguggccagcgaaggcaucaaguacaccgaccggaaauggugcuucgaugggcagcgcaacaaccagauccuggaggagaacauggacgucgagaucuggacgaaagagggcgagaaaaagaagcucagaccccguuggcuggaugcccgcaccuacuccgauccacuggcccucaaggaguuuaaggacuucgccgcgggccgcaagagcauugcccuggaccuggugaccgagaucgggcgcguaccgucccaccucgcucaccggacccgcaacgcacuugacaacuuaguuaugcuccauaccagcgagcauggcgggcgggccuaccgccacgcgguggaggagcugcccgagacgauggagacacugcucuuacuuggccucaugauucugcugaccgggggcgccaugcuguuccugaucagcgguaaggguaucggcaagacguccaucggccugauuugcgugaucgccagcuccggcaugcucuggauggccgagaucccgcugcaguggaucgccagcgcgaucguucuggaguuuuucaugauggugcucuuaauccccgagcccgagaagcagcggacgccccaggacaaccagcuggccuacguggucaucgggauccucacccuggccgccaucaucgccgcgaaugagaugggccugcucgagaccaccaagcgugaccugggcauguccaaagagccggggguggugagcccgaccuccuaucuggacgucgaccuccaccccgccagcgccuggacccuguacgcugucgcgaccacggugaucacacccaugcugagacacaccaucgagaacuccaccgccaacgucagccucgccgccaucgccaaccaggcugugguguugaugggccucgauaaggguuggcccaucuccaagauggaucucggcgucccccucuuggcucucgguugcuacucacaggugaacccccugacgcugaccgccgccguucuccugcugaucacgcacuacgcaaucaucggccccggccuccaggcgaaggccacccgcgaggcccagaagcgaacggcggccggcaucaugaagaacccgaccgucgacggcaucaugacgaucgaccuggaccccgugaucuacgacuccaaguucgagaagcagcuaggccaggugaugcuccugguccugugcgcggugcaacuccugcuuaugcgcaccagcugggcccucugcgaggcccugacucuggccaccggccccaucaccacccucugggagggcucccccgggaaguucuggaacacgaccauugcugugagcauggccaacaucuuccggggcuccuaccuggccggggccggccuugccuucucgauuaugaagucggucggaaccggcaaacgcggcaccgggagucagggcgagacccucggggaaaaguggaagaagaaacugaaccagcugucccggaaggaguucgaccucuacaagaaguccggcaucacggaggucgacaggaccgaagcgaaggaggggcugaagcggggcgaaaucacgcaccacgccgugagccgaggguccgccaagcugcagugguucgucgagagaaacauggugauuccggaggggcgcgugaucgaccucggcugcgggcggggcggguggagcuacuacugugccggccugaaaaaggucaccgaggugagaggcuacacgaagggcgggcccgggcacgaggagcccguaccuaugagcaccuacggauggaauaucgucaaacuuaugagcgggaaggacguguucuacuugccgcccgagaagugcgauacccugcucugcgacaucggcgagagcagucccucgcccacuguggaagagagccgcacgauccggguucugaagaugguggaaccguggcucaaaaacaaucaguucugcaucaaagugcugaaccccuacaugccuaccgucaucgaacaccuggagaggcuccagcggaagcacggcgggaugcuggugcgcaacccccucucccggaacagcacccacgagauguacuggaucuccaacggcacuggcaacaucguggccagcguaaacauggugucccgcuuacugcugaaccguuucacgaugacucaucgccggccgaccaucgagaaggacgucgaccucggcgcgggcacacgccacgucaaugccgagcccgagacuccaaacauggaugucaucggugagagaaucaagcgcaucaaggaggagcacaacucaaccuggcacuacgacgacgagaacccguacaagaccugggcuuaccacggguccuacgaagugaaggccaccgguagcgccucuucuaugauaaacggcgucgugaagcugcugacgaaacccugggacguugugcccauggugacccagauggcgaugaccgacaccacucccuucgggcagcagcgggucuuuaaggaaaagguggacaccaggaccccgagaagcaugcccggcacccgccgggugaugggcaucacugccgaguggcuguggcgcacccuggggcggaacaaaaagccccgccuguguacccgcgaggaguucaccaagaagguccggacuaaugccgccaugggcgcgguguucaccgaggagaaccagugggacucggccaaggcugccguggaggacgaggacuucuggaaacuugucgaucgcgagcgggaacuacacaagcuggggaagugcggcagcugcguguacaacaugauggggaagcgcgaaaagaagcucggugaguucggcaaagcaaaggggucccgggcgauaugguacauguggcugggcgcccgcuaucuggaguucgaggcucucggcuuccugaacgaggaccacugguucucgcgggagaacuccuacucaggcguagaaggggagggccugcacaagcucggcuacauacugcgcgacaucuccaagauccccgggggcgccauguacgccgacgauaccgcggggugggacaccagaaucacggaggacgaccugcacaacgaggagaagauaacccagcagauggacccggaacaucgacagcucgccaacgccaucuucaagcugacauaccagaauaaagucguuaaggugcaacggcccacccccaccggcacggugauggacaucaucagccgcaaggaucagcgggguuccggccagguaggcaccuacgggcuuaacaccuucaccaacauggaggcccaacucauuagacagauggagggcgagggggugcugagcaaggcggaccuggagaacccccaccucccggagaagaagaucacgcaauggcuggagaccaagggcgucgagcggcugaagcgcauggcgaucuccggcgacgacugcguggugaagcccaucgacgaccgguucgccaaugcccuccuggcccugaacgacaugggcaagguccgcaaggacaucccccaguggcaaccaucgaaaggcuggcacgacuggcagcaggucccguucugcucccaucacuuccacgagcucaucaugaaagacgggcgcaagcugguaguccccugccgcccacaagacgagcucaucggccgggcccgcaucucccagggggcgggcuggucccuccgcgagacagccugccugggcaaggccuacgcccagauguggagccugauguacuuccaccgucgcgaccugcggcuggcguccaacgccaucugcagcgccgugcccgugcacugggucccgaccucccguacgaccugguccauccaugcccaccaccaauggaugaccacagaggacaugcugacaguguggaaucgggucuggaucgaggacaaccccuggauggaagacaagacccccgucaccaccugggaggacgugcccuaccuugggaagcgcgaggaccaguggugcggaagccuuaucgggcugacgucccgggccaccugggcgcaaaauaucccgacugccauccaacagguccgcagccucaucggcaacgaggaguuccuggacuacaugcccucaaugaagcgcuuccgcaaggaagaggaaagcgagggggccaucugguga

SEQ ID NO: 25899 - RNA, 9873 nt, Artificial Sequence
  derived and/or modified CDS sequence (opt11) from DENV-3__KJ189282__SS-prME
accucccucugccucaugaugauccugcccgcugcucucgcuuuucaccucacaagccgggacggggagccgaggaugaucguggggaagaacgagcggggcaagagccugcuguucaagaccgccucgggaauaaacaugugcacauugaucgccauggaccugggggagaugugcgacgacaccgugaccuacaaguguccccacaucacugagguggagcccgaggauaucgacugcuggugcaaccuaacaagcacaugggugacauaugggaccugcaaccaggccggcgaacaccggcgcgacaagcgguccguggcacucgcgccucacgugggcaugggacucgacacucgcacccagaccuggaugagcgccgagggcgcauggcgccagguggagaagguggagacgugggcccugaggcauccgggguucaccauccucgcgcuuuuuuuggcgcacuacaucgggaccucucuaacccagaagguggugaucuucauccuguugaugcucgugacgccaaguaugacgaugcggugcgugggggugggaaaccgggacuucgucgagggccugucuggggccacaugggucgaugugguccuggagcacggcggaugcgugaccacgauggccaagaacaagcccacccuagauaucgagcugcagaaaaccgaggcaacccagcuggcgacgcuccgcaagcugugcaucgaggggaagauuaccaauauuaccaccgacagccgcugccccacgcaaggcgaggcgguccugcccgaggagcaagaccagaacuacgucugcaagcacaccuauguggacaggggguggggcaacgggugcggacucuucgggaagggcucccugguaaccugcgccaaguuucagugcuuggagcccauugaaggcaaggucgugcaguacgagaaccucaaguacaccgugaucaucacgguccacacgggggaccaacaccaagugggaaacgagacccagggcguaaccgccgaaauaacgccccaagccagcacgaccgaagcgacacugcccgaguacggcacccuggggcucgagugcucgccgcgaacggggcuggacuucaaugagaugauccugcucaccaugaagaacaaggccuggaugguucaccgacagugguucuucgaccugccccugccauggaccaguggcgccacuacggaaacccccaccuggaaccgcaaggagcuccuggucaccuucaagaacgcgcacgccaagaaacaagaggucgugguguuggguucccaggagggggcgaugcacaccgcccucaccggggccacggagauccagaacagcggcgggaccuccaucuucgccggacaccugaagugucggcugaagauggacaagcucgagcugaagggcaugagcuacgccaugugcacgaacacuuuuguccugaaaaaggaggugucugagacccagcacgggaccauccucauaaagguggaguauaagggcgaggacgcgccaugcaagauccccuucaguacggaggacgggcauggcaaggcucacaacggccgccuuaucaccgccaaccccguugugaccaagaaggaggagccuguaaauaucgaggccgagccacccuucggggagagcaacaucgucaucgggaucggggauaacgcacugaagaucaacugguauaagaaaggcuccagcaucgggaagauguucgaggccaccgcccggggcgcacggcggauggccauacucggcgacacggcgugggacuucggguccguggguggggugcucaacagccugggcaagaugguccaccaaauuuucgguuccgcauauacugcccucuucagcggcguuuccugggugaugaagaucgggauugggguccugcugaccuggaucggccugaacagcaagaacaccuccaugagcuucuccugcaucgccaucggaaucaucacguuguaccugggugccguggugcaagcggacauggggugcgucaucaauuggaagggcaaggagcucaagugcggcuccgggaucuucgugaccaacgaggugcacaccuggaccgagcaguacaaauuccaggccgacagccccaagcgccucgcaacggccaucgccggcgcgugggagaauggggucuguggcauccgcagcaccacccggauggaaaaccugcuguggaagcagaucgccaacgagcugaacuacauccugugggagaacaacauaaaacucaccgugguggucggugacaucaucggcauacucgagcagggaaagcgcacguugacgccccagccgauggagcugaaguacagcuggaagaccugggggaaggcaaagauagugaccgccgagacgcagaacagcucuuucauaauugacggccccaacacacccgagugcccaagcgcgagucgcgccuggaacguaugggaagucgaggacuacggcuucggcgucuucaccaccaacaucuggcuccgcuuacgggaggccuacacccagcucugugaccaccgccucaugagcgccgccgugaaggacgagcgggcgguccacgccgacaugggcuacuggaucgaaucacagaagaacggguccuggaaguuagagaaggccagccucaucgagguaaagaccugcaccuggccgaagucccacacccucuggagcaacggcgugcuggaguccgacaugaucauacccaagagccuggcagggcccaucucccagcacaaucaucgcccgggcuaccacacccagacggcaggcccauggcaccucgguaagcuggaacuggacuucaauuauugcgaaggcaccaccgucguaaucaccgaaaacugcgggacgcguggccccucgcuccgcaccaccaccgucuccggaaaguuaauucacgaguggugcugccgguccugcacccugcccccgcucagguacaugggcgaggacggguguugguacggcauggagauacggcccaucuccgagaaggaggagaacauggucaaaagccugguaagcgcgggcagcgggaagguggacaacuuuaccaugggcgugcuuugccuugcaauccuguucgaagaggugaugcgggggaaguucggcaagaaacacaugaucgccgguguguucuuuacuuucguccugcuccuaucuggacagauuacauggcgggacauggcccauacccuuauaaugaucggcagcaaugccuccgaucgcauggguaugggcgugaccuaccucgcacugaucgccaccuucaagauccagcccuuccuggcccucggauucuuccugcggaagcugaccagccgcgagaaucuguugcugggcgugggccucgccauggcgacgacccugcagcugcccgaggacaucgagcagauggccaauggcaucgcucucggacugauggcucugaagcucaucacccaguucgagacuuaccaguuguggacggcccugaucagccugaccugcuccaacacuaucuucaccuugacggucgcguggcggaccgccacccugauccucgccggggugagccugcugccagugugccaguccagcuccaugcgcaagaccgauugguuacccauggccgucgccgcgaugggcgugccgccccucccacuguucaucuuuagccucaaggacacgcugaagcgccgguccuggccccucaacgaaggggucauggcggugggccucgugagcauucuagccuccucacugcuccgcaacgacguucccauggccggucccuuaguggcggggggccugcugaucgcgugcuacgugauuaccgggaccuccgccgaccugaccguugagaaggcugccgacaucacgugggaggaagaagccgagcagaccggcgugagccacaaccugaugaucaccgucgacgacgacgggaccaugcggauaaaggacgacgagaccgagaacaucuugacgguccuucugaagacugcgcuacugaucguguccggcauauucccauacucgauccccgcuacccugcucguguggcacaccuggcaaaaacagacgcagcgcuccggcguccugugggacgugccaagcccgcccgagacccaaaaggccgaguuggaggaggggguguaccggaucaagcagcaaggcaucuucggcaagacccagguuggcgugggggugcagaaggagggcguauuccauaccauguggcaugugacgcguggcgcuguucucaccuacaacgggaagagacuggagccgaacugggcguccgucaagaaggaccucaucucguacggcgggggcuggcggcucuccacccaauggcagaaaggggaggagguccaagugaucgccguggagcccgggaagaaccccaagaacuuccagaccaugcccggcacguuccagaccacgacaggggagaucggcgccaucgcccuggacuucaagccggggacgagcggcagccccaucaucaaucgggagggcaagguggugggucuguacggcaauggcgucgugaccaagaauggcggguacguguccgggaucgcccagaccaaugcggagccggacgggcccacccccgaauuggaggaggagauguuuaagaagaggaaccucacgaucauggaccugcacccggggagcggcaagacccguaaguaccugccggccaucguccgcgaagccaucaaacggcgccuccggacucugauccuggcccccacccgcgugguggcagcggagauggaggaggcccucaaggggcugcccauccguuaccagacuacugccaccaaguccgagcacacgggccgcgagaucgucgaccugaugugccaugccaccuucaccaugagacuguugagccccgugcgcgugccgaacuacaaccugauuaucauggacgaggcccacuuuaccgaccccgcguccaucgccgcccgcggguacaucucuacccgugucggcaugggcgaggccgcggccaucuucaugacggccacgccgcccggcaccgccgacgcuuucccgcaguccaacgcucccauccaggaugaggagcgcgauaucccugagcgaagcuggaacuccgguaacgaauggaucaccgacuucgccgggaagacggugugguucgugcccagcaucaaggccggcaacgacaucgccaacugccuccgaaagaacgguaagaaggucauucaacugucccggaagaccuucgauaccgaguaucagaagaccaagcugaacgacugggauuucguggugacgacagacauuagcgagaugggcgcuaauuucaaggcggaccgaguaaucgacccucggcgcugccucaagcccgugauccugaccgauggccccgagagggugauccuggcugggcccaugccggugaccgccgccuccgcggcucagcgccggggcagagucgggcggaacccgcagaaggaaaaugaccaguacaucuucaccggucagccccucaacaaugacgaggaccacgcccauuggacggaagccaagaugcuacuggauaacaucaacacgcccgaagggaucaucccggcccucuuugagcccgagcgcgagaaguccgcagccauagacggcgaauaccgccugaagggcgagucccggaagacguucguggaacugaugcggaggggggaucuccccgucuggcuggcucacaagguggccagcgagggcauaaaguacaccgaccguaagugguguuuugacggucaacgcaauaaccagauucuggaagaaaacauggauguggagaucuggaccaaggagggcgagaaaaagaagcuucgcccucgcuggcuggacgcccgcaccuacuccgacccgcuggcacugaaggaguucaaggauuuugccgccggcagaaagagcaucgcccuggaccuggucacggagaucgggcgcguaccuucgcaccucgcccacaggacaagaaacgcgcuggacaacuuggucauguugcacacgagcgagcacggcggucgggccuaucgccacgccguggaagaguugcccgagaccauggagacccugcugcugcugggccucaugauccuguuaaccgggggggccaugcuguuuuugauuagcggcaaagggaucggcaagacgucgaucgggcugaucugcgugauagccagcuccgggaugcuuuggauggcggagaucccacugcaauggaucgccagcgccaucguacuggaauuuuucaugaugguacuccugauccccgaacccgagaagcagcggacgccccaggacaaucaacuggccuacguggucauugggauccucacacuggccgcgaucauagccgcgaaugagaugggccugcuugagacgacgaagcgcgaccugggcauguccaaggagccggggguggugagccccaccuccuaccuggacgucgaccuccacccagccagcgcguggacccuguacgccguggccaccacggugaucacccccaugcugcggcacacuauagaaaacuccacggccaacgucucccucgccgcaaucgccaaccaggccguggugcugaugggccuggacaagggcuggccgaucuccaaaauggaccuuggcgucccccuguuggcccuggguugcuacucccaggugaacccccugacgcucacggccgcggugcuccugcugaucacccacuacgccaucauaggccccggauuacaggccaaggccacccgcgaggcccaaaagcggacggcagccggcaucaugaagaacccgaccgucgacgggaucaugacgaucgaccuggaccccgugauuuacgacuccaaguucgagaagcagcugggccagguuaugcucuuaguccugugcgccguccagcuccuacugaugcggaccagcugggcccucugcgaggcgcugacgcuggccaccggcccaauuaccacccucugggagggcucccccgggaaguucuggaacacgaccauagcugugagcauggccaacaucuuccguggcuccuaucucgcaggggccggccuggccuucagcauuaugaaguccgucgggaccggcaaaaggggcaccggcagccagggcgagacccucggugagaaauggaagaagaagcugaaucagcugagcagaaaggaguucgaucucuauaagaaaucgggcauuacggagguggaccgcaccgaggcaaaagaagggcugaagcggggcgagaucacccaccacgcggugagccggggcagcgccaagcugcagugguucguugaacggaacauggugauuccggaggggcgcgugaucgaccugggaugcggccgggggggguggagcuacuacugcgcgggccugaagaagguuaccgaggugcgcggcuauacgaagggcggccccgggcacgaggagcccguccccauguccacuuacggcuggaacaucgucaagcugaugagcggaaaggacguuuucuaccucccucccgagaagugcgacacccugcugugcgacauuggcgagucaagccccucccccaccgucgaggagagccgcacuauccggguccugaagaugguggagcccuggcucaagaauaaccaguucugcaucaagguccugaaccccuacaugcccaccgucaucgaacacuuagagaggcuccagcggaagcacggcgggauguuagugagaaauccccugucccggaacagcacccacgaaauguacuggaucagcaauggcacagggaacaucguggccagcgucaacauggugucucgccuccuguugaaccgguucacgaugacacaccgccggccuacuaucgagaaggauguggaucucggagcgggcacgagacacgucaaugccgagcccgagacccccaacauggacgugaucggggagcgcaucaaacguaucaaggaagaacacaacaguaccuggcacuacgaugacgagaauccguacaagaccugggcauaccacggcuccuacgaggugaaggcgaccgggagcgccuccagcaugaucaacggcgucgugaagcugcugacaaagcccugggaugugguccccaugguaacccaaauggcgaugaccgacacaacgccguucggucagcagcgggucuucaaggagaagguggacacccgcaccccgcggagcauggccgguacgcgucgggugauggggaucacggccgaauggcucuggaggacccuggggcgaaacaaaaaaccacgccugugcacucgcgaggaguucaccaagaaggugcguacgaacgccgcaaugggugccgucuucaccgaagagaaccagugggacuccgccaaggcagcaguugaggacgaggacuuuuggaagcucguagaccgcgagcgggagcugcacaagcugggaaagugcggcagcugcguguauaacaugauggggaagcgcgagaagaagcucggggaguucggcaaggccaaagggucccgggccaucugguacauguggcugggcgcccgcuaccuggaguucgaagcacugggguuccuuaacgaggaccacugguucucacgggagaacuccuauuccggcguggaaggcgaaggccugcacaagcugggcuacauucugcgcgauaucuccaagaucccaggcggcgccauguacgccgacgacaccgccgguugggacacccggaucacggaggacgaccugcacaacgaggagaagaucacccaacaaauggaucccgaacaccgccaguuagccaacgcgauuuucaagcugaccuaccagaauaaagucgugaaagugcagcggccaacccccacgggcacggugauggacaucaucagccgcaaagaucagcggggcuccggccaggugggcaccuacgggcugaacaccuucaccaacauggaggcccaguuaauucgccagauggaaggcgaaggagugcugagcaaggccgaccuggagaauccccauuuacccgagaaaaaaaucacgcaauggcuggagaccaagggcguggagcggcugaaacgcauggccauauccggcgacgacugcguggucaagccgaucgacgaccgcuucgccaacgcccucuuggcccugaacgacaugggaaagguccguaaggacaucccucaguggcagcccucaaagggcuggcacgacuggcagcaggugcccuucugcucccaccacuuccacgagcucaucaugaaggacggacggaagcuggucgucccgugucgcccccaagacgagcugaucggccgcgcccgcaucagccagggggccggguggucccuccgcgagaccgcgugccugggcaaagcauacgcccagauguggagccuuauguacuuccaucgacgcgaccuucggcuggccuccaacgcuaucugcagcgcugugccaguucacuggguccccaccucucgaacgaccuggagcauccaugcccaccaccaguggaugaccacggaggacaugcugaccguguggaaucggguguggaucgaagacaacccauggauggaggauaagaccccagugaccaccugggaggacgugcccuaccucgggaagcgcgaggaccagugguguggcagccugaucgggcugacgucccgcgccaccugggcgcaaaacauccccaccgccauccagcagguccgcagccucaucggcaacgaggaguuccuggacuacaugccgucaaugaagcgauuccgcaaggaggaggagagcgagggggcgaucugguga

SEQ ID NO: 25900 - RNA, 9873 nt, Artificial Sequence
  derived and/or modified CDS sequence (opt11) from DENV-3__KJ189283__SS-prME
accagccugugucucaugaugauccuaccugcugcccuggccuuccaccuaacgucgcgggauggagaaccgcgaaugauagucgguaaaaaugaacgaggcaaaucccuacucuucaagaccgccagcgggaucaacaugugcaccuuaauagccauggaccucggcgaaaugugugaugacacggucacauauaaaugcccccacaucacggaagucgaaccggaagacaucgacuguuggugcaaccuaaccaguacuugggugacguacgggacaugcaaccaagccggugagcaccggcgcgacaaacgaucaguggcccuggccccucacguaggcaugggacuggauacccggacccaaaccuggaugagcgcggaaggggcguggcggcaaguggaaaaaguagaaacgugggcuuugcggcacccuggguucacgauccuggcacuguuucuugcucauuacaucggaaccagcuuaacgcaaaaaguagugauauucauccuacuaaugcuggugacaccgucaaugacgaugcguugugucggagugggaaacagggacuucgucgaagggcuaaguggcgcaacaugggucgacgugguccucgagcacgggggcuguguaaccacuauggccaagaacaaaccgacacucgacauagaacugcagaaaacugaagcaacacagcuugcuacccuccgaaaacucuguaucgaaggcaagauaacaaauaucaccacagacuccagauguccgacacaaggcgaggcuguacuaccagaagaacaagaucaaaauuacgugugcaaacacaccuacguggacagaggauggggaaacggcugcggacucuucggcaagggaucccucgugaccugugcaaaauuucaaugccuggaaccaaucgaagggaaaguaguacaauacgaaaaccucaaauacacgguuaucaucacaguccauacgggagaucaacaccaaguaggaaaugaaacacaagggguuaccgcggagauaaccccacaagcaagcaccacggaagccacccuaccggaauacggaacccuaggacuagaaugcuccccgagaacaggcuuagacuucaacgaaaugauacuguugaccaugaaaaauaaagccuggaugguacaccgacagugguucuucgacuugccacuaccauggacaagcggagcgacaaccgagaccccgaccuggaacagaaaggaauugcuuguuaccuucaagaaugcacacgccaagaagcaagaggugguaguccuugggucccaggagggcgcuaugcacacggcacuaaccggugcgacagaaauccagaacucuggcggaaccagcaucuuugcaggccaucugaaaugccgauugaagauggacaagcuggagcucaagggcaugagcuaugccauguguacgaauacuuucguccucaagaaagaaguaagugagacacagcaugguacgauccuuauaaagguggaguauaagggcgaagacgcgccuugcaagauacccuuuaguacggaagacgggcauggaaaggcacacaacggcagacucauaacagcaaauccggucgucacaaagaaggaagaacccguaaacaucgaagcggaaccuccguucggagagagcaauaucgugauagggaucggcgauaacgcccuaaaaauaaacugguauaagaaaggcuccagcauaggaaaaauguucgaagccacugcgcgcggcgcaaggcgaauggccauccugggcgauaccgcgugggacuuuggcagugugggcgggguccuaaacagccucgggaagaugguacaucaaauauuugguucugcguacaccgcgcuauucagcggcgugucaugggucaugaagauagggaucgguguacugcuaaccuggaucggacucaacucuaagaauacaagcauguccuucagcugcauugccaucgggauaaucacgcuauaucuaggagcagucguucaggcugauaugggcugcguaaucaacuggaaggggaaagaacucaagugcggauccggaauauucgucacaaacgaagugcacacguggaccgaacaguacaaguuucaagcagacuccccgaaaagacucgcgacugcuauagcgggagcaugggaaaauggggucugcgggauacguuccacgaccaggauggagaaccuacuauggaaacagaucgcuaaugaauuaaacuauauccucugggagaauaacauaaaauuaaccgucguaguaggagacauaauaggcguccuagaacaaggaaaacguacgcuaacaccacaaccgauggaauuaaaauauagcuggaaaacguggggaaaggcaaaaaucgucaccgcugaaacucagaacagcagcuucauaauagacggccccaacacgcccgaauguccaagugcaucgagagccuggaacgucugggaggucgaggauuacggcuucgguguauucacuacaaacaucuggcugagacuccgcgaaguguauacccaacucugcgaccaccgacucaugucggcagcaguaaaggaugaacgagcgguacacgcagacaugggauacuggaucgaaagccaaaagaacggcagcuggaaacuagaaaaggcgagucugauugaagugaagacgugcacguggcccaaaucacacacgcuaugguccaaugggguacucgagagcgacaugauaaucccgaaauccuuggcaggaccgauaucccaacacaaccaccgacccggauaucacacccagacagccggcccguggcaccucgggaagcuggaacuagauuucaacuauugugagggaacaaccguaguaaucacggaaaacugcgggacccgagguccaagccugaggacgacaaccguaaguggcaaacucauacacgaaugguguugcagaucgugcacgcuacccccgcuacgguacaugggggaagauggauguugguaugguauggaaauacgaccuauuucugaaaaagaagagaacauggucaagucacucguaucugcggggucagggaaaguggacaacuucacgaugggcguguuaugccucgcgauccuuuucgaggaagugaugagagggaaauuugggaagaaacauaugauagcggguguauucuucacauucguacugcuacuaucgggccagauaacauggagggauauggcccauacacucauaaugauaggaucaaaugcaucggaccggaugggcaugggagugaccuaccuugcacuaauagcgaccuuuaaaauccaaccguuccuggcgcuuggcuucuuucuaaggaaacugacgaguagagaaaaccuccuauugggcguuggacuggcaauggccacgacacuccaauugcccgaagacauagaacagauggcaaauggaauagcucucggacugauggcgcucaaacuuauaacgcaauucgaaacguaccagcuauggaccgcauuaauaagucuaacgugcaguaaaacaaucuucaccuuaacuguggccuggcgcacggccacccucaucuuggcaggaguaagucuccugccagugugucaauccuccaguaugcggaaaacggacuggcuacccauggccgucgccgcgaugggugucccaccccucccucuguucauauucagucuuaaggacacauuaaaaagaagaucauggccacugaacgaggggguaauggcagucgggcuuguaucgauacuggcaagcucacuacuuaggaacgauguacccauggcagggccccuaguggcuggcggacuccuaauagccugcuacgucaucacaggaacauccgcggaucucacugucgagaaggcugcugauauaacaugggaagaagaggccgaacagaccggugugucacacaaucucaugauaacagucgacgacgacggaaccaugcgcaucaaggacgacgaaaccgaaaacauacucacgguccugcuaaaaacagcccuccuuauaguuucaggaaucuuccccuacucaauacccgcaacccuccuaguauggcacaccuggcagaaacagacgcagcgaaguggggugcuuugggacguaccgucacccccggaaacccaaaaggccgagcuagaagagggcgucuaucggauaaagcaacaagguauauucggaaaaacucaaguuggcgucggugugcaaaaagaagguguuuuccacacaauguggcacgucacaaggggcgcggugcuaacguauaacgggaaacggcuagagcccaacugggcuagcguaaagaaagaccuaaucagcuacggaggcggguggagacucuccacccaguggcagaaaggugaagagguccaagucauagccguggaacccggcaaaaaccccaaaaauuuccaaacaaugccaggaaccuuucagaccacuaccggggagauuggugcgauagcacuugauuuuaaacccggcacaagcgguuccccaauaauaaaccgagagggcaaaguugucggauuguacgguaacggagugguuacgaaaaacggcgguuauguaucgggcauugcacaaaccaacgcagaaccugacgguccaacacccgaacuagaagaggaaauguucaagaaacgaaaccucaccaucauggaccuccaccccgggaguggcaaaacacgcaaauaccugccggcaaucgucagggaggcaaucaagcgaagacuccgcaccuugauauuggcacccacccgaguuguagccgcagagauggaagaagcccucaaaggacuaccaauacgcuaccaaacgacugcuaccaagagugagcauaccggacgagagaucguugaucuaaugugccacgccacguucacaaugagacuccuuagcccagugcgcguucccaauuauaaccuaaucauaauggaugaagcgcauuucacggauccagcaagcaucgcggcaagaggguauaucucgacccgaguugggaugggagaggcggcagccauuuuuaugacagcgacacccccagguacugcagaugccuucccacagagcaacgcacccauacaggacgaggaacgcgauaucccggaaaggagcuggaacucgggaaaugaguggauaacggauuucgcggguaaaacugugugguucgugccguccauuaaagcaggaaacgacaucgcaaacugcuuacggaaaaacgggaaaaagguaauucaacuauccagaaaaacauuugauaccgaauaccagaaaaccaagcugaacgacugggacuuuguggucacgacagacauauccgaaaugggugcgaauuucaaggccgauagagucaucgacccccgccgaugccucaagccaguaauccucacugacggucccgaacgcguaauccuagcaggaccuaugccggugacggccgcgagcgcggcacagcgucguggucgaguaggucguaacccacaaaaagaaaacgaccaauacaucuucaccggacaaccgcuaaacaacgacgaggaccaugcccacuggacggaagcaaaaaugcuacucgacaauauaaacacuccggagggaauuauaccagcccuguucgaaccagagagggaaaagagcgccgccauagacggagaauaccgccuuaagggcgaaagcaggaagacauucguagaacugaugagaaggggugacuuaccagucugguuggcgcacaaaguagcauccgaaggaaucaaguacaccgaucgaaaaugguguuucgacggacagcgcaauaaucaaauucuagaggaaaacauggacguggagauauggacaaaagaaggagaaaagaagaaacugaggccucgauggcuggaugcccgaacguacagcgacccgcuggcacuaaaagaguuuaaagauuucgcagcaggacguaaaucgaucgcgcuagauuuggugaccgaaaucgggcgaguuccgagccaccuagcucaccgaacacgcaacgcccuggauaacuugguaaugcuccacacaagugagcauggcggccgagcauacaggcacgcggucgaagaauugccagagacuauggaaacucuucucuuacuggggcuuaugauucuccuaacagguggagccaugcuauuccugauaagcggcaaaggcaucgguaaaacaagcauaggacuaaucugcguaauagcgagcucagggaugcuauggauggcagaaaucccgcuacaguggauugcauccgcuauuguguuggaguuuuucaugaugguucuacucaucccagagcccgagaagcaaagaaccccucaggacaaccaacucgccuaugucgucaucggaauacuuacccuggcggcgaucauagcugccaacgaaaugggccuacuggagacgaccaaacgagaccucggaaugagcaaggagccaggggucgucuccccaaccucuuaccuggacgucgacuugcaucccgcgucggccuggacacuauacgccguagcaacaacagugaucacgcccaugcuccgccauaccaucgaaaacucaacagccaacgugagcuuggccgcaaucgcgaaccaggccguaguucucaugggacucgacaaaggauggccgaucuccaagauggaccuaggcguaccacuacuggcccucggauguuacucacagguuaacccgcucacauuaaccgcagcgguucuacugcucauaacccacuacgcuaucauaggcccaggacuccaggcuaaagcgacccgcgaagcgcaaaaacgcacagcagccggaaucaugaagaacccgacggucgacggaaucaugacaauagaucuugaccccguuaucuacgacuccaaguucgagaaacaacugggccagguuauguuacucguuuugugcgcaguccaacugcuacugaugcgaacaagcugggcucugugcgaggcgcuaacccuagcaacaggcccaaucaccacucuaugggaagggagcccagguaaauucuggaauacaaccaucgcagugagcauggcaaacaucuuccgaggaucauaccuggcgggggcagggcuggcuuucagcaucaugaaaagcguaggaaccggcaaacgaggaaccgggucgcaaggagaaacacuaggugagaaauggaaaaagaaacuaaaccagcuaucgcguaaagaguucgaccuguauaagaaaagcggaauaacagaagucgaccgaacggaagccaaggagggccugaaaagaggggaaaucacucaccaugccgucagccguggcagcgcaaaacuccaaugguucguugaacggaacaugguaaucccagaaggacgagucauagaccuaggcugcggccgugguggcuggucauacuauugugcggggcucaagaaagucacggagguaagagguuacacaaaagggggccccggucacgaagaacccguaccaaugucgaccuacgguuggaacauagugaaacucaugagcgggaaagacgucuucuacuugcccccagaaaagugcgauacccuccuuugugauauaggggaguccagccccaguccaacgguagaggagucaagaaccaucagaguacugaagauggucgaaccuugguugaaaaacaaccaauucugcaucaaaguccuaaaccccuacaugcccacuguaauagagcaccucgagcgccuucagcgcaaacacgguggaaugcugguuaggaacccucucucgagaaacaguacccacgagauguacuggauaagcaauggaacgggcaacaucguggccagcguaaauauggucagccgccuacugcuaaacagguucaccaugacacacagaaggccaacgaucgagaaagacgucgauuuaggcgcaggcacacgccacguaaacgcagagccugaaacgcccaacauggacguaaucggagaacgaauaaagcgcauaaaggaagaacacaacaguacuuggcauuacgacgaugagaauccauacaagacgugggcguaccauggaucauacgaaguaaaggcgaccggcucagccucgaguaugaucaauggcgucguaaaacuucuuacgaagccaugggacguaguuccaauggugacccaaauggccaugacagauaccacgccguuugggcagcaacgcguuuucaaagaaaagguggauacaagaacaccccggaguaugccgggaacccgccgggugauggguaucaccgcagaauggcucuggcgcacccucggucgcaacaagaaaccacggcucugcacgcgcgaagaguucaccaagaaaguccgcaccaacgccgcuaugggagccguguucacggaagaaaaccagugggacagcgccaaagcagcgguugaggacgaggacuucuggaaguugguggaccgagaacgcgaauuacacaagcugggcaaaugcggcuccugcgucuauaacaugauggggaaaagagagaagaagcucggcgaguucggcaaggcaaaaggaagccgagccauaugguauauguggcucggcgcgagguaccuugaguucgaggcucucggcuuccuaaacgaagaccacugguuuucgcgcgagaacuccuacucgggaguagagggcgagggccuacacaaacuuggcuacauccuaagggacaucaguaaaaucccuggcggcgcaauguacgccgaugacaccgccggaugggacacccgaaucaccgaggacgaccuacacaaugaggaaaagaucacccaacaaauggaccccgaacauagacagcuggccaacgcuaucuucaaacugacguaucaaaauaaaguagucaaaguacagcggccgacccccacaggcacagucauggauauaaucucaaggaaggaucagcggggaagcggccaagucgggaccuacggccucaacaccuucacaaacauggaggcccaacuaauccggcaaauggaaggcgaaggcguacuaagcaaagcggaccucgaaaacccgcauuugcccgagaaaaagauaacacaguggcuggagaccaaaggaguggagcggcuuaagaggauggccauuagcggcgacgacugugucgucaagcccauagacgaccgauucgcgaacgcucuccuagcccucaaugauauggguaagguaagaaaagacauuccacaguggcagccuucaaaaggauggcaugauuggcaacaaguuccauucugcucccaccauuuucaugagcugaucaugaaagauggccgcaagcuggugguucccugucgcccccaggacgagcuuauugggcgagcacggauaucccaaggcgcaggcuggagccuccgcgaaacagccugccuaggcaaggccuaugcgcagauguggucacucauguacuuccaccgccgcgaccuacgccuagccaguaacgcaauauguagcgcgguacccgugcauugggucccgacgucgagaaccaccuggucuauccacgcacaucaccaauggaugacaacugaagauaugcuaacaguauggaauagaguauggauugaagacaacccguggauggaagauaaaacaccaguaacaaccugggaggacgucccuuacuuaggcaaacgugaggaccaauggugcggaucccuuaucggguuaaccucacgugcaaccugggcacaaaacauacuaacagccauccagcaaguaagaucguugaucggaaacgaagaguucuuggacuauaugccgagcaugaagagauuucgaaaggaagaggaaagcgaaggcgcaaucugguga

SEQ ID NO: 25901 - RNA, 9873 nt, Artificial Sequence
  derived and/or modified CDS sequence (opt11) from DENV-3__KJ189284__SS-prME
acuucgcucugucuaaugaugauccugccugccgcccuugccuuccaccucaccuccagggacggggagccccggaugaucguggggaagaaugagcggggaaagagccugcuguucaagaccgccuccgggaucaacaugugcacccucauagccauggaccugggggagaugugcgacgacacagugaccuacaagugcccccacaucaccgagguagagcccgaggauaucgauugcuggugcaaccugaccagcaccugggugaccuacgguaccugcaaccaggccggugagcaucggcgcgacaagcggaguguggcccucgcgccccacgugggcauggggcuggauacccgcacccagaccuggaugucagccgagggcgccuggcgccagguggagaagguggaaacgugggcccugcgccacccgggguuuaccauccucgcgcuguuccuggcccauuacauugguaccucccucacccagaagguggugauauucauccuucuaaugcucgucacgcccagcaugaccaugcggugcgugggggugggcaaccgcgacuucgucgagggccuguccggggccaccuggguggaugugguccuggagcacggagggugcgugaccacgauggccaagaacaagcccacccucgacaucgagcugcagaagaccgaggccacgcagcuggcgacacuccggaagcugugcaucgagggcaagaucaccaacaucacgaccgacagccgcugccccacgcagggcgaggcgguccugccggaggagcaggaucagaacuacgucuguaagcacaccuacguggaccggggguggggcaacgggugcggccucuucgggaagggcucccugguaaccugugccaaguuccagugccuggagcccaucgagggcaaggugguucaguacgagaaccucaaguacaccgugaucaucacaguccauacgggggaccagcaccaagugggcaacgagacccagggggucaccgccgagaucacgccccaggccagcaccaccgaggugacccugccagaguacggcacccuugggcucgaguguuccccacgcacgggccuggacuucaaugagaugaucuugcuaaccaugaagaacaaggcguggauggugcaccggcagugguucuucgaccugccccugcccuggaccagcggggcuaccacggagacccccaccuggaaccgcaaggagcuccugguaaccuucaagaacgcccacgcaaagaagcaagaggugguuguccucgggucccaagagggcgccaugcacacggcgcuuaccggggcuaccgagauccagaacagcggcgggaccuccaucuucgcugggcaccugaagugccggcugaagauggauaaguuagagcuuaagggcaugagcuacgccaugugcacgaacaccuucgugcugaagaaggaggucuccgagacccagcacgggacgauccucaucaaggucgaguacaagggcgaggacgccccgugcaaaaucccauuuagcacggaggacgggcacggcaaggcgcacaacgggcgccugaucaccgccaaccccguggugacaaagaaggaggagcccgucaacaucgaggccgagccgcccuuuggggagucgaauauuguuauaggcauuggggacaacgcccugaagaucaacugguauaagaagggcuccaguaucgggaagauguucgaggcgaccgcaagaggggcccgccggauggccauacugggugacacggccugggacuucgggagcgugggcgggguccucaauucacuggggaaaaugguacaccagauuuucggguccgccuacaccgcccuguucagcggcguguccuggguaaugaagaucggcaucggggugcuucugacguggaucggccugaacagcaagaacaccuccaugaguuucucuugcaucgcaaucgggaucaucacccucuaccugggcgcagugguccaggcagacauggggugcgugaucaacuggaagggcaaggagcugaagugcggcucagggaucuuugugaccaacgagguucauaccuggaccgagcaguacaaguuccaggcggacucccccaagcgccucgccacggccaucgcgggcgccugggagaacggggugugcggcauccggagcaccacccggauggagaaccugcuguggaagcagaucgcgaacgagcucaauuauauccugugggaaaacaacaucaagcugaccguggucgugggggacaucaucggcguguuagagcagggcaagcgcacgcugacgccccagccgauggagcugaaguacuccuggaagacgugggggaaggccaagaucgucaccgccgaaacacagaacagcuccuucauaaucgacggccccaacacccccgagugccccagcgccucccgggcguggaacgugugggagguggaggacuacggguuuggcguauucacuaccaacaucuggcuccgccuacgggagguguauacccagcugugugaucaccgccucaugagcgccgcggugaaggacgagcgggccguccacgccgacaugggcuacuggaucgaaagccagaaaaacggguccuggaagcuggagaaggcgucacugaucgaggugaagacgugcacguggccgaagucccacacccuuuggucaaacggcguguuagaguccgacaugaucaucccgaagagucuggccgggcccaucucccagcacaaccaccgcccgggcuaccacacccagacggccgggcccuggcaccuuggcaagcuggagcuggacuucaacuacugugagggcaccaccguagugaucacagagaacugcggaacgcggggacccagccuccggaccaccaccguguccgggaagcugauccacgaguggugcugccgcagcugcacacugcccccgcuccgcuacaugggcgaggacggguguugguacggaauggagauccggcccaucuccgagaaggaggaaaacauggucaagagccugguguccgccggcagcgggaaaguggauaauuuuaccaugggcguccugugcuuagccauucuguucgaagaggugaugcgagggaaguucggcaaaaagcacaugaucgcggggguguucuucaccuucguccugcuacuauccggccagaucacauggcgggacauggcacacacgcugaucaugaucggcagcaacgccuccgaccgcaugggcaugggcgugaccuaccucgcccuaaucgccaccuucaagauccagcccuucuuggcgcucggguucuuccugcgaaaguugaccucucgcgagaaucuccugcugggcgugggccuggccauggccacgacccugcagcuccccgaggacaucgagcagauggccaacgggaucgcguuaggccugauggcccugaagcugaucacgcaguucgagaccuaucagcuuuggacggcccugaucagccuaaccugcuccaacaccauauuuacccugacggucgcuuggcggaccgccacccuuauccucgcgggagugagccuccugccggucugccaguccagcuccaugcgcaaaaccgacuggcuccccauggccguggccgccaugggcgugccgccccuaccgcuguucaucuucagccucaaggacacguugaagcgccgguccuggccccugaacgagggagucauggccguuggccucgugagcauccuggcgaguagccuccuccguaacgacgucccaauggccggcccccugguggcagggggccugcucaucgccugcuacgucaucaccgggaccuccgcugaucugaccgucgagaaggccgcggacaucacgugggaggaggaggccgagcagaccggagugagccauaaccugaugaucaccguggacgacgacgguacgaugcggaucaaggacgacgagaccgagaacauccucacuguccugcugaagaccgcccugcugaucgugagcggcaucuucccguacucaauccccgccacccuccucguguggcacaccuggcagaagcagacgcagcgcuccggcguccugugggacgugccgagcccgcccgagacccagaaggcugagcuggaggaggggguuuaccggaucaagcagcagggcaucuucgguaaaacccaggucgggguaggggugcagaaggagggcgucuuucacaccauguggcaugugacucgcggcgccgugcucacauacaacgggaagcggcuugagccuaacugggccuccgucaaaaaggacuuaaucagcuauggcgggggcuggcgccucuccacccaguggcagaagggggaggagguccaggugaucgcugucgagcccggcaagaaccccaagaauuuucagaccaugcccggcacauuccaaaccaccaccggagagaucggcgcgauagcuuuagacuucaagccggggacgucuggcagccccaucaucaaccgggaggggaaaguggugggccuguacggcaacggagucgugaccaagaacggcggguacgugaguggcauagcccagaccaacgcagagccggacgggcccacccccgagcuggaggaggagauguucaagaagcgcaaccucacuauaauggaccugcacccggggagcggcaaaacacggaaguaccugccggcaauaguccgagaggcgauaaaacggcgccuucggacgcugauccuggcaccuacccgcguuguggccgccgagauggaggaggcccucaagggccugcccauccgguaccagacgaccgcgaccaagagugagcauaccggccgcgagaucgucgaccugaugugccaugccacuuucaccaugcgacuccugagccccgugagagugccgaacuacaaccugaucaucauggacgaggcccauuucacugaccccgccuccaucgccgcgcggggauauauaagcacccgcguaggcaugggcgaggccgccgccaucuucaugacggccacgccacccgguacugccgacgccuucccgcaguccaaugcccccauccaggacgaggagcgcgacauccccgagcggagcuggaacuccggcaacgaauggaucaccgacuucgccgggaagacggugugguucgugcccagcaucaaggcgggcaacgacaucgccaacugucucaggaagaacgggaaaaaggucauccagcuguccaggaagaccuucgacaccgaguaccagaagaccaagcugaacgauugggacuucguggucaccaccgauaucagcgagaugggcgccaacuucaaggccgaccgcgucaucgacccgcggcgcuguuuaaaacccgugauccugaccgacgggcccgagcgggugauccuggccggucccaugccggucaccgcggccuccgccgcccagcgccggggccgcguggguaggaacccccagaaggagaacgaccaauacaucuucacaggccagccgcucaauaacgacgaggaucacgcccauuggacggaggcgaagaugcugcuggacaacaucaacacccccgaggggaucaucccggcccucuucgaacccgagcgcgagaaguccgccgccaucgacggcgaguaccggcuuaagggcgagucccguaagaccuucguggagcuuaugcggcgcggggaccuucccgucuggcuggcccacaaaguagcuagcgagggcaucaaguacaccgaccggaaguggugcuucgacgggcagaggaacaaccagauccucgaagagaacauggacgucgaaaucuggacgaaggaaggcgagaagaagaagcuccggccccguuggcuggacgcccgcaccuacuccgacccgcuggcccucaaggaguucaaggauuucgcagcaggccgcaaaucgaucgcgcuggaccuggugaccgagaucgggcgcgucccgucccaccucgcccaccggaccagaaaugcccuggacaacuuggugauguuacacacgagcgagcacggcgggcgggccuaccgccacgccgucgaggaacugcccgagaccauggagacccugcuccugcugggccucaugauacugcugaccgggggcgccaugcuuuuccugaucagcggcaaggggaucgguaaaacguccaucggacugaucugcgugaucgccagcuccggcaugcucuggauggccgagaucccgcugcaguggaucgccagcgcgaucguccuggaguucuucaugauggugcugcugauccccgagcccgagaaacagcggacgccccaggacaaccagcuggcuuacguggucaucgggauccucacccuggccgccaucaucgcagcgaacgagauggggcugcucgaaaccacaaagcgcgaccugggaauguccaaagagccgggggugguuagccccaccuccuaccuagacgucgaucuccaccccgccucagcauggacauuauacgccguggcgaccacggugaucacaccuaugcugcgacacaccaucgaaaauucaaccgcgaaugucagccucgcggcaaucgccaaccaggcgguggugcugaugggccuggacaagggguggccgaucuccaagauggaccucggcgucccccugcuggcuuuagggugcuacagccaggugaacccccugacgcugaccgccgcggugcuccugcugauuacacacuacgccauaaucggccccggccuucaggcgaaggccacccgcgaggcccagaagcggacggccgcggggaucaugaagaaccccaccgucgacggcaucaugaccaucgaccuggaccccgugaucuacgacuccaaguuugagaagcagcugggccagguaaugcuacugguccugugcgcggugcagcuccugcugaugcgaaccuccugggcccuuugcgaggcccugacgcuggccaccgggcccaucaccacccucugggagggcucccccgggaaauucuggaacacgaccauugccguguccauggcaaacaucuuccgcggguccuaccuggcgggggccggccuggccuucucgaucaugaagucgguggggaccgggaagcguggcaccgggagccagggggagacccucggggagaaguggaagaagaagcugaaccagcugagcaggaaggaguucgaccuauacaagaaguccggcaucacggaaguggaccgcaccgaggcgaaggaggggcugaagcggggcgagaucacucaccacgccgugagccgcgguuccgccaagcugcagugguucgucgagagaaacaugguaaucccggagggaagggugaucgaccucggcugcggacgaggaggguggagcuacuacugcgcaggccugaagaaggucaccgaggugcgcggcuacacgaagggcggccccgggcacgaggagcccgugcccauguccaccuacggcuggaacaucgucaagcugaugagcgggaaggacgucuucuaccucccgcccgagaaaugcgacacccugcuuugcgacauaggcgagucuagccccucccccacuguggaggagagccgcacgauccggguucugaagaugguggaaccguggcucaagaacaaccaguucugcaucaagguccugaaccccuacaugccgaccgucauugagcaccuagaacgccuccagcgcaagcacggcgggaugcuggugagaaacccccuguccaggaacagcacccacgagauguacuggaucaguaacggcaccgggaacaucguugccagcgucaacauggugucccgccuccuguugaaccgguucacgaugacacaccgacggccgacaaucgagaaggauguggaccuaggcgcgggcacccgccacgucaacgccgagcccgagacgcccaauauggacgugauuggggagcggauuaagcgcaucaaggaggagcacaacagcaccuggcacuacgacgacgagaacccguacaagaccugggccuaccauggcuccuacgaggugaaggccaccgggucagccuccagcaugaucaacggcgucguaaaacuccugacuaagcccugggaugucgugcccauggugacccagauggcgaugaccgauaccacgccguucgggcagcagcggguauucaaagagaagguggacacccguaccccgcggagcaugcccgguacccgcagggugaugggcauaacggccgaguggcucuggcgcacccuggggcggaauaagaagccacgccugugcacacgcgaggaguucaccaagaagguccggacgaacgccgccaugggagcgguauuuacugaggagaaccagugggacuccgccaaggccgccguggaggacgaggacuucuggaagcucgucgaccgcgagcgagaacugcacaaacuggggaagugcggcagcugcguguacaacaugauggggaagcgcgagaagaagcuaggcgaguucgggaaggccaagggaucccgggcaauaugguacauguggcugggcgcccgcuaucuggaguucgaggcccugggguuucuuaacgaggaccacugguucagcagagagaacagcuacucaggcguggagggggaaggccuucacaaguugggcuacaucuugcgcgacaucuccaagauccccgggggcgccauguacgccgacgauaccgcggggugggauacgcggaucacggaggacgaccugcauaacgaggagaagaucacccagcaaauggaccccgagcaccgccagcucgccaacgccaucuucaagcugacuuaccaaaacaaggucgugaaggugcagcggcccaccccgaccggcacgguuauggacaucaucagccgcaaggaccagcggggcucuggacaggugggcaccuacgggcugaacaccuucaccaacauggaggcccagcucauccgacagauggaaggcgaggggguucugagcaaggccgaccuggagaacccccaccucccggagaagaagaucacacaauggcuggagacaaagggcgucgagcggcugaagcgcauggcgaucuccggggacgauugcguggugaagccaaucgaugaccgguucgccaaugcccuccuggcccugaacgacauggggaagguucguaaagacaucccccaguggcagccaagcaagggcuggcacgauuggcagcaggucccguucugcucccaccacuuccacgagcucaucaugaaggauggucggaagcuggugguccccugccgcccccaagacgagcugaucggccgggcccgcaucagccagggggcgggcuggucguuacgcgagaccgccugccugggcaaagccuacgcccagauguggagccugauguacuuucaucggagggaccucaggcuggcguccaacgccaucugcagcgcugugcccgugcauugggucccgacaucccgcacgaccuggagcauccacgcccaccaccaguggaugacuaccgaggacaugcugacgguguggaaccggguauggauagaggacaaccccuggauggaggacaagacccccgucacgaccugggaggacgugcccuaccucgggaagcgcgaggaccaguggugcggcagcuuaaucgggcugacgucccgagccaccugggcgcagaacaucccuaccgccauccagcaaguccggagccucaucggcaacgaggaguuccuggacuacaugcccucgaugaagcgguuccgcaaagaggaagagagcgagggggccaucugguga

SEQ ID NO: 25902 - RNA, 9873 nt, Artificial Sequence
  derived and/or modified CDS sequence (opt11) from DENV-3__KJ189286__SS-prME
acuuccuucugccugaugaugauacuucccgcggccuuggccuuccaucuuacaucaagagacggugagccgcggaugaucguggggaagaacgaacgcgguaagagccucuuguucaagaccgcaagcggcaucaacaugugcacccugaucgccauggaccugggcgaaaugugcgacgacacggugaccuauaagugcccccauauuaccgagguagaacccgaggacauagauugcuggugcaaucugaccucuaccugggugacguacgggaccuguaaccaagcaggcgaacaccggcgcgacaagcgguccguugcccuggcgccccaugugggcauggggcucgacacccgcacccagaccuggaugagcgccgagggcgccuggcgccaaguggagaagguggagacgugggcccugcgccacccgggguucacaauucuggccuuguuucucgcccacuacaucggcaccucucucacgcaaaagguggucaucuucauccuccugaugcuggucacgcccagcaugaccaugcgcugcguaggcgugggcaaccgcgacuucgucgagggcuuguccggugccacuuggguggacgugguuuuagagcauggcggcugcguuaccacaauggccaagaauaagccgacccuagacauagagcuccagaagacugaggccacccagcuggcuacgcuaaggaagcucugcaucgaagguaagaucaccaacaucacaacugacagccgcugccccacgcagggagaggccgugcugccggaggagcaggaccagaacuacgucugcaagcauacauacgucgauaggggguggggcaacgggugcggucuguucgggaagggcucccucgugaccugcgccaaguuccagugccucgagccaaucgagggcaaggucgugcaauacgaaaaccuuaaguauaccgugaucaucacgguccacacaggggaccagcaucaggugggcaaugagacccagggagucaccgcagaaaucacgccccaggccagcacaaccgaagcgacccucccagaauacggaacccugggucuggagugcuccccacguacagggcuggauuucaacgagaugauccuacugaccaugaagaauaaagccuggauggugcacaggcagugguucuucgaccucccccugccauggaccucgggcgcuaccaccgagacccccaccuggaaccgcaaggagcugcucguuaccuucaagaacgcccacgccaagaagcaagaggucguagugcuagggucccaagagggagcgaugcacacagcccugaccggggccaccgagauccagaacaguggcggcaccuccaucuucgcuggucaucucaaaugccggcugaagauggauaaguuagagcucaagggcaugaguuacgccaugugcacgaauaccuucguccugaagaaggagguguccgaaacccagcacggaaccauucugaucaagguggaauacaagggcgaggacgcgcccugcaagauccccuucuccacagaggacgggcacgggaaagcccacaacggacgccucauuaccgcgaaccccgucguaacuaagaaggaggaacccgugaauauagaagccgaaccgcccuucggggagucaaacaucgucaucggcaucggggauaacgcucugaagaucaacugguacaagaaaggcagcaguaucgggaaaauguucgaagcgaccgcccggggcgcccgccggauggccauccuuggugacacggcuugggacuucgggagugugggcggaguccugaacucacucggcaagaugguccaucaaauuuucggauccgccuacaccgcccuguucucaggcguguccugggugaugaagauaggaaucgggguccugcuuaccuggaucggccugaauagcaagaacaccuccaugucguucuccugcauugccauagggaucaucacgcuuuaccucggagcagugguacaggcggacauggggugcgucaucaacuggaaaggcaaggagcugaagugcggcagcgggaucuucgugaccaacgaggugcacaccuggaccgagcaguauaaguuccaggccgauucgcccaagcgucuagcgacugccauagccggcgcgugggagaauggggucugcggcauccgcagcaccacccggauggagaaccuccuauggaagcagaucgccaacgagcuaaauuacauuuuaugggagaacaacaucaagcugacagugguagugggggacauaaucggugugcuggagcagggaaagcgcacccucacgccccagcccauggaguuaaaguacuccuggaagaccugggggaaggccaagaucgugacggccgagacgcagaacagcuccuuuauaaucgacggcccaaacacccccgagugccccagcgcgucccgggcauggaacgucugggagguggaggacuacggguucgguguguuuaccacuaacaucugguugcgccuccgggaggucuacacccagcugugcgaccaccgccugaugucggccgcggugaaggacgagcgggccgugcacgcggacaugggcuacuggauugagagccagaagaacggguccuggaagcucgagaaagccucucugauugaagucaagaccugcacuuggccgaaaucccacaccuuguggagcaacggcgugcuggaguccgauaugaucauucccaagagcuuagccggaccaaucagucagcacaaccaucgaccuggauaccauacccagaccgccgggcccuggcaccuggggaaguuggaguuggacuucaauuacugcgagggcacuaccguggucaucacugagaacugcgggacgcggggcccgagccugcgcaccaccacagugucagggaagcucauccacgagugguguugccggagcugcacgcugcccccccugcgcuacaugggcgaggacgggugcugguacggcauggagauccgccccaucucagagaaggaggagaacauggugaagucccuugugagcgccggcucggggaagguagacaauuuuaccaugggcgugcugugccuggcgauccucuuugaggaggucaugagaggcaaguucggcaagaagcacaugaucgccgguguguuuuucaccuucgugcuguuacuguccgggcagauuacuuggcgggauauggcacacacgcugauuaugaucggcucaaaugccuccgaccguaugggaaugggcgucacauacuuggccuuaaucgcgacauucaagauacaacccuuucuggcccugggguucuucuuacggaagcugaccucacgugaaaaucuguugcuggguguggggcucgccauggccacaacccuacagcugcccgaggacaucgagcagauggcgaacgggaucgcacugggucucauggcacugaagcugaucacccaguucgagaccuaccaacucuggacggcucugaucagccugaccugcuccaacacaaucuucacccucacgguggccuggcggaccgcgaccuuaauuuuagccggagucagucuccugccggugugucagucaagcuccaugagaaagaccgacuggcugcccauggcggucgcagcgaugggcgugccgccccuccccuuauucaucuucaaccugaaggauacgcucaagcgccggagcuggccccucaacgagggggugauggcggucggccugguguccauccucgccagcucccuacugcgcaacgaugugcccauggccgguccccucguugcgggaggccugcugaucgcaugcuacgucaucaccgggaccagcgcggaccucaccguggaaaaagccgccgacaucacgugggaggaggaggccgagcagacuggcgucucccauaaccugaugauuaccguagacgacgacgggaccaugcggauuaaggacgacgagaccgagaacauucugacggugcuucugaagacugcgcugcucauuguaagcggcaucuuccccuacuccauacccgcaacccuucugguauggcacaccuggcagaagcagacgcagaggagcggagugcucugggacguacccucaccuccggagacgcagaaggccgagcuggaggaaggcguguaccggaucaagcaacaggguaucuucggaaagacccaggugggcgucggugugcagaaggaggguguauuucacaccauguggcacgucacacgcggcgccgugcugaccuacaacgggaaacggcucgaacccaacugggcgagcgugaagaaggaccugaucuccuauggugggggcuggcgccuguccacccaguggcagaaaggggaggagguccaggugauagcgguggagcccggcaaaaaccccaagaacuuccagacgaugcccggcacguuucagacgaccaccggugagaucggcgccauugccuuagacuucaagccggggacuucaggaucgcccaucauaaaccgggaaggcaaggucguggggcuguacggcaacggggugguuaccaaaaacggcggcuacgugagcggcaucgcccagaccaacgccgagccggacggccccacccccgaacuggaggaggagauguucaagaagcgcaaccugacgaucauggaccuccacccuggguccgguaagacgagaaaguaccugccggcgaucgugagggaagccauuaaaagacgccugcggaccuugauccuggcuccaacccgcgucguggccgcugagauggaggaggcgcugaaagggcuccccauucguuaucagacgaccgccaccaagucggagcacacuggucgcgagaucguagaccugaugugccaugccacguucacaaugaggcugcucuccccaguucgggugccgaacuacaaccuaauaaucauggacgaagcacacuucaccgauccagccagcauagcggcccggggguacaucucuacucgcguagguaugggcgaggccgccgcgaucuucaugacggccacgccgcccgggaccgccgacgccuucccacagucgaacgcccccauccaagacgaggagcgcgacauccccgagcgguccuggaacagcggcaacgaguggaucacugacuucgcagggaagacggucugguucgugcccuccauuaaagccgggaacgacaucgccaacugccugcggaagaacggcaagaaggugauccagcucagcaggaagaccuucgacacagaguaucaaaagaccaagcugaacgacugggacuucgucguuacgaccgacaucuccgaaaugggcgccaauuucaaagcggaccgcguaaucgacccgcgccgcugcuugaaacccguaauccucaccgacgggcccgagcgggugauccuggcggggcccaugccggugacagcagccagcgccgcccagcgccggggcagaguugggcggaacccgcagaaggagaacgaccaguacauuuucaccggccagccccugaacaaugacgaagaccacgcacacuggacugaggccaagaugcuccuggauaacauaaauacgcccgaagggauaaucccggcccuguucgagcccgaacgcgagaagucugcggcuaucgacggggaguaccggcucaagggcgaaagccgcaagacuuuuguggaauuaaugcggcgcggggaccugcccguguggcucgcccacaaggucgcuuccgagggcaucaaguacaccgacagaaaguggugcuuugacgggcagagaaacaaccagauccuggaggaaaacauggauguggagaucuggacgaaggagggcgaaaagaagaaacucaggccgcgcuggcucgacgcucguaccuacagcgacccucuggcccugaaggaguucaaggacuuugcggccggcaggaaguccaucgcccucgacuuggucaccgagaucgggcgcgugcccagccauuuagcccaccggacccguaacgcccucgacaaccuggugaugcugcacacgucugagcacggcgggcgcgcuuaccgacacgccgucgaggaauugccggagaccauggagacccugcugcuccugggccugaugauccuccucaccgggggagcuaugcuguuccucaucagcgggaaggggaucggcaagacgucaauuggguuaaucugcgucaucgcauccagugguauguuauggauggcggaaaucccccuacaguggaucgcauccgcuaucgugcuggaguucuucaugaugguccugcucauccccgagccagagaaacaaagaacgccccaggacaaccaguuagccuacguggugaucgggauccugacccucgccgccaucauagcggccaacgagaugggccuguuggagaccacuaagcgcgacuugggcaugagcaaggagccgggcgugguguccccaaccagcuacuuggacguugaccugcauccagcuuccgcguggacacucuacgcugucgccacuacuguaaucacuccuaugcuucgccacacuaucgagaacagcaccgcuaacguuucccuggccgcaaucgcgaaccaagccgucgugcucaugggccuagacaaaggguggccuaucucgaaaauggaccugggcgugcccuugcuggcccugggguguuauucccaggucaacccccucacgcuuacagccgccgugcugcuccucaucacgcacuacgcgauaaucggccccggcuuacaggccaaggcgacccgcgaagcccagaagcggacggccgcagggaucaugaagaacccaaccguggacggcaucaugacuaucgaccucgaccccgucaucuacgacagcaaauucgagaagcagcugggccagguaauguuacucgugcugugcgccguccagcugcucuugaugcgcaccuccugggcccuaugcgaggccuugaccuuagcuaccggucccaucacgacccugugggagggcucacccgggaaguucuggaauacgaccaucgcaguguccauggccaacaucuuccgugguagcuacuuagccggcgccggccuggcguucuccaucaugaagucuguggggacaggcaagcgcggcaccgggucccagggugaaacccugggggagaaguggaagaagaaacucaaccaacugagccggaaagaauucgaccuauacaagaaaucgggcaucacugaggucgaccgcaccgaggccaaggagggguuaaagcggggugaaaucacccaucacgccgugucccgcggcuccgccaagcugcagugguucguggagcggaacauggucaucccggaggggcgagugaucgaccugggaugcggacgggggggguggaguuacuacugcgccggucugaagaaggugaccgagguccgcggcuacacuaagggcgggcccgggcacgaagagcccgugcccaugagcaccuacggcuggaacaucgugaaacuaauguccgggaaggacgucuucuaucugccgcccgagaagugugacacccuccugugcgauaucggagagucaucccccagccccaccguggaggaguccagaacgauccgggugcugaagaugguagagccguggcugaagaacaaccaguucugcaucaaggugcucaaucccuacaugcccaccgugauugagcaccuugagcgccugcagcggaaacacggggguaugcucguccggaacccccugagccguaacaguacccacgagauguacuggaucagcaacggcacagggaacaucguggcgucggugaacauggucucuagacuguuguuaaaccgguuuacgaugacucaccgacggccaaccauugagaaggauguagaucugggggcgggcacccgacacgugaaugccgagcccgaaacgcccaauauggacgucaucggggagcguaucaagcgcaucaaggaggagcacaacuccaccuggcacuacgaugacgagaauccguauaaaaccugggccuaccacggcucguacgaggugaaggccacagggucugcgagcuccaugaucaacggcguggucaagcuccugacgaagcccugggaugucguccccauggucacccagauggcuaugaccgacaccacgcccuuugggcagcagcguguauucaaggagaaggucgacacgcggacaccgcggucuaugccgggcacccgccggguaaugggcaucacggccgaguggcuguggcgcacgcuuggacggaauaagaagccccgccugugcacucgggaagaauucaccaagaagguucggaccaacgccgcgaugggcgcggucuucaccgaggagaaucagugggacucggcgaaggccgcggucgaggaugaggauuucuggaaguuaguggacagggagcgcgagcuccacaaacuagggaagugcggguccugcgucuauaacaugauggggaagcgcgagaaaaaacugggcgaauucggcaaggcgaaggggagccgggccauaugguacauguggcucggcgcgcgcuaucucgaguuugaggcccugggguucuuaaacgaggaccacugguucucucgggagaacagcuacuccggcguugagggggaaggacugcacaaacugggcuacauucuccgcgacaucagcaagauacccgggggcgccauguaugcggaugacaccgcggggugggacacccggaucacggaggacgaccugcauaacgaggagaagauaacccagcaaauggacccggaacaccgccagcuggccaacgccaucuucaagcucaccuaccagaacaaaguggucaaggugcagcggcccaccccaaccggcacgguuauggacaucaucucccgcaaagaccaacgggguucaggucaggucggcaccuacgggcugaauaccuucaccaauauggaggcucagcugauccgccagauggagggcgagggcgugcucuccaaggccgaccuggagaacccccaccuccccgaaaagaagaucacgcagugguuagagaccaagggcguggagcggcuaaaacgaauggccaucuccggcgacgacugcgucgugaagcccauagacgaccgguucgccaacgcgcuucuugcccucaacgacauggggaaggugcgaaaggacaucccccaguggcagcccucgaagggcuggcacgacuggcagcaggucccguucugcagucaccacuuccacgagcugaucaugaaggacgggcggaagcucguugugcccugccgcccccaggacgagcuaaucggccgggcccgcauaucccagggggccggcuggagccugcgcgagaccgcuugucucggcaaggccuacgcgcagauguggucccugauguauuuccacaggcgcgaucugcggcuugccagcaaugccaucuguuccgccguccccguucacugggugccgacgucgcgcacgacaugguccauucacgcccaccaccaguggaugaccacggaggauaugcugacggucuggaacagaguguggauugaggacaaccccuggauggaggacaagacucccguaaccaccugggaagacguccccuaucucgggaagcgcgaggaccaguggugcggcucccucauuggucugacgagccgggccaccugggcccagaauaucccgaccgccauccagcaaguccguucccucaucggcaacgaggaguuccucgacuacaugccuaguaugaaacgguuccgcaaagaagaagagucugagggcgcgaucugguag

SEQ ID NO: 25903 - RNA, 9873 nt, Artificial Sequence
  derived and/or modified CDS sequence (opt11) from DENV-3__KJ189287__SS-prME
accucucucugccucaugaugauacugcccgccgcgcucgcguuccaccucaccucacgggacggggaaccccggaugauugucgggaagaacgagcgaggcaagagucuacuguucaagaccgccuccgggaucaauaugugcacccucaucgccauggaucuuggcgagaugugugacgacacugugaccuacaagugcccccauauaacagagguggaacccgaggacaucgacugcuggugcaauuugaccagcacgugggugaccuacggaaccugcaaccaggccggcgaacaccggcgugacaagcgguccguggcccucgcgccccacguaggcaugggucuggacacucgcacccaaaccuggaugucagccgagggcgccuggcgccagguggagaaaguagagacgugggcccugcgccacccgggguucaccauucuugcucuguuccuggcccacuauaucggcaccucccucacgcagaagguggugaucuucauccugcugaugcuaguaaccccaagcaugaccaugcgguguguagggguggguaaccgcgacuucgucgaaggucucuccggggccaccuggguggacgugguccuugagcauggcgguugcgugaccacuauggccaagaacaagcccacccucgacaucgagcuucagaagaccgaagccacccagcuggcgacauuacggaaacuuugcauugagggcaagaucaccaacauaaccaccgacucacguugccccacgcagggcgaggcgguccucccggaggaacaagaccagaacuaugugugcaagcacaccuacguggaccgaggaugggguaacggcugcggccuguucggcaagggcucccugguaaccugcgcaaaguuucagugccuggaacccauugaggggaaggucguucaguaugagaaccucaaguacaccgugaucauaacaguccacaccggugaccagcaccaggucggcaacgagacccagggagugaccgcagaaaucacgccacaggccagcacgaccgaggccacacugccagaguacggcacccuggggcuggaguguuccccgcgcaccggccuggacuucaaugagaugauccugcucaccaugaagaacaaggccuggauggugcaucggcaaugguucuucgaccugccccugcccuggaccuccggcgcuaccacggagacucccaccuggaaccguaaggagcuccuggugaccuucaaaaaugcucacgccaagaagcaggaggucguuguucuggggucucaagagggcgcgaugcacacggcacugaccggggccaccgaaauccagaauagcggcgggaccuccaucuucgccggucaccugaagugccggcucaagauggacaagcucgaguugaaaggcaugucuuaugccaugugcaccaacaccuucgucuugaagaaggagguuuccgagacccagcacggaacgauccuuaucaagguggaguauaagggggaggacgcgccguguaagauccccuucucuacggaggauggccacgggaaggcccacaauggccgccucaucaccgcaaaccccgucgugaccaagaaagaggaaccggugaauaucgaagcugaaccgccuuuuggagagagcaacaucguaaucggcaucggggacaacgcgcugaagaucaacugguacaagaagggcaguagcauugggaagauguucgaggccaccgcccggggcgcgcgucggauggccauucugggcgacacggcgugggacuucggcuccguaggcgggguguuaaacucucuaggcaagaugguccaccagaucuucggguccgcuuacaccgcccuguuuagcggcguguccugggugaugaagaucggcaucgggguucuccucaccuggauaggauuaaacuccaagaauaccucuaugagcuucucgugcaucgccaucgggaucaucacucucuaucugggcgccguagugcaggcugacauggggugcgucauuaacuggaaggggaaggagcugaagugcggcagcgguaucuucgugaccaacgagguucacacauggaccgaacaauacaaauuccaggcugauagccccaagcggcucgccacggccauagccggcgcgugggagaacggggucugcggcauccggucaacuacacggauggaaaacuugcuguggaaacaaaucgcaaacgagcuaaacuacauccugugggagaacaauaucaagcugaccguaguggucggggacaucaucgggauccuugagcaaggcaagcgcacucugacgccccagccgauggagcugaaguacucauggaagaccugggggaaggccaagaucgugaccgcugagacgcagaacagcuccuucauaauugacggccccaacacccccgagugccccagugcgucccgggccuggaaugugugggaggucgaagacuacggguuuggcguguucacgaccaacauuuggcuccgccugcgggagguguacacucagcugugcgaccaccgccuaaugagcgcggccgucaaggacgagcgagcaguccacgcggauaugggauacuggauugaaagccaaaagaacgggagcuggaaacuugagaaggccagccugaucgaggugaagacguguaccuggccgaagucccacaccuuauggaguaacgguguccuggaauccgacaugaucauuccaaagagccuggccggccccaucucccagcacaaccaucgcccaggcuaccacacccagaccgccgggccguggcaccucgggaagcuggagcuagauuucaacuacugugagggcacaaccguggugaucacagagaauugcggcacgcggggccccucccuccggaccaccaccgucuccgggaagcugauacacgagugguguugucgcucaugcacacuacccccgcuucgcuacaugggagaagacgggugcugguacgguauggaaauccggcccaucuccgagaaggaggagaacauggucaagagccuaguguccgccggcagcgggaaggucgauaauuucaccaugggcgugcugugccuggcgauccuguucgaggaggucaugcgcgggaaauucggcaagaagcacaugaucgcuggggucuucuucacuuucgugcuacuucuuagcggccagaucacuuggcggaacauggcccacacucuuaucaugaucggcagcaacgccuccgaccgcauggggaugggcguuaccuaccucgcccuaaucgcgaccuucaagauacagccuuuucuggugcuggguuucuucuugagaaaauuaaccagccgugagaaccuccuguuaggugucggccuagcgauggccacgacccuacagcuacccgaagacaucgagcagauggcaaacgggaucgcgcucggccuuauggcccugaagcucauuacccaguuugagaccuaccaauuauggacggcccugauuucacugacaugcuccaacaccaucuucacccugacgguggccuggaggaccgcuacguugauccucgcgggggucagccugcugccggugugccaguccagcuccaugcgcaagaccgacuggcucccuauggcggucgccgcaaugggcgugccaccccucccucuauucaucuuuagccucaaggacacgcuaaagcgccgguccuggccacugaaugaaggugugauggccguuggacucguguccauacuggcguccucgcugcuccgcaacgacgugcccauggcuggccccuuagucgcugggggccugcucaucgcgugcuacguuaucaccgggaccagcgccgaccugaccguggagaaggccgccgacauaaccugggaagaggaggccgaacagacgggcgugucucacaacuuaaugaucaccguggacgacgacgggacaaugagaaucaaggacgaugagaccgaaaacauucucacgguccugcugaagacggcccuccugauugucagugguaucuuuccguacucaauccccgccacccugcucguguggcacacuuggcagaaacaaacacagcgcuccggcguguugugggacguccccagcccgccggaaacccagaaggcagagcuagaggagggaguguacagaaucaaacaacaaggcaucuuugggaagacccaggugggcgucggagugcagaaggagggcguauuccauaccauguggcacgucacgcgcggcgcggugcuaaccuauaaugggaagcggcuggagccuaauugggcuagcgugaagaaggaccuuauuagcuacggcgggggcuggcgccucuccacccaguggcagaaaggggaggagguccaaguuaucgccguggaaccggggaaaaacccaaagaacuuccagacgaugcccgggacguuccagaccacuacgggggaaaucggcgcgaucgcccuggacuucaaacccggcacgagcggcagcccgaucauaaaccgggagggcaagguaguagggcuguacgguaacggggucgucaccaagaauggaggguauguguccggcaucgcccagacuaaugcggaaccagacggccccacacccgagcuggaggaggagauguucaaaaagcgcaaccucacgaucauggaccuucacccugguucuggcaagacccguaaguauuugccggccauugugagagaggcaaucaagagacgucuccggacccugauccuggccccgacccgcgugguggccgcugagauggaggaggcccucaaggggcugcccauccgguaccagacgaccgcgacaaaauccgagcacacggggcgcgaaauaguagaucugaugugccacgccaccuucacgaugcggcuccugagccccguccgcgugccgaacuacaaccuaaucaucauggacgaggcccauuucaccgaccccgccuccauugccgcucggggguacaucagcacgcgcguggguaugggcgaggccgcugccaucuucaugacggccacgccgccggguacggcugacgccuuuccacagucuaacgcccccauccaggacgaggagcgcgacauuccugagcggagcuggaacuccggcaacgaguggaucaccgacuucgccgguaaaacggucugguucgugcccaguaucaaagcgggcaacgacaucgcgaacugccuccgcaagaacgggaagaagguaauccaguuaucccggaaaacguucgacaccgaguaucagaagaccaagcugaaugacugggacuucguugugacuaccgacaucagugagaugggcgccaacuucaaggccgaccgugucauagacccgaggcgcugucucaagccggucauccugaccgacggccccgagcgugugauacuagccgggcccaugcccgugaccgcugcuuccgcggcccagcgccguggccgcgucggcaggaacccccagaaggagaacgaccaguacaucuucacuggccagcccuugaacaacgaugaagaccaugcccacuggacggaggcaaagaugcuucuggacaacaucaacacccccgaggggaucaucccggcccucuucgagccugagcgcgagaaauccgccgcaauugacggcgaguaccggcugaagggggagucccgcaagaccuuuguggagcugaugcggcgcggggaucuucccgucugguuggcucacaaggucgccagcgagggcaucaaguacaccgaccggaaguggugcuucgacgggcagcgcaacaaccagauucuagaggagaacauggacguagagaucuggacuaaggagggcgagaagaagaagcuacggccgcgcuggcuagaugcacgcaccuacucggacccgcuggcccucaaggaguucaaagacuuugccgcgggccgcaagagcauugcccuugaccuggucaccgagaucggccgugugccaucccaccucgcccaccggacccgcaacgcgcuggacaaccuggugaugcuacacacgagcgagcacgguggccgggcguaccgccacgcggucgaggagcugcccgagacaauggagacccugcuauuacugggcuugaugauccuuuuaaccggaggggccaugcuguuccugaucucgggcaaggggaucggaaagacguccauugggcugauuugcgugaucgccagcagcggcaugcucuggauggccgagaucccgcuucaguggauagccucugcgaucguccuggaguucuucaugaugguccuacugauccccgagcccgagaaacagcggacgccccaggacaaccaacuggccuaugucgucaucgggauccucaccuuagcugccauuaucgccgcgaacgagaugggccugcucgagaccacgaagcgcgaccugggcauguccaaggagccgggggucgugagccccaccuccuaccuggacguggaucuccaccccgcgagcgccuggacccuguacgccguggccaccacggugaucacucccauguuacgacacaccaucgagaacucgaccgccaacgucagcuuggccgccaucgccaaucaggcggucgugcugaugggccuggacaagggguggccuaucaguaagauggaccucggcgugccccugcuugcccuugggugcuacucgcaggucaacccccugacgcugaccgccgcagugcucuugcugaucacccacuacgcgaucauuggccccggccuccaagcgaaagccacacgcgaggcccagaagcggaccgcagcggggaucaugaaaaacccgaccguggacggcauuaugacaaucgaccucgacccuguuaucuacgauuccaaguucgagaagcagcugggccaggucaugcuccuugugcugugcgcgguacagcuccugcugaugcgcacgagcugggccuugugcgaagcguuaacgcuggcuacaggccccaucaccacacucugggagggcucucccgguaaguucuggaacacgaccauagcggugagcauggccaacaucuuccggggcucuuaccucgccggcgcaggccucgccuucagcaucaugaaguccguggguaccggcaaaagaggaaccggcagccagggcgagacacucggggaaaaguggaagaagaaacuaaaccagcucucacggaaagaguucgaccucuacaagaaguccggcauuacggaggucgaccgcaccgaggcgaaggagggcuugaaacggggugagaucacccaccacgcagucagccgcggcucagccaagcuacagugguucguggaaaggaacauggucaucccggaggggagagugauagaccucgggugcgggagaggaggguggagcuacuacugugccgggcugaagaagguuaccgagguccgaggcuacacgaagggagggcccgggcacgaagaacccguuccgaugucuaccuacggguggaacauagugaagcuaaugagcgggaaggacguauucuaucucccgccugagaaaugugacacacuucugugcgacauaggcgaguccagcccaucccccacaguggaggagagcaggaccauccgggugcugaagauggucgagccguggcucaagaacaaccaguuuugcauaaaggugcucaaccccuacaugccgacugugauugagcaucuggagcgacuccagcgaaagcacggagggaugcugguccggaacccccugucccggaacagcacccacgagauguacuggaucaguaacggcacagggaacauuguggccuccgugaacauggucucccgccuacugcugaaccgguucacgaugacacaccgccggccgaccaucgagaaggaugucgaccucggcgcagggacacgccacguaaacgcagagcccgagacgcccaauauggaugucaucggcgagcggaucaagcgcaucaaggaggaacacaauagcaccuggcacuacgacgacgagaacccuuacaaaaccugggccuaucauggcuccuacgaagugaaggccaccgggagugccuccagcaugaucaauggcguggucaaacugcugacgaaaccuugggacgugguccccauggugacccagauggcaaugacagacaccacgcccuuugggcagcagagggucuucaaggagaagguugacacccgcaccccgcggagcauggcuggcacccgccgggugauggggaucacggccgaguggcucuggcgcacccuuggucggaacaaaaagccccgcuuaugcacccgcgaggaguucaccaagaaggugcggacgaacgccgcgaugggcgccgucuucaccgaggagaaucagugggacagcgccaaggccgccguggaggacgaggacuuuuggaagcucgucgaccgcgagcgggagcugcacaaacuggggaaaugcggcucuugcgucuacaacaugaugggcaagagggagaagaaacucggcgaguucggaaaggcgaagggcucccgggccaucugguacauguggcucggcgcgcgcuaccuggaguucgaggcccucgguuuccugaacgaagaccacugguucagccgggagaacuccuauagcggaguggagggggagggccugcacaagcucggcuauauccugcgagacaucagcaagauccccggaggcgccauguacgcggaugacacagccgggugggauacccggauuaccgaggacgacuugcauaacgaggagaagaucacucagcagauggaccccgaacaccgccaguuagcuaaugcgaucuucaaacuuaccuaccagaacaagguugucaaggugcagcggccgaccccaacaggcacggugauggacauuaucagcaggaaggaccagcggggcuccgggcaggucgguaccuacgggcuuaacaccuuuaccaacauggaggcgcagcucauucgccagauggagggugagggcgugcuguccaaggccgaccuugagaacccccaccuccccgaaaagaaaauuacucaauggcuagagaccaagggcguggagcggcugaagcgcauggccaucuccggcgacgacuguguggugaagccgaucgacgaucgguucgccaacgcccuccuagcccugaaugacauggggaaggugcgcaaggacaucccucaguggcaaccaagcaaaggcuggcaugauuggcagcagguccccuuuuguucgcaccacuuccaugagcucaucaugaaggacgggcggaaguugguuguuccgugccgaccccaagacgaacugaucggccgggcgcggaucagccagggggccggcugguccuugcgcgagaccgcuuguuuaggcaaggccuacgcgcaaauguggagccugauguauuuucauaggcgcgaccuccgacuggccuccaacgcaauaugcucggccguccccgugcacugggugcccaccucccgcacaacuuggagcauccacgcucaccaucaguggaugaccaccgaggacauguugacggucuggaaccggguguggaucgaggacaacccguggauggaagacaagacccccgugacuaccugggaggacguccccuaccuuggcaagcgcgaggaccaauggugcggcagccugaucgggcugacgagucgggcgaccugggcccaaaacauccccaccgccauucagcagguccgcagccucaucgguaacgaggaguuucuugauuacaugccuaguaugaaacgcuuucgcaaggaagaggagagcgagggagccaucugguaa

SEQ ID NO: 25904 - RNA, 9873 nt, Artificial Sequence
  derived and/or modified CDS sequence (opt11) from DENV-3__KJ189288__SS-prME
accucguuaugccucaugaugauacuccccgcugcccuggcuuuccaucucacaucccgcgacggcgagccccggaugaucgucgguaagaaugaacgcggcaagagccuccuguucaaaacugccuccgguaccaacaugugcacacucaucgccauggaccugggcgagaugugcgacgacacgguuaccuacaagugcccccauaucaccgaaguggagccggaggacaucgacuguuggugcaaccugaccagcacuugggugaccuacgggacgugcaaccaagccggggagcaccggagggacaagcguucuguugcguuagcgccccacgugggcauggggcuggacacucgcacccaaacuuggaugagcgcggaaggcgcuuggcggcaggucgagaaggucgagaccugggcucugcgccacccggguuucaccauccucgcguuauuccuagcucauuacaucggaaccucccuuacacagaagguggugaucuucauccugcuaaugcucgucacccccagcaugaccaugaggugcgugggagugggcaaccgggacuucgucgaaggauugucaggggcaacauggguggacgugguccuggagcauggcgggugcgugacuaccauggcgaaaaacaagcccacccuggauaucgagcugcagaagaccgaggcaacucaguuagcgacacuccgaaagcugugcaucgagggcaagaucaccaauaucaccacggacagcagaugucccacccagggcgaggcuguccugccggaggagcaagaucagaacuacgucugcaagcacaccuacguggaccggggguggggaaaugggugcggccucuucgggaagggcucccuaguaacaugcgccaaauuccagugccuagagccaaucgagggcaagaugguccaguacgagaaucucaaguacacugugaucauuaccgugcacaccggugaucagcaccaggucgggaacgagacccagggugucacggcugagaucacgccccaggcaagcaccaccgaggcaacccugcccgaguauggcacguuagggcucgagugcuccccgcgaacuggccuggacuuuaacgagaugauucugcugaccaugaaaaacaaggcauggaugguacaccggcagugguucuucgaccugccucuacccuggacaucaggcgccacgaccgaaacuccgaccuggaacagaaaggaacucuuagugacguucaaaaacgcccacgccaagaagcaggaaguggucguguuaggaagccaggagggcgcgaugcauaccgcacucaccggggccaccgagauccaaaacagcggagggacaucaaucuucgccggucaccugaagugcagacucaagauggacaagcucgaguugaagggcaugucguaugccaugugcacaaauacguucgugcugaagaaggagguuuccgagacccaacacgggacuauccucaucaagguggaguauaagggugaggacgcuccaugcaagauucccuucagcaccgaggacggacacgguaaggcacacaacggucgacuuauaacagccaacccuguagucaccaagaaggaggagcccguuaacaucgaggcugaaccgccauucggugaaagcaacaucgugaucggcaucggggauaacgcgcugaagaucaacugguauaagaaggggucaucuaucgggaagauguucgaggccacagccaggggcgcccgccggauggccauccugggcgacaccgcuugggacuucggguccgucggagggguucucaacagccuggguaagauggugcaccagauauucggguccgccuacaccgcguuauucagcggcgucuccugggugaugaagaucggcauaggggugcuccucaccuggaucggccugaacagcaagaacacgucgaugagcuucuccuguauagcaaucgggaucaucacccucuaccugggagccgucguccaggcggauauggggugcgugaucaauuggaaaggcaaagagcugaagugugggucagggaucuuugucaccaacgaggugcacaccuggacggaacaguauaaguuucaggccgacucccccaagagacucgccaccgccaucgcaggcgcgugggaaaacggggucuguggcauccgcagcacaacacgcauggagaaccuacuuuggaagcagaucgccaaugaguuaaacuacauccugugggagaacaacgucaagcugacuguugucgucggugauaucauuggcgugcucgaacagggcaagcgcacccugacuccccagccgauggagcugaaguacagcuggaagaccugggguaaagccaagaucgugacggccgagacgcagaacucguccuuuaucaucgacggccccaauacacccgagugccccagcgcgucucgggccuggaacgucugggagguggaagacuacggguuuggcguauucacaaccaacaucuggcuucgccuccgggaggccuacacgcagcugugcgaccaccgccucauguccgcggccgucaaggacgagcgggcagugcacgccgacaugggcuacuggaucgagagccagaagaauggguccuggaagcuggagaaggccagcuugauagaggugaagaccuguacauggccgaagucccacacccucuggagcaacggcguccuugaguccgauaugaucaucccgaagagccucgccgggcccaucagucagcacaaccaccggccgggcuaccauacgcagaccgccgggcccuggcaucucggcaagcuggaacuggacuucaauuacugcgagggcaccaccguagugaucacggagaacugcggaaccaggggccccagccuccgaaccaccaccgucuccgggaagcuaauccaugaauggugcugccggagcugcacccugcccccguuacgcuacaugggcgaggacgggugcugguacgguauggaaaucagacccaucuccgagaaggaggaaaacauggucaaaucccuuguguccgcgggcuccggcaaggucgacaacuucaccaugggugugcugugccucgccauccuguucgaagaggugaugagggggaaguucggcaagaagcauaugaucgccggggucuucuucaccuucgugcugcuccuguccggccagauuacguggcgggauauggcccacacccucaucaugaucggcagcaacgccucagaucgcauggggaugggugucacuuauuuagcgcugaucgccacauucaagauccagcccuuucuggcccucggcuucuuccuacggaagcugacaagcagggagaaccuccugcugggcgucggucuggccauggcgaccacccugcaguuacccgaggacaucgagcagauggccaacgggaucgcucucggacugauggcacucaaacuuaucacccaguucgagacguaucagcuguggaccgcucuaaucagccuaacaugcucaaauaccaucuucacgcugaccguagcguggcggaccgccacccugauccucgccggggugagccugcugccggucugccaaucuaguuccaugcgcaagacggacuggcuuccgauggccguagcugcgaugggcgugcccccacuuccucuguucauuuucucgcucaaggacacccugaagcgccgguccuggccccuuaacgagggcguaauggcggugggccuuguaagcauccuggccucaucgcuguuacgcaacgacgugcccauggccggcccacugguggccgggggcuugcucaucgcguguuacguuaucaccgggaccuccgccgaccugacgguggagaaggccgccgacaucaccugggaggaggaggccgaacagaccggaguuagccacaaucugaugaucacagucgacgacgacggcacuaugaggauuaaggacgacgagacggaaaacaucuuaaccgugcugcuaaagaccgcgcuauuaauugugagugguaucuucccguacagcauacccgccacccugcuaguuuggcauaccuggcagaagcagacucagagaucaggcgugcugugggaugugcccagcccgccagaaacccagaaggccgagcuggaggaggggguguacaggauuaagcagcagggcaucuuuggcaagacccaggugggcguggggguacagaaggagggcguguuccacacgauguggcacguaaccaggggagcgguccuaaccuacaacgggaagcggcucgaaccgaacugggcaucggugaagaaggaucucaucagcuacggcggcggcuggcgcuuguccacacaguggcagaagggggaggaaguccaggugaucgccguggaacccggaaaaaaucccaaaaacuuccagacgaugccuggcaccuuccagaccacgacuggggagaucggcgcaaucgcucuggacuucaagcccggaaccagcggaagcccaaucaucaaucgggagggcaagguggucgggcuauacggaaacgggguggugaccaaaaacggagguuacguauccggcaucgcccagaccaacgccgagccggauggcccuacgcccgaacucgaggaggaaauguucaagaagcgcaaccuuaccaucauggaccuucaccccgggagcggcaagacccggaaguaccuuccggccaucguucgcgaggccaucaaacggcgccuccguacccugauucuggcccccacucgggugguugcugcggaaauggaggaggcucuuaaggggcugcccauccgguaccagaccaccgccaccaaaagugaacacacgggccgggagaucgucgaccugaugugccacgcaaccuucacaaugcggcuccuguccccagugagggucccgaacuauaaccucaucauuauggaugaagcccacuucaccgaccccgcgagcaucgcagcuaggggguacaucagcacgcgaguggguaugggcgaagccgcggccauuuucaugacggccacgccgcccgggacugcagacgccuucccacaguccaacgcgccgauccaagacgaggagcgcgauauccccgaaagaagcuggaauuccgggaaugaauggaucacggauuucgcagguaaaacagucugguucguccccagcaucaaggccggcaacgacauugccaacugccuacgcaagaacggcaagaagguaauccagcugucccgaaaaacauucgacaccgaauaucagaagacgaaauuaaacgacugggacuucguggugaccaccgacaucagugagaugggagccaauuucaaggcagaccgcgugauugacccgcgacgaugcuugaagcccgugauacugaccgacggcccggagcgggucauucuggccgggcccaugccgguuacugccgccuccgccgcgcagcgcagggggcgcguggggagaaauccccaaaaggaaaacgaccaguacaucuuuacgggccagccccucaacaacgacgaagaucacgcccacuggacggaagcaaagaugcugcuggacaauaucaacacgccagaggggaucauaccggcccuguucgaacccgaacgcgagaagagugcagccaucgacggcgaguaccggcugaagggggagucccgcaagaccuucgucgagcugaugcggcgcggggaccucccuguguggcuugcucacaaaguggccagcgagggcaucaaauacacggaccggaagugguguuucgacggacagagaaauaaccagauccucgaagagaacauggaugucgagaucuggacaaaagagggcgaaaagaaaaagcuacggccgcguuggcuggaugcccgcaccuacuccgacccucuggcacucaaggaguucaaagacuucgcagcaggccgaaagagcaucgcccuggaccucguuacggagaucgguaggguccccucucacuuagcccaucggacgcgcaacgcgcuggacaaccuggucaugcuccauaccagcgagcacggcgggcgggccuaucggcacgcaguagaagaguuacccgagaccauggagacccugcuccugcugggccucaugauccugcuaaccggcggggccaugcuguuccuaauuagcgggaaaggaauuggcaaaacauccaucgggcucaucugcgucaucgccagcucugggaugcucuggauggcggagauuccuuuacaguggaucgccucggccauaguucuugaguucuuuaugauggugcuccugguccccgagccggagaagcaacggacaccccaggacaaccagcuggccuacguuguaaucgggauacucacauuggcugcgauuauugccgccaacgaaauggguuuacucgagacgacaaagcgcgaccuggggaugucgaaggagccuggggucgucuccccaaccuccuaccuggacguugauuugcacccugcgagugcguggacgcuguacgccgucgccacgacugugauaacccccaugcugcggcacacgaucgagaacucaacggcuaacgucaguuuagccgcgaucgccaaccaggccguuguuuuaaugggccuggacaaaggguggccgaucuccaaaauggaccucgguguaccccugcuggcgcuuggaugcuauagccaggucaacccgcugacgcugaccgcugcggugcuccuucucaucacccauuacgccauaaucggucccggauugcaagccaaggccacgcgcgaggcccagaagcggacagcggccgguauuaugaagaauccaaccguggacggaauaaugaccaucgacuuggacccggucauuuaugacuccaaguucgagaagcaguugggccaagugaugcugcuaguacugugugcuguccagcuccuacucaugcgcacgagcugggccuugugcgaggcccugacgcuggccaccggacccaucaccacgcugugggagggcucuccagguaaguuuuggaacacgaccaucgccguguccauggcuaacaucuuuagagguuccuauuuagccggcgcgggccucgccuucagcaucaugaaguccguggggaccgguaagcgcggcaccgggagccagggcgaaacucucggggagaaguggaagaagaagcuaaaccagcugagccggaaggaguucgaccucuauaagaaguccggaaucaccgaggucgaccgcacagaggccaaggaggggcugaagcggggugagauuacgcaucacgcggucagccgcggcuccgccaaguuacagugguucguggaaagaaacauggugauaccggaggggcgagucaucgaccucggcugcgggagaggaggguggucuuacuacugcgcuggccugaagaagguuacggagguccgcggauacaccaagggcgggccggggcacgaggagccugugcccaugagcacguacggcuggaacaucguaaagcuuaugagcgggaaagacguuuucuacuuaccaccugagaagugcgacacgcuacuaugcgacauuggggaguccagccccucccccacgguagaggagucgcgcaccauacgggugcuuaagaugguugagccguggcucaagaacaaccaguucuguauaaaggugcugaacccuuacaugccuaccguuaucgagcaccucgagcgccuccagagaaaacacggcgggauguuaguccgcaacccccugucccggaauaguacacacgagauguacuggauauccaacggcacagggaacauagucgccagcgugaacauggucucucgccuccuccucaacagguucaccaugacgcaccgccggccgaccaucgagaaggacguagaccucggcgccgguacgcgucacguaaacgccgagccugagacaccaaacauggacgugaucggggagcgaaucaagcgcauaaaggaggagcacaacagcaccuggcauuacgacgacgaaaacccguauaagacaugggccuaccacggcuccuacgaagucaaggcgacggggagugccuccucuaugaucaacggcguggucaagcugcugacaaagcccugggacgucgucccgauggugacccaaauggccaugaccgauacgaccccuuucgggcagcagaggguguucaaagagaaggucgauacacgaacaccgcggaguaugcccggaacgcgccggguaaugggcaucaccgccgaguggcuauggcgcacccuugggcguaauaagaaaccccgccucugcacccgagaagaauuuacgaagaaggugcgaaccaacgccgcuaugggggccgucuucacggaagagaaucagugggauagugccaaggcagcgguggaggacgaggacuucuggaagcucguggaucgcgagagagagcuucacaagcuagguaaguguggcagcugcgucuacaauaugauggggaagcgcgagaagaagcucggcgaguucggcaaagccaaggggucgcgggccauuugguauaugugguugggcgcccgcuaccuggaguuugaggcccucggguuccucaacgaggaccacugguuuagcagagagaacuccuacagcggcguggagggugaaggccugcacaagcucggcuacaucuuacgcgacauaucgaagauccccgggggggcgauguacgcugacgacaccgccgguugggauacgaggaucacugaagacgaucugcauaacgaggagaagaucacacagcagauggaccccgagcaccgccaacucgccaacgccaucuucaagcugaccuaccagaauaaggugguuaaaguucagcgccccacccccaccggcacggugauggacaucaucagccgcaaggaucagcggggcagcgggcaggucggcaccuacggguugaacaccuucacgaacauggaggcacagcucauuaggcagauggagggcgagggggugcugagcaaggcagaccuagaaaacccccaccugccggagaagaagaucacccaguggcuggaaacgaaaggcguggaacggcugaagcgcauggccaucuccggugacgacugcgucgugaaaccaaucgaugaucgguucgcaaacgcccuccuggcgcugaacgacauggggaagguccgcaaggauaucccccaauggcagcccucuaagggcuggcacgacuggcagcaggucccuuucugcagccaccacuuccacgagcugauuaugaaggacggacggaaguuggugguucccugccgcccccaggacgagcugaucggccgagccagaaucagccagggggcuggcuggagucuccgcgagacggccugccuaggcaaggcguaugcucagauguggagcuugauguacuuccaccggcgcgaccuccggcuggccuccaaugccaucuguagcgcuguccccguucacuggguuccgacgucccgcaccaccuggucgauccaugcgcaucaucaauggaugaccacagaggacaugcugacggucuggaaucggguauggaucgaggauaaccccuggauggaggauaaaacacccgugaccacgugggaggacguccccuacuuagguaagcgcgaggaccaguggugcggcagccuaaucggccucacgucccgggcgacaugggcccagaauaucccgacggccauccaacagguacguucccucaucggcaacgaagaguuccuggacuacaugcccuccaugaaacgguuccgcaaggaggaggaaucggagggugccaucugguga

SEQ ID NO: 25905 - RNA, 9873 nt, Artificial Sequence
  derived and/or modified CDS sequence (opt11) from DENV-3__KJ189289__SS-prME
accagccugugccuuaugaugauccuccccgccgcccuggccuuccacuugacgucucgagauggggaaccccguaugaucguggggaagaaugagcgcgggaaaucccuccucuuuaagacugccucagggauuaauaugugcacucugaucgccauggaccugggcgagaugugcgacgacacggugaccuacaagugcccccacauuacagagguagaaccagaagacauagacuguuggugcaaucucaccagcaccugggugaccuacgggaccugcaaccaggcaggggagcaucggcgcgacaagcggagcguggcccucgcaccccacgugggcaugggacuggauacccguacucagaccuggaugagugcugagggcgccuggcgucagguggaaaaagucgagacgugggccuuacgccacccgggguucaccauccucgcgcuguuccuugcccacuacauuggcaccucccugacccagaagguugugaucuuuauccuguugaugcucguuacccccagcaugaccaugaggugcgugggggugggcaaucgugacuucgucgagggacuguccggagcaaccuggguagacguggucuuggagcacggagggugcgugacgacgauggccaagaacaagcccacccucgacaucgaacugcagaaaacagaagccacccagcuggcgacgcuucggaagcucugcauugaaggcaagauaaccaacaucacuacagacucuagaugucccacgcagggggaggccgugcugccggaggagcaggaccagaacuauguuugcaagcacaccuauguggacaggggguggggcaauggguguggccucuucgggaagggaucauuagugacuugugccaaauuccagugcuuagaacccaucgaggguaaagucgugcaguacgagaaccucaaguacaccgugauaauaacaguccacaccggagaccagcaucaagugggcaaugagacccagggagucaccgccgaaauaacaccccaagcgucgaccaccgaggcgaccuuaccggaguauggaacccucggccuagaguguagcccccgcacgggacuggacuucaaugaaaugauccuccucaccaugaagaacaaggcguggaugguacacaggcaaugguucuuugaccugccccugcccuggacaagcggggccacgacggaaacccccacuuggaaccguaaggagcuccuggugaccuucaagaaugcccacgcuaaaaagcaggaggucguugugcuuggaucccaggaaggagcaaugcacaccgccuuaaccggggcuacggagauccaaaauucuggcgggaccuccauauuugccggccaccugaagugucggcugaagauggacaagcucgagcuuaagggaaugagcuacgccaugugcacaaacaccuucguccuaaagaaggagguaucggagacccagcauggcaccauccucauuaaaguggaguauaaaggagaggacgcgccgugcaaaaucccguuuagcacggaagacgggcaugggaaggcacacaacggccguuuaauuaccgcgaaccccgucguaacaaagaaggaggaacccgugaacaucgaggccgaaccacccuuuggggaaagcaacaucgucaucggcaucggugauaacgcgcugaagaucaacugguacaagaagggcucgagcaucgggaaaauguuugaggccaccgcucggggcgcucgccggauggcaauccugggggacacugcaugggacuucggcagcgucggcggaguacuuaauagccugggcaagaugguccaccagaucuucggguccgcauacaccgcccuguucuccggcgugaguugggugaugaagaucggcaucggcguucuauugacuuggaucgggcugaacagcaagaauacuucuauguccuucuccugcaucgccaucggcaucaucacacucuaccugggcgccguuguacaggcggacauggggugugugauaaacuggaaagggaaggagcuaaaaugugggagcgggaucuucguaaccaaugaggugcauaccuggacagaacaguacaaauuccaggcagauagccccaagcgucucgcaaccgcgaucgccggcgcgugggagaacggggucugcgggaucaggucuaccaccagaauggaaaaccuccuguggaagcaaaucgccaacgaacucaacuacauccuuugggagaacaacauaaaguugaccgugguggucggggacacgaucggcguguuagagcaggguaagagaacccugacgccgcaaccuauggagcugaaguacucauggaaaaccugggggaaggcuaagaucguuacggccgagacacagaacucuuccuuuaucaucgacggccccaacacccccgaaugccccagugcgucacgggcuuggaacgucugggagguggaagacuacggguuuggcguguucaccacaaauaucuggcuccgccuacgggaaguuuacacccaacugugcgaccaccgccucaugagcgcggccgugaaagaugaaagggcuguacacgcggacaugggauacuggaucgagagucagaaaaacgggucauggaaguuggagaaggccagccugaucgaggucaagaccugcaccuggccgaaaucccauacguuauggagcaacggcguguuagaguccgacaugaucauccccaagagccuggccgggccgaucucccagcacaaccaccgcccuggcuaucacacgcagaccgccgggcccuggcaccuuggcaagcuggagcuggauuucaauuauugugagggcaccaccguugucaucacggagaauuguggaacgcggggacccucucuccgcaccaccacggucuccggcaagcugauccacgaguggugcugccggaguugcacccugccgccccuccgauacaugggcgaggacgggugcugguacgguauggagauucggcccaucuccgagaaggaggagaacauggugaagucauuggucucagccggaagugggaagguggacaacuuuaccaugggcguucugugccucgccauuuuguuugaggaggucaugcgcgggaaguuuggcaagaagcauaugaucgccggggucuuuuucaccuucguuuugcuccuuucaggccaaaucacguggcgggacauggcccacacccucaucaugauaggcagcaaugccuccgaccgcauggggaugggggucacguaccucgcccugaucgccaccuuuaagauccaaccauucuuggcccuaggguucuuccugcgaaagcugacgucucgggagaaccuucuguuaggcguuggccucgccauggccacgacccuccaacugccggaagacaucgaacagauggcuaacggcauagcccucggucugauggcccugaagcugaucacucaauucgagacauaccaacuguggacugcucuaaucucgcugacaugcuccaacacgauauucaccuugaccguggcauggcggacugcgacucugauucucgccgggguuucgcuucugccggugugccaguccagcuccaugcgcaagaccgacuggcugccaauggcagucgccgcaaugggcgugccgccccuaccgcuguucauauucagccucaaggauacccugaagagaaggagcuggccuuuaaaugagggggugauggcggucggccucguguccauccuggcuuccagccugcuucgcaacgacguucccauggccgggccgcucgucgccgguggcuuacucaucgccugcuacgugauuacaggaacguccgcagaucugacaguugaaaaggccgcagacaucaccugggaggaagaagccgagcaaaccggcgucagccacaaucucaugaucaccguggacgaugacggaacgaugcgcaucaaagacgacgagacagagaacaucuugaccguucugcugaagaccgcauuacugaucgucucgggcauuuucccuuacagcauucccgccacgcugcucgucuggcauacguggcagaagcagacccagcgcagugguguucuaugggacguccccagcccuccugagacccaaaaggccgagcuagaggaggggguauaccgcaucaaacagcagggcaucuuugggaaaacccaggugggcgucggagugcagaaagagggcguauuccacacgauguggcacgucacccgcggcgcagugcucacuuauaacgguaaacgccuggagccaaauugggcguccguuaagaaagacuuaaucagcuacggcggcggcuggcgccugaguacccaguggcaaaagggagaagaaguacaagugaucgcuguggagccaggcaagaaccccaagaauuuccagacgaugccggggaccuuccagaccaccacgggcgagaucggagccaucgcccuugacuuuaaacccggaacgagcggcagcccaaucaucaaccgggaagggaaggucguggggcucuacgguaacggggucgucaccaagaacggcggauacguaaguggcauagcgcagaccaaugcagaacccgauggccccacucccgaacuggaagaggagauguucaaaaagcgaaaccucacaaucauggaucuacacccugggucgggcaaaacccgaaaauaccugccggcgaucgugcgagaggccaucaagcgacgccucaggacucugauacuggcgccgacgcgcguaguggccgcggaaauggaagaagcgcucaaggggcucccgauacgguaccaaacuacagcaaccaaguccgagcauacgggcagggagaucguggaccugaugugccacgcgaccuucaccaugcggcuccugagccccgugcgugugccgaacuacaaccugaucaucauggacgaggcccacuucaccgacccugccuccaucgcggcgcgaggauauaucucuacucgcguagggaugggcgaggccgccgcgaucuucaugacggccacgccacccggcaccgccgacgccuucccgcaaagcaaugcccccauccaggacgaggaacgcgacauccccgagagaaguuggaacuccgguaacgaauggaucacggacuucgcggggaagacagucugguuuguccccagcauuaaggcugggaacgacaucgccaacugccuccggaagaacgggaagaaaguuauccagcuaucccggaaaaccuuugacaccgaguaccagaaaacgaagcugaacgacugggacuucgucgugaccaccgacauaagcgaaaugggcgccaacuucaaggcggaccgcgugaucgacccacgacgcugccucaagcccgucauucuaaccgaugggcccgagagggugauucuugcggggcccaugccggugaccgcugcaucggcggcccagcgccggggccgcgucggacggaacccccagaaggagaacgaccaauacauauucacgggccagccucucaacaacgacgaagaccacgcgcacuggacagaggccaagaugcugcuagacaacauuaacacccccgaggguaucauaccggcucuauucgagcccgagcgcgaaaaauccgccgcuaucgacggcgaguaccgccuuaagggcgaaucccgcaagaccuuuguggagcugaugagacgcggagaucucccaguguggcuggcccacaaaguggccucggaaggaauaaaguacaccgaucguaagugguguuuugacggccagaggaacaaccagaucuuggaggagaacauggauguggagaucuggaccaaggaaggcgagaagaagaagcuccgcccccgcugguuagacgcccgcacuuacagugacccgcuggcacugaaggaguuuaaggacuuugcagcgggccgcaagucuaucgcacuggaccuagugaccgaaaucgggcgcguucccucacauuuggcucaucggacgcgcaacgcgcuggacaaccuggugaugcuacauacgagugaacacggcggaagggcguaccgacaugccgucgaggagcugccggagaccauggagacccugcuccugcugggucucaugaucuuacugaccggaggcgccaugcuguuccugauuuccggcaaggguaucgguaagaccuccaucggccugaucugcgugauagccagcagcggaaugcucuggauggccgagauaccgcugcaauggauagcgucagccauuguucuggaguucuucaugaugguccuccugauccccgagcccgaaaagcaaaggacaccacaggauaaucagcuggcguacgucgugaucgggauacucacccuggccgccauaaucgccgcuaacgagaugggccugcucgagacgaccaaacgcgaucugggaaugagcaaggaaccgggggucgucucauccacuagcuaccuggacguggaccuccaccccgccucagccuggacccuguacgcggucgcgaccaccgucaucaccccgaugcuuaggcacacgaucgagaauagcacggcgaaugugucuuuagccgcgaucgcgaaccaggccgucgucuuaaugggccuggauaaagguuggccuaucagcaagauggacuuaggcgugccucugcuugcccucgggugcuauucccaagucaacccgcugacucugacugccgcagugcuucuacuaauaacccauuacgcgauuauuggccccgggcuucaggcgaaggccacucgugaggcacagaagcggacugcggcggggaucaugaagaacccaaccguggacggcauuaugaccaucgaucuggauccgguuaucuacgacagcaaauucgagaaacagcugggccagguuauguugcuaguguuaugcgcaguucagcuccugcugaugcgcacgucuugggcccucugugaagcucugacccuugcgacggguccaaucacgacacucugggagggcagcccugggaaguucuggaacacgaccaucgcuguguccauggcaaacauauuucggggcagcuaccuagccggugccggucuggcuuucuccaucaugaagucgguggggaccggcaagcgcggcaccgggucucagggggagacgcucggggagaaauggaagaagaagcucaaccagcugucgcgcaaggaguucgaucucuauaagaagagugggaucacagaggucgaccgcacagaagccaaggagggacugaaacggggagagaucacucaccacgccgugucccgcgggagcgcuaaacugcagugguucguggagcguaauauggucauccccgagggucgcguuaucgaccucggcuguggucggggcggguggucuuacuacugugccggcuuaaagaaagugacagagguccgcggcuacacaaaaggcgggccgggacacgaagaacccguacccaugagcaccuacgguuggaacauagugaaacugauguccgguaaggacguguucuaucucccgcccgaaaagugcgauacccugcugugugacaucggugagucgucccccagcccgacgguagaagaaucgcgcacuauccgcgugcugaagauggucgagcccuggcuaaagaacaaucaguucugcaucaaggugcugaacccuuauaugcccaccgugaucgagcaucuugagaggcugcagcggaagcacggcgggaugcugguccgcaaucccuuaagccggaacagcacacacgagauguacuggaucagcaacggcacggggaacaucguugccagcgugaacauggugagccgccuccuucugaaccgcuucaccaugacccaucgucggccaaccauugaaaaagacguggaccucggcgcaggaacccgccacgugaacgccgagccggagacccccaauauggacgucauaggggagcggaucaagcgcauuaaggaggagcacaacuccacuuggcacuaugaugacgagaacccauauaagaccugggccuaccacgggucuuaugaggugaaggccacgggguccgcaagcucaaugauaaauggagucgugaaacuucugaccaagccgugggauguaguccccaugguaacccagauggccaugacggacacgacccccuucgggcaacagaggguguucaaggagaagguugacacccggacgccacggagcaugccaggcacgcgccggguuaugggcaucacagccgaguggcucuggagaacccugggccgcaauaagaaaccccgccugugcacccgagaggaguucacuaagaaggugcggaccaacgcggcgaugggcgcggucuucaccgaggagaaccagugggacagcgccaagacugcaguggaggacgaggacuucuggaaguugguggaccgcgagcgggaacuucacaagcugggaaagugcggcuccugcguguacaauaugauggggaaacgcgagaagaaacucggcgaguucggcaaagcaaaggggucccgggcuauaugguacaugugguuaggagcccgcuaccuggaguucgaggcucucggauuccuaaacgaggaccacugguucucacgggagaacagcuacuccggcguggaaggggaaggucuacauaaacucggcuacauccuacgcgacaucaguaagauucccgggggagcgauguacgccgacgauaccgcggggugggacacccgcauaaccgaagacgaucuccauaacgaggaaaagaucacccagcaaauggaccccgagcaccgucagcucgcgaacgccaucuucaagcugaccuaccaaaacaagguggucaaaguccagaggccgacgcccaccgguacagugauggacaucaucucccgcaaggaccagcgggggagcgggcaaguggggaccuaugggcugaacaccuucacgaauauggaggcccagcucauccgacaaauggagggggaggggguucuauccaaagcugaccucgagaacccucaucucccugagaagaaaaucacccaguggcuugagaccaagggcguugaaagacuuaagcgcauggcgaucagcggcgaugacugugucguuaaaccgaucgaugaucgguuugcaaacgcccuccuggcccugaacgacauggggaaggugcgcaaggacaucccucaauggcagcccuccaagggcuggcacgauuggcaacagguccccuucugcagccaccacuuccacgagcuuaucaugaaagacggacggaagcuaguaguuccgugccgcccccaggaugagcugauaggccgugcccgcauuucacagggggcgggcuggagucuccgcgaaacggccugccuggggaaggccuaugcacagauguggucccucauguacuuccaucggcgcgaccucagacuggccagcaacgccaucugcucagccgucccugugcauuggguuccuacuagccgcacaacguggagcauccacgcccaccaccaguggaugaccacagaggacaugcugaccgucuggaaccggguguggauugaagacaacccuuggauggaggacaagacaccagucacgaccugggaggauguucccuaccuugguaagcgcgaggaucaguggugcgggucgcuaauugggcuuacuucuagggcuaccugggcgcagaauauccccacugccauccaacaggugcgcagucucaucggaaacgaagaguuccuggacuacaugccuucgaugaagcgguuucgcaaggaggaggaauccgagggcgccaucugguga

SEQ ID NO: 25906 - RNA, 9873 nt, Artificial Sequence
  derived and/or modified CDS sequence (opt11) from DENV-3__KJ189290__SS-prME
accagccuuugcuuaaugaugauucuacccgcagcccuggccuuccacuuaacaagccgagacggcgaaccaaggaugauuguggggaaaaaugaacggggcaaaucccugcuauuuaaaacggcaagcgggaucaacaugugcacccucaucgcgauggaccucggcgaaaugugcgaugacacaguaacauauaaauguccccacauaaccgaaguagagccugaggacaucgacuguugguguaaccuaaccagcacaugggucaccuacggaaccugcaaccaagccggugaacauagaagagacaaacgaucgguggcacuggcaccccacguaggcauggguuuagauacgcggacacaaacauggaugagcgcugagggcgccuggagacaagucgaaaaaguggaaacaugggcgcugcgucaccccggguucacgaucuuagcacuauuccuagcacacuacauaggcacgucacugacucaaaaagucguaauauucauccuauuaaugcuugucacgccaagcaugacaaugcgauguguggggguagguaaccgcgacuuuguagaggggcucagcggagccacuuggguagacgugguucuggaacacggagggugcguuaccaccauggccaaaaacaaaccaacccuagauauagaacuccagaaaacagaggccacacaauuagcgacgcugcggaaacucugcaucgaagggaaaauuaccaacaucacgaccgacucaagaugcccaacucaaggagaagccguucugccggaagaacaagaccagaacuacgucuguaaacauacguacgucgacagaggauggggaaacggcugcggacuguuuggcaaggggagccuaguaaccugcgccaaguuccaaugucucgagcccauugaggguaaagucgugcaauacgagaaccuaaaauacaccguuauuaucacggugcauacgggcgaccaacaccaagucggaaaugagacacaagguguaaccgcggagaucacaccgcaagccucaacaacggaggcaacacuaccagaauacggcacacugggucuagaguguagcccccgaaccggacuagacuucaacgaaaugauacuccuuacaaugaaaaacaaggcuuggaugguccacagacaaugguucuuugaucugccgcuaccauggacgucaggcgccaccaccgagacaccuacauggaacaggaaagagcuucuugugaccuucaaaaaugcucaugccaagaaacaagagguugucguacucggaucccaagaaggggcaaugcacaccgcacuaacgggcgcaacagaaauccagaacucgggcgggacaagcaucuucgcuggccaccucaaaugccgacuaaaaauggacaagcuagaacuaaagggaaugucguaugccaugugcaccaauacuuucguacucaagaaagaagugagcgagacgcaacaugguaccauccuuaucaagguagaauauaaaggugaagacgcaccauguaaaauaccguucagcacggaggacggccacggaaaagcacauaacggacggcuaaucaccgccaacccggugguaaccaagaaggaagaacccguaaauaucgaggcagaaccacccuucggcgagucaaacauagugauaggaaucggagacaaugcacuuaaaauaaacugguacaagaaaggcagcagcaucgguaaaauguuugaggccacggcccgcggugcccggcgcauggcuauacucggggacaccgcaugggacuucggaagcguaggagggguucuaaauagccuaggcaaaaugguacaccaaaucuucggaagcgccuauaccgcccuauucucgggcgugucaugggucaugaagauugggauagggguacuauugacuuggauuggacucaacuccaaaaauacaucgaugucauuuucauguauagcaaucggaauaaucaccuuguaucucggggccgugguccaggcagacaugggaugcguaaucaauuggaaaggaaaggaauuaaaaugcggaagcggaaucuucgucacaaacgagguacacaccuggacagagcaauacaaauuccaagcagacagcccgaagcgacuggccaccgcaauagcaggagcgugggagaacggagucugcggaauccgaucaaccacuagaauggaaaaccuccuauggaagcagauagcaaacgagcucaacuauauacucugggaaaacaacaucaaacucacagugguagucggcgacaucauaggcgucuuggaacaagggaaaaggacccugacuccgcagccaauggaacugaaguacagcuggaaaaccugggggaaagccaagaucgucacugcggaaacucaaaacucgagcuucauaauagacggaccuaacacgcccgaaugcccaucugccucacgugcguggaacguaugggaaguagaggacuacggguuuggaguauucacuacgaacauauggcuucggcucagagaggucuacacgcaacucugcgaccauagacuuaugagcgcagcaguaaaagaugaacgggcuguacacgccgacaugggauauuggaucgaaagccagaaaaacggcucauggaaacucgaaaaggcuagccucaucgaaguuaaaacuugcacauggccaaaaucacauacgcucuggagcaauggcgugcuggaaagcgacaugauaauacccaaaagucuggccggaccgaucagccaacacaaccaccgccccggcuaccauacucagaccgcaggaccguggcaccugggaaaacuugaacuggacuucaauuacugcgaaggaacaacaguagucauaacggaaaauugcggcacaagaggacccucccugcgaacaacuaccguuagugguaagcuaauucacgaguggugcugccggagcugcacucugccgccauugcgcuacaugggggaagauggcuguugguacgggauggagauacgaccgaucagugaaaaggaagagaacauggugaagucauuagugagugccgggagcggcaaaguagauaacuuuaccaugggaguacucugucucgcaauccuauuugaagaagucaugagagguaaguucggcaaaaagcauaugauagcaggaguauucuucacuuucguacuauuacucucagggcagauaaccuggcgcaacauggcccacaccuuaauaaugauagguagcaacgccucugacagaaugggcaugggcgucacguaccuugcauuaaucgcgacauucaaaauacaacccuuucuugcacucggauucuuccuccggaaguuaaccagcagagagaaccuccuacugggcguaggucucgccauggcaaccacccuccaguugcccgaagauauagaacaaauggcuaacgggaucgcccuuggcuuaauggcgcucaaacucaucacgcaguucgagaccuaccagcuuuggacugcccugaucagccugaccugcucaaacaccauauucacacucacaguggcguggcgaaccgcuacacucauauuagcgggggugucccuccuccccgucugccaaucauccagcaugcggaaaacugacuggcuaccgauggcgguugcggcuaugggggucccacccuuaccccucuucaucuucagucucaaggacacgcucaagcgccgcagcuggccucucaacgagggugugauggcagucggauuaguuucaauccucgccagcagccugcugagaaacgacguaccgauggcgggaccccuagucgcgggaggccuauugauugcaugcuacguaauaaccggaacgucagcggaccuaacaguagaaaaagccgcagacaucacaugggaagaggaagccgaacaaacaggcguaucacacaaccucaugaucacggucgaugacgacggaacgaugcggauaaaagacgacgagacggaaaacauccugacaguccuauuaaagacagcccucuugaucguuucagggauauucccuuacagcauacccgcaacacugcugguauggcacaccuggcagaagcaaacacagcggucgggcguucuuugggaugugcccagcccuccggagacacaaaaagcggagcuagaagaaggagucuaccgaaucaaacaacaggguauauuugggaaaacgcaagugggaguaggaguccaaaaagagggggucuuccacacuauguggcacguaaccagaggggcaguacucacauauaacggaaagcgacucgagccgaacugggcaagcgugaagaaagaccucauaucauacggaggaggcuggaggcuauccacccaauggcagaaaggagaagaaguacaagucaucgcaguagaacccggcaaaaaccccaaaaauuuccagacaaugccagggacguuccagacuaccacaggagaaauaggagccaucgcucucgacuucaagccgggaacgucaggaagcccaauuaucaacagagaaggaaaaguggucggacuauacgggaacggcgucguaaccaaaaacgggggauacguaaguggaauagcucaaacaaacgccgaaccagacgguccuacaccggaauuagaggaagagauguucaagaaacggaaccuaacaaucauggaccugcaccccgguagcgggaagacgcgcaaguaccucccggcgauaguuagagaagccauaaaaagaagauugcggacucuaauacuggcuccaacaagaguaguagcagcugaaauggaagaagcucuaaagggguugcccauuagauaccagacuaccgcaacaaagagcgaacacacagggagggaaaucguagaccugaugugccaugccacguucacgaugagacugcucuccccaguacguguacccaacuacaaccugaucauaauggacgaagcccacuucaccgaccccgccagcaucgcugcaagagguuacauuucaaccagggucgggaugggggaggcagcggccauuuucaugacggcuaccccuccagguacagcagaugcguucccacaauccaacgcgcccauccaagacgaagaacgggacauucccgagcgaucguggaacuccggaaacgaauggauaaccgauuucgcggggaaaaccguaugguucguaccaagcaucaaggcgggaaacgacauagcaaacugcuugaggaaaaacggcaaaaagguuauccaauugucuaggaaaacauuugauaccgaauaucagaaaacaaagcuaaacgacugggacuuuguaguuacgacagauaucagugaaaugggagccaauuucaaagcggaccggguaauagauccgcgccgcugucuaaaaccagugauccugacagaugggccggaacgugucauacuagccgggccgaugccgguaacagcggcgagcgcggcacaaaggcgaggacgcgugggucgaaauccacaaaaagaaaaugaccaauacauuuuuacaggccaaccccuuaacaacgacgaggaccacgcacacuggacagaggccaagaugcugcuagacaacaucaauaccccggaaggaauaaucccagcgcuauuugagccggaacgcgaaaaguccgcagcaauagacggagaauaccgccugaaaggagaaagcaggaaaacguucguggaacuuaugaggcgcggagauuuaccagucuggcuggcucacaaaguagcaagcgaagguaucaaguacacagacagaaaaugguguuucgacggacagagaaauaaccaaauccuagaggaaaauauggacgucgaaaucuggaccaaggaaggugagaagaagaaacucagaccccgcuggcuagaugcgaggacguacucagacccucuagcgcucaaagaguucaaggauuucgccgcaggacgcaaguccaucgcgcucgacuugguuacggaaaucgggagagugccgucacaccucgcgcaucggacacggaacgccuuagacaacuuaguuauguuacacaccagugaacacgggggucgcgcauaccgccaugcgguagaagaauuaccugagacaauggaaacguugcuauugcuggguuugaugauccucuuaacaggaggggccaugcucuuucuuauaucaggaaagggaaucggaaagaccaguauaggccuaaucugcguuauagcauccagcgggaugcucuggauggcagaaaucccgcugcaauggauagccagcgccaucguacuagaauuuuucaugaugguauuacuuaucccugagcccgagaaacagcggacgccgcaagacaaccagcuagcauacguaguaauaggcauccuaacacuagcugccauaauugcagcgaacgagaugggccuccuugagacgacaaaaagggaucuagguauguccaaagaaccaggcguaguuaguccgacgucguaccucgacguugaccugcacccagccagcgccuggacucucuacgcaguugcaacgacagucaucacgcccaugcuccgacacacuaucgaaaacucuaccgcuaacgugagcuuggcagcaaucgcuaaccaagcgguaguacuaaugggucuggauaaaggauggccuaucucaaaaauggacuuaggggucccccuccucgcgcuuggcugcuacucccaaguaaacccgcuaacccucacggccgccguccugcucuuaauaacgcacuacgcgaucauagguccaggccuccaagcgaaagcaacgcgcgaagcucagaaacgcaccgccgccgggaucaugaaaaauccuacaguagacgguaucaugaccauagaucuggauccggucauauacgacagcaaauucgaaaaacaacucggacaaguaaugcuucucguucugugcgcaguccagcuccuauuaaugcgaacaagcugggcccugugcgaggcgcucacgcuggcgacgggaccaaucaccacgcuuugggaagggucccccgguaaauucuggaacacuacgauagcagugucgauggcaaacaucuuccggggaagcuacuuggcaggcgccggccuagccuucagcauaaugaaaagcguugguaccgguaaacgaggcaccggcucccagggggagacgcucggagaaaaguggaagaagaaacucaaccagcugagccgaaaagaguuugaccuuuauaagcgcucagggauaacagaagucgaccguacggaggccaaggaaggacuaaaacgcggcgaaauaacccaucacgcagugucccgaggcuccgcaaagcuacaaugguucgucgagcguaacauggucaucccagagggccgcguaaucgaucucggaugcggacgaggaggcuggagcuacuacugugcuggacuaaagaaagugacugaaguaagaggauacacuaaagguggacccggucaugaagaacccguaccgaugucaacguauggcuggaacaucguaaaacucaugaguggaaaggaugucuucuaccucccgccagagaaaugcgacacgcuucuuugcgauauuggcgagaguucccccaguccgacagucgaagagucaaggacuauaaggguacugaaaaugguggagcccuggcucaagaacaaccaauucugcauaaagguacugaaccccuacaugccuacagucauagaacaccuagaacgccuccaacgaaaacacggugggaugcuaguccgcaauccccuaucacgaaacaguacucacgaaauguauuggauauccaaugggaccggcaauauuguggccagugucaacaugguaucacgacucuugcuaaaccguuucacaaugacgcaccggcguccgacgauugagaaagaugucgaccucggugcagguacuaggcacguaaacgccgaacccgagacacccaauauggacgucauaggagagaggaucaaaagaauaaaagaggaacauaacuccacauggcacuacgacgaagaaaaccccuacaagacgugggcguaucacggaucauacgaagucaaggcgacagggagcgcauccucgaugaucaauggagucguuaaauuacuaacgaagcccugggacgucgugcccaugguuacccagauggcaaugacagauacgaccccauucgggcagcagagaguguuuaaagagaaagucgacacaaggacaccacgaucaaugccggguacaagaaggguaaugggaauaaccgcggaaugguuauggagaacccucgguagaaacaagaaaccucgguuaugcacgcgggaggaguucacuaagaagguacggacaaacgcggccaugggggccguguuuaccgaggagaaccagugggauagcgcgaaagcagcagucgaggacgaagacuucuggaagcuaguggacagggaaagagagcuacacaaacucggaaaaugugggucguguguguacaacaugaugggcaagcgcgagaagaaauugggugaguucgguaaggcgaaagggagucgagccaucugguacauguggcugggagcccgcuaccucgaguucgaggcccuaggauuccuaaacgaagaucauugguuuagccgcgagaacucuuacucgggagucgaaggagagggcuuacauaaacuaggauacauacucagggacaucuccaagauaccaggcggcgcaauguaugcagacgacacggccgggugggauacccggauaacggaggaugaccugcacaacgaggagaaaaucacgcaacaaauggaccccgagcauaggcaacuggcaaaugcaaucuucaaauuaaccuaucaaaacaaagucgucaaaguccagagacccacccccacgggcaccguaauggacaucauaaguagaaaagaccaaagaggaucaggacaagucggcacauaugggcucaacacauucacaaacauggaggcacaacucauaagacagauggagggagaaggcguccuaucgaaagcggaucuugagaacccccaucuuccagagaagaaaauuacacaguggcuggagaccaaaggcgucgaacgccuaaaaaggauggcaauaagcggggacgacugcguagucaaaccaaucgacgaucgcuucgcaaaugcgcuccucgcacugaacgacauggggaaaguacgaaaagauauaccgcaauggcagccgucgaaaggauggcacgacuggcaacaaguacccuucuguucgcaucauuuucacgagcugauaaugaaggacggaaggaaauuaguagucccaugcaggccccaagacgagcugaucgguagagccagaaucucgcaaggcgcaggauggucccuacgagaaaccgccugcuugggaaaagccuacgcacaaauguggucccuaauguauuuccacagacgggaucuuagacuggcaucaaacgcuaucugcuccgcgguaccgguucacugggucccgacgucgcgaacaacauggucuauacacgcacaccaccaguggaugaccaccgaagacaugcugacgguuuggaauagaguauggauugaagauaacccguggauggaagacaagacaccuguaaccaccugggaggacguaccuuaccugggcaagcgagaagaucaguggugcggaucuuuaaucggcuuaacaagccgagcgacaugggcacaaaacauaccuacggccauacaacaagugagaagucugaucgguaaugaagaguuccuagacuacaugccgagcaugaaaagauuccgaaaggaagaggagagugaaggagccaucugguaa

SEQ ID NO: 25907 - RNA, 9873 nt, Artificial Sequence
  derived and/or modified CDS sequence (opt11) from DENV-3__KJ189291__SS-prME
acaucucucugucucaugaugauucugccggccgcccuggcguuccacuugacuagccgggacggggagccgcggaugaucguggggaaaaacgagcggggaaagucacugcuguucaagacagcguccgggaucaacaugugcacccucaucgcgauggaucucggagagaugugcgacgacaccgugaccuacaaguguccccacaucacagagguggagccagaggacaucgacugcuggugcaaccucacgagcaccugggugaccuacgggaccugcaaccaggccggcgagcaccggcgugacaagcgguccguggcccucgcgccacacguagguauggggcuggacacccgcacccagacauggaugagcgccgagggcgcauggcgccagguggagaaggucgaaacaugggccuuacgccauccgggguucaccaucuuggcgcuguucuuggcccacuacaucgggaccagccucacccagaaaguggugauauuuauacugcugaugcucgucacgccgagcaugaccaugcggugugugggggugggcaaccgcgacuucgucgaaggacucuccggggccaccuggguagacgugguacuggaacacggagggugugugaccacgauggccaagaacaagcccaccuuagacauugagcugcagaagaccgaggcuacacagcuggcgacgcucaggaagcugugcaucgagggcaaaaucaccaacaucacgaccgacagccgaugcccuacgcagggcgaggcaguccugccggaggagcaagaccagaauuacgugugcaagcacaccuauguggacagggguugggguaacgggugcggccuuuucgggaagggcucccugguuaccugcgccaaguuccagugccuggagcccaucgaaggcaaagucgugcaguacgagaaccuuaaguacaccgugaucaucacuguccacaccggggaucagcaccaggucggcaacgaaacacagggggucaccgcggagaucacgccccaggccagcacaaccgaggccacucugccggaguacggcacccuggggcucgagugcuccccgcgcacgggcuuagacuucaaugagaugauacugcugaccaugaagaacaaggccuggauggugcaccggcagugguucuuugaccugccccugccguggacuagcggcgccaccacggagaccccaaccuggaaccgcaaggaacucuuagucacguuuaagaacgcccacgccaagaagcaggagguugugguucuggggucccaggagggcgcgaugcacacggccuuaaccggggcaaccgagauucagaacagcggcgggaccuccaucuuugccggccaccugaagugccgccugaaaauggauaagcucgaacugaagggcaugucuuaugccauguguacgaacaccuuuguccugaagaaggaggugagugagacccagcacgggacgauacugaucaagguugaguacaagggugaggacgcgccaugcaaaauccccuucagcacggaggacggccacggcaaggcccacaauggucgccugauaaccgccaacccagucgugaccaagaaggaggagcccgugaacaucgaggccgagccccccuucggggagaguaauaucguuaucggcaucggcgacaaugcgcugaagaucaacugguacaagaagggcucgagcauagggaaaauguucgaggcgaccgcucggggcgcccgccggauggccauucuuggcgacacggcgugggacuucggguccgucggagggguacuaaauagccugggcaagaugguccaccagaucuucggguccgccuacaccgcccuguucagcggcguguccugggugaugaagaucggcaucgggguccuccugaccuggaucggccugaacucuaagaacaccuccaugucguucucaugcaucgcuauagggaucaucacguuguaccuuggcgccguagugcaggcggacauggggugcguuauuaacuggaagggcaaagagcugaagugcggcucagguauauucgugacgaacgaaguacacaccuggacggagcaguacaaguuucaggccgauuccccaaagcgccucgccacggccauagccggagcgugggagaauggggucugcggcauacgcaguacaacccggauggagaaccugcuguggaagcagaucgcaaacgagcucaacuacaucuuaugggagaacaacauuaagcugacggugguugucggggauaucaucggcgugcuagagcagggcaagcggacgcugacgccccagccgauggaacugaaguacaguuggaagaccugggggaaggccaagaucgugaccgccgagacgcagaauagcuccuuuauuaucgauggacccaacaccccugaaugcccaagcgcgucccgagccuggaacgucugggagguggaggacuauggguucgguguguucaccaccaacaucuggcuccgcuuacgggaggucuauacucagcuuugcgaccacaggcugaugagcgccgccguaaaggacgagagggcuguacacgcagacaugggcuacuggaucgagagccagaagaacggguccuggaagcuggagaaggccagccugauagaggucaaaacgugcaccuggccgaagucccacaccuuguggagcaacggcgugcuggaguccgacaugaucauccccaagucacuggccggacccaucucccaacauaaccaccgcccuggauaccacacccagacggcagguccuuggcaccuuggcaaguuggagcuggauuucaauuacugcgagggcacuaccguggucauuaccgagaauugcgggacccgcggccccucucuccgcaccaccaccguguccgggaagcucauacacgaguggugcugccgcagcuguacguuacccccucuccgcuacaugggcgaagacgggugcugguacgguauggaaauccggcccaucagugagaaggaggagaacauggugaagagccuggucucagccggcagcgggaagguggacaacuucaccaugggggugcugugucuggcgauccuguucgaggaggucaugcgcgggaaguucgggaagaagcacaugauagccgggguguucuucaccuucgugcugcuacuguccggccaaaucaccuggcggaacauggcccacacgcugaucaugaucggcagcaacgcuuccgaccggauggguaugggugucaccuaccucgcccugaucgcgacauucaaaauccagcccuuccuggcccucggguucuuccuacggaagcugaccagccgcgagaaccuccugcugggcgugggccucgccauggccacuacgcuccagcugcccgaggacaucgaacaaauggcuaacgggaucgcccuaggucucauggcccugaaguugauaacccaguucgagaccuaccagcuguggaccgcguugaucagccugaccugcucaaauacgaucuucacccugacgguugccuggcggaccgcgacccuuauccucgcuggggucucgcugcugccggucugucaguccagcucgaugcggaagaccgacuggcuccccauggccguggcugccaugggcgugccgccgcugccgcuguucaucuucucucucaaggacacacucaagcgccgguccuggccccugaacgagggugugauggccgucggcuuggugucaauccuggccuccagccuguugcgcaacgacguuccgauggccggcccccugguggcagggggccuguuaaucgccugcuacgugaucacagggaccuccgcggaccugaccguggagaaggcagccgacauuaccugggaggaggaagcagaacaaaccggcgucagccauaaucugaugauuacaguggacgacgauggcaccaugaggauuaaggacgaugagaccgaaaacauccucacggugcugcugaagaccgcccuccuuaucgucuccggcaucuucccguacagcaucccugcgaccuugcucguguggcacaccuggcagaaacagacccaacgguccggcgugcugugggauguccccuccccgcccgagacccagaaagccgaacuggaggaggggguguaccgaaucaagcagcaaggcaucuucgguaagacgcaggugggcgucgguguacaaaaggagggcgucuuccacacaauguggcacgucacgaggggcgccgugcucaccuacaacgggaagcggcuggagcccaauugggccuccgugaagaaggaucugaucagcuacggcgggggauggcgccuguccacccaguggcagaagggggaagaggugcaggugaucgcgguggagccuggcaagaaccccaaaaacuuccagacuaugcccggcacguuccagaccaccaccggggaaaucggcgccaucgcccuggacuucaagccgggcacaagcgggucaccuaucaucaaccgugaaggcaaggucguggguuuguacggcaacggcguugucacaaagaacggcggguacguguccggaaucgcgcagaccaacgccgagccggauggccccacacccgaacuggaggaagagauguucaagaagcgcaaccucacgaucauggaccugcaccccgguagcggcaagacgagaaaauaccugccggcuauagugagggaggccauaaagcgccgucuccguacgcugauccuggcgcccacccgcgucgucgcagccgaaauggaggaagcgcuuaagggccugcccauccgguaccaaacgaccgccacuaaaucggagcacaccggccgcgagaucguggaccucaugugccacgccacguuuaccaugcggcuccugucgcccguccgcgugccgaacuauaaccugaucaucauggacgaggcccacuucaccgaccccgccagcaucgcagcccggggauacaucucgacccgcgugggcaugggcgaggccgccgcgauuuuuaugacggccacgccgcccgggaccgccgacgccuucccgcaguccaacgccccgauccaggacgaagagcgcgacauccccgaaaggagcuggaacuccggcaacgaguggaucacugacuucgcggggaaaacggugugguucgugcccucgaucaaggccggcaacgacaucgccaacugccuccguaagaaugggaagaaggugauucagcugagucggaagacauucgacaccgaguaccagaagacgaagcucaaugacugggauuucgucgugacgaccgacaucuccgagaugggcgccaacuucaaggccgaccgcgugaucgacccgcggcgaugccucaagccagucauacugacggacggccccgagcgggugauucuggcggggccaaugccggugaccgcggccuccgcugcgcaacgccggggucgugucgggcggaacccgcagaaggagaacgaccaguacaucuuuacuggccagccccucaauaacgacgaggaccacgcucauuggacggaggccaagaugcugcuggacaacaucaauacccccgaggggaucaucccagcccuguucgagcccgagcgcgagaaaucggccgcaaucgacggcgaauacagguugaagggagagucucgcaagaccuuugucgaacugaugcggcgcggggaccuaccuguguggcucgcccacaaggucgccagcgagggcaucaaauacacugaccggaaguggugcuucgacgggcagaggaacaaccagauccuggaggaaaacauggacguggagauuuggacaaaggagggcgagaagaagaagcuccggccccgcuggcuggaugcccgcaccuacagcgacccgcuggcccucaaggaguuuaaggacuucgcggccggccgaaagagcaucgcucuggaccuggucacugagaucgggcgcgugcccucccaucucgcgcaccggacuagaaacgcccuggacaaucuggugaugcuucacacgagcgagcacggcggucgagcauaucggcacgccguugaggagcucccggagaccauggagacccugcuccugcugggccucaugauccugcucaccgggggcgccaugcuuuuccuaaucagcggcaagggaaucggcaagacguccaucggguuaaucugcgucauugccagcuccggcaugcucuggauggccgagaucccgcugcaguggaucgcaagcgcaaucguguuggaguuuuucaugauggucuuacugaucccagagcccgagaagcagcggacgccucaggacaaccagcuggccuauguggugaucgggauccucacccuggccgccaucauagcggccaacgaaaugggacugcucgagaccacuaagcgcgaccugggcauguccaaggagccgggcgucgugucucccaccuccuauuuagacgucgaccuccacccagccagcgcguggacccucuacgcggucgccaccacagugaucaccccgaugcugcgacacaccaucgagaacaguacggcuaacgucagccucgccgcaaucgcgaaccaagccguggugcugaugggccuggacaagggguggccgaucucuaaaauggaccucggcgugccauuacuugcccucggauguuacagccaggucaauccguugacgcuuaccgccgccgugcuacugcugaucacccacuacgcuaucaucggacccggccuccaagccaaggccacgcgcgaggcccagaagcggacggcggcagggauaaugaagaauccgaccguggacgguauuaugaccauugaccuggacccugugauuuacgacuccaaauucgaaaagcaguugggccaagugaugcuccuggugcugugcgccguccaguuauuacugaugcgcaccucgugggcccuaugcgaggcccugacguuggcgaccggcccgaucacuacgcuuugggaaggaucccccgggaaauucuggaauacgacuaucgccgugaguauggccaacaucuuccggggcucuuaccuggcgggcgccggccuggcguucagcauuaugaagucgguuggcacaggcaagagggguaccgggagccagggcgagacacucggcgagaaauggaagaagaaacucaaccaacuaucucggaaggaguucgacuuauauaagcgcuccggcauaacggaagucgacaggaccgaggccaaggagggguuaaagcgcggggagaucacccaccacgccgugagccgggguuccgccaagcuccagugguucguggagcgaaacauggucaucccugaagggcgggugaucgaccucggaugcgggagaggcggguggagcuacuauugcgccggccugaagaagguaaccgagguccgcggcuacacgaagggcgggcccggccacgaagagcccgugcccaugagcacguacggcuggaacauugugaagcuuaugagcgggaaggacguuuucuaccuaccucccgaaaaaugugacacccugcuaugugacaucggcgaguccagccccuccccgaccguagaggagagccgaaccauccgcguacugaagauggucgagccguggcucaagaacaaccaauucugcaucaagguacugaaccccuacaugcccaccgugauagaacaucuggagcggcuccagcgcaagcacggcgggaugcuggucagaaacccucugucccgcaacagcacccacgagauguauuggaucuccaauggcaccgggaacaucguggcgagcguuaauauggucucccgguuauugcugaaucgcuucacuaugacacaccggcggcccaccaucgagaaggacguggaccucggcgccggcacccgacacgugaaugccgagcccgagacgcccaauauggacguuaucggggaacgcaucaagcggauaaaagaggaacauaauucaacguggcacuacgacgaagagaaccccuacaaaacgugggccuaccacggcuccuacgaggucaaggcgaccggcucggcgaguagcaugaucaacggaguugucaaacuuuugacaaagcccugggacgugguccccauggugacccaaauggccaugaccgauacgacgccguucgggcagcagcgcguauucaaggaaaaggucgacacccggaccccucgcaguaugcccgguaccaggcgaguuaugggcaucacagccgaguggcucuggcggaccuuagggcgcaacaaaaagccccgccugugcacccgggaggaguucaccaaaaaaguacgcacgaaugccgcuaugggggccgucuucaccgaggagaaccagugggauuccgccaaagccgccguggaggacgaggacuucuggaaacucgucgaccgggagcgcgaauugcacaagcuggggaagugcgggagcugugucuacaauaugauggggaagcgggagaagaagcucggcgaguucggcaaggcaaaaggaucccgcgccauaugguauauguggcugggggcccgguaccuggaguuugaggcccucggguuccugaacgaggaccauugguucagccgcgagaacuccuauucugggguugagggggagggucuucacaagcucggcuacauccugcgagacaucuccaagauccccgggggcgccauguacgcggacgacaccgccgggugggacacccgcaucacggaagacgaccugcacaacgaagagaagaucacccagcaaauggacccggagcaccggcaguuagcaaaugccaucuucaaacugacauaccagaacaaggucgucaaggugcaacgcccuacccccaccggcacggugauggacaucauaagcagaaaagaucaacgcggcucggggcaagucggcacguacgggcugaacacguucacaaacauggaggcccagcucaucagacagauggagggcgaaggggugcugagcaaggcggaccuggagaacccccaucucccggagaagaagaucacgcaauggcuugagaccaagggcguggagagacugaagcggauggccaucucaggcgacgauugcguggugaagcccaucgacgauagguucgccaaugcccuccuggcccugaacgauaugggcaaggugcggaaggacaucccacaguggcaaccgagcaagggguggcacgacuggcagcaggucccguucugcucccaccauuuccacgagcucaucaugaaggacggcagaaagcugguggugcccugccggccccaggacgagcugaucggccgcgcgcggauuagucagggggcaggcuggucccuccgcgaaaccgcaugccugggcaaggccuacgcacagauguggaccuuaauguacuuccaccgccgggacuugaggcucgccagcaacgccaucugcucagccgucccgguccacuggguuccaacgucucggaccacuugguccauccaugcgcaccaccaauggaugaccacggaagauaugcuaacggucuggaaccgcgucuggauagaagacaacccauggauggaggacaaaacucccguaaccacgugggaagacguccccuaucucgggaagagggaggaucaauggugcggcagccuaaucggccugaccagccgugcgaccugggcccagaacaucccgaccgccauccaacaagucagaucgcugauagggaacgaggaguuucuggacuauaugcccucaaugaagcgcuuccggaaggaggaggaguccgagggggccaucugguga

SEQ ID NO: 25908 - RNA, 9873 nt, Artificial Sequence
  derived and/or modified CDS sequence (opt11) from DENV-3__KJ189292__SS-prME
accagccuaugccuaaugaugauacuacccgcggcccuagcguuccaucuaacguccagggacggagaaccccgcaugaucgucgggaaaaacgaacgcggaaaaagucuacuguuuaaaacagcgaguggaaucaauaugugcacacuaaucgcuauggaucuaggcgaaaugugcgacgauacaguaacuuacaaaugcccacacauaaccgaagccgaaccagaagacaucgauuguuggugcaaccucacaagcacauggguuacauacggcacauguaaccaagccggcgaacaccggagagacaaaaggagcgucgcacucgcaccacaugucggaaugggucuugacacucgaacccagaccuggaugagcgccgaaggggcauggcgacaaguggaaaaaguggaaaccugggcauugagacacccggguuucaccauccucgcgcuauucuuggcgcauuacauaggcacaucccugacacaaaaagugguuaucuucauccuacuaaugcuaguaacgcccuccaugacgaugaggugcguagggguugggaaccgugacuucguggaggggcuaaguggggccacguggguagacguugugcuagaacacggagggugcgucaccaccauggcgaaaaauaaacccacguuagacaucgaacuacagaaaacagaagccacacaacuggcgaccuugagaaaacuaugcaucgaggguaaaaucacuaauauuacuaccgacagccguuguccaacacagggcgaggcaguucugcccgaagaacaagaccaaaauuaugugugcaaacauacauauguggauagaggcuggggcaacggcugcggacuguucgguaaaggaucgcucgucacgugcgcuaaguuccaaugucuggaaccaauagagggaaaagucguccaauacgagaacuuaaaauacacaguaaucauaacaguacauacaggagaucaacaccaaguaggaaacgagacucagggcguaaccgcagaaauuacaccgcaggcuagcacgacagaggcaacucuccccgaguacggaacccucgggcuagaauguuccccaaggacagggcuagacuuuaacgagaugauccuacucacaaugaagaauaaggcguggaugguucacaggcaaugguuuuucgaccuaccgcuuccguggacgagcggggcgacaacggagaccccaacauggaaccgaaaagaacuucuaguaaccuucaaaaacgcccacgccaagaaacaggaagugguuguucuaggaucccaagagggggccaugcacacugcgcuaaccggcgccacagagauccaaaacagcggagggacgagcauauucgcaggacaccuaaaguguagacucaaaauggauaaauuagaacucaagggaaugagcuacgccauguguacaaauacuuucguauuaaagaaagagguauccgaaacacagcacggcacuauuuugaucaagguugaauacaaaggggaggaugcaccuugcaaaauucccuucuccacagaagacggccacgguaaggcccacaacgggagauuaaucacggcgaacccugugguaacaaagaaagaagaaccgguuaauauagaggccgagccacccuucggagaaucgaauauaaugauugggaucggagacaacgcucuaaaaauaaacugguacaaaaagggcucauccauaggaaaaauguuugaggcuaccgccaggggcgcucgcagaauggccauucugggagacacagcaugggacuucggaucagucggaggagugcugaacagucugggaaaaaugguucaucagauauucggaagcgcauacacugcgcuauucagugggguguccuggguuaugaaaauugguaucggaguauugcugaccuggaucggacuaaacuccaagaacaccucuaugucauucuccugcauugcgauaggaauuaucacacuauaccucggagcgguaguacaggccgauaugggcuguaucauaaacuggaaggggaaagagcuaaaaugcggaagcggaauuuucguaacaaacgaaguucacaccuggacagagcaauacaaguuccaagcggacucuccaaagaggcuggccacagcaaucgccggagcuugggagaacggggucugcgggaucaggucgacgacacgaauggaaaaucugcuauggaagcagauagcaaacgagcuaaauuauauuuuaugggaaaacaacauaaaacuaacgguuguagucggugacaucaucggcguucuagaacaagguaaaaggacucugacuccacagccgauggaguuaaaguauucauggaaaaccugggguaaagcgaagauagucacagcggaaacacaaaauucauccuucauuaucgacgggccgaacacgccagagugcccgucggccucgcgugcguggaacgucugggaaguagaggacuacggguuuggcguauucacgacaaauauauggcuaaggcuaagagaaguuuauacacaacuaugcgaccaucgccucaugagcgcagcagucaaagacgaacgcgccgugcaugcagauaugggauacuggauagagagccagaaaaauggcucguggaaacuggagaaagcuagccucaucgaagucaaaaccuguacauggccuaagucgcauacgcuuuggagcaacggggugcuagagucggacaugaucaucccaaaaucgcuagccgggccgauaagucaacacaaccaucgcccaggguaccacacgcagaccgccggaccguggcaccuuggaaaacuugaacuugauuucaacuacugcgaggggacuaccgucgucauaacugagaacugcgguacgcgugggccgagcuuaaggacuaccaccgugucaggcaaacucauacacgaauggugcugucguucgugcacccuaccacccuugcgguauaugggcgaagacggcugcugguacgggauggagauacgaccgauaucagagaaagaagaaaacauggucaagucgcuagucuccgccggcuccggcaaggucgacaauuuuacgauggguguccuaugucuagcgauccuauuugaggagguuaugcggggaaaguucggaaagaaacacaugaucgcgggcgucuuuuucaccuucguucugcuccuauccggacagauaacauggcgcgauauggcacacacccucauaaugauaggaucgaacgccucugaccggaugggaaugggcgugacauaccucgcccucaucgccacuuuuaagauacagccuuuccuagcccugggguucuuccuaaggaaauugacgagccgggagaaccuacuccuagguguagggcuagcaauggcuacuacacuucaacuaccagaagauauagaacagauggcaaacggaauagcgcucggccucauggcauugaaacugauaacacaauuugagacauaccaacuauggacugcgcugauaagucuaacaugcuccaacacgauauuuaccuuaacggucgccuggaggacagcaacuuugauacuagccggugucagucuacuaccagucugccaaagcucaagcaugcguaaaacagauuggcuaccgauggcgguugcggccauggggguaccaccgcugccccuguuuaucuucagccuaaaggauacguuaaaaagacgaaguuggcccuugaacgagggcgucauggcgguagggcucguauccauccuagccuccucgcuucuaaggaacgacgucccaauggcggggccacucgucgccggcggccuucuaaucgcauguuacguaauaacggggaccucugcagaccucaccguagaaaaggcggccgacaucacgugggaagaagaggccgaacagacggggguuucccacaaucuaaugauaacuguagacgacgacgggaccaugcgcauaaaggacgacgaaacugaaaacauacucacaguucuucugaaaacggcccucuugaucguaucuggaauauuuccguauaguauccccgcgacgcuacuuguauggcacacguggcagaaacaaacgcaaagaagcggagugcucugggacguccccagcccacccgaaacacagaaagcggaguuagaagaagggguguaccggauaaaacaacaggguaucuuuggaaagacccaaguggggguaggaguacaaaaagagggcguauuccacacgauguggcacgucacucgcggugcaguacuaacguauaacgggaaaagguuagaacccaacugggcauccguaaagaaagaucuaauaucauacggcgggggauggagacuuaguacucaauggcaaaaaggcgaggagguacagguuaucgcggucgaaccggggaaaaacccaaagaacuuccaaacaauaccgggcaccuuccagaccacaacuggggagauaggcgccauagcucuggauuucaagcccgggaccagcggcagcccaauuauuaauagggagggaaaagucguaggacuuuaugguaacggagucguuacuaagaaugggggauacguuagcgggauagcgcaaacuaaugccgagccugacggcucaacucccgagcuugaagaggagauguucaagaagcgaaaccucacgaucauggaccuccacccaggauccggaaaaacccgaaaauacuugcccgcgauagugcgcgaagcgauaaaacgacggcuaaggacacucauacuggcgccaacaagaguaguggcggcggaaauggaggaagcauuaaagggacuucccauaagauaucagacgacagccacuaagucagaacacaccggccgagaaaucgucgaucuuaugugccacgccaccuucacaaugcgucuacuaucgcccgucagggucccaaacuacaacuuaaucaucauggacgaagcccacuucacggaccccgcaagcauagcggcacgagguuauauaagcacgcggguugggaugggggaagccgcugccauauuuaugaccgcaacaccaccaggaacagccgaugcauucccacaaucgaacgcgccgauucaggacgaggagcgcgacauacccgaacgcagcuggaacucaggaaaugaauggauaaccgauuuugcagggaaaaccgucugguuuguaccgucaaucaaagccgggaacgauauagcaaacugccuacgcaagaacggcaaaaaggugauacaacugagccgaaaaacauucgacacggaguaccagaaaacaaaacucaaugacugggacuucguaguuacgacagacauaagugagaugggagccaauuuuaaagcugacagggucauagacccacggcgcugccugaaaccggucauccugacggaugggcccgagagagucauacucgcaggaccaaugccagugacgguugcgucggcagcgcagcgacgcgggcgggugggacguaacccgcagaaagagaacgaccaguacaucuuuacaggucaaccccugaacaaugaugaggaucacgcucacuggacggaagcaaagauguugcuugacaacaucaauacaccagaaggcaucaucccggcgcuauuugaaccagagagagagaagagugccgccauugauggagaguaccgccucaaaggggaaagcagaaaaacguucguggaacugaugcgaagaggcgaccuccccgucuggcuagcucauaaaguagcuagcgagggcauuaaauauacagaccgaaaguggugcuuugacggacaaagaaacaaccaaauccucgaggagaacauggacgucgagauauggaccaaagagggcgagaagaagaaauugagacccagguggcucgaugccaggacauacagcgacccgcuagcccuaaaagaguucaaggauuuugcggcagggcgcaaauccaucgcauuggaccuagugacugaaauuggccggguaccgagccaccuagcucaucggacacggaacgcacuugauaaucuggucauguuacacacgucggagcacggcgggagagcauaccgccacgcaguugaagaacugcccgaaacgauggaaacacuauuacugcugggccugaugauccuauuaacuggaggcgcgaugcucuuucugauaaguggaaaagguaucggaaagacgagcaucggacugauaugcguaaucgcaagcaguggaauguuauggauggccgaaauuccgcugcaauggauagcaucagcaaucgugcuggaguucuucaugaugguacuacuaaucccggagcccgaaaagcagcgaacaccccaggacaaucagcuggccuacguugucaucgggauucucaccuuggcagcuauaaucgcagccaacgaaaugggccuccucgaaaccacaaaacgagaccucgggaugagcaaagagccgggugucgucagcccaaccucuuacuuggacguagauuugcaccccgcaagcgcauggacccuauaugcggucgcgaccaccguaaucacacccaugcucaggcacacaauagagaacagcacggccaacguuucacuugcggccaucgccaaccaggcaguggucuuaaugggcuuagacaaggguuggccgauaagcaaaauggaccuaggggugccucuauuggcguugggcugcuacucacaagucaaccccuugacgcucacagccgccguccuccugcucaucacucacuacgcuaucauaggacccggucuccaggccaaagccacgagggaagcccaaaagcggacagcagccggaauaaugaagaacccaacaguagacggaaucaugaccauagaccuagaucccguaauuuacgauucaaaauucgagaagcagcuuggccaggugaugcuccugguacucugugcaguacaacuacugcuaaugcgaaccucaugggcccugugcgaggcgcucacacucgccaccggaccgauaacgacccugugggaggggagccccgguaaauucuggaacacuaccauagccguaucgauggcaaacauauuccgggggaguuaccuagcaggggccggacuagcauucucuauaaugaaaagcgucgggacugggaaaagaggcacuggcagccaaggugagacguugggggaaaaguggaagaagaaacugaaccagcucagucggaaagaguucgaccuuuacaagaagucaggcauaaccgagguagacaggacagaagcuaaagagggucucaagagaggugagauuacccaccacgcaguaucacgagggagcgcuaagcugcagugguuuguggaacggaauauggucauaccugaggggagaguaaucgaccuggggugcggcagagggggauggucauacuauugugcaggacucaagaaagugacggaaguacggggguacaccaagggcgggccaggacacgaagaacccgugccuaugagcacauacggauggaauaucguaaaguuaaugagcggcaaagacgucuucuaucucccuccagaaaaaugcgacacgcuacuuugcgauauuggggaaaguucgccuucacccacgguugaagaauccaggacuauaagaguguuaaaaaugguggaaccauggcucaaaaacaaccaguucugcauuaaaguccugaacccuuacaugccaacgguaauagagcaccucgagaggcuacaacggaaacacggcggaaugcucgucagaaauccccuaucccguaauaguacacaugaaauguacuggaucucaaacgggacagggaacauaguggcuagcguuaacauggugagccgauugcucuuaaaccgauucacgaugacacaccgucggcccacaaucgaaaaggacgucgaccucggggcugggaccaggcaugucaacgcggagccugaaacaccaaacauggacguuaucggcgaacggauaaagaggaucaaggaagaacacaacaguacguggcacuacgacgaugaaaacccauacaagacaugggccuaucacggaagcuacgaaguuaaggcuacaggaucagccagcucuaugauaaacggagucguaaaacuacucacgaagccuugggacgucgucccgaugguaacgcaaauggcgaugaccgacacgacgccauucgggcagcaacggguguuuaaggagaaaguagauacacgcacaccgcggucaaugccuggaaccaggcgagucaugggcaucacagccgaguggcucuggcgaacccuaggaagaaacaagaaaccucgccucugcacacgagaggaguucaccaagaaaguccguacuaacgcagcgaugggcgccguauucacggaagaaaaccaaugggacucggcgaaggcagcgguggaagacgaggacuucuggaagcuagucgaccgggaacgggaauuacauaaacucggcaaauguggcucaugcguguacaacaugauggggaagcgagagaagaaacuaggagaguucggcaaagcaaaagguucccgggccauaugguacauguggcucggagcucgauaccucgaguucgaggcucucggcuuucuaaacgaggaccacugguucucaagagagaacucguacaguggcguagaaggugaaggccuacacaaguuaggcuacauacuucgcgacauaucgaagauacccggcggggcgauguacgccgacgacaccgccggcugggacacaaggauaaccgaagaugaucugcacaacgaagagaaaauaacgcaacaaauggacccagaacaucgacaauuggcaaacgcaauauucaaacuaaccuaccaaaauaaaguggucaaagugcaacggcccacacccacaggcacaguaauggacauaauuagucgaaaagaccaaagggggucgggacaaguaggaacauacggacugaauaccuucaccaacauggaaguacaacucauacgccagauggaaggcgagggcguccugagcaaggcugaccuggagaacccccaucucccggagaagaaaauaacacaguggcuggagaccaagggaguagagagauugaagcgaauggccauuuccggcgacgauugcguaguaaaaccgauagacgacagauucgcaaacgcucugcuggcccucaacgacaugggaaaaauccgcaaagacaucccgcaauggcagccaucaaagggcuggcacgacuggcagcaaguacccuucuguucacaucacuuccacgaacuaauaaugaaagacggccggaaguuagugguaccaugcaggccccaagacgaacugaucgggagggcccggauaagccaaggcgcgggcuggucgcuccgggaaacggccugucucggcaaggccuacgcgcagauguggucccucauguacuuccacagaagagaccugcggcucgccuccaacgccaucuguucagccgucccaguccacugggugccaaccucucgaacaacuugguccauacacgcccaccaccaguggaugaccacggaagauaugcuaaccgucuggaacagggucuggaucgaagauaaccccuggauggaggacaaaacgccagucacaaccugggaagacgucccguaccucggcaaacgggaagaucaguggugcgggaguuugauaggacugacgucccgcgccacgugggcacagaacaucccuacggcaauccaacaagucagaagccucauagggaacgaggaguuccuugacuacaugcccuccaugaaacgguuccgaaaggaagaagaaagcgaaggagcgaucugguag

SEQ ID NO: 25909 - RNA, 9873 nt, Artificial Sequence
  derived and/or modified CDS sequence (opt11) from DENV-3__KJ189293__SS-prME
accagccucugccucaugaugauacugcccgcggcccuggcguuucaccucaccagucgugacggugagccucggaugauaguggggaagaacgagcguggcaagagccugcuguucaagaccgccuccgggauaaacaugugcacccucauugcgauggaccugggcgagaugugcgacgacaccguuaccuacaagugcccccacaucaccgagguggagcccgaggauaucgacugcuggugcaaccuuaccagcaccuggguuacauaugguaccugcaaccaggccggggagcaccggcgcgacaaacgguccguggccuuggcgccucacguggggauggggcuagauacccgcacccagaccuggaugagcgccgagggggccuggcgccagguggagaaggucgagacgugggcacugaggcacccgggguuuaccauccucgcguuguuccuggcccauuacaucggcaccucccucacgcagaagguggugaucuuuauucugcugauguuggucacacccagcaugaccaugcggugcgugggcgugggaaaccgcgacuuuguagagggccuguccggggcgaccuggguggaugugguacuugagcacggagggugugugaccacgauggcuaagaacaagccaaccuuagacaucgaacugcaaaagaccgaggcuacccagcuggcgacgcuccgaaaacuguguauugagggcaaaaucaccaacauaaccaccgacagccgcugccccacgcagggcgaggcagugcugcccgaggagcaggaccagaauuaugucugcaagcacaccuacguggaucggggcugggggaaugggugcggcuuauuuggaaagggcucgcuagugacgugcgcgaaauuucagugcuuagaacccauagagggcaaggucgugcaauacgagaaccucaaguacaccguaaucaucacgguccacaccggggaccagcaccaggucggcaacgagacccaggggguuaccgccgagaucacgccucaggccaguacuacugaggcgacccugccugaguacggcacgcugggucucgaaugcuccccacgcaccgggcuugacuuuaacgagaugauucugcucaccaugaagaauaaggccuggauggugcaccggcagugguucuucgaccugccucugcccuggaccucuggggccacaacggagacaccuacauggaaccgcaaggaacucuuggugaccuuuaagaacgcucaugcuaagaaacaagaggucguggugcucgggucccaggaaggugcgaugcauacagcccugacuggggccaccgagauucagaacagcggugggaccuccaucuucgcuggucaucuaaaaugccggcugaaaauggacaagcucgagcucaagggcaugagcuacgccauguguacuaacaccuucguccugaagaaggaaguuagcgagacacagcauggaaccauucucaucaagguggaauacaaaggcgaggacgcgcccugcaagauccccuucaguacggaggacgggcauggcaaggcgcacaacggccgccugauuacugccaaccccgucguuaccaaaaaggaggagcccguuaacaucgaggccgagccgccguucggggaaagcaacaucgucaucggcaucggggauaacgcacugaagaucaacugguacaaaaagggcucgagcaucgggaaaauguucgaagccaccgcucggggcgcccggcggauggcuauucugggugacacugcuugggacuucgggucggugggcggagugcugaacucgcuuggcaagaugguacaccagaucuucgggagugcuuacacggcucuguuuaguggcguguccugggugaugaagaucggcauagggguccuccuaacuuggauaggccugaauagcaagaacaccuccaugagcuuuuccugcaucgccaucgguaucaucacgcuuuaccugggcgccguggugcaagcagacauggggugcgucauuaacuggaaagggaaggaauugaaaugcggcagcgggaucuucgugaccaacgaggugcacacauggaccgagcaauacaaguuccaagccgacuccccgaagcgccucgcuacggccaucgccggcgcgugggagaacggggucuguggcauccgcagcaccacucggauggagaaccugcuguggaaacagaucgccaaugagcucaacuacauccugugggagaacaacaucaagcugaccgugguggucggagacaucaucggcguacucgagcaaggcaagcgcacgcuaacuccacagccgauggagcuaaaguacaguuggaagacgugggguaaggccaagaucgucacagccgagacgcagaacaguucuuucaucauugacggccccaacaccccagaaugccccagcgccucccgggcauggaacgucugggagguggaggacuacggguucggcguguucaccaccaacaucuggcuccgccugcgggaggucuacacacaacucugcgaccaccgccucaugagcgccgcuguaaaggacgaaagagccgugcacgcggacaugggcuauuggaucgagagucagaagaaugggagcuggaagcuggaaaaggcaucccugaucgaggucaagacgugcacuuggccgaagucccacaccuuauggagcaaugggguacuggaaagugacaugauuaucccgaagagccuggcaggccccauaucccagcauaaccaccgcccgggguaccacacccagacggccgggcccuggcacuugggcaagcuggaacuggacuucaacuacugcgagggcaccaccgugguaaucaccgagaauugcggcacgcggggacccagccugcgaaccaccacaguguccgggaagcugauccacgaguggugcugccggagcugcacgcugccgccgcuccgcuacaugggcgaggacgggugcugguauggcauggagauccggcccaucuccgagaaggaggagaacauggugaagucauuaguuucggccggaagcgggaagguggacaacuuuacgaugggcgugcuaugccucgcgauccuguuugaggagguaaugcgcgggaaauuuggcaagaagcacaugaucgcgggcguuuuuuucaccuucgugcuguuacuguccggccaaaucaccuggcgggauauggcccauacgcugauaaugaucggcucgaaugcauccgaccgcaugggaaugggcgucaccuaccucgcucugauagcgaccuucaagauccagcccuuccuggcgcuaggguucuuccugagaaagcuaaccucacgcgagaaccuccugcugggcgugggccucgccauggccacgacccugcagcugccggaggacauugagcagauggcgaacgggaucgccuuaggccugauggcccugaagcucauuacccaguucgagaccuaccagcuguggaccgcccugauaagccugaccugcuccaacacuaucuucacccugacugucgccuggcgaaccgccacccuaauucucgcugggguaagccuguugccggugugccagucuagcuccaugagaaagaccgauuggcuccccauggccgucgcggccaugggcguuccgccccucccccuguucaucuucucguuaaaggacacgcugaaacgccguuccuggccccucaacgagggggugauggcggucggccucgugucuauccuagccuccucacuccuccgcaacgaugugcccauggccgggccccugguggcagggggccuguugaucgccuguuacguuaucaccgggacgucggcggacuugaccguggagaaggccgccgauauaacgugggaggaagaggccgaacagaccggcgucagccauaaccugaugaucaccgucgacgacgacgggaccaugcggauaaaggacgaugagaccgagaauauccucaccgugcugcucaaaaccgccuugcugauagucuccggcaucuucccguauucuauccccgcaacucugcucguguggcacaccuggcagaaacagacgcaacgguccggcguguuaugggacgugcccagcccgcccgagacccagaaggccgagcuggaggaggggguguaccggauaaagcagcagggcaucuucggaaagacccaggugggcguugggguccaaaaggaggggguguuccacaccauguggcaugucacgcgcggggccguguugacauacaaugggaagcggcuggaaccuaacugggcuuccgugaagaaggaccugaucagcuacggcggugguuggcgccucuccacccaguggcagaagggggaagagguccaagugaucgcaguggagcccggcaagaacccuaagaacuuccaaaccaugccgggcacauuccagacaaccaccggggagaucggcgccaucgcccuugacuucaagcccgguacgagcggcagccccauuaucaaucgggagggcaaggucgugggacuguacggcaaugguguggugacgaaaaacggcgguuacguguccgggaucgcccagaccaacgccgagcccgacgggcccacaccugagcuugaggaggagauguucaagaagcggaaccucacuaucauggaccuucacccagggucaggcaagacccgcaaguaccugcccgcgaucguucgcgaggcaaucaaacggagacuccggacccugauccuggccccgacccgcgucguggccgcggagauggaggaagcgcuuaagggucuuccaauacgcuaccagacgaccgccaccaaguccgaacacaccgggcgcgaaaucguggaccugaugugccacgccacguucaccaugcggcucuugagccccguuagaguuccgaacuauaaccugaucauaauggacgaggcccacuucaccgaucccgccuccaucgcggcaagaggguacaucagcacccgcguuggcaugggcgaggccgccgcgaucuuuaugacggcgacaccucccgggaccgccgacgccuucccgcaauccaacgccccaauccaggacgaggaacgcgacauaccagaacguagcuggaauuccgguaaugaauggaucaccgacuuugcggggaagacggucugguucgugcccagcaucaaggccggcaacgacaucgccaauugccucagaaagaacgggaagaaggugauccagcugucccggaagaccuucgacaccgaguaccagaagaccaaguuaaacgauugggacuucguggugacgaccgacauaucugaaaugggggccaacuuuaaggccgaccgcgugaucgacccuaggagaugcuuaaaaccggugauccugaccgacggccccgaacggguuauccuugccgggcccaugccggugacugccgcaucugcggcccagcgcagaggccgcgucgggagaaacccccagaaggagaacgaccaguacaucuucaccgggcaacccuuaaacaacgaugaggaccaugcgcacuggacggaggccaagauguugcuggacaacauuaacacccccgaagggauuaucccggcucuuuucgagcccgagagagagaagagcgcggcgaucgacggagaguaccgccugaagggcgagucccgcaagaccuuuguagagcuuaugcggagaggggaccuccccguguggcuagcucauaaggucgccagcgagggcaucaaguacaccgaccggaaguggugcuucgacgggcagcgcaacaaccagauccuggaggagaacauggacguagagauauggaccaaggagggggaaaagaagaagcuccgccccagguggcuagacgcccgcaccuacucagacccguuggcccucaaggaguucaaggacuucgcagccggccgcaagagcauagcccuagacuuagugaccgagaucgggcgcgugcccucccaccucgcccacagaacccggaacgcccuggacaaucuggugaugcuccacacgagcgaacacggcggucgggcauaucgccacgcugucgaggaguuacccgagaccauggagacccugcucuuacugggcuuaaugauccugcugacggggggugccaugcuguuccugaucagcggaaaggggauugggaaaacguccaucgggcucaucugcgugaucgccagcuccggcaugcucuggauggccgaaaucccgcugcaguggaucgcaagcgcuaucgugcuggaguucuucaugaugguccuccugauccccgagccggagaaacagcggacgccccaggacaaucaacuggccuacgucgugaucgguauccucacguuagccgccaucaucgcggccaaugaaaugggccugcucgagaccacgaagcgcgaccugggcauguccaaggaaccggggguagugagccccacuuccuaccuggacguagaccuccacccggccucggcguggacucuuuacgcugucgccacgacagugaucaccccgaugcugcggcacacgaucgagaauuccaccgcuaacgugagccucgccgccaucgcgaaccaagccgucguacugaugggcuuggacaagggauggccgaucuccaagauggaccucggagugccacugcuggcucucgggugcuacucgcaggucaacccccuuacgcugacugcagcggugcuccuucugaucacccacuacgcgaucauaggucccggcuugcaggccaaggccacuagggaggcccaaaagcgcacggccgcgggcaucaugaagaaccccaccguggacggcaucaugaccaucgacuuggaucccgugaucuaugacuccaaguucgaaaagcaacuugggcaggucaugcuccugguccugugcgccguccagcugcuauuaaugcgcacgagcugggcucucugcgaggcgcugacuuuggcgacaggccccaucaccacacucugggagggcagccccgggaaguucuggaacacaaccaucgcagugucgauggcuaacaucuuccggggcuccuaccuggcaggagccggacuggcguucagcaucaugaaguccgugggcaccggcaagcgcggcaccgggagucaaggcgagaccuuaggagagaaguggaagaagaagcugaaccagcugagccggaaagaguucgacuuauauaagaaauccggaaucacggaaguugaccgcaccgaggccaaggagggauugaagcggggggagaucacccaccaugcggugucgagaggcuccgccaagcugcagugguucguggagcggaacaugguaaucccggaggggcgcgugaucgaccucggaugugggagagggggguggucuuacuacugugccggccugaaaaaggugaccgagguccgaggguauacgaaaggcgggcccgggcacgaagagcccguuccuauguccaccuauggguggaacaucgucaagcucaugagcggaaaagaugucuuuuaccucccgcccgaaaaaugcgacacccugcucugcgacaucggcgaguccagccccucgcccacaguggaggagagccgcacgauccggguccugaagaugguagagccguggcucaagaacaaccaguuuuguaucaagguacugaacccauacaugcccaccgugaucgagcaccuggagcgccuacaacggaagcacggcgggaugcuaguccgcaauccccugucccggaacagcacccacgagauguacuggauauccaaugggaccgggaauaucgucgcuagcgucaauauggucuccagacuccugcugaaucgguucacgaugacgcaccggaggccgaccaucgagaaggacguggaccucggcgccgggacgcgccacgugaaugccgagcccgagacgcccaacauggacgucaucggagagagaaucaagagaaucaaagaggaacacaauagcaccuggcauuacgacgacgagaacccguacaagaccugggccuaccacggcucauaugaggugaaggccaccgggagcgcgaguagcaugaucaauggcguggucaaacuucugaccaagccuugggacgugguccccauggugacccagauggccaugaccgacaccacgcccuucgggcagcaacggguguucaaggagaaaguggacacucgcacgccgcggagcaugccaggaacccgccgggugaugggcaucacagccgaguggcuauggcgcacucugggccggaauaagaagccucgacugugcacccgcgaggaguucaccaagaaggugcggacgaacgccgcgaugggcgccgucuucaccgaggagaaucagugggacuccgcuaaggccgccguggaggacgaggacuucuggaagcucguagaccgagagcgggagcuccauaagcuggggaagugcgggagcugcguauacaauaugauggggaaacgcgagaagaagcucggcgaauucggcaaagcuaagggcagccgagccaucugguacauguggcucggcgcccgcuaccucgaguucgaagcgcucggguuccucaaugaggaucacugguuuagucgggagaacuccuauuccggcguggaaggcgaggggcugcacaaguugggcuacauccugcgugacaucuccaagauccccgggggagccauguacgcugaugauaccgcugggugggacacgcggauaacggaggacgaucuucauaacgaagagaagaucacccagcagauggauccugagcaccgccagcucgccaacgcaaucuucaaacucacauaccagaacaaaguggucaaggugcagcggcccaccccaaccggcaccguaauggacauuauaagccgcaaagaccagcgaggcucggggcaggucgggacuuacgggcugaauacguucaccaacauggaggcucagcucauccgccaaauggagggcgagggggugcugagcaaggcugaccuggagaacccccaucucccggagaagaagaucacgcaguggcuggaaaccaaaggaguagagagacugaagcgcauggccauuuccggcgaugacugcgucgucaagcccaucgacgaccgcuucgccaacgcucuccucgcccugaacgacauggggaagguucgcaaggacauaccccaguggcagccaucgaaaggcuggcacgauuggcagcaggucccguucugcucccaccacuuucaugagcucauuaugaaggacggccggaaacugguggugcccugucgaccccaggaugagcugaucggccgggcgcgaaucagccagggggccggcugguccuuacgcgaaacagccugcuuaggaaaggccuacgcgcagauguggagccugauguauuuccacaggcgugaccuccggcuggccuccaaugccaucugcagcgcgguccccgugcacugggugccgaccucgcgcacgaccuggagcauccacgcccaucaccaauggaugacaaccgaggacaugcugacggucuggaaccggguguggauugaggacaaucccuggauggaggauaagacgcccgugaccaccugggaggacguccccuauuuagggaagagggaggaucaguggugcggcagccugaucggccugacuuccagggccacaugggcccagaacaucccgacugcuauccagcagguucggagccuuaucggcaacgaggaauuccuggacuacaugccauccaugaagcgguuccgcaaggaggaggagucugagggggcaaucugguag

SEQ ID NO: 25910 - RNA, 9873 nt, Artificial Sequence
  derived and/or modified CDS sequence (opt11) from DENV-3__KJ189294__SS-prME
accucguugugccucaugaugauccugccagccgcccuggccuuccaccugaccagccgggacggcgagcccagaaugaucguggggaagaaugagcggggcaagagccugcuguucaagaccgccuccgggauuaacauguguacccugaucgccauggaccugggcgaaaugugcgacgacaccgugaccuacaagugcccucauauuaccgagguagaacccgaggacaucgacugcuggugcaaccugaccagcaccugggugaccuaugggacuuguaaccaggccggcgagcaccggcgcgacaaacgguccguagcccuugcgccccaugugggcauggggcuugacacccgcacgcagaccuggaugucugccgagggggccuggcggcaggucgagaaggucgaaacgugggcccugcgucaccccggguuuaccaucuuggcguuauuccuggcccacuacaucggcaccagccucacccagaaggucgucaucuucauccuguugaugcucgucacgcccagcaugacaaugcggugcguaggagugggcaaccgcgauuucgucgagggccuguccggggccacauggguggacgugguccuggagcacggcgggugugucaccacgauggccaagaacaagccgaccuuggacaucgagcugcagaaaaccgaagccacacaacucgcgacgcuccggaagcugugcaucgagggcaaaaucaccaacauuacgacggacagccgcugcccuacgcagggcgaggccgugcugccggaggagcaggaccagaacuacgucugcaagcauacuuacguggauagggguuggggcaacggaugcggccucuucgggaagggcucccuggugacaugcgccaaguuccagugucuagagcccaucgaggguaagguggugcaguacgagaaccucaaauauacugucaucaucacuguacacaccggggaucagcaucaagugggcaaugagacccagggagucaccgccgagaucacgccccaggccucuaccaccgaggcgacgcugcccgaguauggcacccuggggcucgagugcucuccacgaacgggacuggauuuuaaugaaaugauccugcucaccaugaagaacaaggccuggaugguucaccggcagugguuuuucgaccugccccugcccuggacuagcggcgccaccacggagacccccaccuggaaucgcaaggagcuccuuguaaccuucaagaacgcacacgccaagaagcaggaggugguggugcuugggucccaggagggcgcgaugcacacagcucucaccggggcaaccgagauccagaacagcggcggaaccagcaucuucgccggccaucugaagugccgacugaagauggacaagcucgaguuaaaggguaugagcuacgccauguguacuaacaccuucguccugaagaaagagguguccgagacgcagcacgguaccauccuaaucaagguggaguacaagggggaggacgcgccgugcaaaauccccuucagcacggaggacggucacggcaaggcgcacaacggccgccugauaacagccaaccccguagugacgaagaaggaggagcccgugaacauugaggccgaaccgcccuucggggaauccaacaucgucaucgggaucggggacaaugcgcucaagauaaacugguacaagaagggcucuaguaucgguaaaauguucgaggcuaccgcccggggcgcccgccggauggcgaucuugggcgauacggcgugggauuuuggguccgugggcgggguuuuaaacagccuggggaagaugguucaccagauauucggguccgccuacacugcacuguucagcggcguguccuggguuaugaagaucgggaucggcguccucuugaccuggaucggccuaaacagcaagaacaccucuaugagcuucuccugcauagccaucgggauaaucacgcucuacuuaggcgcaguggugcaggcggacaugggguguguuauaaacuggaaaggcaaagaacugaagugcggcucugggaucuucgugaccaaugaggugcauaccuggaccgagcaguauaaguuccaagccgacucacccaagcggcuagccacggcaaucgccggggcgugggagaacggcgucugcggcaucaggagcaccacgcggauggagaaucugcuguggaagcagaucgcaaacgaacucaacuacauccugugggagaacaacaucaaacugaccguggugguuggggacauuaucggcauacucgagcagggcaaacgcacgcuuacgccccagccgauggaacugaaauacuccuggaagacgugggggaaagccaagaucgugaccgcagagacgcagaacucauccuuuaucauugauggccccaacacccccgagugccccagcgcaucccgcgccuggaacgugugggagguugaagacuacggguuuggcgucuucaccacuaacaucuggcuacgacucagagagguguauacccagcugugcgaccaucgccugaugucggccgccgugaaggacgagcgggccgugcacgcggacaugggcuauuggaucgagagccagaagaacggguccuggaaacuugagaaggccagccuaaucgaggucaagacgugcacguggccgaagucccauacccuguggagcaacggcguccuugagucggacaugauuauucccaagucccuggcuggucccaucucccagcacaaccaccgcccgggcuaccacacccagacugccgggcccuggcaccuuggcaagcuggagcucgacuucaauuacugcgagggcaccaccguggugauuaccgagaauugcggaacgaggggccccagccuccgcaccacgaccgucucggggaaacugauccacgaauggugcugccgguccugcacguugcccccgcuccguuacaugggagaggacggauguugguauggcauggagauccgucccaucucugagaaggaggagaauauggucaagucgcucguuuccgccggcagcgguaaggucgacaacuucaccaugggcgugcugugcuuggcgauccuauuugaggaggugaugcgagggaaguuugggaaaaagcacaugaucgccggagucuucuucaccuucgugcugcuccuguccggucagaucacguggcgugacauggcccacacccugaucaugauuggcagcaacgcuuccgacaggaugggaaugggcgucacauaccucgcccugaucgcgaccuucaagauccagcccuuccuggcccucggguuuuuucugcguaagcuuaccagccgcgagaaccuccugcugggugucgggcucgcaauggccacgaccuuacagcugccggaggacaucgagcagauggcgaacggcaucgcccucggacucauggcccugaaacucaucacacaauucgaaacguaccagcuguggacggcccugauaagccugaccugcuccaacaccaucuucaccuuaacgguggccuggaggacagcgacucugauuuuggccggggugagcuuguuaccggucugccaauccucuucuaugcgcaagacggacuggcuccccauggccgucgccgccaugggugugccgcccuugccguuguucaucuucucccucaaggacacgcuaaagcgccgguccuggccccugaaugagggggugauggcggugggccucguaagcauccuggccuccagccugcuccgcaacgaugugcccauggccggcccccuaguagcagggggacugcucaucgccugcuaugucaucacuggcacauccgcggaccugaccguggagaaggccgccgacaucacgugggaggaggaggccgaacagacuggugugagccacaacuuaaugaucaccguagaugaugauggaaccaugcggaucaaggacgaugagacggagaacauccucacuguacuauuaaagacagcccuccugaucguguccgguaucuucccguauuccauucccgcuacccuacucgucuggcacacuuggcagaagcagacccagcgcucuggcguccugugggacgugcccagcccgcccgagacacagaaggccgagcuagaggaggggguuuaccgaaucaagcaacaagggauuuucggcaagacccaggugggcguaggcguacaaaaggaaggcguguuccacacuauguggcacgucacuagaggcgccguauugaccuacaaugggaagcggcuggagcccaacugggccuccgugaagaaggaucugauuuccuacggugggggcuggcguuuaaguacccaguggcagaagggggaagagguacaagucaucgcgguggagcccggcaaaaaccccaagaacuuccagaccaugcccggcacguuccaaaccaccacgggggaaauaggcgcgaucgcccuggacuucaagcccgggacgucaggcucacccaucauaaaccgggaaggcaaaguggucgggcuguacggaaacggcgugguaacgaagaauggcggcuaugugagcggcaucgcccaaaccaaugcagagccugacggccccacccccgagcuggaggaggagauguuuaaaaagcgcaauuuaacgaucauggaccuccaccccgggagcggcaagacacggaaguacuugccggcgaucgugcgugaggccaucaagcggcgccuccggacccugauacuggcuccgacacgcguggucgccgccgagauggaggaggcccuaaaggggcugccaauccgguaccagacgacggcgacuaagagcgagcacaccggccgcgagauaguggaccugaugugccacgcaacuuucaccaugcgccucuuaaguccugugcgcgucccgaauuacaaccugaucaucauggacgaagcccacuucacugaccccgcguccaucgccgccaggggauauaucagcacccgugugggcaugggcgaggccgccgcaaucuucaugaccgccacaccgcccgguaccgccgacgccuucccgcaguccaacgcacccauccaggacgaggagagagacauccccgagcgaagcuggaacucgggaaacgaguggaucaccgacuucgccgggaagacugugugguucguccccucaauaaaggccggcaacgauaucgccaacugccuccgcaagaacggaaagaagguaauccagcugagccggaagaccuuugacacugaguaccagaagacgaagcugaacgacugggacuucguggucacgacagacaucagcgagaugggugccaacuucaaggccgaccgcguuaucgauccgcggagaugccuaaagccagugaucuugaccgacggccccgagcgggugauccuggcgggccccaugccggugaccgccgccagcgcagcccagcgaaggggccgcguggggcguaauccccagaaggagaacgaccaguacaucuucaccggccagccgcucaacaacgacgaggaccaugcgcauuggacggaggcaaagaugcugcuggacaacaucaacacccccgaggguauuauaccggcccucuucgagcccgagagggagaaauccgccgcgauagauggugaguaucgguugaagggcgagagccgcaagaccuucgucgagcuuaugcggcgcggcgaccugccaguuuggcuggcacacaaaguagcgagcgaggguaucaaguacaccgaucggaaguggugcuucgacgggcagcgaaacaaccagauuuuggaagagaacauggacgucgagauuuggacgaaagagggcgagaagaagaagcuccggccgcggugguuagaugcacgcaccuacuccgacccccuggcccucaaggaguucaaggacuucgcagcgggccgcaagagcaucgcccuggaccuggugaccgaaaucggucgcguaccgucucaccucgcccaccggacacgcaaugcccuagacaaucuggugaugcugcacacaucggaacacggcgggcgggccuaccgccacgccguggaagagcugcccgagacgauggagacacugcuccugcugggccucaugauuuugcuuacagggggcgccaugcuguuccucaucagcggcaaggggaucggcaagacguccaucgggcuuauaugcgucaucgccagcuccggcaugcuuuggauggccgaaauaccccuucaguggauagcgagcgccaucguucucgaguucuucaugauggugcuccugauccccgaacccgagaagcagcggacgccccaggacaaucagcuugccuacgucgugaucggcauacucaccuuagccgccauaaucgcagccaaugaaaugggccugcucgagaccacgaagcgcgaccuggggauguccaaggagccgggggucgucagcccgaccucguacuuagacguggaccuccacccugccucggccuggacccuguacgcgguggcgaccacggucaucacccccaugcuucggcacaccauagagaacuccaccgccaacgugucgcucgccgccaucgcgaaucaggccguagugcugaugggccuggacaagggcuggccgaucuccaaaauggaccuuggcgugccccugcuggcccucgguugcuauagccaggucaauccgcuaacguuaaccgccgcgguguuacugcugaucacgcacuacgcgaucaucggccccggccuccaggccaaggcgacacgcgaggcccagaagcggacggcugcggggauaaugaagaauccgaccguggaugggaucaugacaaucgaccuggacccugugauauacgacuccaaguucgagaagcagcuggggcaggucaugcugcuggugcugugcgccgugcaacuccugcucaugcgaaccagcugggcccucugcgaagcccugacgcuugcgaccggccccaucacgacccuaugggagggcucccccggcaaguucuggaacacgaccaucgccgucagcauggccaacaucuuucggggcuccuauuuggccggggccggccuggcguucagcaucaugaaguccguggggaccggcaagcgcggcaccgggagccaaggagagacccuaggggagaaguggaagaagaagcugaaccaauugucgcgaaaggaguuugaucucuacaagaagucuggcaucacggagguagaucgaaccgaggccaaagaggggcugaaacggggugagaucacccaccaugcggucagcaggggcucugccaagcugcaaugguucguggaacggaacaugguuaucccggaagggcgggugaucgaucuagggugcgggcggggcggguggagcuacuacugcgccggccugaagaaggugaccgagguacgagguuacacgaagggcggacccggccacgaggagcccguccccauguccaccuacggcuggaacauaguaaagcugaugagcgggaaggacguguucuaucucccgcccgagaagugcgacacccugcugugcgacauuggugaguccagccccucccccaccguagaggagagucgcacgauccggguccugaagaugguugagccguggcucaaaaacaaucaauuuugcaucaagguccuuaaccccuacaugcccaccgugauugagcacuuggaacgccuccagcggaagcauggcgggaugcuggugcgcaauccauugucacggaauagcacccacgagauguacuggaucagcaauggcacuggaaauauagucgcgagcgugaacauggugucccgccugcugcugaaccgguucacgaugacccaccgcagaccuaccaucgagaaggacguagacuuaggcgccggcacccgacacgugaaugccgagcccgagacgcccaauauggacgugaucggggaacggaucaagcgcaucaaggaggagcauaacagcaccuggcacuaugacgacgagaauccuuacaagaccugggccuaucacggcuccuacgaggucaaggccacugggagcgcgucaagcaugaucaacgguguggugaaguuacuuaccaagcccugggacgucgugcccauggucacccagauggccaugaccgacaccacacccuucggacagcaacgaguguuuaaggagaagguggacacccgaaccccgcggagcaugcccgguacccgucgggucaugggcaucacggccgaguggcucuggcguacccugggaagaaacaaaaagccccgccugugcacacgcgaggaauuuaccaagaagguccggacgaacgccgcgaugggcgccguuuucacggaggagaaccagugggacuccgccaaagccgccgucgaggacgaggauuucuggaagcuuguggaccgcgagagggagcuccauaagcuggggaagugcggcagcugcguguacaauaugauggggaagcgggagaaaaaguuaggcgaguucgguaaggcgaaggggucccgggcuaucugguacauguggcugggugcccgcuaucuggaguucgaggcccugggguuccugaacgaggaucacugguucagccgggagaacucuuacagcgguguagagggggagggccugcacaagcucggcuacauacugagagauaucuccaagaucccgggaggcgcuauguaugcggaugauaccgcugggugggacaccaggaucacggaggacgaccugcacaacgaggagaaaaucacccagcagauggacccugagcaccgccaacucgccaacgcuaucuucaaacugaccuaccagaauaagguggugaagguacagcggcccaccccuaccgggaccgugauggacaucauuucacgcaaggaccagcggggcucuggccagguagguaccuacggguuaaacaccuucaccaacauggaagcucagcucauccgccagauggagggcgaggggguccugagcaaggcggaccuggaaaacccccaccucccugagaaaaagaucacgcaguggcuagagaccaaggguguggagcggcuaaagcgcauggccaucuccggcgacgacugcguggugaagcccaucgacgaccgguucgcaaaugcccuccuggcccugaacgacauggggaaggugcgcaaagacaucccccaguggcagcccagcaagggcuggcacgacuggcagcaggucccuuucugcucccaccacuuucacgagcucaucaugaaggacggccggaaacuggucgugcccugucgcccccaggacgagcugauaggucgggcgcgcauuagccagggugcgggcuggucucucagggagaccgccugccugggcaaggcguaugcucagauguggagccugauguacuuccaccggcgcgaccuucggcuggccuccaacgcaaucugcagcgcagugcccguccacugggucccgaccucgcgcacuacuuggagcauccacgcccaccaccaauggaugaccacagaggacaugcuaacuguguggaaccgggucuggaucgaggacaaccccuggauggaggauaaaacccccgugaccaccugggaagacgugccauaccuagggaagagagaggaccaguggugcggcagccugaucggacucacgucccgggcgaccugggcccagaacauccccacggcuauacagcagguccgcucgcucaucgguaacgaggaguuucucgacuacaugcccucgaugaagcgguucaggaaggaggaagagagcgagggggcgaucugguga

SEQ ID NO: 25911 - RNA, 9873 nt, Artificial Sequence
  derived and/or modified CDS sequence (opt11) from DENV-3__KJ189295__SS-prME
accucccucugucuaaugaugauacugccagccgcacuggcguuccacuuaacuagucgggauggcgagccacggaugaucgucgguaagaacgagcguggcaaaagccugcuguucaagacagcauccgggauuaacaugugcacccuuaucgcgauggaccuaggggagaugugcgacgacacuguaaccuacaaaugcccccauaucaccgagguagaacccgaggacaucgacugcuggugcaaucugacaagcaccugggugaccuacggcacgugcaaccaagccggcgagcaccgaagggacaagagauccguagcccucgccccacacgugggcauggggcuagacacccgcacacaaaccuggaugagcgccgagggcgccuggcgccagguggagaaggucgagacgugggcacugcgccacccaggcuucacuauauuagcgcuauuccuggcccacuacauuggcaccagucucacccagaagguugugauuuucauccugcuuaugcucgucacgcccagcaugacgaugagaugcgugggggugggcaaccgcgacuucguugaagggcuauccggggccaccuggguggacgugguccucgaacacggggguugcgugaccacgauggccaagaacaaacccacgcucgacauugagcugcagaagaccgaagccacccagcuggcgacguugcggaaacuaugcaucgaaggcaaaaucaccaacauuaccacggacagccgcugcccuacgcagggcgaagcuguccugccggaagagcaagaccaaaacuacgucugcaaacacacuuacguggaucgagguuggggcaacggguguggccucuuuggaaagggcucccuagugaccugcgcgaaauuccagugccuggagcccaucgaggggaaagucgugcaguacgaaaaccucaaauacaccgugaucaucacagugcacaccggagaucagcaucaggucggaaacgagacacagggggucacggccgagaucacgccccaggccucaaccaccgaagcgacccugcccgaguacggcacccuagggcucgagugcuccccgcgcacgggccuggauuucaacgaaaugauccugcuuaccaugaagaacaaggcguggauggugcaucgucagugguucuuugaccuuccccugcccuggaccagcggcgccaccacagaaacucccaccuggaaucggaaggagcucuuggugaccuucaagaaugcccaugccaagaaacaggagguagugguccugggcucccaggagggcgcgaugcauacggcgcucacgggggccaccgagauccagaacucaggaggcaccuccauuuucgcggggcaucugaagugucggcuaaaaauggacaagcucgaacugaagggcaugagcuacgcgaugugcaccaauacauuuguccugaagaaggagguuagcgagacgcagcacgggaccauccuuauaaaaguggaguacaagggcgaggaugcgccguguaaaauucccuucucuacugaggacggacacggcaaggcucacaacggccgccugaucaccgcuaacccugugguaaccaaaaaggaagagccggugaacauugaagccgagccgcccuucggggaaagcaacaucguuaucggaaucggggacaaugcguugaagaucaauugguacaaaaagggcuccagcaucgggaagauguucgaggccaccgcccgcggcgcccgucggauggcuauccucggagacacggcgugggacuucgggucuguuggcgggguacugaauucacuagguaagaugguucaccagauuuucggauccgcguacaccgccuuauucucgggcgugagcugggugaugaagauaggcauagguguacuccugaccuggaucggccugaacagcaaaaacaccuccaugucuuucuccugcaucgccaucggcaucauuacgcuguaccugggugccguggugcaggcggacaugggguguguuaucaacuggaagggaaaggaacugaagugcggaagcgggauuuucgugacaaaugaaguacacacguggacugaacaguacaaauuccaggccgacucucccaagcguuuggcaacagccaucgccggcgcaugggaaaacggggugugcggcauccgcagcaccacccggauggaaaaucucuuguggaagcaaauagcaaacgagcucaacuacauacucugggagaacaacaucaagcugaccguggugguaggggauaucaucggaguguuggagcagggcaagcgaacacuaaccccccagccgauggagcugaaguacuccuggaaaacuuggggaaaggccaagaucgugaccgccgaaacgcagaauaguucguucaucauagauggacccaacacccccgagugccccagcgccuccagagcguggaacgucugggagguggaggauuacggcuucggcguuuucacuacgaacaucuggcugaggcugcgugaggucuauacccagcugugcgaccaccgccucaugagcgccgccguuaaggaugagcgggccgugcacgcggauaugggcuauuggauugaaagccagaaaaacggguccuggaaguuagagaaggccagccuaaucgaggucaagacgugcaccuggccgaagucccacacacucuggagcaacggcguccuggagucggauaugaucauccccaagagccuggccgggccuauuucccagcacaaccaucggccaggcuaccauacccagacggcugggccguggcaucucggaaagcuggagcuggauuucaacuacugcgagggcaccacuguagucauaacagaaaauugcgguacccgcgguccaagccuacgcaccaccacgguuuccgguaagcugauacaugagugguguugccggagcugcacccugcccccccuuagauacaugggcgaggauggcugcugguacggcauggagauccggccaauauccgagaaagaagagaacauggucaagagccugguuucagcugguagcgggaagguugacaacuuuaccaugggcgugcuaugcuuggcgauccuguuugaggagguuaugcgggguaaguucgggaagaaacacaugaucgccgggguauucuuuaccuucgugcugcuccuguccggccagaucacauggcgugacauggcccacacgcugauuaugaucggcagcaaugccuccgaccgcauggggaugggggucaccuaccuugcuuuaaucgcgaccuucaaaauccagccguuucuggcccucggguucuuccugcgaaagcugacuucgagggagaacuuacuauuaggcgugggccucgcaauggcuacgacccugcaguugcccgaagauauugaacaaauggcgaacgggaucgccuugggucugauggcccucaagcuaaucacccaguuugagaccuaccaacuguggacggccuuaauaagccucacauguucuaacaccaucuucacccucacgguggccuggagaacugcgacuuugauucucgccggcgucagccugcugccggugugucagucaucgucgaugaggaagaccgacuggcuccccauggcagucgccgcuaugggcguaccgccacugccgcucuucaucuucagccucaaagacacccugaagcgccgguccuggccgcugaaugagggcgugauggcagucggccuugugaguauccuugcauccagccuucuccgcaaugacgugcccauggccggcccucugguagccggcggccugcuuaucgccugcuacgugauaacggggacuuccgcggaccugaccguagagaaagccgccgacaucacaugggaggaggaagccgagcaaaccggggucucgcacaaucugaugauuaccgucgaugaugacgggaccaugcggaucaaagaugaugagaccgagaauauccucacgguccugcugaagacagcuuuacugauugucaguggcaucuucccguacucuauccccgcgacccuacucguguggcacaccuggcagaaacagacgcaacgcuccggaguucugugggaugucccaucaccgccugagacccagaaggccgagcuggaggaggggguauaccggaucaagcagcaaggcaucuucggaaaaacccagguaggaguggguguucaaaaggagggaguguuucacacuauguggcacgucacccgcggcgcaguucucaccuauaaugggaagcggcucgagccaaacugggccucugugaagaaggaccuaaucagcuauggagggggauggaggcucuccacccaguggcagaagggggaggagguacagguaaucgcgguugaacccggaaagaaccccaagaacuuucagacuaugccgggcacguuucagaccaccaccggggagauaggcgccaucgcccuggacuucaagccaggaacgagcgguaguccaaucaucaaucgagagggcaaggugguggggcuauacggaaacgggguugucacaaaaaacggcggcuacgugucaggcauagcccagaccaaugcagaaccggauggccccacacccgagcuggaggaggagauguucaagaaacgcaacuuaacgaucauggaccuacauccaggaucugguaagacccggaaauaccuaccggcgaucgugcgugaggccaucaagcggcgccuccggacccugauccuggccccuacccgcgucguagccgccgagauggaagaggcguugaagggccugcccauucgauaccagacgacggcgacuaaguccgagcacaccggcagagagauuguagaccugaugugccacgccaccuucaccaugcggcuccucagccccguaagggugccgaacuacaaucugauuaucauggacgaagcccacuucaccgacccggcaucuaucgcggcccggggguauaucagcaccagaguggguaugggggaagccgccgcuauuuuuaugacagccacgccaccuggaacggcugacgcuuuuccgcaguccaaugcccccauccaggaugaagagcgagacauacccgagcgaucauggaacuccggcaacgaguggaucacagacuuugccgggaaaacggucugguucgucccuagcauaaaagccggaaacgauauugccaacugccucaggaagaaugggaagaaagugauccagcugucgagaaagacauucgauaccgaauaccagaagaccaagcugaacgacugggacuucguggugaccaccgacauaagcgagaugggcgccaacuucaaggcugaucgggucaucgauccgcggcgcugccuaaaacccgugaucuuaaccgacgggcccgaacgggugauccuggccgggccuaugccagugacggccgcguccgccgcucagcgccggggccgcgucgggcguaauccccagaaggaaaacgaccaguacauauuuaccggccaaccccucaauaacgacgaagaccaugcgcacuggacggaagcuaaaauguugcuagacaacaucaacacccccgaggguauaauaccugcacucuucgagcccgagcgcgaaaagagcgccgcgaucgauggcgaguaccggcugaagggggagucucgcaaaaccuucguggaauuaaugcggcgcggggaucuccccgugugguuggcccacaaggucgccuccgagggaauuaaguauacggaccgcaaguggugcuucgacgggcaacgcaauaaccagauccucgaggagaauauggauguggagaucuggacgaaggagggcgagaaaaagaaguugcgcccgcgcuggcuagacgcccgaacguacuccgacccguuggcccucaaggaguucaaggacuucgcggccggccgaaagucaaucgcccuggaucuggucaccgagaucgggcgcgugcccucacacuuggcccaucggacccgcaacgcccuggacaaccuugugauguuacacacuagcgagcacgggggccgggccuaccgccacgccguggaagaacuccccgagaccauggagacccugcuccugcugggacucaugauccugcuaaccggaggcgccaugcuguuccuuaucucaggaaaagggauugggaagacgucuaucggauugaucugcguuauugccucauccgggaugcucuggauggccgagauuccucugcaguggaucgcuagcgccauugugcuggaguucuuuaugaugguuuugcugauccccgaacccgagaagcaaagaacgccgcaggacaaccagcuggcuuauguugugaucgggauucucacccuggccgcgaucaucgccgcuaaugagauggggcugcuggaaaccacgaagagagaccucggcauguccaaagagccggggguggugagccccacaaguuaccucgacguggaccuucaucccgccagcgccuggacccuguacgcggucgcuaccacgguaaucacaccgaugcugcgucacacgauagagaacuccacugcgaacgucagccucgccgcaaucgcgaaucaggccguaguacugaugggccuggacaagggguggccgauuuccaagauggaccuuggggugccucugcuggcccucggguguuacagccaggucaacccgcugacgcugaccgcagccguccuccuuuuaaucacccacuacgccauuaucggacccggccuccaggcaaaggcgacgcgcgaggcgcagaaacgaacugccgcagguaucaugaagaacccgacaguggacgguauaaugaccauugaccuggaccccgucaucuacgauuccaaguucgagaaacaauuaggccaggugaugcuccucgugcuaugcgcaguccaguuacugcuaaugcgaaccagcugggcccucugcgaggccuuaacgcuggcgaccggcccuauaaccacccucugggaggggagccccgggaaguucuggaacacgaccaucgcgguaagcauggcaaacauuuuucgggguuccuaccuggcgggugccggccuagccuucagcaucaugaaguccgugggaacaggcaaaagagguacugguagccagggcgagacccuaggcgagaaguggaaaaagaaacucaaucaauugucuagaaaggaguucgaccucuacaagaaguccggaauaacugaggucgaccgcacagaggccaaggaggggcuuaagcggggagagaucacgcaccacgccgugagccgcggcuccgcgaagcugcaaugguucgucgagaggaacauggucaucccggagggaagggugaucgaccuaggcugcgggcggggcggguggaguuauuauugcgccggccugaagaaagugacagaaguccgcggcuauacgaaggguggccccgggcacgaggagcccguuccaaugucaaccuacggauggaacauugucaagcucaugagcgggaaggacgucuucuacuugccccccgagaaaugugacaccuuauugugcgacauuggagagaguagcccuucuccgaccguugaagagagccgcacgauucggguguugaagaugguagagccauggcucaagaauaaccaguucugcaucaagguguuaaacccauauaugcccacugugaucgagcaccuugagaggcuccaacggaagcacgggggcaugcugguacgaaacccacugucgcggaauucgacacaugagauguacuggaucaguaacggcaccgggaauauaguggcgagcgugaacauggucucgcgacuccugcugaaucgguucacaaugacgcacagaaggcccaccaucgagaaagauguggaccucggggccgggacucgccacgugaacgccgagccagaaacgcccaacauggacgucaucggggagcggaucaagcgcaucaaggaagaacacaauagcaccuggcacuaugacgacgagaacccauacaagaccugggccuaccacggauccuacgaggugaaggccaccggguccgcgucaagcaugaucaacggcguagucaaauugcuuacgaagcccugggacguggugcccauggugacgcagauggcgaugacugauacuacccccuucggccagcagcggguauucaaggagaaagucgacacccgcaccccgcguucgaugcccggaacccgacgggugaugggaauuacggcugaaugguuguggaggacccugggccggaacaaaaagccccgccugugcacccgcgaggaguucacuaagaaggugcggacgaaugccgcgaugggcgccgucuucaccgaggaaaaccagugggacuccgccaaggcugccguagaggacgaggacuucuggaaacucguggaucgggagcgggagcugcauaagcugggaaaguguggauccugcguguacaacaugauggggaagcgggaaaagaagcucggcgaguucggcaaggcuaaagggucccgagcgaucugguauauguggcugggagccagauaccuggaguucgaagcccucggguuucugaacgaggaucauugguucagucgggagaacuccuacagcggcguugagggcgagggccugcacaaauugggcuauauccugagagacaucuccaagauuccgggaggggcaauguaugcggaugacaccgccgggugggacaccagaaucacagaggaugaccuucacaacgaggagaagaucacccaacagauggauccggagcacagacagcucgccaacgcaaucuucaagcugaccuaccagaauaagguggucaaagugcagcguccuaccccgacugggacugugauggauaucauaagccguaaagaucagcggggcagcggccaggucggcaccuacgggcugaauaccuucaccaacauggaggcccagcucauccgccaaauggagggcgaagggguccugcucaaggcggaucucgagaacccccaccuccccgaaaagaagaucacgcaguggcuggagaccaaaggaguggaacgucucaagcgcauggccauaagcggcgaugauugcgucgugaagcccaucgacgaccgguuugccaacgcccuacuggcccuaaacgacaugggaaaggugcggaaagauaucccucaauggcaacccuccaagggauggcaugacuggcaacaaguaccuuucugcagucaccacuuccacgaacugaucaugaaggacggccggaagcucguggugcccugccgcccccaggacgagcucaucgggcgagcucgcaucagucagggggccggcuggucucucagggaaacggccugcuuaggcaaggcauacgcccagauguggucucucauguacuuccaccggcgcgaucugcgguuggccucuaacgccauuugcuccgcgguucccguccacugggucccaaccagccguacaacuuggagcauccacgcccaucaccaauggaugaccaccgaggacaugcucacuguguggaaccggguguggauagaggacaacccuuggauggaggaccguacgccagucaccaccugggaggacguucccuaccuggggaagagggaggaccaguggugcggcucccugaucgggcuuacgucgcgagcgacaugggcccagaacaucccaacggccauucaacagguucggucccugaucggcaaugaagaguuccuggacuacaugccauccaugaagcgcuucaggaaggaagaggaguccgagggggcgaucugguga

SEQ ID NO: 25912 - RNA, 9873 nt, Artificial Sequence
  derived and/or modified CDS sequence (opt11) from DENV-3__KJ189297__SS-prME
accuccuuaugccucaugaugauccugccugcagcucuggcguuucaccucaccagccgggacggcgaaccccggaugaucgucgggaaaaaugagcggggcaaaagccugcuguucaagacggcguccgggaucaacaugugcaccuugaucgccauggaccucggcgaaaugugcgacgauaccgugaccuacaaaugcccacacaucacagaaguagagccggaggacaucgacuguuggugcaaccucaccagcaccugggugaccuacgguaccugcaaccaggccggggagcaccggcgcgauaaacgcuccguagcccuagccccacacgugggcauggggcuugacacccgcacccaaacauggauguccgcugagggggccuggcgccaagucgagaaagucgaaacgugggcucuacgccacccgggguuuaccauccucgcacuguuccucgcucacuacaucggcaccucccucacgcagaaaguggugaucuucauauugcuaaugcucgucacgccuagcaugaccaugcgaugcgucgggguggggaaccgcgauuucguggagggucuauccggggccaccuggguggacgugguauuagagcauggcggaugcgugaccacgauggccaaaaauaagccaacucuugacaucgaacuacaaaagaccgaggccacgcagcuugcgacuuuacgcaaguugugcauagaggguaagaucaccaacaucacuacugacagccggugccccacgcagggugaagcgguucugccggaggagcaggaucagaauuacgucuguaagcacacguacguggaucguggguggggcaacggauguggucuauucgggaaggguucacuggugacaugcgccaaguuccaaugccucgagcccaucgagggcaaggucgugcaguacgaaaaccucaaguauacuguuaucaucacaguccacaccggggaucaacaucagguggggaacgagacacagggggucaccgccgagauaacgccccaggccucuaccaccgaggcgacccucccggaauacggcacacugggacucgagugcuccccgagaaccggccuugacuucaacgagaugauccuucucaccaugaagaauaaggccuggauggugcauagacagugguucuucgaccuuccacugcccuggaccagcggugccaccacggagacccccaccuggaaucggaaggagcugcucguaaccuucaagaaugcucacgccaagaagcaggagguugugguucuggggucccaggaaggcgcaaugcauacggcccucacuggggcuacugagauucagaacagcggugggacguccaucuucgcgggccaccugaagugccggcucaagauggacaagcucgagcugaagggcaugagcuaugccaugugcacgaauaccuucgugcugaagaaggaggugucggagacucagcaugguaccauccucauuaagguggaauacaagggagaggacgcuccgugcaaaaucccuuucaguacggaggaugggcacgguaaagcucauaacggucgacugauuacugcaaaccccgucgugacuaagaaggaggagcccgugaauaucgaggccgagccgcccuucggggagucaaacaucgugaucggcaucggggacaacgcacugaagaucaacugguacaagaagggcuccucuauugggaagauguucgaggccaccgcccggggcgcccgccgaauggcaaucuuaggcgacacagcgugggacuucgggucagugggcggggugcucaacagcuuggguaaaauggugcaucagauuuucggguccgccuacacugccuuguuuaguggcguguccugggugaugaagaucgggaucggggugcuccucaccuggaucggccugaacucgaagaacacguccaugagcuucuccuguauugcaaucgggauaaucacgcucuaccugggcgccguggugcaggcugacauggguugcgucaucaauuggaaaggcaaagagcugaagugcgggagcggaauauucguaacuaacgaggugcacacguggacggaacaguacaaguuccaggccgacaguccaaagcgacucgcuacggccaucgcuggcgcgugggagaacgggguaugcggcauacgcagcaccacccggauggagaaccugcuguggaagcagaucgccaaugagcugaacuacauccugugggagaauaauaucaaauuaacugugguagucggugacaucauuggaguuuuagagcagggcaagcguacgcugacgccccagccgauggaacugaaguacucuuggaagacuuggggaaaagccaaaaucgugaccgccgagacgcagaacagcuccuucaucauugauggcccgaacacacccgagugccccagcgccucccgggccuggaacgucugggagguugaggacuacggguucgguguguucacgaccaauauauggcucaggcugcgggagguuuacacccaguuaugcgaccauaggcucaugagcgcagcuguuaaggacgaacgugccguccaugcggacaugggcuacuggauugagagccagaagaacgguuccuggaaguuggagaaagcgagccugauagaggucaagacaugcaccuggccaaaaucccacacacucuggagcaacggaguacuggagagugacaugaucaucccuaagucacuggcagggccuaucucgcagcacaaccaccguccgggcuaccacacccagacugcgggucccuggcacuuaggcaaauuggaguuggacuucaacuacugcgaaggaaccaccguagucaucaccgagaacugcgggacgcggggcccgagcuugcggacaacaacggucuccggaaagcugauucaugaguggugcugcagaagcugcacgcugcccccgcuccgcuacaugggcgaggacggcugcugguacggcauggaaauccggccgauuuccgagaaggaagagaacauggucaagagccugguauccgccggcagugggaagguagacaacuucaccaugggcguacugugcuuagcaauccuguucgaggaaguaaugcgcgggaaguucgggaagaaacacaugaucgcuggggucuucuucaccuuuguauugcuccuguccggccagaucacuuggcgggauauggcacacacucugauaaugaucggaagcaacgccuccgaucgaaugggcaugggcguaaccuaucucgcccugaucgcgacuuucaagauacagcccuuccuggcccuaggguucuuucugcgcaagcugacaucacgcgaaaaccuccuccugggcgugggccuugccauggcuacgacccugcagcuuccugaggacaucgagcagauggcgaacgggaucgcacucggauugauggcccugaagcugaucacccaguucgagaccuaccaguuauggacagcccuaauaagccugacgugcuccaacaccaucuucaccuugacgguagcuuggcgcacagcuaccuuaauacucgccggagucagccugcugccagucugucaguccucgagcaugcgcaaaaccgacuggcuccccauggcugucgccgcaaugggugugccuccccucccgcuguucaucuucagccucaaggauacccuuaagcgcagauccuggccgcugaacgagggugugauggcggucggacucgugagcauccuggccuccucucugcuucgcaacgacgugcccauggccggccccuugguagcugguggccuucucaucgccugcuaugugaucacuggcacuucggccgaccugaccguggagaaggccgcagacaucacgugggaggaggaagccgagcagacaggcgucucucacaaccugaugaucacuguggacgacgacgggaccaugcggaucaaggacgacgagaccgagaacauucucacggugcugcugaagaccgcccuccuaaucgucuccggcaucuucccguacagcauuccggcgacccugcuaguauggcacaccuggcagaagcagacccaacgauccggcgugcugugggacguccccuccccgccggagacgcagaaggcagaacuugaggaggggguguaccggauaaaacagcagggcaucuucgguaagacccaggucggagucgggguacagaaggagggcguguuccacaccauguggcacgugacgcggggagcaguucuuaccuauaacgggaagcggcuggagcccaacugggcguccguaaagaaagaccugaucucauacggaggaggcuggcgucuauccacgcaguggcaaaagggggaggaaguacaggugaucgcgguggagcccgguaaaaaccccaagaacuuccaaacuaugccgggcacguuccaaacaaccaccggggagaucggugccaucgcccuggauuucaagcccgggacgagcggcucacccauuaucaacagagaagguaagguagugggucuguacggaaacggcguggugaccaagaacggcggauacgugagcggcaucgcccaaaccaacgcagagcccgacggcccaacuccggagcuggaggaagagauguucaagaaacgcaaccucacgaucauggaccugcaccccgguagcggcaaaacgcgaaaguaccugcccgccauugucagggaagccauaaagcgucgccuucggacccucauacuggccccaacccgcgucguugccgccgagauggaggaggcgcucaagggucugccuauucgguaccagacgaccgcaacaaaguccgagcacacaggccgugagaucguggaucuaaugugccaugccacguucaccaugcggcuccuuagccccguccgcgugcccaauuacaaccuaauaaucauggacgaggcacauuuuaccgaccccgcuucgauagcagcccgggguuacaucucuacgcgcgugggcaugggagaggcggccgcgauuuucaugacggccacgccgccugggaccgccgacgccuucccacaaucuaacgcgccaauccaagacgaagaacgcgacauccccgagcggagcuggaacuccggcaacgaguggaucacugacuucgcgggcaagacagugugguucguccccucgaucaaggccggcaaugacaucgcaaacugcuuacggaagaacgggaagaaggugauccaguugucacggaagacuuuugacaccgaguaccaaaagaccaaacuuaacgacugggauuucgucguuacgaccgacaucucugaaaugggagccaacuuuaaagcggaccgggugaucgacccucggcgcugccucaagcccguuauccugacagacggacccgagcgggucauccuggcggggccgaugcccgugaccgccgccucagcagcccaacgccgcgggagaguaggccggaacccccagaaggagaacgaccaguacaucuucaccggccaaccgcucaauaacgaugaggaccacgcgcacuggacggaggcuaagaugcugcuggauaacauaaacaccccagaaggcaucaucccagcccuguucgagccagagcgcgagaaguccgccgcaauagacggcgaauaccgacugaagggagagucccgcaagaccuuuguggagcugaugaggcguggggaccuacccgugugguuagcccacaaagucgcaagcgaaggcauuaaguauaccgacaggaaaugguguuucgacgggcagcgcaacaaccagauucuggaagagaacauggacgucgagaucuggacgaaagagggggaaaagaaaaagcuccggccgaggugguuagaugcucgcaccuauuccgacccgcuggcccucaaagaguucaaggacuucgcggccggccgcaagucgauagcauuagaccugguaaccgaaauagggcguguucccucccaccucgcccaucgcacgcgcaaugccuuagacaauuugguuauguugcacacgagcgagcacggcggccgggcauacaggcacgcaguagaggaacugccagaaacuauggagacccugcucuugcugggccucaugauccugcugaccggcggcgcgauguuauuccugauaagcggcaaggggaucggcaagacguccaucggccugauuugcgugaucgccucuagugggaugcucuggauggccgagaucccucuccaguggaucgcgagcgccaucguacuggaauuuuucaugauggugcuccugauccccgagcccgagaagcagcgcacgccccaggacaaccagcuggccuauguggugaucggaauccucacccuggcugcuaucaucgcggccaacgagaugggacugcucgagacgaccaagcgugaccugggcauguccaaggagccgggugucguguccccaacuuccuaccuggauguggaccuccaccccgccucagccuggacguuguacgcggucgccaccacugugaucaccccuaugcuacgucacaccaucgaaaacucaaccgccaacguuucucucgcagccaucgccaaccaggccgucgugcucaugggccuggacaagggguggcccaucuccaagauggaccugggcgugccccuucuggccuugggguguuacucccaggucaacccacugacauuaaccgcagcaguccucuuacugaucacccacuacgcgaucauaggccccggccuccaggccaaggccacccgcgaagcccagaagcggaccgccgccgggaucaugaagaacccaaccguggacggcaucaugaccaucgaccuggaccccgucaucuacgacuccaaguuugaaaagcagcugggccagguuaugcuucugguccugugcgccguccagcuccugcugaugcgcaccucgugggcgcucugugaggcccugacacuagcaaccggacccaucaccacgcuuugggagggcucccccgggaaguucuggaacacuaccaucgcggucagcauggcuaacaucuuucggggguccuaccuggccggggccggcuuagcguuuagcauaaugaaauccguugggacaggcaaacgcgguaccgggucucagggagagacccucggggagaaguggaagaagaagcucaaccaacugagccguaaggaguucgaccucuacaagaaauccggcaucacggaaguggaccgaaccgaggcgaaagaggggcuuaagcggggcgagauuacccaucacgccguguccagaggcuccgcaaaguugcaaugguucguugagcggaacauggugauaccugagggacgcgugauugaccucggcugcgggcggggcggguggucguacuacugugccgguuuaaagaaggugacggagguccgcggguacacaaagggcggucccgggcacgaggagccagucccaaugagcaccuacggcuggaacauugugaaacuuaugagcgggaaggauguauucuaucucccacccgaaaagugcgacacccugcuaugcgacaucggggaguccucucccucucccacuguugaggagucacgcaccauccgaguccugaagauggucgaaccguggcucaagaacaaccaauuuugcauaaagguguugaaucccuacaugcccaccgugaucgagcaucuggagagacuccagcguaagcacggcgggaugcuggucaggaauccccuuucgcggaacagcacccacgagauguacuggaucagcaacggcacaggaaacauuguggcuucgguuaacauggucucccgccuccuccugaaucgguucacuaugacccaucgcaggccgaccaucgagaaggacguugaucucggcgcuggaacccggcacgucaacgccgagccugagacacccaacauggacgucaucggggagaggaucaagcgcauaaaggaggaacauaacagcaccuggcacuacgacgacgagaacccauacaagaccugggccuaccacggcuccuacgaggucaaggcaaccgggagcgcaucgagcaugauuaauggaguggugaagcugcugacgaagcccugggacgugguucccauggugacacagauggccaugaccgauacaacgcccuuuggccagcagcggguguucaaggagaaagucgacacccgcacaccgagaucaaugccgggcacccgccggguaauggggauaacggcugaguggcuuuggcgcacgcuggggcgaaauaagaaaccucgccugugcacccgcgaggaguucaccaagaaggugcggacuaaugcagcgaugggugcaguuuucacugaagagaaccagugggauagugcgaaggccgcaguagaagacgaagacuuuuggaagcugguagaccgcgagcgggagcuucauaagcugggcaagugcgggagcugcguuuacaacaugauggggaaacgcgaaaagaagcucggugaguucgguaaggcgaaggggagccgggccaucugguacauguggcugggcgcgcgcuaccuggaguucgaggcccuuggguucuugaacgaggaccacugguucagucgcgagaauagcuacagcggugucgaaggggaaggacugcauaagcucgguuauauccuacgcgauaucagccaaauacccgggggcgcuauguacgcugacgauaccgcugggugggacaccagaauuacggaggacgaucuacacaacgaggagaagaucacgcagcagauggauccggagcaucgccagcucgcgaacgccaucuucaagcucaccuaccaaaauaagguggugaaagugcaacggccaacccccacuggcaccgugauggacauaaucagccgcaaggaucagcguggcuccgggcaagucggcaccuaugggcugaauacguuuaccaauauggaggcgcagcucauccgccagauggagggcgagggggugcugagcaaggcggaccuagagaacccacaccucccagagaagaaaaucacgcaguggcuagagaccaaaggaguggagcggcugaagcggauggccaucucaggcgacgacugcguggucaagccuaucgacgacagguucgccaacgcccuccuggcccugaacgacauggggaagguccgcaaagacaucccucaauggcagcccucgaagggguggcacgacuggcagcaggucccuuuuugcucccaucacuuucaugagcugaucaugaaggacgggcgcaaguuaguggugcccugucggccgcaagacgaauugaucggccgugcacgcaucagccagggggcaggaugguccuuacgcgagacggccugccugggcaaggcuuacgcgcagauguggagccugauguauuuccaccggcgagaccucagacuggcaaguaacgcuauauguagcgccguucccgugcacuggguuccgaccucccgcacgaccugguccauacacgcgcaccaccaauggaugaccaccgaggacaugcugacagucuggaaucggguauggaucgaggauaaccccuggauggaggauaaaacccccgugaccacaugggaggaugugcccuacuuagggaaacgcgaggaccaguggugcggcagccugaucggacucacgucccgggcuaccugggcgcagaauauuccgacugccauacagcaaguccgcagccucauugggaacgaggaguucuuggacuauaugccuuccaugaagcgguuucgaaaagaggaagaaagcgagggugcaauuugguga

SEQ ID NO: 25913 - RNA, 9873 nt, Artificial Sequence
  derived and/or modified CDS sequence (opt11) from DENV-3__KJ189298__SS-prME
acgagucucugccugaugaugaucuuacccgcagcacuagcguuccaucucacaucacgggacggagaaccucguaugauaguaggcaaaaacgagcgggggaaaagccuguuguucaaaacagcuucuggaauuaacaugugcacccuaaucgcgauggaccugggcgagaugugcgaugacacgguaacguauaaauguccacauaucacagaggucgagccagaagacauugauugcuggugcaaccugaccucaacauggguaaccuacgggacauguaaucaagccggagagcaccgcagggacaaacgguccguugcguuagccccacaugucggaaugggccuugacacccguacgcaaacuuggaugagugccgaaggcgccuggcgccagguugagaaaguagaaacaugggcauugcgucaucccggcuucacaauuuuggcccuauuccuggcgcauuacaucggcacaucacugacucaaaaaguagugauuuucauccugcuaaugcucguuacaccgagcaugaccaugcgcuguguugggguugggaaccgagacuucgucgaaggccugagcggagccacguggguagacguaguucuggaacauggcgggugcguuaccacaauggcgaaaaacaaacccacccuugacauugaacuccagaaaacugaggccacucagcuggccacauuacgcaaacuaugcauagaaggaaaaauuacaaacauaaccacggauagucgaugccccacccaaggggaggccgugcuccccgaagaacaagaucaaaauuacgugugcaaacacacguacguagauaggggcugggggaacgggugugggcuguucggcaaaggcucacucgugacaugcgccaaauuccaaugucuugaacccauagagggcaaagucguacaguacgaaaacuuaaaauacacugucaucaucacaguccauaccggugaccagcaucaggucggaaacgagacccaagggguuacggccgaaauaacaccccaggcuucaaccacugaagccaccuuaccggaauacggaacgcuaggauuggaauguagcccacgcacaggacuggauuuuaacgaaaugauccuccucacaaugaaaaacaaagccuggaugguccacaggcagugguucuuugaccuaccgcuucccuggacaagcggagcuaccaccgagacaccaaccuggaaccgcaaagaacuacuggucaccuucaaaaaugcacacgcgaagaaacaagaggugguaguacucggcagccaggaaggggcuaugcacacagcccuuaccggggcgaccgaaauucaaaacucaggcgguacaaguauauucgcagggcaccugaaaugccgccuuaaaauggacaaacucgagcugaaagguaugagcuacgcgaugugcaccaacacguucgugcucaagaaagaagugucggagacacagcacggcacgauacucauaaagguagaauacaaaggggaagacgcaccuugcaaaaucccauucucgacagaggacggccacgguaaagcacauaacggaaggcugauuacggcaaacccagucguuacuaagaaagaggaacccgucaauaucgaggcugaacccccguucggggaaagcaauauuguuaucggcaucggcgacaacgcucucaagaucaacugguacaagaaaggaaguaguaucggcaaaauguucgaggcaacagcucgcggcgcccgaagaauggcuauacuaggagauacagcaugggauuuuggcucggucggaggcguccucaauagccuugguaagauggugcaccaaauuuucggcagcgcauauaccgcccuguucucgggugucaguuggguuaugaaaaucggcauaggcgucuuacuuacauggaucggccucaacucuaaaaacacaagcaugagcuucuccugcauagccaucggaaucaucacacucuaccucggugccguuguacaggcggacaugggcugcgucaucaacuggaaggguaaagagcucaagugugggagcgggauauuuguaaccaacgaaguucacacuuggaccgagcaauacaaauuccaggcagauucaccaaaaagauuggcaacugccauagcuggagccugggagaacgggguaugcggcaucaggagcaccacgagaauggagaaccucuuauggaagcagauagcgaacgagcucaauuacauauuaugggaaaacaacaucaagcucacugucgugguuggugacauaauaggaguacuggagcaaggcaagcgcacacugacuccgcaaccaauggagcuuaaauacagcuggaagacauggggaaaagcaaaaauagugacugcagaaacacaaaauagcucauucauaaucgacggacccaacaccccggaaugccccagugccucgcgagcauggaacguaugggaagucgaagacuacgguuucgguguguucacgacaaacaucugguugcggcuuagggaaguuuacacccagcuaugcgaccaccgccuaaugagugcggcgguaaaagaugaaagagcaguacacgcagacaugggauacuggauagagucgcaaaagaacggcagcuggaagcucgagaaagcgucccugaucgaagugaagacauguacauggccuaaaucgcacacgcuuuggaguaacggcguccuagagagugacaugaucaucccaaaauccuuagccggaccaaucucccaacacaaccaccguccaggcuaucacacucagaccgccgggccuuggcaccuaggaaagcucgaacuagauuuuaacuacugugaggguacgacgguggucauuacagaaaauugcgggacacggggaccaucucuccggaccaccaccguguccggaaaacucauccacgaguggugcugcaggagcugcacauugccgccucucagauacaugggggaggacggcugcugguacggaauggaaauucgccccauauccgagaaagaagaaaauauggucaagagccuagucucagccggcagcggaaagguggauaacuuuacgaugggaguacucugucuggcaauauuauucgaagaaguaaugcggggaaaguucggcaaaaagcacaugauagcgggaguauuuuucacauucguguuacuccugagcgggcaaaucaccuggagaaacauggcacauacccucauaaugauaggcucgaacgccagcgaccgaaugggaaugggagugacuuaccuggcacuaauugccacauuuaagauacaaccauuccuagcucuuggcuucuucuugcguaaacugaccucccgggaaaaucucuuacuaggagucggccucgcuauggcgaccacccuacaacuuccagaggacauagagcaaauggccaacggcauagcccuaggguugauggcacugaaacuaaucacccaauuugaaacauaccagcuuuggacagcacuuauaucuuuaacaugcagcaauaccaucuucacacuaacgguagccuggagaaccgcuacucuaaucuuagcaggcgugagccuacuuccugucugccagagcucgucuaugcgaaaaaccgacuggcucccaauggccguggcagccaugggugucccgccacuaccacuguuuauuuucucacuaaaagacacccugaagagaagaucauggccucugaacgaaggcgucauggcaguaggccuaguguccauucuggccagcucccuccuacggaaugauguaccgauggcaggcccuuuaguagcugggggauuacucaucgcaugcuauguaauaaccggcaccagcgccgaccuaacgguggagaaggcagccgauaucacgugggaagaggaagcagagcaaaccggcguaucccacaaccuaaugaucacagucgaugacgacggaaccaugcgaauaaaggacgaugaaaccgaaaacauccugacaguccucuugaagaccgccuuacucauaguaagcggcaucuucccguacuccauaccagccacacuccuaguauggcacaccuggcagaagcagacccaaagaucagggguacucugggacguuccaucaccacccgaaacacaaaaagcggagcucgaagagggagucuacaggaucaaacaacaggggauuuucggaaagacgcaaguaggagucggaguacagaaagaagggguauuccacacaauguggcacguaaccagaggcgccguccucacauacaacgguaagcggcucgaacccaacugggccucggucaagaaggacuugauaucuuauggcggcggcuggaggcuuagcacacaauggcaaaagggugaagagguacaggucauagccguagagccgggcaagaacccaaagaauuuccaaacgaugcccgggaccuuucagacgaccacaggcgaaauaggagccauagccuuagauuuuaagccggggacaagcgggagcccaauuauaaaccgagagggcaaaguagucggguuauacgguaacggagugguuacgaagaacggcggcuacguuagcggaaucgcgcaaacuaacgcagaaccggauggacccacgccugagcuugaggaagagauguucaaaaagcgaaaccuuacaaucauggaccuacacccagguucaggaaagacgaggaaauaccucccagcaauuguacgggaggcaauaaagcgaagauuacgcacgcugauccuggcaccgacgagaguggucgcagccgaaauggaagaagcacugaagggccucccgauacgguaucaaaccacagcaacuaaaagcgagcacaccggcagggaaauagucgaccucaugugccacgcaacauucaccaugcgacuccuaaguccagugagagucccuaacuacaaucuuaucaucauggacgaagcccauuucacagacccagcgagcauugccgcgcgaggauauauuucuacgcgggucggcaugggagaagcggcugcaaucuuuaugaccgccaccccgccagggacugcagacgccuucccgcagaguaacgcacccauucaggacgaagaacgcgacauaccagaacggagcuggaacucagguaacgaguggaucacugacuuugcagggaaaacagugugguuugucccgagcaucaaagcagguaaugacauagccaacugccuacggaagaacggcaagaaaguaauacaacuaaguaggaagaccuuugacacugaauaccaaaagacuaaauugaacgacugggacuuuguggucacgacagacaucagcgagaugggagccaauuuuaaggccgacagagucaucgauccccgcagaugucucaaaccaguuaucuuaaccgauggcccagagcgaguaaucuuagccgggccaaugccagucacggcagcaagcgcugcccaacgacgggggagaguaggaaggaacccccagaaagaaaaugaccaguacauuuucacagggcagcccuugaacaaugacgaagaccacgcacacuggacagaggcaaagaugcuacuagacaacauaaacacaccagaaggaauaauuccagcucuuuucgagccagaaagggagaaaagcgcagcaaucgauggcgaauauaggcucaaaggcgagagucggaaaacauucgucgagcucaugcgccgcggcgaccuaccgguguggcuagcacacaagguagcgagcgaagguaucaaauacacagaucgaaaauggugcuucgacggccagagaaacaaucaaaucuuggaagaaaacauggacguggaaaucuggacuaaggaaggcgagaagaagaaacugcggccucgauggcuugaugcucgaaccuacucggacccuuuagcgcucaaagaguucaaagauuucgcagccggccgaaaaucaauugcgcuagaccuagucacagagauaggacgugucccuagccacuuggcacauagaaccagaaacgccuuggacaaucugguuaugcugcauacauccgagcacgguggccgagcauacagacacgccguagaggagcuccccgaaacuauggagacccuacuucuccugggccuaaugauacuguugacggguggcgccauguuauuuuuaauuagcggaaaaggcauaggaaaaacuagcaucggccucauaugcguaauagcauccaguggaaugcuuuggauggcggaaauaccacugcaauggauugcaucagccauaguccuugaguucuuuaugaugguauuacugauuccggaaccagaaaaacagagaacuccccaagauaaccagcucgcauacguggucauugguauccucacacuagccgccauaauagcggccaacgagaugggauuauuggaaacaacuaaacgagaccuaggcaugucgaaggaaccaggagucgugagcccuacuucguaccucgacgucgaccuucauccagcaucagcauggacgcucuaugcagucgcaaccaccguaaucaccccaauguuacgacacacaauagaaaacuccaccgcaaaugucagucucgccgcgaucgcaaaccaagcgguaguguuaaugggccucgauaaaggguggccaauuagcaagauggaucucggggugccgcucuuagcacuagggugcuacagccagguaaacccccugacgcucacagccgccguacuucuccugaucacccacuaugcaauaauaggcccgggacuacaggcuaaggcaacaagggaggcccaaaagagaacggcugcagguaucaugaagaaccccacaguggacgggauaaugacaaucgauuuagacccagugaucuacgacagcaaguucgagaaacagcugggucagguaaugcuccuaguuuuaugcgccguacaacuccuguugaugcgcacaagcugggcccugugugaggcgcucacguuagcgaccggaccuauaaccacguugugggaagguagcccagggaaguucuggaacacuaccaucgcggucucaauggcaaacauauuucgaggaaguuauuuagcgggagccggucuggccuucagcaucaugaaaagcguggggacagguaaacgaggcaccgguucccagggagaaacgcuaggagaaaaguggaaaaagaaacucaaccaauuaaguagaaaggaguucgaccuauauaagaaaagcgguaucaccgagguugaccgaaccgaagcgaaagaaggccuuaagagaggagaaauaacccaucaugcagucagccgugggucggcaaaacuccagugguucguagagagaaacaugguuauaccagaaggucgcguaauagaccuaggguguggucgaggcggguggagcuauuauugugccggccuaaagaagguaacggagguccgaggguacaccaaagggggaccaggccacgaggaaccagucccaaugagcacguauggcuggaacauaguaaaacuaaugucagggaaagaugucuucuacuugccgccugaaaagugcgacaccuuacuuugugacaucggagaaagcagccccagccccaccgucgaggaaucacgcaccauacgaguacuaaagauggucgaacccuggcuaaagaacaaccaauuuugcauaaagguuuugaacccuuauaugccgacggugauagagcaucuggagcgccugcaacgaaaacacggcggcaugcuagugcgcaacccacuaucccgcaauucaacacacgaaauguacuggauaagcaacggaaccggaaacauuguggccagugucaacaugguaucaaggcugcuguuaaaccgguucacaaugacacaccggcgcccgacuauagagaaggacguggaccuaggagcgggaacgcgacacguaaacgcagagccggagacgccuaacauggacguuauaggagagcgaauaaagcguaucaaggaggagcacaauuccaccuggcacuacgacgaagaaaacccauacaagacuugggcauaccacggaagcuaugaagugaaagcaacugggucagcuucaagcaugauuaacggagucgugaaacugcugacuaaaccaugggaugucguacccaugguuacucagauggcgaugacugacacaaccccguucggacagcaacgaguguucaaagaaaagguugacacgagaacgccgcgaaguaugccaggcacgcgccggguaaugggaaucacagccgaauggcuauggcgaacccuaggaaggaacaaaaagccacgccucugcacaagagaggaguucacuaagaaaguacgcacaaacgcagcgaugggagccgucuucacagaggaaaaccagugggacagcgcaaaggcggcaguagaagaugaggacuuuuggaagcugguugaccgcgagcgugagcuucacaagcucggcaagugcggguccugcgucuacaauaugauggggaaaagagagaagaaacucggagaguucgggaaagcgaaggggagcagggcuauuugguacaugugguugggagcucguuaccuagaguucgaggcgcuugguuucuugaaugaggaucauugguucagucgcgaaaacucguacucaggcguugagggggaaggucuucauaaacuaggcuauauucuaagggacauaagcaaaaucccaggaggggcgauguacgcggacgacaccgccgggugggacacacgcaucacugaagacgaccuacacaacgaggagaaaauuacacaacaaauggacccggaacaucggcaacuugcaaacgcaaucuucaagcucacguaccagaacaaggucguaaaagugcaacggcccacgccuaccggcacaguaauggacauuaucagcagaaaggaccagcggggaagcggacagguggguacuuacggacuaaauaccuucacaaacauggaagcgcaauugauuagacagauggagggcgaagggguacuaucaaaagcagaccuggaaaauccgcaccuuccugagaagaaaauaacccaguggcuagaaacaaaaggaguagaacgcuugaagcguauggcaauaucgggcgaugacugcgugguaaagccaaucgacgaccgguucgcuaacgcguugcuagcacucaacgauaugggcaaaguacgcaaagauaucccccaauggcaaccgagcaagggguggcacgacuggcaacaaguacccuucuguucgcaccacuuccacgaacuaauaaugaaagacggcagaaaacuggugguaccgugcagaccacaggaugaacuaauaggacgagccagaauaucucaaggcgcaggauggagccuaagggaaacagcgugccugggaaaagcguacgcacaaauguggagucucauguacuuucaccgccgcgacuuaagguuggccucaaacgccauuugcucagccguuccagugcauugggucccaacgucuagaacuaccuggagcauccacgcgcaucaccaauggaugaccaccgaggacaugcucaccguuuggaaccgaguauggauugaggacaacccauggauggaagacaagacgcccguuacgaccugggaagacguucccuaccuuggcaaaagagaagaccagugguguggauccuuaauaggccuaacaagccgagccacaugggcccaaaacauaccaaccgcuauccaacaggugaggucgcucauagggaacgaggaguucuuggacuacaugcccucaaugaagcgguuccgaaaagaagaagagucugaaggcgcaaucugguag

SEQ ID NO: 25914 - RNA, 9873 nt, Artificial Sequence
  derived and/or modified CDS sequence (opt11) from DENV-3__KJ189301__SS-prME
accagccucugucucaugaugauccugcccgccgcucuugcguuccaccucaccagccgugacggggaaccccggaugauuguggggaaaaacgaacggggcaagagcuuauuauucaagaccgccucagguaccaacaugugcacccucaucgcuauggaccuuggcgaaaugugcgacgacaccguuaccuacaagugcccccacauuacagaaguggaaccggaggacaucgacugcuggugcaacuuaaccagcaccugggugaccuacgggacaugcaaucaggcgggggagcaucggcgcgacaagcgauccguggcucucgcgccccaugugggcaugggucuggauacuaggacccagaccuggaugagcgccgagggcgcguggagacaggucgagaagguggaaaccugggcccuccgccaccccgguuucaccaucuuagcacuguuccuggcgcacuacauuggcacgucccucacgcagaaaguggucaucuucaucuugcugaugcucgucacccccagcaugaccaugcggugcguggggguagggaaucgcgacuucgucgagggccuguccggugcuaccuggguggacgugguccuggagcauggagggugcgugacaacaauggcaaagaacaaacccaccuuggacaucgagcugcagaagaccgaggccacgcagcuggcgacccuccggaaacucugcaucgagggcaagaucaccaacaucacaaccgacucaaggugcccaacccagggcgaggccgugcugcccgaggaacaggaccagaacuaugugugcaagcauaccuacguugacagaggauggggcaaugggugcggccucuucgguaagggcucgcuagugacuugugccaaguuccagugccuggaacccaucgagggcaaggucgugcaguacgaaaaccucaaauauaccgucaucaucacgguccacacgggggaccagcaccaggugggcaaugaaacccagggcgugacggccgagauaacaccccaggcaagcaccaccgaggcgacccugcccgaguacggcacgcugggccucgaguguucuccgcgcaccggguuggauuucaaugagaugauucugcucaccaugaaaaacaaagccuggauggugcaccggcagugguuuuucgaccugccccugcccuggaccucaggggccaccaccgagacccccaccuggaaccgcaaggagcuauuggugacguucaaaaacgcccacgcaaagaagcaggaggucgucgugcuggggucacaggagggcgcuaugcacacugcccucaccggggccacugagauccaaaacucgggcgggaccucgauuuuugcuggccaucuaaagugccgacugaaaauggacaagcucgagcugaagggcaugucauacgccaugugcaccaacacauuuguccugaagaaggaagugucggaaacgcagcacgggacgauacucaucaagguggaauacaagggcgaggacgcgccaugcaaaauccccuucucaacggaagacggacauggcaaggcgcacaacgggcgccucaucaccgccaaccccgucgucaccaagaaggaggagcccguuaacaucgaggcggagccgcccuucggcgagagcaacaucgucauagguaucggugacaacgcgcugaagaucaacugguacaaaaagggcucgagcauuggcaagauguucgaggccacggcccggggcgcccgccggauggcuaucuuaggcgacaccgccugggacuucggguccguagggggcgugcuaaacagccugggcaagaugguccaccaaauauucgggagugccuacaccgcauuauucagcggcguauccugggugaugaagaucggcaucgggguccuccugaccuggaucggccugaauagcaagaacacguccaugucauuuuccugcauagccaucggcaucauuacccuauaccugggcgcuguagugcaggcugacauggggugcgucauuaacuggaagggcaaggagcugaagugcggcaguggcaucuuugugaccaacgaaguacacaccuggacggaacaguacaaguuccaggccgauucccccaagcgucucgccaccgccaucgccggggcuugggagaauggggugugcggcaucagaagcaccacgcguauggagaauuugcuguggaagcaaaucgccaacgagcucaacuacauccuaugggaaaacaauguaaaacuuaccguggucgugggggacaucaucggcguacucgagagaggcaagagaacccuaacgccccaaccgauggagcucaaauacaguuggaagaccugggggaaggccaagaucgucacggccgagacccagaacagcuccuucaucauagacgggcccaacacgcccgaguguccaagcgcguccagagcguggaaugugugggagguggaggacuacggguucggcguuuucaccaccaacaucuggcuccgucugcgugaagcauacacgcagcugugcgaucaucgguugaugagcgccgcuguuaaggacgagcgcgcgguucacgccgacaugggcuauuggaucgagagccagaagaacgguagcuggaagcucgagaaggccagccuaauugaggucaagacuuguaccuggcccaagucccacacccucuggagcaacggcgugcuggaguccgacaugaucauucccaagucucuugccgggcccaucucucagcacaaucaccggccgggcuaccacacgcagaccgcuggcccuuggcacuugggcaagcuagagcuggacuucaacuacugcgagggaaccacaguggugauuacggagaacugcgggacgcgcggacccagccuccggacaacaacgguuagugggaagcugauucaugaauggugcugccgcagcuguacucugcccccgcuccguuacaugggggaggauggaugcugguacgguauggagaucagaccuauuucagagaaggaggaaaacauggucaaaucacuggucagugcuggcagcggaaaaguggacaacuucaccaugggcgugcugugccucgcgauucuguucgaggaggucaugcgggggaaguucggcaaaaagcacaugaucgccgggguguuuuucaccuucguucuccuccuguccgggcagaucacguggcgagauauggcccacacccuaauuaugaucgggucuaacgccuccgaccggauggggaugggcgucaccuaccuagcgcugauugcgacguucaagauccagcccuuccuugcacucgguuucuuccugcggaaacugacgagccgcgagaaccuacugcugggcguggggcucgccauggccaccacucugcaacugcccgaagacaucgagcagauggccaacgguauugcccucggccugauggcccugaagcucauuacccaguucgaaacguaccagcuguggaccgcgcugauuagccuuaccuguuccaacacgaucuucacccugaccguugcuuggcgcaccgccacuuugauccucgccggcgucagccugcugccgguaugccagucaagcuccaugcgcaagacggacuggcucccaauggccgucgccgcgaugggcguaccgccacuuccauuauucaucuucagucucaaggacacccucaagcggcgauccuggccacugaacgaaggggugauggccguuggccucgucagcauccuggccuccagccugcucagaaacgaugugcccauggccgggccccugguagccgggggacugcucauagccugcuacgugaucaccgggaccucagcagaccugacgguggaaaaagccgccgacaucaccugggaggaggaggcagagcagaccggcgucagccacaaucuaaugaucaccguagacgacgacgggaccaugcgcaucaaagaugacgagacugagaauauccucaccgugcugcugaagaccgcucuccugauugucuccggcaucuucccguacagcauacccgccacccugcucguguggcauacguggcaaaagcagacccagcgaagcggcgugcugugggaugucccuagcccgcccgagacccagaaagcugagcuggaggaggggguguaucgcaucaagcagcaggggauuuucgggaagacccaggugggcgucggggugcagaaggagggcgucuuccacacgauguggcacgugacccggggagcugugcucacguauaaugggaagagauuagagcccaauugggcuagcgugaagaaggacuuaaucagcuacggcgguggcuggcggcucaguacccaguggcagaagggggaggagguccaggugaucgccguggagccuggcaagaaccccaaaaacuuucagacgaugccaggaaccuuucagaccaccacgggggagaucggcgccaucgcccuggacuucaaacccggaacaagcgguagccccauuaucaacagggaggggaaggucgugggucuguacggcaacgggguggucaccaagaacgguggguacgugagcggcaucgcccagacuaacgcggagcccgacggccccacgccggagcuggaggaggagauguucaagaagcggaaccucaccaucauggacuugcauccggguagcggcaagacccgcaaguaccugccggccaucgugagagaagccaucaagcgccggcugcgcacccuaaucuuggcccccacgcgggucguggccgcggagauggaggaggcucucaaggggcugccgauucgauaccagacgaccgcuaccaagagcgagcacacgggccgggagaucguggaccugaugugccaugccaccuucaccaugcgacuccugucacccguccgggugccgaauuauaacuuaaucaucauggacgaggcccacuucacagaucccgcguccauagccgcgagaggcuacaucagcacgcgcgugggcaugggcgaggccgcggccaucuucaugaccgcuacgccgcccgggaccgcggacgcuuucccgcaguccaaugcgcccauccaggaugaggagcgggacauuccagagcgcagcuggaacuccggcaacgaguggauuacagacuucgcgggcaagaccgucugguucgugccgagcaucaaggccggcaaugacaucgcuaauugucuccggaagaacgguaagaaggugauucaguugucucgcaagacauuugacaccgaguaccagaagacgaagcugaacgacugggacuucgucgugaccacggacauuagcgagaugggcgcaaacuucaaggcggaccgggugaucgacccgcgccggugccucaagcccgucauccugaccgacggccccgagcgcgugauccuagccgggccuaugccagucacggccgccuccgccgcgcagcgucgcggucgagucgguaggaauccccagaaagagaacgaccaguacaucuucacaggccagccccuuaauaacgacgaggaccacgcccacuggaccgaggccaagaugcugcuggacaacaucaacacacccgaggggaucaucccggcccucuucgagcccgagcgggagaagucagcggccauagacggggaguaccgcuuaaagggcgagucgcguaagacguuugucgagcugaugcgccguggagaucuccccguuuggcuggcccacaaggucgcgagcgagggcaucaaguauacggaucggaaauggugcuucgacgggcaacggaacaaccaaauccucgaggagaacauggacguggagauauggacuaaggagggcgagaagaagaaacuccgcccccgcuggcuggacgcgaggacuuacuccgauccgcuugcccucaaggaguucaaggauuucgccgcuggccgcaagagcaucgcccuggaccuugugaccgagauaggacgggugcccagucaccucgcgcaccguacccggaacgcgcuagacaaccuggugaugcuccacaccagcgagcacggcgggcgcgccuaccggcacgccgucgaggagcugcccgaaaccauggagacccugcucuugcugggccuuaugauccuccugaccggcggggccaugcuguuccuaaucagcgguaaggggaucgggaagaccuccauaggccucaucugugucaucgcguccucaggcaugcucuggauggcggaaaucccacugcaauggaucgccagcgccaucgugcuggaguucuucaugaugguccuccuggugccagagccugagaagcagaggacgccccaggacaaccagcucgccuauguagucaucgggauccugacccucgccgcgaucaucgcugccaacgaaaugggacugcucgagacgacaaagcgggaucugggcaugagcaaggagccgggagugguaagcccuaccuccuaccuggacgucgaccuacaccccgcaagcgcguggacccuuuacgccguggccacgacaguaaucaccccuaugcugcgccacaccaucgagaacuccaccgccaacgucagccucgccgcgaucgcuaaucaggcagugguacugaugggauuagauaagggguggccgaucaguaagauggaccucggugucccccuucuggcccucgggugcuacagccagguaaacccauugacccugaccgccgccgugcuccugcugaucacccacuaugccaucaucggccccggcuugcaggcgaaggcaacaagggaggcacagaagcgcacggcagccgggaucaugaagaacccaaccgucgacggcauaaugaccaucgacuuagaucccgugaucuacgauuccaaguucgagaaacagcugggccaggucaugcuccugguccugugcgccgugcagcuccugcuaaugaggacuucaugggccuugugcgaagcguugacccuugccacaggucccaucacgacgcucugggaaggcucccccgggaaauucuggaacacgaccauagccgugagcauggcaaacaucuuccggggcuccuaucuggccggggcgggccuggcauucagcaucaugaaguccgucgggaccggcaagcggggcaccggcagccaaggcgagacguuaggggaaaaguggaagaaaaagcugaaccagcugagccgcaaggaguucgaccucuauaagaaaucaggcaucacggagguggaccggaccgaggccaaggagggguugaagcgcggcgagaucacgcaccacgccgugagccgggguuccgcgaaguuacagugguuuguugagcgcaacauggugauaccggaggggcgaguaaucgaccucggaugcggucgcggcggguggagcuacuacugcgcgggccugaagaagguaacggagguacgcggcuacaccaaaggcgggccugggcacgaggagccugugcccauguccacguacggcuggaauaucgucaagcugauguccgggaaggacguuuucuacuugccuccagagaagugcgacacccugcuaugcgacaucggcgaguccagccccucccccacgguagaagagagccggaccauccgcguccugaaaaugguagaacccuggcucaaaaauaaccaauucuguaucaaggugcucaaccccuacaugccgacggucauagagcaccuggagcggcuccaacgcaaacauggcgggaugcuggugcggaacccucugucccgcaacucuacccacgagauguacuggaucuccaacggcacagggaacaucguggcgagcgucaacauggugucucggcuccugcugaaccgcuuuaccaugacccaccggcgcccgaccaucgagaaggacguggauuuaggugccggcacacggcacgucaaugccgagccggagacacccaacauggacgugaucggggagcgcauaaaaaggaucaaggaagaacacaacagcaccuggcauuacgacgacgagaacccguacaaaaccugggcuuaucacggcucauacgaggugaaggccaccgggagcgccucgagcaugaucaacggcgucguuaagcuccugaccaagcccugggacgucguaccuauggugacccagauggccaugaccgacacgacccccuucgggcagcagcgcguguucaaggagaagguggacacgcggaccccgcgcucuaugccuggcacgcggcgggucaugggaaucacagccgaguggcucuggcggacccugggucgcaacaagaagccccgccuguguacccgggaagaguucacgaagaaaguucgcaccaacgcggccaugggcgccguguucacugaggagaaucagugggacagcgcuaaggccgcugucgaggacgaggauuucuggaagcucgucgaccgggaacgcgaguugcacaagcuggggaagugcggcagcuguguguauaacaugauggggaagcgggagaagaagcucggcgaguucggcaaagccaaggggucccgcgccaucugguacauguggcugggagccagguaccuggaguucgaggcccucggcuuccugaacgaagaccauugguucagccgcgaaaacagcuacagcggcguggagggggaggggcugcacaagcucggcuacauccugcgcgacauuuccaagauccccgggggugcgauguacgccgaugacaccgcaggaugggacacgcgcaucaccgaggacgaccugcauaacgaggaaaagauuacccaacagauggacccggagcaccggcaacucgccaacgcuaucuucaaacuuacguaccagaacaaggucgugaaggugcagcgcccuacucccacgggcacugucauggacauaaucagucggaaggaccagcgcgguuccggccaggugggcaccuacggccuuaacaccuuuacgaacauggaagcgcagcucauccggcaaauggaaggcgaggggguucugagcaaggcugaccuggagaacccccaccuaccagagaagaaaaucacccaguggcuggagaccaagggcguggaaaggcugaagcguauggccaucuccggcgacgauuguguggugaaacccaucgacgaucgcuucgcuaacgcgcuccuggccuugaacgacauggguaagguacggaaagacaucccccaguggcagcccucuaagggguggcacgauuggcaacaggugccguuuugcucccaccauuuccacgaguugaucaugaaggacgggcgcaagcuggugguccccugccggccccaggacgagcugauaggccgggccagaaucagccaaggggccggcuggucccuccgggaaacagccuguuugggcaaggcguacgcccagauguggagccugauguacuuucaccgucgugaucuccgacuggcuuccaaugcgaucugcagcgcugucccggugcauugggucccgacaucccggacuaccuggagcauccacgcacaccaucaguggaugacuacugaggauaugcugaccgucuggaaccgcguguggaucgaggacaaccccuggauggaggacaagaccccaguuaccacgugggaggacgugccauaccugggcaagcgggaggaucaguggugcgguagccugaucggccugaccuccagggccacgugggcacagaacaucccgacggccauacagcagguccggagccugaucggcaaugaggaguuccuggacuacaugcccucgaugaagcgcuuccggaaagaggaagagagcgagggggcaaucugguag

SEQ ID NO: 25915 - RNA, 9873 nt, Artificial Sequence
  derived and/or modified CDS sequence (opt11) from DENV-3__KF955456__SS-prME
accucgcuuugcuuaaugaugauucugccggcagcgcuggccuuucaccucaccagccgggacggggagccccggaugauugugggcaaaaacgagcgcggcaagagccugcuguucaagacagccagcgggaucaacauguguacccucaucgccauggaucugggcgagaugugcgacgacaccguaaccuacaagugcccacacaucgccgaaguggagccggaggauaucgacugcuggugcaaccugaccagcaccugggugaccuacgggaccugcaaucaggcaggggagcaucggagggacaagcgguccguggcccuugcgccccacguuggcauggggcucgacacgaggacccagaccuggaugucugccgagggagccuggcgccagguagagaaaguggagacaugggccuugcgucacccgggguucacgauccucgcccuguuuuuggcccacuacaucggcaccuccuuaacccagaagguagugaucuucguccugcugaugcucgugacccccuccaugacgaugcggugcgugggggucggcaaccgcgacuucgucgagggccuguccggggccacauggguggacguagugcuagaacacggcgggugcgugaccacaauggccaagaacaagcccacgcucgacaucgagcugcagaagaccgaagcgacgcagcuggccacccuccggaaguugugcaucgagggcaagaucacgaacaucacuaccgacagcagaugucccacccagggcgaggcggucuugccggaggagcaagaccagaauuacgugugcaagcacacguacguugaccguggcuggggcaacgggugugggcucuucggcaagggcucccuggugaccugcgccaaguuucagugccucgagcccaucgagggcaaagucgugcaguacgagaaccucaaauacacggucaucaucaccgugcacacgggggaccagcaucagguuggaaaugagacacagggugucacugccgagaucacaccccaagcgagcacgaccgaagccaucuuacccgaguacggcacucugggucucgagugcuccccgcgcacgggacuggacuucaaugagaugaucuugcucacgaugaaaaacaaagcguggauggugcaccggcagugguucuuugauuuaccccugcccuggacgucgggcgccaccacugagacuccaacguggaaccgcaaggaguugcuagugaccuucaagaacgcccacgcgaagaaacaggagguggugguacuggggucccaagagggagccaugcauaccgcccucaccggggcuacggaaauccagaacagcggugggaccagcaucuucgccggccaccugaaaugucgguugaagauggacaagcuugaacugaaggggaugagcuacgccauguguacuaacaccuucgugcuaaagaaggaggugagugaaacacagcaugggaccauccucaucaaggucgaguacaagggggaagacgccccgugcaagauaccuuucuccaccgaggacggacaggggaaggcucacaacggccgccugauuaccgccaacccaguggugacgaagaaggaggagcccgucaauaucgaggcggagccgcccuucggcgagucuaauaucgugauagguaucggagacaacgcucugaagaucaacugguauaagaagggcucaucaaucgggaagauguucgaagccaccgcgcggggcgcccgccggauggcaauccugggcgauacggccugggacuucggcuccgugggcgguguccucaacucacugggcaagauggugcaccagaucuucggguccgccuacaccgcgcuguucagcggcguguccuggguaaugaagaucggcaucggcgugcugcugacuuggaucggccugaacagcaagaacaccuccaugagcuuuuccugcaucgccaucggcaucauuacucucuaccugggcgcugucguccaagccgauaccgggugcgugaucaacuggaagggcaaggagcugaaaugugguucugggauuuucgugacgaaugagguccacaccuggaccgagcaguacaaguuccaggccgacucaccuaaacgccucgcaaccgccauagcgggcgccugggagaauggcguguguggcaucagaagcacgacccggauggagaaccuccuauggaagcagguggccaacgagcuaaauuacauccugugggagaacaacaucaaguugaccgucguggugggggacaucaucggcguccuugaacagggcaagcgcaccuuaacgccacaacccauggaacugaaguacuccuggaagaccugggggaaggccaagauuguaaccgcugagacgcagaacagcuccuucaucaucgacggccccaacacgcccgagugccccuccgccucccgggccuggaacguuugggagguugaggacuaugguuucggaguguucacaaccaacaucuggcucaagcuucgcgagguguacacccaacugugugaccaccgguugaugagcgccgcugucaaagacgagcgcgccgugcacgccgauaugggauacuggaucgagagccaaaagaacggguccuggaagcuggagaaagcgagucugaucgaggucaagacaugcacuuggccgaagucccauacgcuguggagcaacggcguccuugaguccgacaugaucauccccaagagccuggccgggcccaucucccagcacaauuaccggccgggcuaucacacgcagaccgccgggcccuggcaccucggcaagcuggagcuggacuucaacuauugcgagggcacuaccguggugaucaccgagaacugcgggacgcgcggcccgucacuccggaccacuaccgucuccgggaagcugauccacgagugguguugucguagcugcacccugcccccucuccgauacaugggcgaggaugggugcugguauggaauggaaauccggccuaucuccgagaaggaggagaacauggugaagagccuuguguccgcgggcucugggaaagucgauaacuucacuaugggcguguugugccucgcgauccuguucgaggaagugaugcgggggaaguuuggcaagaagcacaugauagcggguguauucuucaccuucguccuguugcugagcggccaaauuacguggcgagacauggcccacacccuugugaugaucggcagcaacgcauccgaucggauggggaugggggucacuuaccuggcgcugaucgccaccuucaaaauccagccguuccuggcccuaggguuuuuccuacgcaaacugaccucucgggagaaccuucugcuaggcgugggcuuggccauggcgaccacgcugcagcugccggaagauauagagcagauggccaacggcaucgcccuaggccuaauggcccugaagcucauaacccaauucgaaaccuaccaacuguggaccgcgcugauuagccucacgugcuccaacacaaucuucacgcugaccgucgcguggcgcacggcaacccugauacucgccggggugagccuucugccggugugccagaguagcuccaugcggaagucggacuggcuccccaugaccgucgcagccaugggugugccgccccucccccuguucauauucuccuuaaaggacacccugaagcgccggagcuggccccugaacgagggagugauggcugucggccucgucuccauccuggcuagcucgcugcucagaaacgaugugcccauggccggcccccuggucgccgguggccuccucaucgccugcuacgugaucacgggaacaagcgcugaucugacgguugaaaaggccgcagacguaaccugggaggaggaggcggagcagacgggggugucccacaaccugaugaucaccguggacgacgacgggaccaugcgcaucaaagacgacgagaccgaaaacauccucacgguccugcugaagacggcccuccucauagugagcggcaucuuuccuuacuccauccccgcuacccuuuuaguguggcacaccuggcagaagcagacccgccgcagcggcguucugugggacguaccuuccccgcccgagacgcaaaaggccgagcuggaggagggaguguacagaauaaagcagcagggcauauucggcaagacccaaguuggcguggggguccaaaaggaaggcguuuuccauaccauguggcacguuaccagaggggcagugcucacauacaacgggaagcgccucgagcccaauugggccaguguaaagaaggaccugaucuccuauggugggggcuggcgucucagcgcgcaguggcagaagggggaggagguacaggugaucgccgucgaacccggcaaaaacccaaagaacuuccaaaccaugcccggcaccuuccaaaccacaacuggcgaaaucggcgccauugcccuggacuucaagcccgggaccaguggcucccccauaaucaaccgcgaaggcaaggugguggggcuguacggcaacggggucgugaccaagaacggcggguacgugagcggcaucgcacagaccaaugccgagccggacgggcccacccccgagcuggaggaggagauguucaagaagcguaauuuaaccaucauggaccugcaucccggguccgggaagacccgaaaguaccugccggcuaucguccgcgaggccaucaagcggcgccucagaacgcugauccuggcccccacccgcguuguggcagccgagauggaggaagcccugaaggggcugcccauacgguaccagaccaccgccaccaagagcgagcauaccggcagggaaauugucgaccugaugugccacgcuaccuucaccaugcggcucuuaucucccguccgcgugccgaacuacaaccugaucaucauggacgaagcccacuuuacggaucccgcgagcaucgcggcccggggguacaucuccaccagggucggcaugggugaggccgcggccaucuucaugaccgccacgccgcccgggacggcagacgccuucccgcagagcaacgcccccauccaggaugaggagcgcgauaucccugagagguccuggaacaguggcaacgaguggaucacggauuucgccgggaagacugugugguucgugcccucuaucaaggccgguaacgacaucgcuaacugcuuacgcaagaacgggaagaagguaauccaacugucacgaaagaccuucgauacggaguaccagaagaccaagcucaacgauugggacuucgugguaaccaccgacaucagcgagaugggggccaacuucaaggcagacagggucaucgacccgcggcggugcuuaaagcccgugauccugacggacggucccgaacgggugauccuggccggaccuaugccaguuaccgccgccagcgccgcucagcgccggggccgcguggggcgaaacccccagaaagagaacgaucaguacaucuucacaggccaaccacuuaacaacgacgaggaccacgcccauuggaccgaagccaagaugcugcuggacaauauuaacacccccgaagggaucaucccagcccuuuucgagccugagcgcgagaagucagcggccaucgauggcgaguaccggcuaaagggcgagagcaggaagacguucgucgagcugaugagacgcggcgaccucccgguguggcuggcccacaagguggccuccgaggggauuaaauauaccgaccguaaguggugcuucgacgggcagcgcaacaaccaaauucucgaagagaacauggacgucgagaucuggaccaaggagggcgagaagaagaagcuccggccccgcuggcucgacgcccguacauacagcgacccacucgcgcuaaaggaguucaaggacuucgcggccggccggaagucgaucgcccuggaccuagugacggagaucgggcgcgugcccagccaccucgcccauagaacccggaacgcacuagacaaccuggucaugcuucauaccagcgagcacggugggaaggcuuauagacacgccguggaggaacugcccgaaacaauggagacgcugcuccuguugggccucaugauccugcuuaccgggggcgcgaugcuguuccuaaucucagggaaggggaucggcaagacgagcaucgggcugaucugcgucaucgccuccagcggcauguuauggauggcggagauuccgcugcaauggaucgccuccgccaucguccuggaauucuucaugauggugcucuugauccccgagcccgagaagcagcgcacgccccaggauaaccagcuggccuacguggugaucgggauccucacacuggccgcgaucaucgccgcuaacgagaugggccugcuagaaaccaccaagagagaccugggaaugagcaaggaaccgggggugguaagucccaccagcuaccuggaugucgaccuacaccccgccuccgccuggacacuguacgcgguggccacgaccgucaucacccccauguuacgccauacgaucgagaacagcacggccaaugucucccuggccgcgaucgccaaccaggcuguugugcugaugggccuggauaagggguggccgaucagcaagauggaucucggcgucccccuucuggccuuaggcugcuacucucaggucaaccccuuaacccugaccgccgcggugcuccuucuaaucacucacuacgcgaucauuggccccggccuccaggccaaggcuacccgggaggcgcagaagcgcaccgcagccgggaucaugaagaacccgacggucgacgggauuaugacgaucgaccuggaccccguaaucuacgacagcaaguucgagaaacagcuggggcaggugaugcugcuaguccugugugccauccagcuccugcugaugcggacauccugggcccucugcgaagcgcugacccuggcgacuggacccaucacgaccuuaugggagggcagccccgggaaguucuggaacaccacuaucgccguguccauggccaacauauuccgaggcucuuacuuggccggggcgggccuggcuuucuccauuaugaaguccguggggacgggaaagcgcggcaccgggagccagggcgaaacccucggggagaaguggaagaagaagcuaaaccaauuaucccgcaaagaauucgaccucuacaagaaguccggcaucaccgaaguagaccggaccgaggccaaggaagggcuuaagcgcggcgagaucacgcaccacgcagugucccggggcagcgccaagcugcagugguucguggaacgcaacauggucaucccggaggggcgggugauagaccucggcugcggaaggggcggcuggucauacuacugcgcgggccugaagaagguuacugagguccggggcuacaccaagggcgggccugggcacgaggagcccgugccaaugagcaccuacggguggaacaucguuaagcugauguccgggaaagacgucuucuaucucccgcccgagaagugcgacacccugcugugcgacauuggugagagcuccccgagccccaccguggaagagucacggaccauccggguccucaagauggucgagccguggcugaagaacaaccaguuuugcauaaaagugcugaaucccuauaugcccaccgugaucgagcaucucgagcggcuccagcgcaaguauggugguaugcugguccggaacccacugucucgcaacuccacgcacgaaauguacuggaucagcaacggcaccgggaacaucguggcuucagucaacauggucagccgguuacugcuuaaccgcuucaccaugacccaccggcgcccgaccaucgagaaggacguggaucucggcgccgguacccggcacgugaacgccgagcccgagacccccaacauggacgucaucggugagcgcaucaaacggauaaaggaggagcacaacuccaccuggcauuaugacgacgagaacccguacaagacaugggcauaccacggcagcuacgaggugaaggcaaccggauccgcaagcagcaugaucaacggcgucgugaaacugcugaccaagcccugggaugugguccccauggugacacagauggcaaugacggacaccaccccguucggccagcagcggguguucaaggagaaagucgacacccggacgccccgcuccaugcccggcacccggcgcgucaugggcaucaccgccgaguggcucuggcggacacuugggcgcaacaaaaagccccggcucugcacgcgggaggaauucacuaagaaggugcggaccaacgcggccaugggcgcugucuucaccgaggagaaucagugggacagcgccaaggccgcaguggaggaugaggacuuuuggaaauuaguggaccgggagcgcgagcugcacaagcuggggaagugcggcuccuguguauacaacaugaugggcaagcgggagaagaaacucggcgaguucggcaaggcuaaggggagccgcgccauuugguacauguggcugggcgcccgguaccuggaguucgaggcgcucggguuccugaacgaggaccacugguucucccgcgagaacagcuauaguggcguagagggugagggccugcauaagcuuggcuacauccuucgggacauuagcaagauccccggaggcgcgauguacgcugaugauacggcaggcugggacacccgcauuacugaggacgaccuccacaaugaggagaagaucacccagcagauggacccggagcaucggcaauuggccaaugcgaucuucaagcugacguaucagaacaaggucgucaaagugcagcgcccgacucccaccggcaccgugauggacauaaucucccggaaagaccaaagaggcagcgggcaagucggaaccuacgggcucaacacguuuaccaacauggaagcgcaguugauccgucagauggaaggggagggugugcugaccaaggccgaucucgagaauccccaccucuccgagaaaaagauaacacaauggcuggagacgaaaggcguggagcgcuuaaagcgaauggcaauaagcggcgacgauugcguugugaagccgauagacgaccgcuucgccaacgcccuccuggcgcugaacgacauggggaaggugcggaaagacaucccccaguggcagccguccaaaggcuggcacgacuggcaacagguccccuucugcagucaccacuuccacgagcucaucaugaaggacgggcgcaagcugguggugccgugccggccccaagacgaguugaucggccgcgcgcggaucucccagggggccggauggucgcuccgggagaccgccugccuuggcaaggcguacgcacagauguggucccugauguacuuccaccgccgagaccugcgccuggcgagcaacgccauuugcuccgccguucccgugcacugggugcccaccagccggaccaccuggagcauucaugcgcaccaccaguggaugaccaccgaggacaugcugacgguuuggaaccgcguguggauagaagacaacccguggauggaagacaaaacgcccgugaccaccugggagaacgucccguaccuuggaaagcgcgaggaccagugguguggcagccugauaggccuuaccagccgcgccacgugggcgcagaacauccccaccgccauccagcagguccggucccucaucggaaacgaagaguuucuggacuacaugccaagcaugaagcgcuucagaaaggaggaggaaucugagggggccauuugguga

SEQ ID NO: 25916 - RNA, 9873 nt, Artificial Sequence
  derived and/or modified CDS sequence (opt11) from DENV-3__KF955465__SS-prME
acgucgcugugcaucaugaugauccuccccgcggcgcuggcguuccaucucacaagccgggacggggaaccgaggaugaucguggggaaaaacgagcggggcaagagccuuuuguucaagacggcuucggggauaaacaugugcacccucaucgcuauggaucucggcgagaugugcgacgacaccgucacuuacaagugcccgcacaucacggagguagagcccgaggacaucgacugcugguguaaccugaccuccaccugggugaccuacggcacgugcaaccaggccggcgagcauaggcgcgauaaacgguccguggcccuggcaccccauguggguauggggcucgacacgcgcacgcaaacuuggaugagcgccgagggagccuggagacagguggagaagguggaaacgugggcccugaggcaucccggguucaccauucuugcccucuucuuagcccacuauaucggaacgagccugacgcagaagguggucauauuuaucuuacugaugcuugugacgccgagcaugaccaugcggugcguggggguaggaaaccgcgacuucguggaaggccucuccggggccacuuggguggacgucgucuuggagcaugggggaugcgucaccacgauggcaaagaauaagcccacccuggacaucgaacuccaaaagaccgaggcuacccagcuggcgaccuugcggaagcucuguaucgagggaaaaaucaccaacaucaccaccgacagccgaugcccaacgcaaggcgaggcugugcucccggaggagcaagaucagaauuacgucugcaaacauaccuacguggaccggggguggggcaacgguugcggccuguucggcaagggcucccucgugacgugcgccaaguuucaaugccuggaacccaucgagggcaaagugguucaauacgaaaaucugaaguacaccgugauaaucacgguucauaccggggaucagcaccaagugggcaacgagacccagggggucacugcugagaucacuccacaggccucaacgacagaggcgauccugccggaauacggaacccuugggcuggaaugcuccccgcgcacgggccucgacuucaacgagaugguucugcugacgaugaagaacaaggcauggauggugcaccggcaaugguucuucgaccucccgcuaccauggacaucgggcgcuacuaccgagacacccacauggaaucgcaaagagcugcuggucacuuucaaaaaugcucacgcaaagaaacaagagguggugguccugggcucccaggaaggcgcgaugcauaccgcccugacaggagccacagagauccagaacucaggcggcacauccauauuugccggccacuugaagugcaggcugaagauggauaagcuggaguuaaagggcaugagcuacgcuauguguacgaacacguucgugcucaagaaggaagugucugagacccagcacgggacaauccugaucaagguagaguacaaaggggaggacgugccgugcaagauuccauucagcaccgaagacgggcagggcaaggcgcacaacgggcgccucaucacggcuaaccccguugucaccaagaaggaggagccugugaacaucgaggcagagccgccauuuggggagagcaacaucgugauaggcaucggggacaacgcccugaagaucaacugguauaagaagggcagcagcaucggcaagauguucgaggcgaccgcccggggugcccgccggauggcuauacuaggggauacggccugggacuucggguccguaggaggggugcugaacagccucgguaagauggugcaccagaucuucggaucugccuauacggcucuguucucuggcgucuccugggugaugaagaucggcauugggguucugcuuacguggaucggccugaacucuaagaacacuuccaugucuuucuccugcauugucaucgggauaaucacccuuuaccucggagccguggugcaagccgacauggggugcgucaucaacuggaaaggcaaggagcugaagugcggcagcgggaucuucgugacgaacgaggugcacaccuggacagaacaauacaaguuccaagcugacucucccaagcgccuggcgaccgcgaucgccggcgcuugggaaaacggggucugugggauucguagcaccacccggauggaaaacuugcuguggaagcagauugccaacgagcugaacuauauucucugggagaacaacaucaagcugaccgugguagucggagacaucauuggcgugcuggagcagggcaagcgcacccugacgccccagcccauggaguuaaaguacuccuggaagaccugggggaaggcgaagaucgugacugccgaaacccaaaacuccuccuucauuaucgacggaccgaacacgccggagugucccagcgccucucgggcuuggaacgucugggaggucgaggacuacggcuucggcguguuuaccaccaacaucuggcugaaguugcgcgagguuuacacccagcugugcgaccaccggcugaugagcgcggcagucaaagaugagcgagcugugcacgccgauaugggcuauuggaucgagagccagaaaaacggguccuggaaacucgagaaggccucgcugauagaggucaaaaccugcacguggcccaagucccauacucuguggucuaacgguguguuagagagugacaugauaaucccaaagagccuggcugggcccaucucccagcauaacuaccgcccgggcuaccacacccagaccgcagggcccuggcaucuaggcaagcucgagcuggauuuuaacuacugcgaggggacaacuguaguuaucaccgagaauugcggcacccgggggcccucguuacggacaacuaccgucucuggcaagcucauccacgaguggugcugccgcagcugcacccuaccaccccugagguacaugggcgaggacggcuguugguacggcauggagauucgccccauuucugagaaggaggaaaauauggucaagaguuuagucuccgccggcuccgggaagguggauaauuucacgaugggcguccugugucuagccauacucuuugaggaggucaugcgggggaaguucggcaaaaagcacaugauagcaggcguguucuucaccuucgugcugcuccucuccgggcagaucaccuggagggauauggcgcacacccugaucaugaucggaagcaacgcauccgaccggaugggcaugggcguuacauaccuggcccucaucgcuacguucaaaauccagccuuuccuggcacugggguuuuuccuccgcaagcugacaagcagggagaaccugcuacuaggcguagggcucgcgauggccaccacgcuacagcugccugaagacauagagcagauggccaacgggauagcacugggcuuaauggcgcucaagcugauaacccaauucgagaccuaucagcuauggaccgccuuaaucucacugacuugcuccaacaccaucuucaccuuaaccgucgcauggcgcacugccacucucauccuugccgggguaucacuccuaccggugugccaguccaguuccaugcggaagaccgacugguugcccaugaccguggccgccaugggcgugccuccuuugccacucuucaucuucagucugaaggacacccugaagcgccgaaguuggcccuugaacgaggggguaauggccgucggccucguuagcauccucgccagcagccugcugcggaacgacgugcccauggccggccccuuaguugccgggggccugcugaucgccugcuacgucaucaccggcacuagcgccgacuuaaccguggagaaggccgcagaugucaccugggaggaagaggcggagcagacuggugugucgcacaacuugaugaucaccguugaugacgacgggacgaugcguaucaaagaugacgaaacggagaacauccugaccgugcuacuuaagacagcgcuguugaucguguccggaaucuuuccguacagcauccccgccacccuguuaguauggcacaccuggcagaagcagacgcagcgguccggcgugcucugggacguaccaagcccgcccgagacccagaaggccgagcucgaggaaggcguguaccggauuaagcagcagggaauuuucgggaagacgcaggucggcguggggguucagaaggaaggcgucuuccacaccauguggcauguaacgcggggugccgucuugaccuacaacggcaaacggcuggaacccaauugggcguccgucaagaaggaccugaucagcuacgguggaggcuggaggcugucugcccaguggcagaagggggaggagguucaaguuauugccguugagccagggaagaaccccaagaacuuccaaaccaugcccggcaccuuucagaccacaaccggggagaucggcgcgaucgcgcucgacuucaagcccgggacgagcggcagcccaaucaucaaucgcgagggcaaagugguugggcuguauggcaacggggucguuacgaaaaaugguggguacguguccgggauagcccagaccaaugccgaaccggacggcccuacacccgaacuagaggaagagauguucaagaagcggaaccugaccauaauggaccuccaccccgggucugggaagacccgcaaguaccugccggccaucguucgggaggccauuaaacggcggcucagaaccuuaauccuggcccccaccagggugguggcggccgagauggaggaagcccugaaggggcuccccauccgcuaucagaccacggccacaaaguccgagcacaccggccgcgaaauagucgaccugaugugccacgcaaccuucacgaugcgccugcucucgcccguaaggguuccgaacuacaaccuuaucaucauggacgaggcucauuucaccgaucccgccuccaucgccgcccgcggguacaucuccacccgggucgggaugggcgaggcggccgccauuuucaugacugcgacgccuccggggaccgcggacgcauucccacaguccaacgccccuauacaggacgaggaacgcgacauucccgagcgcagcuggaacucaggcaaugaguggaucaccgacuucgccgggaaaacagugugguucguucccagcaucaaggcgggcaacgacaucgccaauugucugcggaaaaacgguaagaaggucauccaacucucaaggaaaacguucgacaccgaauaccagaagacaaaacugaacgauugggacuucgucgugaccacugauauuagcgaaaugggcgcgaacuuuaaggccgaccggguuauugaccccaggcgaugccugaagccugugauccucaccgacggcccggagcgugugauacuggcagggccaaugccggucaccgccgcguccgccgcccaacggcggggucggguaggucgcaauccccaaaaggagaacgaccaguauauauucaccggacagccacugaacaacgacgaggaccacgcccacuggaccgaggcaaagauguugcuggacaauaucaacacgcccgaggggaucauccccgcccuguucgaaccggaacgggagaaguccgccgcgauugacggcgaauacagauuaaaaggcgagucccggaaaaccuucgucgagcugaugcgccgcggggaccugcccguuuggcuugcccacaagguggcgagcgaggggaucaaguacaccgacaggaaguggugcuucgacggccagaggaacaaccagauccuggaggagaacauggacgucgagauuuggacuaaggagggcgagaagaagaaacuaaggcccagauggcuggacgcgcgcaccuacucugacccgcuagcgcugaaagaguucaaggauuucgcugcgggcagaaagagcaucgcccucgaccuaguuacggagauagggagaguacccucgcaccuggcacaccgcaccagaaacgcucuagacaaccugguuaugcugcacaccagcgaacacggcggaaaagcguaucgccacgccguggaagaauuacccgagacgauggagacccugcucuugcugggacugaugauccucuugaccgguggggcgaugcuauuccugaucagugggaaggggauagggaaaaccaguaucggguugaucugcgucauugcuagcuccgguaugcucuggauggccgagaucccgcuucaguggaucgccagcgcaaucguccuggaguucuucaugauggugcugcuuaucccggagcccgagaagcaacgcacgccccaggauaaccagcuggcguacguggucauugggauccugacccucgccgccauuauagcagccaacgagaugggacuacuagaaaccacgaaaagagaucucggcauguccaaggagccgggggugguguccccaacgucuuaucuugacguagaccugcaccccgcgagcgcguggacucucuaugccguggcgaccaccgugaucacgcccaugcuacgacacaccaucgagaacucuaccgcgaacguaucacuggccgcgaucgccaaccaggcaguagugcucaugggucuggacaagggcuggccgaucaguaagauggaucugggcgugccgcuccucgcgcuggggugcuacagccaggugaauccccucacccugacagccgccgugcugcuacucauuacccauuacgccauuaucgggccuggccugcaagccaaagcaacgcgagaggcucagaagcguacggcagccggaaucaugaaaaacccgacuguggacggaauaaugacaauugaccucgaccccguuaucuaugauuccaaguuugagaagcagcugggccagguuaugcuccugguccugugugccguacaacugcuccucaugcgcacuagcugggcgcugugcgaggcccucacgcuggccacgggacccaucaccacccuaugggaggggagccccgggaaguucuggaacacuacgaucgccguaagcauggccaacauuuuccggggguccuacuuagccggcgccgggcuagccuucucaaucaugaagagugucgguacaggaaagaggggcacagggagccaaggcgagacacugggggagaaguggaagaaaaagcucaaccagcuaagccggaaggaauuugaccuguauaaaaagagcgggauuaccgaaguugaccgcacggaggccaaagaagggcucaaacgaggcgagaucacccaccaugcggucucacgcggcuccgccaagcuacagugguucguugagcggaauauggugaucccggaagguaggguaaucgaccuaggcugcggucggggcggguggucguacuacugcgccggccucaagaaagucaccgaggugcgaggcuauacaaagggcggucccggucacgaggaacccgugccaaugagcacguacggcuggaacaucgucaagcucaugucggguaaagacgucuuuuaccugccgccggagaagugcgacaccuugcugugcgauaucggagaauccagccccagccccaccguggaagagagccggacaauccgggucuugaaaaugguggagccguggcugaaaaacaaccaguucugcaucaaggugcucaauccguacaugcccacggucaucgagcaccuggagcgccugcagcggaagcacggugggaugcucgucagaaauccccugucccgaaacagcacccaugagauguacuggaucuccaacggcaccgggaauauaguggccagcgucaacauggugucccggcuucuccugaaccgcuucaccaugacgcaucgccggccgaccaucgagaaggacguggaccucggcgcuggcacacgccaugucaacgccgagccagagacccccaacauggaugugauaggggagcgcauuaagcgcaucaaggaggagcacaacuccacguggcauuacgacgaugagaacccuuauaagaccugggccuaccauggguccuacgaggucaaggcuacugggagcgccuccagcaugauuaacggaguggucaagcuccugacgaagcccugggacguuguucccauggugacgcagauggcaaugaccgacacuacccccuucggucagcagcggguguucaaggaaaagguggacacaaggacgccgcggagcaugccgggaacgcgccgugugaugggcaucaccgcggaguggcuguggcgcacucucgggcgcaauaagaagccccgccuuugcacccgugaggaguuuaccaagaagguccgcacuaacgccgcaaugggcgcaguguucacggaggagaaccaaugggauucggcaaaggccgcuguugaagacgaggauuucuggauccuggucgaucgcgaacgggagcuucauaaacuugggaagugcggcagcugugucuacaacaugaugggcaagcgcgaaaagaagcucggcgaguucggcaaggcuaagggguccagggcgaucugguacauguggcucggcgcgcgcuaucuggaauuugaggcucucggcuuccugaacgaagaccacugguuuagccgggaaaacaguuauagcgggguggagggugagggucuccacaagcuggguuacauccugcgcgacaucuccaaaauccccgguggagccauguacgccgacgacaccgccggaugggacacccggaucaccgaagacgaccugcacaaugaggagaaaaucacgcagcagauggaucccgagcaccgccagcuggcgaacgccauauucaagcucaccuaucagaacaagguagugaaggugcagcggcccacacccacaggcaccgucauggacaucaucagcagaaaggaccagcggggguccggccaggucggcacguacggccugaacaccuucacuaacauggaggcgcaacugauccgacaaauggagggcgaaggcgugcuaucgaaagccgaccuggaaaacccacaccuccccgagaagaagauaacucaauggcuagagacgaagggcgucgaacgauuaaaacgcauggcgauaagcggcgacgacugcguggugaagcccaucgacgaucgguucgcgaaugcccugcucgcacugaacgauaugggaaaaguccguaaggauaucccccaguggcagccuagcaagggcuggcaugacuggcagcaggucccguucuguucacaccacuuccacgagcugaucaugaaagacggucggaaauuagugguacccugucgcccccaggaugagcugaucggucgggcccgcauuucucaaggggccggcuggagccuucgugagaccgcuugccugggcaaggccuacgcgcagauguggucgcugauguacuuucaccgcagagaccugcgucucgccuccaacgcaaucugcagcgccgugcccguacacugggugccgaccucccgaaccacguggagcauccacgcucaccaccaguggaugaccaccgaagacaugcugaccguauggaauagaguuuggauagaggacaacccauggauggaagacaaaacgcccgucacuacaugggagaacgugcccuaccuggggaagcgcgaggaucagugguguggcucucucaucgguuuaaccucgcgggccacgugggcucagaacaucccuacugccauccaacaaguacggagccugaucggcaaugaagaguuccucgacuacaugcccucaaugaagcgauuccgcaaggaggaggaaucugagggggcuauaugguaa

SEQ ID NO: 25917 - RNA, 9873 nt, Artificial Sequence
  derived and/or modified CDS sequence (opt11) from DENV-3__KF955466__SS-prME
accagccuaugccucaugaugauccugccagcggcacuggccuuccaccuaaccucacgggacggugagccccgaaugaucguggggaaaaacgagcgcgggaaaagccuguuguucaagacggccuccgguaucaacaugugcaccuugauugccauggaccugggcgagaugugcgaugacaccgugacguacaagugcccgcacauaacggagguggagcccgaggacauagacugcugguguaaccugaccagcaccugggugacauacggcacgugcaaccaagccggcgagcaccggcgcgacaaacgguccguggcucuggcgccccacguagggauggggcuggacacccgaacgcagaccuggaugucggcugagggcgccuggagacaggucgagaaagucgagacuugggcacugcgacaccccggguucaccauccucgcgcuguuccuagcccacuacaucggaacgucccucacccaaaaaguggugaucuucauccugcucaugcucgucacgccaagcaugaccaugcggugcgucggggugggcaaccgggacuucguugagggccuguccggggccacuuggguggacguggugcuggagcacggggggugugugaccacgauggcuaagaacaagcccacucucgauaucgagcugcaaaagaccgaggccacccagcuggcgacgcuacggaagcuaugcaucgagggcaagaucaccaacauaaccaccgauagccgcugccccacccaaggcgaggccguccugccggaggagcaggaucagaauuaugucugcaagcacaccuacguggaccgggguuggggcaacgggugcggcuuauucgggaaaggaucccugguaacaugcgccaaguuucaauguuuagagcccauagaggggaaggucguacaguaugagaaccucaaauacaccgugaucaucacuguccacaccggugaccagcaccaaguggguaacgagacgcagggggucacugccgagaucacgccccaggccagcacgacugaggcuauccugcccgaauaugggacccuggggcucgagugcucuccgcgcaccggccuggacuucaacgaaaugauccugcucacgaugaagaacaaggccuggauggugcaccgccagugguucuucgacuugccccugcccuggacgagcggcgccaccaccgagacgccaacauggaaccgcaaagagcugcucgugaccuuuaagaaugcacacgccaagaagcaggaggucguuguacuggggucccaagagggcgcaaugcacacggcucucacgggugcaaccgaaauccagaacagcggcgggaccucgaucuucgccggucaccugaagugccgacugaagauggauaagcucgaacuaaagggcaugagcuaugccaugugcacgaacacuuuuguccugaagaaggaagugagugagacgcagcacggcacaauccucaucaagguggaguacaagggcgaagacgucccgugcaagauccccuucagcacggaggaugggcaggggaaggcgcauaacggcagacucaucacggccaaccccguggucaccaagaaggaggagcccgugaauaucgaggccgagccacccuucggggagucgaacauagugaucggcauaggggacaaugcccuaaagaucaauugguauaagaaaggcuccagcaucgggaagauguucgaggccaccgccaggggcgcccgccggauggcaauccugggcgacaccgccugggacuucggguccgugggggguguccucaacagccuuggcaagauggugcaccagaucuucggcucagcguacacggcccuguucagcggcguguccugggucaugaagaucggcaucggggugcucuuaaccuggaucggucugaacucgaaaaacaccuccaugucguucagcuguauugugaucgggaucaucacccucuaucucggcgccgucgugcaggcagacaugggaugcgucauuaacuggaagggaaaggagcugaaguguggcuccgggaucuucgucacuaacgaggugcacaccuggaccgagcaguacaaguuucaggccgacucccccaagcgccucgcgaccgccauugccggcgccugggaaaaugguguaugcggcauccguagcaccacacggauggaaaaccugcuguggaagcaaaucgccaaugagcucaacuauauccugugggaaaacaacaucaagcugacggugguggucggggacaucaucggcguccucgagcaaggaaaacggacccugacaccccagccuauggaacucaaguacuccuggaagaccugggggaaggcgaagauugugaccgccgagacccagaacagcucuuuuaucauugauggccccaacacgcccgagugcccaagcgccucccgggccuggaacguuugggaggucgaagauuacggguucgggguguuuaccaccaacaucuggcugaagcugagagagguguacacccaguuaugcgaccaucggcucaugagcgcggccgucaaggaugagcgcgcugugcacgccgauaugggcuacuggaucgagagccaaaagaacggguccuggaagcuggaaaaagcuagccugaucgaggugaaaaccugcacguggccgaagucccauacccucuggucuaauggcguccuggaguccgacaugaucauucccaagagcuuggcggggcccauuucccagcacaacuaccggccaggcuaccauacccagaccgccgggcccuggcaccucgguaaguuagagcuggacuuuaacuacugcgagggcacgaccguggucauaacagagaacugugggacccgcggaccgagccuccggacuaccacggucuccgggaagcugauccacgaauggugcugcagaagcuguacccugcccccgcuccgguacaugggcgaagaugggugcugguacggcauggaaauccgcccuaucuccgagaaagaggagaacauggucaagagccugguguccgccggaagugggaagguggauaacuucacgaugggcgugcuuugccucgcaauccuguucgaggaagugaugagagggaaguucggaaaaaagcacaugaucgccgggguguucuucaccuucgugcugcuccuguccgggcagaucaccuggcgcgauauggcgcauacuuuaaucaugaucggcuccaacgccuccgaucggauggggaugggugugacguaccucgcacugauugccaccuucaagauacaaccguuccuggcccucggcuucuuccugagaaagcugacuucucgggagaaccucuugcugggcgucggccucgcgauggccaccacgcuucagcugcccgaggacaucgagcaaauggccaacgggaucgcccucggcuugauggcccuaaaacucaucacccaguucgagaccuaucagcuguggacggcccugauuucacucacguguuccaacaccaucuucacccugaccguugccuggcggacggcaacccugauccucgccggggucucccugcugccggucugccaguccucuucaaugcggaaaaccgauugguugcccaugaccguggcagccaugggcgugccuccccucccgcucuucauauuuucucucaaggacacgcugaaacgccgauccuggccccugaacgagggggugauggcgguaggccucgucagcauccucgccucuagcuuacuccggaacgaugugcccauggcgggcccgcugguggccggcggccugcucaucgccugcuacgucaucacgggcaccucggccgacuuaaccguggagaaagccgcagacgugacgugggaggaggaggcggaacaaaccggggucagccacaaccugaugaucaccguggacgacgacgguaccaugcguaucaaggacgacgagaccgagaauauccucaccguguuacugaagaccgcccuccucaucgucaguggcauauucccauacagcauccccgccacgcugcucguguggcacaccuggcagaagcagacgcagcguuccggcgugcuuugggacguacccucuccacccgagacccagaaagccgagcuggaagaggggguguaccgcaucaagcaacaaggcauuuucgggaagacccagguuggcguaggggugcaaaaagagggcguguuccauaccauguggcaugucacgcggggcgccgugcucaccuacaacgggaagcgccuagagcccaacugggcguccgugaagaaagaccugaucagcuacggcgggggcuggcggcucuccgcucaauggcagaaaggggaagaggugcaagugaucgccguggagcccggaaaaaacccuaagaauuuucagacuaugcccggcacguuccagacaaccacuggggagauuggugccaucgcgcuggacuucaaacccgggacaucuggcucgcccaucauuaaccgcgaagggaaggucguggggcuguaugggaacggggugguuacuaagaacgguggguacguguccggcaucgcgcagaccaacgccgagccggauggaccgacccccgaguuggaggaggaaauguuuaagaagcguaaucucacgauuauggaccugcaccccgguagcggaaaaacgcgcaaguaccugccggccaucguacgggaggccaucaagcgccggcuccgcacgcugauccuggcgcccacccgggucguggccgccgagauggaggaggcccucaaggggcuccccauccgguaccagaccaccgccacaaagagugagcacaccggccgcgagaucguggacuuaaugugccacgcgaccuuuacgaugcgcuuacuuagccccguucgggugccgaacuauaaccugaucaucauggacgaggcccacuucaccgaccccgcguccaucgccgcccgcggguacaucagcaccagagugggcaugggagaggcggccgccaucuucaugaccgcuacgccgcccgggaccgcggacgccuucccccagagcaacgcccccauacaggacgaggagcgcgacauacccgagcgcucauggaacuccgggaacgaguggaucaccgacuucgccgggaaaacggucugguucguacccagcaucaaggccgggaacgacauagcgaauugccuccggaagaacgggaagaaggugauccaacugucccgcaagacguucgauaccgaauaccagaagaccaagcugaacgacugggacuucguagugaccacagacaucagcgagaugggcgccaacuucaaggcagaccggguaaucgauccucgucggugccucaagcccgucaucuugaccgacggccccgagcgcgucauucuggccggcccgaugccggugaccgcagcuuccgccgcucagcggcgcggccggguagggcguaacccccagaaggagaacgaccaauauaucuucaccggccagccccucaacaacgacgaggaccacgcccauuggacugaggcaaagaugcugcuggacaacaucaacacgcccgaggggaucauaccggcucucuucgagccggaacgggagaagagcgcagccaucgacggggaguaccgccugaagggcgagucccggaagaccuucguggaacugaugcgcagaggggacuuacccgucuggcuagcccacaagguggcaagcgagggaauaaaguauaccgaucgcaaguggugcuucgacgggcaacgcaacaaccagauccucgaggagaauauggacguggagaucuggacuaaggagggcgaaaagaagaagcuacggccucgguggcuggacgcacgcacguacucggacccccucgcccuuaaggaauucaaggacuucgccgcuggccgcaaaagcaucgcguuggaccuggucaccgagaucggccgggugcccucgcaccuagcacaccgcacccguaacgcccuggacaaccuggugaugcuccacaccucagagcacggcgggaaggcauaccgccacgccguagaggaacugccagagacgauggagacgcuccuccugcuaggccuuaugauccugcugaccggaggugcgauguuguuccugauaagcggcaaggggauaggcaagaccuccauagggcucauuugugugaucgccagcucaggcaugcuguggauggccgagaucccacugcaguggauugcuucagccauuguccuggaguucuucaugauggugcuccuuaucccggagccggagaagcagcggacgccccaggauaaucaguuggcguaugugguuaucgggaucuuaacccuggcugccauaauagccgccaaugagaugggacugcucgaaaccaccaagcgcgaucugggcauguccaaggagccgggggucguaagccccacguccuaucuggauguggaccuccaccccgccagcgccuggacccuguacgcuguagcuaccacggugaucacgcccaugcugcggcacacgaucgagaacuccacagcgaaugugagccuugccgcuaucgccaaccaggccguaguucugaugggccuggacaaaggguggccgauaucaaagauggacuugggcgugccccugcuagcacucgggugcuauagccaggucaacccccuuacucuaacggccgccguauugcugcugaucacccacuacgccaucaucgggccaggccuccaggcuaaggcgacucgcgaggcccagaaacgcacagccgccgggaucaugaagaacccaacuguugacggaaucaugaccaucgaccuggaucccgugaucuacgacucgaaauucgaaaagcagcugggccaagugauguuacucguccucugcgccguccaacuccugcugaugcgcaccagcugggcgcucugcgaggcgcugacacuggcgacgggacccaucacuacuuugugggagggaucacccgggaaguucuggaacaccacgaucgccgucuccauggcaaauaucuuucggggcuccuaccucgccggggccggccuggcauuuagcaucaugaaguccguggggacaggcaagcgcgguaccggcagccagggcgagacacucggggagaaguggaagaagaagcugaaccaacugagccggaaggaguuugaccucuacaaaaaguccggcauuaccgaggucgaccgcacggaagcaaaagagggacugaagcgaggcgaaaucacccaccacgcugugagccgcggcuccgccaagcuucagugguucguagagcgaaacauggucaucccugagggacgcgugauagaucucggcugcgggcgggggggcuggagcuacuacugcgccgguuuaaagaagguuaccgaaguccgcggauacacuaagggcggucccgggcacgaggagcccgugcccaugaguacguacggcuggaacaucgugaaacugaugucagggaaagacgucuucuaccucccgcccgagaagugcgauacccuacugugcgacauuggagaguccagucccucccccaccguggaggagagccggaccauccgcgugcugaagaugguggagccauggcucaaaaacaaccaguucugcauaaaggugcugaaccccuacaugcccacuguuaucgagcaucuggaaaggcuccagagaaagcacggcgggaugcuaguccgaaacccccugucucggaacucgacccaugagauguacuggaucuccaacggcaccgggaacaucguggccagcguuaacauggucuccaggcuccugcugaaccgguucacuaugacgcaccgccggccgaccaucgagaaagacgucgaccucggcgccggcacacgccaugugaacgcggagccggagacacccaacauggacguuauuggggagcggaucaagaggauuaaagaggagcacaacagcacguggcacuacgacgacgagaacccguacaagaccugggcauaccacggcuccuacgaagugaaggcgaccggaagcgccuccucuaugaucaauggcguugugaaacucuugaccaaacccugggacguagucccgauggugacgcaaauggcaaugaccgacaccacccccuucgggcagcagcgggucuucaaggagaaggucgacacgcgcacuccgaggagcaugccgggcaccagaagggugaugggcauuacggcggaguggcucuggcgcacucugggucggaauaagaagccccgacuuugcacacgugaagaguucaccaaaaaggugcgcaccaacgccgccaugggcgccgucuucacggaggagaaccagugggacagugcgaaggccgccguggaagacgaggacuucuggaugcucguggaccgcgagcgcgagcugcacaaacugggcaaguguggaagcugcgucuauaacaugaugggaaagcgcgagaagaagcucggcgaguucggcaaggccaagggaucccgagccauaugguacauguggcuaggcgcgcgauaccuggaguucgaggcgcucggcuuccuaaacgaggaccacugguucagcagagaaaacuccuacucaggcguagagggggaggggcugcacaaauuggguuacauccugcgggauauuuccaagaucccugguggggcgauguacgccgacgacacugccgggugggauacucggaucaccgaagacgaucugcauaacgaggaaaagaucacgcaacagauggaccccgaacaucgccagcuggcuaacgccauuuucaaacugacguaccagaacaaggugguuaaagugcagaggcccacccccacuggcaccgugauggacaucaucucccgcaaggaccagcguggcuccgggcaggucggcacguacgggcugaauaccuucaccaauauggaggcccagcucaucaggcagauggagggugaagggguacugagcaaggcagauuuagaaaacccccaccucccggagaaaaagauuacacaguggcuggagacuaagggcguagagcggcugaagcgcauggccaucuccggcgacgacugcgucgugaagccgauugaugaccgguucgcgaacgcccuccuggcccuaaacgacaugggcaagguccggaaggacaucccccaguggcagccguccaaaggauggcacgacuggcagcaagucccuuucugcucccaccacuuucacgagcucauaaugaaggacgggcgaaaguugguggugcccugccgcccccaggacgagcugaucggccgugcgcgcaucagccagggggccggcuggagccuccgggagaccgcgugcuuaggcaaagcuuacgcccagauguggagucugauguacuuccaucgucgcgaucucagacuggccuccaacgccaucugcagcgcaguccccgugcauuggguuccgacaucccgcaccacguggagcauccacgcccaccaccaguggaugaccaccgaggauaugcugaccgucuggaaucggguguggauagaggauaauccauggauggaggauaaaacgcccguaaccaccugggagaacguccccuaccucgguaagcgcgaggaccaguggugcgguagccugaucggguugaccucccgggccacaugggcccagaauauuccgaccgcgauucagcagguccgcagcuuaaucggcaacgaggaguuccuggacuacaugcccuccaugaagcgguuccgcaaggaggaggagagcgagggggccaucugguga

SEQ ID NO: 25918 - RNA, 9873 nt, Artificial Sequence
  derived and/or modified CDS sequence (opt11) from DENV-3__KF955468__SS-prME
accagccugugccucaugaugauccugcccgcggcccucgcguuccaccucaccucccgggacggcgagccacggaugaucguggggaagaacgaacgcggcaagagccugcuguucaagacggccuccggaaucaacaugugcacccucauugccauggaccugggcgagaugugugacgacacagugacauacaagugcccucacauuaccgaaguggagcccgaagacaucgacugcuggugcaaccugaccagcaccugggugaccuacgggacgugcaaccaggccggcgagcaccggcgcgacaagcgguccguggcccucgcgccacacguugguauggggcuggacacccggacccagaccuggaugagcgccgagggcgccuggcggcagguagagaaagucgagacgugggccuuacgccacccgggauucaccauccuugcgcuuuuccuggcacauuacaucggcacuucccucacacagaagguugugaucuucauacugcugaugcucguuacucccagcaugaccaugaggugcgugggcgugggcaaucgcgacuucgucgagggccuguccggcgccaccuggguggaugugguccuggagcacggcgggugcgugaccacgauggccaagaacaagcccacgcucgacaucgaacugcagaagaccgaagccacccaguuagcgacgcugcggaagcugugcauugagggcaagaucaccaacaucaccaccgacagccgcugcccuacgcagggcgaggcggugcugccggaggagcaggaccagaacuacgucugcaagcauaccuacguggaucgggggugggguaacgguugcggccucuucgggaagggcuccuuagugaccugcgccaaguuccagugccuggagcccaucgagggcaaggucgugcaguacgagaaccugaaguauaccguuauaaucacgguccacaccggggaccaacaccaggugggcaacgagacccaaggggucaccgccgagaucacgccccaggcuagcaccaccgaagcgauccugccugaguacggcacccuggggcucgagugcuccccgcggacgggccuggacuucaacgaaaugauccugcucacgaugaagaauaaggccuggauggugcaccggcagugguucuucgaccugccccugcccuggaccucgggcgccaccaccgaaacgccaaccuggaaccgcaaggagcuccuugugaccuucaagaacgcccacgccaagaagcaggaggucguugugcuggggucucaggagggcgcuaugcacaccgcccucaccggggccacugagauccagaacuccggagggacauccaucuucgccggacaccugaaaugccggcugaagauggacaagcucgaguuaaagggcaugagcuacgccaugugcaccaacacguucgugcugaaaaaagagguguccgagacccagcacgggaccauccucaucaaggucgaauacaagggagaggacguuccgugcaagauccccuucagcaccgaagacggacagggcaaagcccauaacggccgccugaucaccgccaacccuguggugaccaagaaggaggaacccgucaacaucgaggccgagccgcccuuuggggagucaaauaucgugauaggcaucggggacaaugcccugaagaucaauugguacaagaaggguuccuccaucggcaagauguucgaagcgacggccagaggcgccagacgaauggccauacugggagacaccgccugggacuucggguccgugggugggguccucaauagucugggcaagauggugcaccagaucuucggguccgcuuacacggcacuguuuagcggcguguccugggugaugaagauuggcaucggcgugcuccugacauggaucggccugaacagcaagaacaccuccaugagcuucuccuguaucgugaucgggaucaucacccucuaccugggcgccguggugcaggccgacauggggugcguaaucaacuggaaggggaaagagcuuaagugcggcagcggaauuuucgucacuaacgaagugcacaccuggaccgagcaguacaaauuccaggccgacucccccaagcgccucgcgaccgccaucgccggcgccugggagaacggggugugcggcauccgaagcacgacccggauggagaaucugcuguggaaacagaucgccaacgagcucaacuacauucugugggagaacaacaucaagcugacagucguggugggggauaucauuggcguccucgagcaggggaaacgcacccugacaccgcaaccgauggagcugaaguacuccuggaaaaccugggguaaggcgaagauagugaccgcagaaacccaaaacagcuccuucaucaucgacggccccaacacgcccgagugccccuccgccucccgagccuggaacgugugggaggucgaagacuacggguucggcguguucacgaccaauaucuggcucaagcuacgggagguauauacccagcugugcgaccaccgucucauguccgcggcggucaaggacgagagagccguccacgccgacaugggcuacuggaucgaaagccaaaagaauggguccuggaaguuagagaaggccagccuaaucgaggucaagaccugcacguggccgaagucccauacccuuuggagcaacggcgucuuggaguccgacaugauaaucccaaagagccuggcggggcccaucucccagcacaacuaucggccgggcuaccacacccagaccgccggacccuggcaccucggcaagcuagagcuggacuucaauuacugugagggcacgaccguggugaucaccgagaauugcgggacucguggccccagcuugcggacgaccaccgucuccggcaagcuaauccacgaguggugcugccguagcuguaccuuaccaccgcuccgguacaugggagaggacgggugcugguacggcauggagauccgccccaucagcgagaaggaggagaauaugguaaagucacugguguccgcgggcuccggaaaggucgacaacuucacgaugggcguacugugccucgccauccuguucgaggaggugaugagagggaaguucggcaagaagcacaugaucgcgggcgucuucuucaccuuuguacugcuccuguccggacaaaucaccuggcgcgauauggcgcacacccugaucaugaucggcagcaacgccucagacagaauggggaugggcgugacguaccucgccuugaucgccacguuuaagauucagcccuuccuggcccucggguuuuuccugcgcaagcugacgagccgggagaaccuccugcugggagucggccucgcgauggcuaccacucugcagcugcccgaggacaucgagcagauggccaacgggauugcccuaggccugauggcgcugaaguuaauaacccaguucgagaccuaccaguuauggaccgcccugaucagccucacgugcuccaacacgauccugacgcucacggucgccuggcgcaccgcaacccucauccuggccggggucagccugcucccugugugccaguccucuuccaugcgaaagaccgacuggcugcccaugaccguggcggccaugggcgugccgccccugccccuguucaucuucagccugaaagacacgcugaagaggagaucguggccccucaacgagggggugauggcaguagggcuggucaguauccuggcauccucccuccugcggaacgacgugcccauggccggcccccugguggccgguggucuccugaucgccugcuacgucauaaccgggaccucagcagaccugacuguggagaaggccgccgacgugacgugggaagaggaggcggagcagaccggggucagccacaaccucaugauuaccguggacgaugacgggaccaugcgcaucaaggacgacgagaccgagaacauccuaacggugcugcucaaaaccgcccugcuuaucguuuccggcaucuucccguacagcaucccugccacccuccugguguggcacaccuggcagaagcaaacccaacgguccggcgugcugugggacgucccauccccgcccgaaacccagaaagccgaguuagaagaggggguguaccgcaucaagcagcagggcaucuucgggaagacccaggugggcgucggggugcaaaaggagggcguguuccacaccauguggcacgucacgcguggcgccgugcugacauauaaugggaagcgccuggagcccaacugggcauccgugaagaaggaucucaucagcuacggcgggggcuggcggcuuagugcccaguggcagaagggggaggagguccagguuaucgcaguggagcccggcaagaaccccaagaacuuccagacuaugcccggcaccuuccagacgaccaccggggagaucggcgcuaucgcgcuggacuucaagccagggacuuccggcagccccaucaucaaccgcgaaggccggguagugggccuguauggcaacgggguugucaccaagaacggcggcuacguguccgguaucgcccaaacuaacgccgagccggacggccccacccccgagcucgaagaggaaauguuuaagaagcgcaaccugaccaucauggaccuacaccccggaucggguaagacgcggaaguaccucccggccaucgugcgcgaggcuaucaagcggagauugcggacacugauccuugcgccaacccgcgugguggcugccgagauggaggaggcccugaaggggcugcccauccgguaccagaccacggccaccaagagugagcacaccgggcgcgaaaucguagaccucaugugccacgcgaccuucacaaugcgguuacugagccccguccgcgugccgaacuacaaccucaucaucauggacgaggcccauuucaccgaccccgccagcauagccgcaaggggguacauuagcacccgcgugggcaugggcgaggcggccgcaaucuucaugaccgccacgccgcccgggaccgcggacgccuucccgcaauccaacgccccuauccaggaugaggagagggauauccccgaacggagcuggaacuccggcaacgaguggaucaccgacuuugccggcaagaccgucugguucgugccgucuaucaaagcgggcaacgauaucgcgaacugccugcgcaagaacgggaagaagguuauccagcugucccggaagacguucgauacagaguaccagaaaaccaaacucaacgacugggacuuugucgugaccacagacauuagcgagaugggugccaacuucaaggccgacagagugaucgacccgcgccgcugccugaaacccgucauccugacagacggccccgagcgggugauucucgcagggcccaugccugugaccgccgcguccgccgcccaacgccggggccgcguggggcggaacccccagaaggagaacgaccaguacaucuucacgggccagcccuugaacaacgacgaggaccacgcucacuggaccgaggccaagaugcuguuagacaacaucaacacgcccgaggguaucauaccggcgcuguucgagcccgagcgcgagaagagugcagcgaucgauggggaguacaggcugaagggagaguccagaaaaacauucguggagcucaugcggcgcggcgacuuaccaguauggcuggcgcacaaaguggcaagcgagggcauaaaguacaccgaccguaaguggugcuuugacggucagaggaacaaccagauccucgaggagaacauggacguggaaaucuggaccaaggagggcgagaagaagaagcuucggccccgcugguuggaugcccgcacguacucugacccacuagcccugaaggaguucaaggacuucgccgccggccgcaaaagcaucgcguuggaccucgugaccgagaucgggcgcgugcccucccaccuggcucaccggacccgcaacgcccucgacaaccucgugaugcugcacaccagcgagcacggcgggaaggccuaccggcacgccgucgaggaacugcccgagacgauggagacucuccugcugcucggccugaugauccugcucacagggggcgcgaugcuguucuuaauaagcggaaaagggaucggcaagaccaguaucggguugaucugcgugauugcauccuccggcaugcuauggauggccgaaaucccgcuucaauggaucgccagcgcaaucguucucgaguucuucaugaugguccugcugauccccgagcccgagaagcagcgcacgccccaggacaaucaacuagcauacguggugaucgggauccugacccuggccgccaucaucgccgcaaacgagaugggccuacucgagacuaccaaacgggaccugggcauguccaaggaaccgggggucgugagucccacgucguaccucgauguagacuuacacccugcgucugccuggacccuguacgccguugccaccaccgugaucacacccaugcuuaggcacacaauugagaacuccacggcgaacguaagccuggccgccaucgccaaccaagccgucgugcugaugggccucgacaagggguggccgaucaguaagauggaccucggcgugccucugcucgcgcugggguguuacagccaaguaaacccccugacccucacugcugccgugcugcugcucauuacccacuacgccaucaucggccccgggcugcaggccaaggcgacccgggaggcccagaagcgaaccgccgccgggaucaugaagaacccgacgguggaugguaucaugaccaucgaucuggacccagucauauacgacuccaaguucgagaagcaacucggccaggugauguugcucgugcucugcgccguccagcugcuucucaugcggaccagcugggcgcuuugcgaagcccuuacccucgccacaggccccaucaccacccugugggagggcuccccggggaaguucuggaauaccacgaucgccgugaguauggcgaacaucuuccgcggcuccuaccuggccggagccggccucgcguucagcaucaugaaguccgucgggaccggcaagagagggaccgggagccaaggcgagacacugggggagaaguggaagaaaaagcugaaccagcucagccgcaaagaguucgaccuguacaagaagagcggcaucaccgagguggaccggacugaggccaaggaggggcuaaagcgcggcgaaaucacccaccacgcugugucccggggcuccgccaagcuccagugguucgucgagagaaauauggucauaccggaggggcgggugauagaccugggcugcgggcgcggcggauggagcuacuacugcgccggguugaaaaaggugaccgagguccggggcuauacgaagggcgggcccgggcacgaggagcccgugcccauguccacguacggcuggaacaucgugaaguuaaugucuggcaaggacgucuucuaccuuccgcccgagaagugcgacacccugcugugcgacauuggcgaguccagucccucccccacaguggaggagucucgcaccauccgcguacucaaaaugguugaaccguggcugaaaaauaaccaguuuugcaucaaggugcugaaucccuacaugcccacggugaucgaacaccucgagagauugcagcgcaagcacggcgggauguugguucggaacccgcucucucggaacagcacccaugagauguacuggaucuccaacggcaccgggaacaucguggccagcgugaacaugguuuccagguugcugcucaaccgcuucaccaugacgcaccggcgcccuaccaucgagaaggauguggacuuaggcgccgggacccggcacgugaacgcggagcccgaaacccccaacauggaugugaucggggagcgcauaaaacggaucaaggaggaacacaacuccacuuggcacuaugacgacgagaauccguacaagaccugggccuaccacggcaguuaugaggugaaggcuacagguagcgccuccucuaugaucaacggggucgugaaacugcucaccaagcccugggacgugguucccauggugacccagauggcgaugaccgacacaacccccuuuggucagcaacggguguucaaggagaaggucgacacgcggaccccccgcagcaugcccgguacacggagggugaugggcaucaccgcggaguggcuguggagaacgcuggggcgcaacaagaaaccacggcuaugcacccgcgaggaguucaccaagaaggugagaacaaacgccgccaugggcgccgucuucacggaggagaaccagugggacuccgcgaaggcggccguggaggacgaggacuucuggacccugguggaccgcgagcgagagcugcacaagcucgggaagugcggcagcugcgucuacaacaugauggguaagcgggagaagaagcugggcgaguuuggcaaggccaaagggucccgcgcuauuugguacauguggcugggcgcgcgguaccucgaguucgaagcccuggguuuccugaacgaggaccacugguucagccgcgaaaauucguacagcggcguggaaggggagggccuucacaagcugggcuauauacugcgggacaucucgaagauccccgggggcgccauguacgcagacgacaccgccgggugggacacccgcaucacggaggacgaccuccacaacgaggagaaaaucacucagcaaauggacccggagcacagacaacuggcgaacgccaucuucaaacugacuuaccagaacaaggucguuaaggugcagcgccccacccccacgggcaccgugauggacauaaucagccggaaggaucagcgcgguuccggccaggucggcaccuacggucuuaacaccuucaccaacauggaggcccagcugauccggcagauggagggcgagggggugcugagcaaagcagaccucgagaacccccaccucccggagaagaagauuacgcaguggcuggaaaccaaaggaguggagagacucaagagaauggcaaucuccggcgacgacugugucgugaagcccaucgacgaucgcuucgcgaacgcccuccuggcgcucaacgacauggggaaggugcgaaaagacauuccacaguggcagcccagcaaggguuggcacgacuggcagcaagucccguucugcucccaucacuuccacgagcugaucaugaaggaugggcgcaagcugguggugcccugccggccccaggacgagcucauaggccgcgcucggauaagccagggggccggcuggucccugcgcgaaacugcgugccuaggaaaagccuacgcccagauguggagccuuauguacuuucaccgccgggauuugcgccuggccuccaacgcgaucuguuccgccguccccgugcacugggugccuacgucccggacgaccuggagcauccacgcccaccaccaguggaugaccaccgaggacaugcuaacggucuggaaucggguguggaucgaggacaaccccuggauggaggauaagaccccggugaccaccugggaaaacguucccuaccuggggaagcgggaggaccaguggugcggcagccugauugggcucacgucccgcgccacgugggcccagaacaucccaacugcgauccagcagguccggagccugauuggcaacgaggaguuccuggacuacaugcccuccaugaagcgcuuccgaaaagaggaggagagcgagggggcuaucugguga

SEQ ID NO: 25919 - RNA, 9873 nt, Artificial Sequence
  derived and/or modified CDS sequence (opt11) from DENV-3__FJ744726__SS-prME
accagccuaugccucaugaugaugcugcccgccacccuugccuuccaccucacgagccgggacggcgagccgagaaugaucguagccaagaacgagcggggcaagucacugcuuuucaagaccgccuccggcaucaacaugugcacccucauagcgauggaccugggggagaugugcgacgacaccgugaccuauaagugccccuugaucgccgaaguggagcccgaggacauugacugcuggugcaaccugaccagcaccugggugaccuacggcacgugcaaccaagccggggagcaccggagagauaaacgcagcguggcguuggcgccccacgugggcaugggccuggacacccggacccagaccuggaugagcgccgagggggccuggcgccagguggaaaaggucgagacgugggcgcuccgccacccagguuucaccauccuggcccuguuccucgcccacuacauagggaccucccugacucaaaagguggugaucuucauccuccucaugcugguaacucccucgaugaccaugcggugugugggcguggggaaccgggacuucguugagggccuuuccggagccaccuggguggacgugguccucgagcacgggggcugcgugaccacaauggccaagaacaaacccacccuggauaucgagcuacagaagaccgaggcgacccaacuagccacgcugcggaagcugugcaucgaggggaagaucacaaacaucaccaccgacagccgcugcccaacgcagggcgaggccauccucccggaggagcaggaccagaacuaugugugcaagcacaccuaugucgacaggggcugggggaacggcugcgggcuguucggcaaggggucccuggugacgugugccaaguuccaaugucucgagcccauagagggcaaggugguccagcaugagaaccugaaauacaccguaauuauaacgguucauaccggggaccagcaccaggucgggaaugacacccagggcguuaccguagagauuacgccccaggccagcaccguggaggcgauccugcccgaguacgggacccucggccuggagugcucaccgcgcaccggguuggacuucaaugagaugauucuccugaccaugaaaaacaaggcuuggaugguucaucggcagugguucuucgaucucccccuccccuggacgucuggcgccaccaccgagacccccacguggaaccgcaaggagcugcuggucaccuucaagaacgcccacgccaagaagcaggaagugguggugcucggcucccaggagggagcgaugcacaccgcccugaccggcgccacggaaauccagaacucgggcggcaccaguaucuucgccgggcaccugaagugccggcuuaagauggacaagcuggagcugaagggcaugagcuacgcgaugugucucaacaccuucgugcugaagaaggaaguguccgagacucaacacgggaccauucugaucaaggucgaguauaagggggaggacgcgccgugcaagaucccuuucucuacugaagacggccaagggaaagcucauaauggccgccugaucaccgccaaccccguggugacgaaaaaagaggagcccguuaacaucgaggccgagccgcccuucggcgagagcaacaucgugaucgggauuggcgacaaagcgcucaagaucaacugguacaagaaagggagcagcaucgggaagauguucgaggcgacggcccgcggggcccgcagaauggccauccugggcgacaccgcgugggauuucggcuccgucggcgguguccugaacagucuggggaagauggugcaccagaucuucggguccgcguacaccgcccuuuucagcggaguguccuggaucaugaagaucggcaucggcguccugcucaccuggaucggacuuaauagcaagaacacguccauguccuucuccugcauugucaucggcaucaucacccuguacuugggggccgucguccaggccgacaugggaugcgugaucaacuggaaggggaaggagcuuaagugcggcagcggaauuuucgucaccaacgagguccacaccuggacugaacaguacaaauuccaggcggacuccccgaagcgcuuggccaccgccaucgccggggccugggagaacggcguaugcgggaucaggagcaccacccggauggagaacuuacuguggaagcagaucgccaacgaacugaauuauauccucugggaaaacaacaucaagcugacgguggucgugggugacaucaucgggguucuagagcagggcaagcgcacccucacgccccagcccauggagcugaaguacucguggaagacuuggggcaaagccaagaucgucacggccgagacucagaacagcagcuucaucaucgacgggcccaacacccccgagugccccagcgccucccgggcguggaacgugugggagguggaggauuacggcuucgggguguuuacaacgaacaucuggcuuaagcuccgcgagguguacacccagagcugcgaccaccggcugaugagcgcggcaaucaaggacgagagggcagugcacgcugacaugggcuacuggaucgaaucccagaaaaacggcucauggaagcuggagaaggcguccuucaucgaggucaaaacaugcaccuggcccaagucccacacgcucugguccaacggcguguuagagucugacaugaucauccccaagucccuggcaggccccaucucacagcacaaccaccgaccgggcuaccacacccagacagcgggccccuggcaccucgguaagcuagagcuggauuucaauuacugcgagggcaccaccguggucaucacggagaacugcggcacucgcgggcccucccuccggaccaccacgguaagcgggaagcugauucacgaguggugcugcagguccugcacccuccccccgcuccgcuacaugggagaggacggcugcugguacgggauggagauccgccccauaaacgagaaagaggagaacauggucaagagccuggucuccgcaggcucgggcaagauggacaacuucaccauggggauauugugccuugccauccuguucgaggaggugaugcgggguaaguuugggaagaagcacaugaucgcgggcgugcuuuucaccuucguccucuuacugucuggucagaucaccuggagggacauggcucacacccuuaucaugauaggcagcaacgccuccgaccggaugggcaugggggugaccuaucuggcccugaucgccaccuucaagauccagcccuuucuggcgcuggguuucuuccugcgcaagcucacgagccgggagaauuugcuacucgggguggggcucgccauggcaacuacccugcagcugccagaggacaucgaacagauggccaacgguaucgcguuaggguuaaugacucucaagcugaucacgcaguucgagacuuaccagcuauggaccgcccucgucagccugaccuguucaaacacgauauucacccugaccgucgccuggcgcaccgccacgcucauccucgccggcgugucauuacucccguuaugccaguccucuuccaugcggaagaccgacuggcugcccaugacugucgcugccaugggggugccgccccugccgcuguuuaucuucagccugaaggacacccccaagcgccgcuccuggccgcucaacgagggagucauggccguggggcuggugagcauccuggccuccucgcuccugcggaacgacgucccuauggccggccccuugguggcgggcgguuugcuaaucgccugcuacgugauuaccggcaccuccgccgaccugaccgucgagaaggccgccgacgugacgugggaggaggaagccgaacagacgggcgugagccauaaucucaugaucacagucgacgacgacgggaccaugaggaucaaggacgacgagacggagaacauccugaccgugcugcucaagacugccuuacugauaguuagcgggaucuuccccuacagcauccccgcuacgcuccuggucuggcacaccuggcaaaagcagacccaacgauccggcgugcugugggacgugcccagcccaccagagacacagaaggccgagcucgaggaaggcgucuaccgcauuaagcagcaagggaucuuuggcaaaacccagguaggggugggcguccagaaggaggguguuuuucauaccauguggcacgugacccggggcgccgugcugacccacaauggcaaacgccuggagcccaacugggccuccgucaagaaagaccucauaagcuacgggggcggguggcggcuguccgcacaguggcaaaagggcgaggaggugcaggugaucgccguggagcccggcaagaacccgaagaacuuccagaccaugccaggcauauuccaaaccacaacgggcgagaucggggccaucgcgcuagacuucaagcccgggaccagcgggucgccgauuaucaaccgcgaaggcaagguagucggccuguacgggaacggcguggugaccaagaacgggggcuauguuuccggcauagcccagaccaacgccgaacccgacggccccacgcccgagcucgaggaggagauguucaagaagcggaacuuaaccaucauggacuuacacccgggcagcgggaagaccagaaaguaccugccggcgaucgugcgggaggccaucaagcgccggcugcgcacccugauccucgcacccaccagaguggucgcugcugagauggaggaggccuugaaaggccugcccauccgcuaucagaccaccgcgaucaaguccgagcacaccgggcgggagaucguggaucucaugugccacgcuacguuuaccaugcgccuacugaguccggugcggguccccaacuacaaucucaucaucauggacgaggcccauuucaccgaccccgcguccaucgcagcccgcggcuacaucagcacacggguggggaugggcgaggcggccgccaucuucaugacggccacgccgcccggaacggcggaggcuuucccccagagcaacgcgccaauucaggacgaggagaaggacaucccugagcggucguggaauuccgggaacgaauggaucaccgacuuugugggcaagacggucugguucgugccuagcaucaaggcagggaaugacauagcaaacugccugaggaagaacggaaagaaagugauccagcugucccggaagaccuucgacaccgaguaccagaagacccgccuuaacgauugggauuucgucgugacgacagacaucagcgagaugggggccaacuuuaaggcagaccgggugauugaucccagaagaugccugaagcccgucauccugaccgacggccccgagcgugugauccucgcgggcccgaugcccgugaccgcagccuccgcggcgcagcggcgcgggcgggucgggaggaacccccagaaggagaacgaccaauacaucuucacgggucagccccugaacaacgacgaggaccacgcgcauuggaccgaggccaagaugcugcucgacaacaucaacaccccggagggcauaaucccugcccuguucgagcccgagcgggagaaauccgcagcaaucgacggugaguaucgccugaagggcgagucccggaagacuuucguggagcucaugcgccggggcgaccugcccguguggcuggcucacaaggucgccagcgaaggaaucaaauacaccgacagaaaguggugcuucgacggugagcggaacaaccagauacucgaggagaacauggacguggagaucuggacaaaggagggcgagcgcaagaagcugcgcccccgcugguuggacgcgcgcacuuacuccgacccccuggcacugaaggaguucaaggacuucgccgccgggcgcaaaagcauugcccuggaccuugucaccgagaucggacgugugcccagucaccuugcccaccggacacgcaacgcccuggacaaccucgugaugcugcacacgagcgagcacgggggacgggccuaucgccacgccguagaggagcugccggagaccauggaaacccucuugcugcucgggcugaugauacugcucaccggcggggccaugcuguuccugaucagcggcaagggcaucgggaagacgucuaucggccucaucugugugauuguuucauccgggaugcuguggauggcggacgucccucugcaauggaucgccagcgccauagugcucgaguucuucaugauggugcugcugauccccgagcccgagaagcagaggacgccccaggacaaccaacuugcauacgucgugauuggaauuuuaacccuggccgcgaucgugaccgccaacgagaugggcuuacuggagacgacgaagcgcgaccugggcaugucaaaggagccgggagucgugagccccaccuccuaccuagacguggaccugcaccccgccagcgccuggacccuguacgccgucgcaacaaccgugaucaccccgaugcuccggcacacaaucgagaacuccacggccaacguaagccuggccgccaucgcgaaccaggccgucgugcugaugggguuagacaagggguggcccaucuccaagauggacuugggggugccccuucucgcccugggcuguuacucucaggucaacccccugacucucaccgcugccgugcugcugcucgugacccacuaugcgaucauagggccgggccuccaggccaaggccacccgugaagcacagaagcggacagccgcgggcauaaugaagaaccccaccgucgaugggaucaugaccaucgaccuggaccccgugaucuacgacuccaaguucgagaagcagcucggucaggugauguuacugguccucugcgccgugcagcugcugcucaugcgcacgucuugggcccugugcgaggcccugacccucgcgaccgggcccaucaccacgcugugggagggcuccccgggcaaguucuggaacaccaccauagcggugaguauggccaacaucuuucggggauccuaccuggccggcgcggggcuugcguuuagcaucaugaagagcgucggcacggggaagagagguacaggcagucagggggagacccugggcgagaaguggaagaagaagcugaaccagcuaagccggaaggaguucgaccuguacaagaagucagggauuaccgagguggaucgcaccgaggccaaggaagggcugaagcgcggggagaccacgcaucacgccguaagccgcggcuccgcaaagcuccagugguucgucgaacgcaacauggugaucccugagggccgcgugauugaccuggggugcggccgcgggggcuggagcuacuacugcgccgggcugaagaaggucacagaggugcgcggcuacaccaagggggggcccggccacgaggagccagugccgauguccaccuacggauggaacaucguuaagcuaaugucuggcaaggacguguuuuaccugccgcccgagaaaugcgacacgcugcugugcgacaucggggaguccagcccguccccgaccguggaagagagccgcacuauccggguccucaagaugguggaacccuggcugaagaacaaucaauucugcaucaaagugcugaaucccuacaugcccaccgucaucgagcaccucgagcgccuacaaaggaagcacggcggaaugcuggugcgcaacccgcucucccggaacagcacgcacgagauguacuggauauccaacgggaccggcaacaucgugucguccgucaacauggugucaaggcugcugcucaaucgguucacuaugacacaccgcagacccacgauugagaaggacguggaccugggggcgggaaccaggcacguaaacgccgagccggagacaccaaacauggacgugauuggcgagcggaucaagcguaucaaagaggagcacuccagcaccuggcacuacgaugacgagaaccccuacaagacgugggccuaccacggguccuacgaggucaaagccaccggcagugcuagcuccaugaucaaugggguggugaagcugcucaccaagccuugggacgucgugcccaugguaacgcagauggcgaugacggacaccacaccguuuggccaacagagaguauucaaggagaaagucgacacucgcacgccccggcccaugccagggaccagaaagguuauggagaucaccgccgaguggcuauggcggacccuuggccgcaacaagcggccgcgccucugcacgcgcgaggaguucacuaagaagguccggaccaacgccgcaaugggcgccguguucacagaggagaaucagugggacagcgcgagggccgccguggaagaugaagaguucuggaagcuggucgaccgggagagagaacugcacaagcucgggaagugcggcaguugcguguacaacaugaugggaaagcgggagaagaagcugggcgaguucggaaaggccaagggcagccgcgcaauuugguacauguggcugggcgcucgguaccucgaauucgaggcccuuggguucuuaaacgaggaccauugguuuucccgggagaacagcuacuccggcguugagggggagggcuugcacaagcugggauacauccugcgggacaucagcaagauccccgguggagcaauguaugccgacgauacggcgggcugggacacccgcaucaccgaggacgaccuccacaacgaggagaagaucacccagcagauggaccccgagcaucggcagcuugcuaacgccaucuucaagcugacguaccaaaacaaagucgugaaggugcagcgccccaccccgaagggcaccgucauggacaucaucucccggaaggaccaacggggguccggccaggugggcaccuacgggcuaaacaccuuuacgaauauggaggcccagcuggugcggcagauggagggcgagggcguucuguccaagguagaccuagagaauccgcaucugcuagagaagaagaucacccaguggcuagagaccaagggcgucgagcgccuucgaagaauggccaucagcggggacgacugcguagugaagcccaucgacgaccgguucgcgaacgcgcugcucgcccugaacgacaugggaaaaguucgaaaggacaucccccaguggcagccuuccaaaggcuggcaugacuggcagcagguuccguucugcagccaccauuuccacgaacugaucaugaaggacgggcgaaagcucguggugcccugccgaccacaagacgaauuaauuggccgcgcccggaucucccagggggccggcuggagccugaaggagaccgcgugucuaggaaaggccuacgcacaaauguggucccuaauguacuuucaccggcgggauuuacgccucgccagcaacgccauauguuccgcggucccgguucauugggugcccacgagccggaccaccuggagcauccacgcacaccaccaguggaugaccacugaggacaugcugacugucuggaaucgcguguggaucgaggacaacccauggauggaggacaagaccccagugaccacgugggaggacgucccguaccugggcaagcgggaagaccagugguguggaucccucaucggucugaccagccgcgccaccugggcccagaacaucuuaaccgcgauccagcagguccggucccucaucggagacgaggaguuccucgacuacaugccuucgaugaagcgcuucagaaaggaggaagagagcgagggggccauaugguaa

SEQ ID NO: 25920 - RNA, 9873 nt, Artificial Sequence
  derived and/or modified CDS sequence (opt11) from DENV-3__FJ744729__SS-prME
accucacugugccucaugaugaugcucccagccacccuggccuuccaccucaccagccgagacggagagccgcggaugaucguagccaagaacgagcggggcaagagcuuacuguuuaagaccgccuccggcauuaauauguguacccucaucgccauggaccugggcgagaugugcgacgacaccgugaccuacaagugcccccuaaucgccgagguggagcccgaggacaucgacugcugguguaaccuuacaagcacuugggugaccuacggcacuugcaaccaggccggggagcaccggcgcgacaagaggucugucgcacuagcgccccacgugggcaugggccuggacacacggacccagaccuggaugagcgccgagggggccuggcgccagguugagaagguggagacgugggcguugcgucacccgggauucaccaucuuggcccuguuccucgcacacuauaucgggaccucccugacccagaagguggugauauucauucugcucaugcuggucaccccaagcaugaccaugcgcugcguggggguggggaaccgcgacuucgucgaaggccuguccggcgcuaccuggguggacgugguucucgaacacggggggugcguaaccacaauggcaaagaauaaacccacccuggacaucgagcugcagaagacagaggcgacccagcucgcaacguuacggaaacugugcaucgaggggaagaucacaaacaucaccaccgauagccgcugucccacgcagggcgaggccauucucccggaggagcaggaccagaacuacgugugcaagcauaccuaugucgauagagguugggggaacggcugugggcuguucggaaaagggucccuggugaccugcgccaaguuccagugccucaagcccaucgagggcaaggugguccagcacgagaaccuuaaguacaccguaaucaucacggugcacaccggcgaccagcaccaggucgggaacgacacccaaggagugaccgucgagaucaccccccaggccagcacaguggaggcgauucugcccgaguacgggacccucggccuggagugcucaccccgcaccggccuugacuuuaacgagaugauccuccuuaccaugaagaacaaggccuggauggugcacaggcagugguucuucgaccuuccucugcccuggacguccggcgccaccaccgaaacccccacguggaaucggaaagagcuguuggucaccuucaagaacgcccaugccaagaagcaggagguggugguucucggcucacaggagggcgcgaugcacacugcccuaaccggcgccacggagauccagaacagcgggggcaccuccaucuucgcugggcaucugaagugccgucucaagauggacaaacuggagcugaaaggcaugagcuacgccaugugccucaacaccuucguauuaaagaaggaggugagcgagacccaacacggcacgauccugaucaaaguagaguauaagggggaggacgcgcccugcaagauccccuucagcacagaagacggccaggguaaggcccacaacggccgccugaucaccgccaaccccgugguuaccaagaaggaggaacccgucaacaucgaggcugagccgcccuucggcgaaagcaacaucguaaucgggaucggcgacaaggcccucaagaucaacugguacaagaaaggguccagcauugggaagauguucgaggccacagcucgcggggcaaggcggauggccauccugggcgacaccgcgugggacuucggcuccguaggcgggguacugaacagcuuggggaagauggugcaucagaucuucggguccgccuacacagcccuguucagcgguguguccuggaucaugaagaucggaaucggcguccugcucaccuggaucggucugaacagcaagaacacgucuaugagcuucuccugcaucgugaucggcauuaucacccuauaccucggggccguggugcaggccgauaugggaugcguaauaaacuggaaagggaaagagcugaagugcggcucugggaucuucgugaccaaugaaguccacacauggacggagcaguacaaguuccaggcugacucccccaagcgccuggccaccgccaucgccggggccugggaaaacggcgugugcgggauccgcagcaccacacggauggagaaccuccuguggaagcagaucgcgaacgagcugaacuacauauugugggagaacaacaucaagcuuacaguggucgugggcgacaucaucgggguccuggagcagggcaagcgcacccuaaccccccagccgauggagcugaaguacuccuggaagacgugggguaaggccaaaaucguuacggcagagacccaaaacucuuccuucaucaucgacgggcccaacacccccgagugccccagcgccagccgggccuggaacgugugggaaguggaagacuacggcuucgggguuuucaccacgaacaucuggcugaagcuccgugagguguacacccagagcugugaucaccggcugaugagcgcugccaucaaggacgagcgcgccguacaugcggacaugggcuacuggauugaaagccaaaagaacggaucguggaaacuggagaaggcguccuucauagaagucaagacauguaccuggcccaagagccacacccuuuggagcaacgggguacuggagucggauaugaucauccccaagucccucgcaggaccgaucucacaacacaaccaccgacccggcuaccacacgcagacagcgggcccauggcaccucgggaagcuggagcuggacuuuaacuacugcgagggcacaaccguugucaucacggaaaacugcggcacccgcgggcccucccucaggaccaccacugugucgggcaagcuuauccacgaguggugcugccgcucuugcacccugcccccgcuccgguacaugggagaggacggcugcugguaugguauggagauacgucccaucaacgagaaggaagagaacauggucaagagccucgucuccgccggcagcggcaagauggacaacuucaccauggggauccuuugucucgccauccuguucgaggaggugaugcggggcaaguucgggaagaagcacaugaucgcgggcgugcuauucaccuucguccuccugcuguccgggcagauaacguggcgcgacauggcccauacccucauuaugaucggcagcaacgccuccgaccguaugggcaugggaguuaccuacuuagcucugaucgccaccuucaagauccagcccuuccucgcccugggguucuuccugcgcaagcucacgagccgggagaaccuguuguugggggucggccuggccauggccaccacccuacaacuccccgaggacaucgagcagauggccaacgggauagcgcucgggcugaugacacugaagcugaucacacaguucgagaccuaccagcuguggaccgcgcucgucagccugacgugcuccaacacgaucuucacccugaccguggccuggcgcacagccacgcucauccuggcgggcgugagccugcucccgcugugccaaucaagcucgaugcggaaaaccgacugguugcccaugacugucgcugccaugggggugccucccuuaccccuguuuaucuuuagccugaaggacacccccaaacgccgauccuggccccucaaugaggggguuauggcugugggacuugucagcauccuggccuccagccuccugcggaacgacgugcccauggccggcccgcugguggcaggcggucuccugaucgccugcuauguaaucacggggaccuccgccgaccugaccgucgagaaagccgccgacgugaccugggaggaagaggcggaacagacgggggugagccacaaccucaugaucaccgucgaugacgacggcaccaugcgcaucaaggacgaugaaaccgagaacauccucaccguguuacucaaaacagcacugcugaucguauccgggaucuuccccuacagcauucccgccacccuccugguguggcacacuuggcagaagcaaacccagcgcuccggcguguugugggacguucccucaccgcccgagacccaaaaggccgaauuggaggagggcgucuaccgcauuaagcagcagggcaucuucggaaagacccagguuggggugggcguccagaaggaggggguguuccacacgauguggcacgugacccggggcgccguacugacccacaacggcaagcggcuggaaccuaacugggcguccgugaagaaggaccucaucagcuacgggggcggguggagacuguccgcccaguggcagaagggcgaggaggugcaggucauugccguggaacccgggaagaauccgaagaacuuccaaaccaugcccggcaucuuccagaccaccacgggcgagaucggggccaucgcgcuggacuucaagccgggcaccagcgggaguccgaucauuaaccgcgagggcaagguggucggccuauaugggaacggcguggugaccaagaacggcggcuacguauccgggaucgcccagaccaacgccgagcccgacggccccacgcccgagcucgaagaggagauguuuaaaaagcggaaucugacuaucauggaccugcacccgggcagcgggaaaacccgcaaguaccucccagccaucgucagggaggccaucaagcgccggcugcguacccugauccucgcacccacgcggguagucgcagccgaaauggaagaggcccugaagggccugccuauccgcuaccagaccaccgccaucaaguccgagcacacugggcgggaaaucguugaccucaugugccacgcgacguucaccaugcgucugcugagcccgguucgggucccuaacuacaaccucaucaucauggacgaggcccauuuuaccgacccggccuccaucgcugcccgcggcuacaucaguacccgcgugggcaugggcgaagcggcugcuaucuucaugacggcuacuccacccggcacagcggaggccuucccccaguccaacgcccccauccaggaugaggagcgcgauauccccgagaggagcuggaauagcgggaacgaguggaucaccgacuucgugggcaagacugucugguucguaccaucgaucaaggccgggaaugacauugcaaacugccugcggaaaaacggcaagaaagugauccagcugucucgcaagacauucgacacugaguaccagaagacccggcucaacgacugggauuucgucgugacaaccgauauauccgagaugggggcgaacuucaaggccgaccgcgugaucgacccccggcgcugccugaagcccgucauccugaccgacggccccgagcgggugauccucgccggcccgaugcccgugaccgcagccuccgcggcccaacgccgagggcgaguaggucggaacccccagaaggagaacgaccaguacaucuucacgggucaaccccuuaacaacgacgaggaccacgcccacuggaccgaggccaagauguugcucgacaacaucaacacccccgagggcaucauacccgcccuuuucgaacccgaacgcgagaagagugcggccaucgacggggaguaccggcugaaaggcgagucucgcaaaacguuuguggagcucaugcggcguggagaccugcccguguggcucgcccacaaggucgccagcgaggggaucaaguacaccgaccggaaguggugcuucgacggcgagcgcaacaaccaaauccuagaggagaacauggacguggagaucuggacuaaggaaggggagcggaagaagcugcguccgcgcuggcucgacgcgcggaccuacuccgacccgcuagcgcugaaggaguucaaggacuucgcagccggucgcaagagcaucgcccuggaccuagucacagaaaucggccgaguacccucacaccuggcacaccguacccggaacgcccuggacaaccucgugauguugcacacgucugaacacgggggccgggcuuaccgccacgccgucgaggagcugccggagacaauggagacccuccuguugcucggguuaaugauccugcugaccggcggcgccauguuauuucugauaagcggcaaggggaucgggaagaccaguaucgggcucaucugcgugaucguguccuccgguaugcuguggauggcagacguaccccugcaguggaucgccagcgccaucguguuagaguuuuuuaugauggugcugcugauccccgagccggagaaacagcgcaccccgcaggacaaccagcucgccuacgucgugaucggcauccucaccuuagccgcgaucguuaccgcuaacgagauggggcuccucgagacgaccaagcgugaccugggcauguccaaggagcccggugucgugagccccacauccuaccucgauguugaccuucaccccgccagcgccuggaccuuauacgccgucgcgacgaccgugaucaccccgauguugcgacacaccaucgagaacuccacggcgaacgugagccuggccgcuaucgcaaaccaggccgucgugcugaugggguuggacaaaggguggccuaucuccaaaauggaccugggcgucccccugcucgcccucggaugcuacagccaggucaacccccugacccugaccgcagccgugcugcugcucgugacccacuacgcgaucaucgggccgggccugcaggccaaggccacgcgagaggcccaaaagcgcaccgcggcuggcaucaugaagaaccccacggucgacgggaucaugaccaucgaucuggaucccgugaucuacgacuccaaguucgagaaacagcugggccaggugaugcuacugguccucugugccgugcagcugcugcucaugcggacuagcugggcccucugugaggcgcuaacccucgccaccgggcccauuaccacgcuaugggagggcuccccggguaaauuuuggaauaccaccaucgcagugucuauggcaaacaucuuucgcgggagcuaucuggccggcgccgggcuagcguucagcauuaugcgguccgucgggacuggaaaacgcggcacggggagccagggggagacccugggcgagaaguggaagaagaagcucaaccagcucagccggaaagaguuugaucuguacaaaaaguccgggaucaccgagguggaccgaaccgaggccaaggagggccugaagcgcggggagaccacgcaccacgccgugagccgcggauccgccaagcuccagugguucgucgagaggaacauggugauacccgaggggcgagugaucgaccuggggugcggccgcgggggcugguccuacuacugcgcgggacugaagaaagucaccgaaguucgcgguuacacuaagggugggcccggccacgaggagcccgugcccauguccaccuacggguggaacaucgucaagcuuaugagcggcaaggacguauucuaccuaccgcccgaaaagugcgacacgcugcugugcgacaucggggaauccagccccuccccgaccguggaggaaucacgcaccauccggguccuuaaaaugguggagccauggcugaaaaacaaccaauucuguaucaagguguugaaccccuauaugcccacugucaucgagcaccucgagcgccugcagcggaagcacggcggcaugcugguucgcaacccucucucccguaacagcacacacgaaauguacuggaucuccaacgggaccggcaauaucguuagcuccgucaacauggugagccgccugcugcucaacagguucacuaugacccaccgccgucccaccaucgagaaggacguggaccugggggcgggcacccgccacguaaacgccgagccugagaccccgaacauggacguaaucggcgagcggauuaagcgaaucaaggaggagcacuccagcaccuggcacuacgacgacgaaaaccccuacaaaacgugggccuaucacgggucguacgagguuaaggccaccgggagcgccagcuccaugaucaacggagugguuaaguugcucaccaagcccugggaugucguaccuauggugacccagauggcgaugacggacacuaccccguucggccagcagcggguauucaaggagaagguggauacccgcacgccucggcccaugcccgggacccgcaaggugauggagaucacagccgaguggcuguggcggacucuaggccgcaauaagcgcccgcgacucugcacacgugaagaguucacuaagaagguccggaccaacgccgccaugggcgccguguucacugaggagaaccagugggauagcgcgcgcgccgccguugaggaugaggaguucuggaagcuggucgaccgagagcgggagcugcacaagcucgggaagugcggcuccuguguguacaacaugauggggaagcgggagaagaagcuuggcgaguucgggaaagccaagggcagucgcgcaaucugguacaugugguuaggagcccgguaccucgaguuugaggcccugggauuccucaacgaggaucacugguucucccgugagaacagcuacuccggcguggagggagagggccuacacaagcugggguauauccugcgggacaucagcaagauccccggcggcgccauguacgccgacgacacggcggggugggacacgcgcaucacggaagacgaccuccauaacgaggagaagaucacucaacaaauggaccccgagcaccggcagcuggccaacgccaucuucaagcugacguaccagaacaaagucgugaaggugcagcgcccgacaccgaaaggcaccguaauggacauuauuucccggaaggaccagcgcgggagcggacagguaggcaccuacgggcucaacaccuuuacgaacauggaagcccagcuugugcggcagauggaaggcgaggggguccuguccaagguggaccucgagaacccccaccuccuggagaagaagaucacccaguggcucgagaccaagggcguggagcgccuccggcgcauggccaucagcggugacgacugcgucgugaagcccaucgacgaccgguuugcgaacgcgcugcucgcccugaacgauaugggcaaggugcgcaaggacaucccccaguggcagccguccaagggcuggcacgacuggcagcagguccccuucuguagccaccauuuccacgagcuuaucaugaaggacggacgcaagcucguggugcccugucggccccaggacgagcugaucggccgcgcccggaucucccagggugcgggcuggucguuaaaggagacggcgugccucggaaaggcauacgcccagauguggucccugauguacuuccaccgccgggauuugcgccucgccucgaacgcgaucugcuccgcggucccggugcauugggugcccacgucccggaccacauggucuauccacgcccaccaccaguggaugaccaccgaggacaugcugaccguuuggaaccgcguguggauagaagacaaucccuggauggaggacaagacccccgugaccacgugggaggacgucccguaccuuggcaagcgggaggaucaauggugcggcucccucaucgggcucaccagccgcgccaccugggcccaaaacauucucaccgcgauccagcagguccggucccucaucggcgacgaggaguuuuuggacuauaugcccagcaugaagcgcuuccggaaggaggaggaguccgaaggugccaucugguga

SEQ ID NO: 25921 - RNA, 9873 nt, Artificial Sequence
  derived and/or modified CDS sequence (opt11) from DENV-3__FJ687448__SS-prME
acuagccuauguuugaugaugaugcugcccgccacccuagccuuucaccuaacgagccgggacggagagccacggaugaucguggcuaaaaacgaacggggcaagucccugcuguucaagaccgccagcgguaucaacaugugcacucucaucgcgauggaccugggggagaugugcgacgacaccgugacuuacaaguguccucugaucgccgagguggaaccugaggacaucgauugcuggugcaaucucaccagcacgugggugaccuacggcacgugcaaccaggccggggagcaccgucgcgauaaacggagcgucgccuuagcgccucacguaggcaugggacuggacacccggacccagaccuggaugagcgccgagggggcauggcgccaaguagagaagguggagacuugggcgcuccgacacccgggcuucacgauccuggcccuauuccuagcccacuacauaggcaccucccugacccagaagguggugaucuucauacugcuuaugcugguuacgcccucgaugaccaugcggugcguaggugucgggaaucgcgacuucguugagggccugucuggcgcgaccuggguagaugugguccucgagcaugggggcuguguuaccacgauggccaagaacaagccgacucuggacaucgagcugcagaagacagaagcgacccagcucgcgacucugcggaaguugugcaucgaagggaagauuaccaacauaaccaccgacagccggugccccacgcagggcgaggccauucuaccggaggaacaggaccagaacuacgugugcaagcacacauacgucgaucggggcugggggaacggcugcggauuguucggaaaaggcucccuggugaccugcgccaaauuccagugccucgaacccaucgagggcaaggugguucagcacgaaaaccuuaaguacaccgugaucaucacuguccacacgggugaccagcaccagguggggaacgacacacagggggugaccgucgagauaacgccucaggcuaguaccguggaggcgaucuuaccggaguacggcaccuugggucuggagugcuccccgcgcacagggcuggauuucaacgagaugauccuccuuacaaugaagaacaaggccuggauggugcacaggcagugguucuucgaccugccccucccguggacgagcggcgccaccacugagacccccacauggaaccgcaaggagcugcuggugaccuuuaagaacgcgcacgccaagaagcaggagguggugguucucgggucccaggagggggcgaugcacaccgcacugacgggagccacggagauccagaacagcgggggaaccucuaucuucgccgggcacuuaaaaugccgacuaaagauggacaaauuagaacugaagggcaugucuuacgccaugugccucaacaccuucguacugaagaaggagguuuccgagacccaacauggcacgauacucauaaaagucgaguacaaaggggaagacgccccaugcaagauccccuucagcaccgaggacggccagggaaaggcccacaauggccgccugauaaccgccaacccagugguuaccaagaaagaggagccggugaacaucgaggccgagcccccauuuggcgagucuaacaucguuaucgguaucggggacaaggcccucaagaucaauugguacaagaagggguccuccaucgguaagauguucgaggcaacugcccgaggggcgcgccggauggccaucuuaggggacaccgcgugggacuucggcuccguuggggggguccugaacagccucgggaagauggugcaccagaucuucgguuccgcuuacaccgcccuguuuucaggaguguccuggaucaugaaaauuggcaucggcguguuacucacuuggauagggcugaacagcaagaacacgucaauguccuucuccugcaucgugaucggcaucaucacccuguacuugggggccgugguccaggccgacaugggcugugucaucaacuggaagggaaaggaguuaaaaugcggcagcggaauauucguuacaaaugaaguccacaccuggacugaacaguauaaguuccaggcggacucccccaagcgucuggccaccgcgaucgccggggcgugggaaaauggcgugugcgggauccgcagcacgacccguauggagaacuuacuguggaagcagaucgcgaacgagcugaacuacaucuugugggaaaauaacaucaagcuuacgguugucgugggcgacauaaucggggugcuugaacaggggaagaggacccucacgccacaaccgauggagcugaaguacuccuggaagaccuggggaaaggccaagaucgucacggccgagacccaaaacucguccuucauuaucgacgggcccaacacccccgagugcccuagcgccucccgggcguggaacguuugggagguggaagacuacggcuucggugucuucaccacgaauaucuggcugaagcuccgcgagguguacacacagucgugcgaccacagguuaaugagcgccgcaaucaaggacgagcgcgcugugcacgccgauaugggcuacuggauagagucacagaagaacggcagcuggaagcuggagaaggcgagcuucaucgaggucaagaccuguaccuggcccaagagccacacccucugguccaacggggugcuggaaucagacaugaucaucccaaaauccuuagccggccccaucagccaacacaaccaccggcccggguaccauacgcagaccgccggcccguggcaccucggcaagcucgaacuggauuucaauuacugcgaggggacaacuguuguaaucacagagaacugcggaacccgcgggcccucccucaggaccaccaccgugucgggcaagcugauccaugaguggugcugccguuccuguacccugcccccgcuucgguacaugggggaggauggcugcugguacgguauggagauccgacccauuaacgaaaaggaggaaaacauggucaagucacuaguguccgcaggcagcggcaaaauggacaauuucacgauggggauacugugccucgccauccuguucgaggaggucaugcgcggcaaguucgggaagaagcacaugaucgcgggcgugcuguucaccuucguguuacugcuguccggacaaaucacguggcgagacauggcgcacaccuuaaucaugaucggcagcaacgccuccgaccgaaugggcaugggggucacuuaccucgcccuaaucgccaccuucaaaauccaacccuuccucgcgcucggcuuuuuccugcggaagcucacuucacgggagaaccuuuuacuugggguaggccuggcuauggccaccacccugcaguuaccugaggauaucgagcagauggcgaacggaauagcgcuaggguuaaugacccugaaacugaucacgcaguucgaaaccuaccagcuguggaccgcuuuggucagccuaacuuguucgaacacaauauucacccucacuguggccuggcgcaccgccacucuuauuuuggcuggcguuagccuacucccccugugccaguccaguuccaugcggaagaccgacuggcugcccaugaccgucgcggccaugggggugcccccucugccgcuuuuuauauucagccugaaggauacccccaagcgccgaucuuggccgcuaaacgagggcguuauggccguagggcuggugagcauccuggcuagcucgcuccugcggaacgaugucccgauggcuggcccgcucguggcgggaggccuccugauagccugcuacgugaucaccggcaccagcgccgaccugaccgucgagaaggccgccgacgugaccugggaggaggaggcagagcagaccggcgugagucacaacuugaugaucacggucgaugacgauggcaccaugcgcaucaaggacgacgaaaccgagaauauuuugaccguccugcucaagacggcccugcucaucgugaguggaaucuucccuuauagcauccccgccacccuccuggucuggcacacguggcaaaagcagacccagcgguccggcgugcuaugggacgugcccagcccgcccgagacucagaaagcggagcucgaggagggugucuaucgcaucaagcagcaagggaucuucggcaagacccaggugggggugggcguccagaaggaggggguguuccacacaauguggcacgugacccgaggugccguucugacgcacaacgggaagcgccuggagcccaacugggccuccgugaagaaggaccucauuagcuauggagguggauggcggcuaagcgcccaguggcaaaagggcgaggagguucaggucaucgccguugagcccgggaagaacccgaaaaauuuucagacgaugcccggcaucuuccagaccaccacgggagagauuggggccaucgcgcuggacuucaagcccggaacuucgggcucuccgaucauaaaucgcgaggggaagguggugggucuguacggaaacggcguagugaccaagaacggaggcuacgucagcgggaucgcccaaacgaacgccgaacccgacggacccacacccgaacucgaggaggagauguucaagaaaaggaaucugacuauuauggaucugcacccaggcagcgggaaaacgcgcaaguaccuccccgccaucguacgugaggccauuaagcgacggcugcgcacccugauccuugcgccgacgcggguggucgccgccgagauggaggaggcccuuaagggacugccaauccgcuaccagacuaccgcuaucaaguccgaacauaccggacgagaaauaguggaucuaaugugucacgccacguuuaccaugcgccuccucagccccgugcgggucccgaacuacaaccuuaucauuauggacgaggcacacuucacggaccccgccuccaucgcggcacgcggcuacauaagcaccagaguggggaugggcgaggcggcggcaaucuuuaugacggccacgccgcccgggaccgcggaggccuucccccaauccaacgccccaauccaggacgaagagcgcgacauucccgagcgaagcuggaacucggggaacgaguggaucaccgacuucguaggcaagaccguuugguucguacccagcaucaaggccgggaaugauaucgcuaauugccuacggaaaaaugggaagaagguuauucagcugucccgcaagaccuucgauacggaguaccagaagacgcgguuaaaugauugggauuucguaguaacgaccgacauuagcgaaaugggggcgaauuucaaggccgacagggugauugacccccggcgcugccugaagcccgucauuuugacagacggacccgagcgcgugauccucgcuggcccgaugcccguuaccgccgccucagcggcucagcgccggggccgagucgguagaaacccccagaaggaaaacgaccaauacaucuucacugggcagccccugaacaacgacgaggaccacgcccacuggacugaggccaaaauguuacucgauaacaucaauaccccggagggcaucauccccgcgcuguucgagccggaaagagagaaguccgcggcuaucgacggggaguaccgccuuaagggcgagucccgcaagacguucgucgagcucaugcggagaggcgaccugcccguguggcuggcccacaaagucgcgucugaggggaucaaguauaccgacaggaaguggugcuucgauggcgaacgcaauaaucagauucucgaggagaacauggacguugagaucuggacaaaagagggugagagaaagaaacuccgcccgcgguggcuugacgcccggaccuacagugacccccucgcccugaaggaguucaaagacuucgccgcaggccgcaagagcaucgccuuggaccugguuaccgaaaucggccgggugccaucccacuuggcgcaucguacgcggaaugcgcuagacaaucucgugaugcugcacacgagugagcacggaggccgcgcauaccggcacgcagucgaggaauugccggagacgauggagacccuccuguugcuugggcugaugaucuuacucacggguggggccaugcuguuucugauaagcgguaagggaauagggaagaccuccaucggccuaauuugcgugaucgugucuuccgggaugcucuggauggcggacguccccuugcaguggaucgccagcgccaucguacucgaguucuucaugaugguguuacugauccccgaacccgagaagcagcgcaccccacaagacaaccagcucgcuuacgucgucauaggcauccugacccuggccgcgaucguaacagccaacgagauggggcuacuugagacgaccaagcgggacuuaggcauguccaaagagccugguguggucagccccaccuccuauuuggacguggaccugcaccccgccucagccuggacccuguacgccgucgcaacgaccgugaucaccccuaugcuccgccacaccaucgagaacagcacagccaacgugagccuggccgcuauugcuaaccaggcaguaguccugauggggcucgacaaaggguggcccaucucaaagauggaccuaggcgugccucuguuagcccugggcugcuacagccaggucaacccccuuacccuuaccgccgccgugcugcugcucguaacccauuacgcgaucaucgggccgggccugcaggccaaggccacgagggaagcccagaagaggaccgcugcgggcaucaugaagaaccccacgguagauggcauuaugaccaucgaucuggaccccgugaucuacgauuccaaguucgaaaagcagcucggccaagugaugcuguuaguccucugcgccgugcagcuguuacucaugcggacuagcugggcccugugcgaggcacugacacucgccacagggcccauaacgacucugugggagggcucccccggcaaguucuggaacaccaccauagcggugagcauggcgaacauauuccgcgguuccuaccuggccggcgcggggcucgcguucagcaucaugaagagcguaggcacagggaaacggggcaccggcagccagggagagaccuuaggagaaaaguggaagaagaagcuuaaucaguugagccgcaaagaguucgaccuguauaagaaguccgggaucaccgaggucgaccggaccgaggccaaagagggcuuaaagcgcggggagacuacccaccacgccgugagccgaggauccgcaaaauugcagugguuuguagagcgcaauaugguaauccccgaaggcagaguaauugaucucgggugcggccgcgggggauggucguacuacugcgccgggcuaaagaaagugaccgaggugcgcggauauaccaagggcgggccgggccacgaggagccugugccgauguccaccuauggguggaacaucgucaagcucaugagcgggaaggaugucuucuaucugccacccgagaagugcgacacuuuacucugugacaucggagaguccucgcccagcccgacuguggaggaaagccggacaauccguguccucaagaugguggagccuuggcugaagaauaaucaauucugcauuaaggugcugaaccccuacaugcccaccgucaucgagcaccucgagcggcugcagcgcaagcacggcggcaugcuagugcggaacccgcucucccgcaacagcacgcaugagauguacuggaucuccaacggaacggggaacaucgugagcagugucaacaugguaagucggcuacuucucaaccgcuucaccaugacccaucgacggcccaccaucgagaaagauguggaccugggggcgggcaccagacacgucaaugccgagcccgaaacuccuaacauggacgucaucggcgagcgcauaaagcggauaaaggaggagcacucaagcaccuggcacuacgacgacgagaacccuuacaagaccugggccuaccacggguccuaugaggucaaggccaccgguagugcgucguccaugaucaauggggugguaaagcugcucaccaaacccugggacgucguccccauggucacccagauggccaugacggacaccacgccguucggccagcagcgcgucuuuaaagagaagguugacacccguacgccccgccccaugccggguacccggaagguaauggagaucaccgccgaguggcuauggcgcacccugggccggaauaaacgcccgcgccucugcacccgggaagaauucacuaagaagguccggacaaacgccgccaugggcgccguuuucaccgaagagaaccagugggauagcgcacgggccgccguggaagaugaggaguucuggaagcuggucgaccgcgagcgggaacugcacaaacuuggcaaguguggcuccugcgucuacaacaugauggggaagcgcgagaagaaguugggcgaauuuggcaaggcuaagggcagccgggcuaucugguacauguggcugggagccagauaccuagaguucgaggcccugggguuccugaacgaggaccacugguucucccgggaaaacucguacuccgguguugaaggggaaggucuccacaagcugggguauauccugcgggauaucagcaagauccccggcggugccauguaugccgaugacacggcggggugggacacccguaucacggaagacgaccuccacaacgaggagaagauaacccagcagauggacccggagcaccgccagcuggccaacgccauauucaaguugacguaccaaaacaaggucgugaaaguccagcgccccacaccaaagggaaccguaauggacaucauuuccagaaaggaccaacgggguagcggccaggugggcaccuacggcuugaacaccuucacgaacauggaagcgcagcuggugcgccagauggagggcgaagggguccuaucuaagguggaccucgagaacccccaccuccuggagaaaaagaucacucaguggcucgaaaccaagggcguggagcggcuacgacggauggccaucuccggggacgacugcgucgugaaacccauugaugaccgcuucgcuaacgccuuauuagcacugaacgacauggggaaggugcgaaaggacauaccccaguggcagcccucgaagggcuggcacgacuggcagcagguccccuucugcucacaccacuuucacgaguuaaucaugaaggaugggcgcaagcucguggugcccugccguccccaagacgagcuaaucggccgggcccggaucagccagggcgccggcuggucgcuaaaggagaccgcgugucucgggaaggcauacgcccagaugugguccuugauguacuuccaccgccgcgaccugcggcucgccagcaacgccaucugcucggcugucccgguacacugggugcccacuagccgcaccaccuggucgauacacgcccaccaccaguggaugaccacggaggauauguuaaccgucuggaaucggguguggauagaggacaaccccuggauggaggacaagacucccgugacgacgugggaggacgucccguauuuaggcaagcgcgaggaccagugguguggcucccucaucgggcugaccagccgcgcgaccugggcgcagaacauacugaccgcgauccagcaagugcgcucgcucaucggcgaugaagaauuucuggacuacaugcccagcaugaagcgcuuccgcaaggaagaggaguccgagggugccaucugguaa

SEQ ID NO: 25922 - RNA, 9873 nt, Artificial Sequence
  derived and/or modified CDS sequence (opt11) from DENV-3__FJ744732__SS-prME
accagccugugccucaugaugaugcugcccgccaccuuggccuuccauuugaccagccgagacggcgagccgcggaugaucguagccaagaacgagcggggcaaaagucugcuguucaaaacagcuuccggcaucaauaugugcacgcuaaucgccauggaccugggggagaugugcgaugacaccguaaccuacaagugcccccuaaucgccgagguggagccagaggacauugacugcuggugcaaccucaccucuaccuggguuaccuacggcacgugcaaccaagccggggagcaucggagagacaaacgauccgucgcgcuggcaccccacgugggcaugggccuggacacuaggacccagacguggaugagcgccgaaggggccuggcgccagguggaaaagguggagacgugggcgcuccgccacccgggcuuuaccauccuggcccuguuccucgcccacuacaucgggaccucccugacacaaaagguggugaucuuuauucuacugaugcugguaacgccuagcaugaccaugcggugcgugggcguugggaaccgagacuucgucgagggccuguccggcgccaccuggguggauguuguccucgagcacggggguugugugacaaccauggccaagaacaagcccaccuuagauaucgagcugcagaagaccgaggcgacccaacuagccacgcugcggaagcugugcaucgaggggaaaaucaccaacaucacgaccgacagccgcugucccacgcagggugaggccauccucccggaagaacaggaccagaacuacgugugcaaacacaccuacguagaccggggcuggggaaacggcugcggacuguucggaaagggcucccuggugacaugcgccaaguuucagugccucgaaccaaucgaaggcaaggugguccagcacgagaaccugaaguacaccguaaucauuacggugcauacgggcgaucagcaccaggucgggaacgacacccagggcgugaccgucgagauuacuccccaggccagcaccguggaggcgauccugcccgaguacgguacauuaggccuggagugcuccccgcgaacagggcuggacuucaaugagaugaucuuacugacuaugaaaaacaaggccuggauggugcaccgucagugguucuucgaccuaccucuccccuggacgagcggugccaccacggagacccccacguggaaccgcaaggagcugcuagucaccuuuaagaacgcccacgccaagaagcaggagguggugguccuuggcucccaggagggggcgaugcacaccgcuuuaaccggcgccacggagauccaaaacagcgggggaaccuccaucuucgccggacaccugaagugccggcucaagauggauaagcuggagcugaaggggaugucguacgccaugugccucaacaccuucgugcugaagaaggagguguccgagacacagcacggaacgauccugaucaaggucgaguacaagggggaggacgcgccaugcaaaaucccuuucagcacagaggauggccagggaaaggcgcacaacggccgccucaucaccgccaauccaguugucaccaaaaaggaggagcccgucaacaucgaggccgagccgcccuucggcgagagcaacaucgugaucgguaucggcgacaaggcccucaagauaaacugguacaaaaagggguccagcaucggcaagauguuugaagccacggcucgcggggcucgccgcauggcuauccuaggcgacaccgcgugggacuuuggcagcgugggugggguccugaacagccucgggaagauggugcaccaaaucuucggaucugccuauacagcccuguucagcggcguguccuggaucaugaagaucggcaucggcguccugcucaccuggaucggucugaacagcaagaacacguccaugagcuucuccugcaucguaauagguauuauuacccuguaucucggggccgugguccaggccgacauggguugcgugaucaacuggaaaggcaaggagcugaagugcggcagcggaauauucgugaccaacgaaguacacacauggacugaacaguacaaauuccaggcggacagccccaagagacuugcuaccgccaucgccggggcuugggagaacggcgugugcgggauccggagcaccacccguauggaaaaccuccuguggaagcagaucgcgaacgagcugaacuacauccucugggaaaacaacaucaagcugacggucgucgugggcgauaucaucggcguuuuggaacaggggaagcgcacacucacgccccagccgauggagcugaaauacucuuggaaaaccuggggaaaggccaagaucgugacggccgagacacagaacaguuccuucaucaucgacggcccuaacacgcccgagugccccagcgccucccgggcguggaacgugugggaaguggaggacuacggcuucggggucuucacuacgaauaucuggcugaaguugcgcgaaguguacacccagagcugcgaccacagauugaugagcgccgccauaaaggacgagagggccgugcaugcggacaugggguauuggaucgagucccagaagaacggcagcuggaagcuggaaaaggcgagcuuuaucgaaguaaagaccugcaccuggcccaagucacauacucucugguccaacggcgugcucgaaucagauaugaucauccccaaguccuuagccggccccauuucccagcacaaccacaggccggguuaccauacgcagacugcuggccccuggcauuuagggaagcucgagcuggacuucaacuacugcgagggcacgacuguggucaucacugagaacugcggcaccagaggacccucccuccggaccaccacgguguccggcaagcugauccacgaguggugcugccgcucgugcaccuugccuccgcuacgguacaugggggaggacggcugcugguacgggauggagauacgcccuaucaacgagaaagaggagaacauggucaagagcuugguauccgccgggucggguaagauggauaacuuuaccauggggauucugugucucgccauccuguuugaggaggugaugcggggcaaguucgggaagaaacauaugaucgcgggcgugcuguucaccuuuguucuacugcugagcgggcagauaaccuggcgagacauggcccacacccucaucaugaucggcaguaacgcaucagaucggaugggaauggggguuacguaccuggcacuaaucgcuaccuucaaaauccagcccuuccuugcgcugggguucuuucuucgcaaacucacgagccgggagaaccuccuacucgggguggggcuggccauggccaccaccuugcagcuacccgaggacaucgagcagauggccaauggcauagcacuggggcuaaugacccucaagcugauaacgcaauucgaaaccuaccagcuguggacagcccucgucagccugaccuguuccaacacgaucuucacccugaccguggccuggcgcaccgccacacucauccuggcaggcguaagccugcucccguugugucaguccagcuccaugcggaagaccgacuggcugcccaugaccgucgcagccaugggggugccgccucugccucuguucaucuucagcuugaaggacacccccaaacgccgcuccuggccacugaacgagggcgugauggcuguggggcucguaaguauucuggcaucgagccuccugcggaacgacguccccauggccggcccgcugguggcgggcgggcucuuaaucgccugcuauguaaucacaggcaccuccgccgacuuaaccgucgagaaggccgccgacgugaccugggaggaggaggccgagcagacgggggugucacacaaccucaugauaaccgucgacgaugauggcaccaugaggaucaaggaugacgagaccgaaaacauccugaccguucugcuuaaaacagcccugcuuauaguguccgggaucuuccccuauucaauccccgccacguuguuggucuggcacaccuggcagaagcagacccaacggucugguguccugugggaugugccaagcccgcccgagacgcagaaggccgagcuggaagaggggguguaccgcaucaaacaacaggggauuuucgggaaaacccaggugggggugggcguccagaaggaaggggucuuccacacgauguggcacgugacccggggcgcuguccugacgcauaacggaaagcgucuggagccaaacugggcuuccguaaaaaaagaucucauaagcuacggcggcggguggcguuuauccgcccaguggcagaagggcgaggaggugcagguuauagcgguggagcccgggaagaacccgaaaaacuuccaaacaaugcccggcauauuccagacuaccacgggcgagaucggugcgaucgcucucgacuuuaagcccggcaccagcgggagcccgaucaucaaucgugaaggaaagguggugggacuguacgggaacggcgucgugacgaaaaacgggggcuacgucuccgggauugcacagaccaacgccgagccggacggcccaacgcccgagcucgaagaagaaauguucaagaaacgaaaccugaccaucauggaccuccacccgggcagcgggaaaacgcgcaaguaccuccccgcgaucgugcgggaggccaucaaaaggcggcuccgcacccugauucucgcucccacgcggguggucgccgccgagauggaagaggcucuaaaagggcugcccauccgcuaccaaacgaccgccauaaaguccgagcacacaggacgagagauaguggaccucaugugccacgcaacguucaccaugcgccugcugagcccagugcgugucccaaacuauaaccucaucauaauggacgaggcucacuucacagacccagccaguaucgcugcacgcgguuacaucagcacccgggugggcaugggcgaggcggccgcuaucuucaugacggcaacuccccccggcaccgcggaggccuuuccgcaguccaaugccccgauccaggacgaagaacgcgacauccccgaacgcucauggaacucagggaacgaguggauuacugacuuugccggcaaaacgguuugguucguucccucgauaaaggcggggaacgacauugcgaacugccugcggaagaacggcaagaaggugauccagcugucccgcaaaacauucgacaccgaguaccagaagacucggcucaaugacugggacuucgugguaacgaccgacauuagcgagaugggggccaacuucaaggccgaccgggugaucgacccccgccgcugccuuaagcccguaauccugacggacggucccgaacgcgugauccuugccggcccaaugccagugacggccgcaucggccgcccagcggcgggggcgcgugggccggaacccccagaaggagaacgaccaguacaucuuuacugggcaaccacuaaacaacgacgaggaccacgcccauuggaccgaggccaaaaugcuguuggacaacaucaauaccccggaggguaucaucccagcguuauuugagcccgagcgcgaaaagagugccgcaauagauggggaguacaggcugaagggcgagucccgcaagaccuucgucgagcucaugcggcguggggaccugcccguguggcuagcccauaaaguggcaagcgaggguaucaaauacacagacaggaaguggugcuucgacggugagcgcaacaaccagauucucgaggagaacauggacguggagauauggacgaaggaaggggagcggaaaaaauuacguccaagauggcucgacgcccggaccuacuccgacccacucgcccugaaggaauucaaggacuucgccgcugguagaaagagcaucgcgcuggaucucgugacagagaucggccgugugcccucccaccuggcccaccgcacccggaacgcccuggacaaucuagucaugcugcauacgucugaacacgggggucgggccuaccggcacgccgucgaggagcugccugagaccauggagacccuccuguuacucggacugaugauucuccucaccggaggggcgaugcuguuccugaucagcggcaagggcauugggaaaaccuccaucggccucaucugcguaaucgugagcuccgggaugcuguggauggcggacgugccgcuucaguggauagccagcgccauugucuuagaguucuucaugaugguucugcugauccccgagcccgagaaacagcgcaccccgcaagacaaccagcucgccuacgugguuaucggcauccugacccuggccgccaucgugaccgccaaugagauggggcucuuagagacgaccaaacgcgacuuaggcauguccaaagagcccgggguagucagccccaccuccuaccucgacguagaccugcaccccgccucugccuggacccuguacgcgguggccacgacugugaucacgccgaugcuccgccauaccaucgagaauuccacggccaaugugucacuggccgcgaucgccaaccaggccgugguccugaugggacucgacaagggguggcccaucuccaagauggaccugggagucccccuacucgcccuaggcugcuacagccaggugaacccccugacccucaccgccgccguccuacuccucgugacccacuacgcuauaaucgguccagggcugcaggccaaggccacgcgggaggcucagaaacgcaccgcggccggcaucaugaagaaucccacaguugaugggaucaugacuaucgaccucgacccggucaucuaugacaguaaguucgagaagcagcucggccaagugaugcugcugguguuaugcgccguccaacugcugcucaugcggacaagcugggcccucugcgaggcccugaccuuagcaaccgggcccaucaccacccugugggaaggcaguccggggaaguucuggaacacaaccaucgccguaagcauggccaauauauuccgcggguccuaccuggcgggcgcggggcucgccuucagcaucaugaaaaguguuggcaccgggaaacggggcacuggcagucagggcgagacccucggcgagaaguggaagaagaaauuaaaucagcucagccgcaaggaguucgaucuguacaaaaaguccgggaucacggaggucgaucguaccgaggcuaaggagggguuaaaacgcggcgagacgacgcaccacgccgucucacggggcuccgccaaacuccagugguucguggagcgcaauaugguaauaccggagggccgagugaucgaccugggaugcggccgcgguggcuggagcuauuacugcgcggggcugaagaaggugaccgagguccgcggcuacacgaagggcggaccgggccacgaagagcccgugccgauguccaccuacggguggaauaucgugaagcucaugagcggaaaggacgucuucuaucugccgcccgaaaagugcgacacgcugcugugcgacaucggggaguccagccccucuccgaccguggaagagagcaggaccauucgcguguuaaagauggucgagcccuggcuaaagaacaaccaauuuugcaucaaggugcuaaacccauacaugcccaccgugauagagcaccucgagcggcugcagcgcaagcacggcggcaugcuggucagaaacccguugucccgcaacucgacacacgagauguacuggaucuccaacgguaccggcaacaucgugagcucagugaacauggucucucgcuuacuccucaacagguucaccaugacucaccggcgccccacgaucgagaaggauguggaccugggggccggcacccggcacgucaacgccgaaccugagacaccgaauauggacgugaucggagagcgcauuaagcgaauuaaggaggagcacucuagcaccuggcauuacgacgacgaaaaccccuauaagacaugggccuaucauggguccuacgaggucaaggccaccggcagcgcgucauccaugauaaaugguguuguuaagcugcuaaccaagcccugggacgucgucccaaugguaacccagauggccaugaccgacaccaccccguuuggccaacagcgcguuuucaaagagaaggucgacacccggacgcccaggcccaugccggggacccguaaggugauggagaucaccgcugaguggcuguggcgcacccugggccggaacaaacgcccgcgccucuguacgcgggaagaguucacaaagaaggugagaaccaacgcugccaugggcgcagucuucacagaagagaaccagugggacagcgcccgggcggccguagaagacgaagaguucuggaagcuuguggaccgcgaaagagaacugcacaaguuagggaaaugcggcuccugugucuacaacaugauggggaagcgcgagaaaaagcugggcgaguucgggaaggcuaaaggcucccgggccaucugguacauguggcugggcgcccguuaucucgaguucgaggccuuaggguuucugaaugaggaccacugguuuucccgggagaacagcuacaguggcguggagggggaaggcuuacacaaguugggguacauauugcgcgacaucagcaagauccccggcggcgccauguacgcugacgacacggccgggugggacacccggaucaccgaggaugaccuccauaacgaggagaagauuacccagcagauggaccccgagcaccgccagcuggccaacgccaucuucaagcugacauaccaaaacaagguggucaagguccagcgccccaccccaaagggcaccgugauggacaucaucucccgcaaggaucagcggggaagcgggcaggucggaaccuacgggcucaacacauucacaaacauggaagcccagcuggugcgccagauggagggcgagggggugcugagcaaggucgaucucgaaaacccccacuugcuggagaagaagaucacccaguggcucgagaccaagggcguggagcggcugcgccggauggcgaucagcggggacgacugcguagucaagccgaucgaugaccgcuucgccaaugcgcugcuagcccugaaugacauggguaaggugcggaaggacauaccccaguggcagccgucgaaaggcuggcacgacuggcaacagguccccuucugcucgcaccacuuccacgagcugaucaugaaggacgggcgaaagcuagucgugcccugucgcccgcaggacgagcucaucggccgggcccggaucucccagggggcgggcuggagccugaaggagaccgccugccucgggaaggcguaugcucagauguggucccugauguacuuccaccggcgcgaccuucggcucgccucuaacgcgauuugcuccgccgugccggugcacugggugcccacuagccggacaaccuggagcauccacgcccaccaccaguggaugaccacggaagauauguuaaccguguggaaucggguuuggaucgaggacaaccccuggauggaggacaagacgccugucacaacgugggaggaugugccguaccugggcaagcgugaggaccaguggugcgguucccucaucgggcugaccucccgggccaccugggcgcaaaacauccucaccgcgauccagcagguacgcucccucaucggagacgaagaguuucuagacuacaugcccucaaugaagcgguuccgcaaggaagaagaaagugagggggcuaucugguga

SEQ ID NO: 25923 - RNA, 9873 nt, Artificial Sequence
  derived and/or modified CDS sequence (opt11) from DENV-3__FJ810414__SS-prME
accagccuaugccucaugaugaugcugcccgccacccuggccuuccaucucacgucucgggacggagaaccacggaugaucguggccaagaaugagcggggcaagagccugcuguucaagaccgccucgggcauaaacaugugcacguuaauagccauggaccugggagagaugugugacgacaccgugaccuacaagugcccccugauugccgaaguugagccggaagacauagacuguuggugcaaccucaccaguacaugggugaccuacggaacgugcaaccaggccggggagcaccggagagacaaacgguccguugcgcuggcgccccacguuggaaugggguuagacacacgcacccagaccuggaugagcgcugagggggcauggcgacaagucgaaaaggucgagacaugggcgcuccgccacccgggcuucaccauccuggcccuguuccucgcccacuacaucgggaccucccuaacccagaagguggugaucuucauccugcucaugcuggugacuccuagcaugaccaugcggugugugggcguggggaaccgugacuucgucgaggggcugucaggcgccaccuggguggacgucguccuagagcacgggggcugcguuaccacgauggccaagaacaagcccacccuggacauagagcugcagaagaccgaggcgacccagcucgccacgcugagaaagcugugcaucgaggguaagauaacuaacaucaccaccgacagccgcugccccacgcagggcgaagcaauucucccggaggagcaggaccagaacuacguuugcaagcauacuuacguagaccggggcugggggaauggcugcgggcucuucggcaaggggucccuggugacaugcgccaaauuccagugccucgagcccaucgagggcaaggugguacaacacgagaacuugaaguauacagugauaaucaccgugcacaccggcgaucaacaucaggucggaaacgacacccaaggcgugaccgucgagaucacgccacaggccagcaccguggaagcgauccugccggaguacgggacccuuggccucgaguguuccccgcgcacaggccuggacuucaacgaaaugauacuccugaccaugaaaaacaaggcauggauggugcaccggcagugguucuucgacuugccccuccccuggacgagcggcgcuaccaccgagacucccacguggaaccguaaggagcugcugguaaccuucaagaacgcacacgccaagaagcaggagguggugguucucggcucucaggaaggagcgaugcacaccgcacugaccggcgccacagagauucaaaacagcgggggcaccucaauuuucgccgggcaccuuaaguguagacucaagauggacaagcuggagcugaagggcauguccuacgccaugugccuaaacaccuucgugcugaagaaggagguguccgagacccagcacggcaccauccugaucaaggucgaguacaagggugaggacgcgccgugcaaaauacccuucagcaccgaggacggccaggggaaggcccacaacggccgguugaucaccgcaaaccccgugguaaccaaaaaggaggagcccgucaacaucgaggccgagccgcccuucggggaaagcaacaucgugaucgggauaggcgacaaggcccugaagaucaauugguacaagaaggggucgagcaucggcaaaauguucgaggccacggcucgcggggcccgcagaauggccauucuaggcgacacugcgugggauuuuggcuccgucggcgggguacugaacagccucgggaaaauggugcaccagaucuucgguucugcauauaccgccuuauucagcggggugucguggaucaugaagaucggcaucgggguccuacucaccuggaucggccugaacagcaagaacacguccaugagcuucuccugcaucgugaucggcaucaucaccuuauaccucggagcggugguccaagccgauaugggcugcgugaucaacuggaaggggaaggagcugaaaugcggcagcgggaucuucgugacaaacgagguccacaccuggacagagcaguacaaguuccaggccgacucgcccaagcgcuuagcuaccgcaaucgcuggggccugggaaaacggcgugugcgggauacgcucaaccacacggauggagaaccuucuguggaaacaaaucgcgaacgagcugaacuacauacucugggagaacaacaucaagcugacgguaguugugggcgacauaaucgggguuuuggagcagggcaagcgcacccucacaccccagcccauggagcugaaguacucauggaagaccuggggcaaggccaagaucgucacggccgagacccagaacagcuccuucauuaucgacggcccaaacacucccgaaugccccuccgcgucccgggcguggaacgugugggagguggaggacuacggcuucggggucuucacuacgaacaucuggcugaagcuccgcgagguguacacccagagcugcgaccaccggcugaugucugccgcuaucaaggacgaacgcgccgugcacgcugacaugggcuauuggaucgagucucaaaagaacggaagcuggaagcucgagaaggcguccuucaucgaagucaagaccugcaccuggcccaagagccacacccucugguccaacggugugcuggagagcgacaugaucauccccaagucccuggccggccccauuagccagcacaaccaucgcccuggcuaccacacgcagaccgccggccccuggcaccucgggaagcuggagcuggacuuuaacuacugcgaggguaccaccguggucauuacugagaauugcgggacgcgcgggcccucacuccgaaccaccaccgugagcgggaaacugauucacgaguggugcugccgcaguugcacucuucccccgcuccgguauaugggggaggacggguguugguacggcauggagauaaggcccaucaacgagaaggaggagaacauggcuaaguccuuagugucugccggaagcgggaaaauggacaacuucacgauggggaucuugugcuuggcuauccuguucgaggaggucaugcgggggaaguucgggaagaagcacaugaucgccggcguccuguucaccuucgugcucuugcuguccggucagaucacguggcgugacauggcccauacccugaucaugauagguucaaacgccuccgaccggaugggcauggggguaaccuaucuggcccugaucgcgacuuucaagauccagccuuuccucgcauuagguuuuuuccugcgcaagcucacgagccgggagaaccuguugcuaggggugggcuuggccauggcaacgacacuacaacuccccgaggauaucgagcagauggcaaacggaaucgcccuggggcugaugacccugaagcugaucacacaguucgagacauaccagcuauggaccgcccuugugagcuuaaccugcuccaacacaaucuucacccugacggucgccuggagaaccgccacgcucauccuggccggcgugagccuguugccgcugugccaguccagcucuaugcggaagacugacuggcugccgaugaccguagccgccaugggcgugccgccgcuuccgcuuuucaucuucagucugaaggacacccccaagcgacgcucuuggccccuaaaugagggcgucauggccguuggguuaguuagcauacucgcgucaagccucuuacggaacgacguacccauggcggggcccuugguggccggcgggcuccugaucgccugcuacgugauuacgggcaccuccgccgaccugaccguggagaaggccgcggacgucacuugggaagaggaggccgagcagacggggguuagccacaauuuaaugaucaccgucgacgacgacggaaccaugcgcaucaaggacgacgagaccgagaacauccugacggucuuauuaaagacggcccugcugauaguguccgguauauucccguacucuauccccgcaacgcuccugguauggcacaccuggcagaagcagacccagcgguccgggguccugugggacgugcccucaccgcccgagacgcagaaggccgagcucgaagagggcguguaccgaaucaaacagcaggggaucuucggcaagacccaggugggggugggcgugcagaaggaggggguauuccacaccauguggcacgugacucggggcgcggugcugacacacaacggcaagcgccuggagcccaacugggccuccgucaaaaaagaccucaucagcuacgguggcggguggaggcuguccgcccaguggcagaagggugaggagguccaggugaucgccgucgagcccggcaaaaacccaaaaaacuuccagaccaugcccggcaucuuccagaccacgacaggugagauuggggcuauugcccuggacuuuaaaccuggcacuagcgggagcccgaucaucaaccgagaggguaaaguggugggccuguacgggaauggcguagugaccaaaaacgggggcuacgugagugggaucgcucagaccaacgccgaacccgacggccccacgcccgagcucgaggaggagauguuuaagaagcggaaccugaccaucauggaucugcacccgggcagcgggaagaccagaaaauaucuccccgcuaucguccgggaggcgauuaaacgccggcugcgcacccuaauucuugcccccacacgugugguagcagccgagauggaggaggcgcugaagggccugcccauccgcuaccagaccaccgccaucaagucagaacacaccgggcgggaaaucguugaccucaugugccacgcuacguuuacgaugcgccugcugucuccggugcgggugcccaauuacaaccucauaaucauggacgaggcacacuucacugaucccgccuccaucgccgcucgcggcuauaucucuacccgggucgggaugggcgaagccgccgccaucuucaugacggcgacgccgcccggaaccgcugaggcauucccccaguccaacgcccccauccaggacgaggagcgcgacauccccgagcgcagcuggaacuccggcaacgaguggauaaccgacuucgugggcaaaacggugugguucgucccuagcaucaaggccgguaacgacaucgcgaacugcuuacggaagaacggcaaaaaggucauacaacugucccgcaagacguucgacaccgaguaccagaagacucgucucaacgacugggacuucguuguaacgaccgacaucucggagaugggggccaacuucaaggccgaccgggugauugaccccagacgcugccugaagcccgugauacugaccgacggcccugagcgggucauacucgccggaccgaugcccguaaccgccgcguccgccgcccagcgcagagggcgcgugggccggaauccccagaaggagaacgaccaguacaucuucacggggcaaccccuaaacaaugacgaggaccacgcccauuggaccgaggcaaaaauguuacuggacaacaucaacacgccggagggcaucauccccgcccuguucgagcccgagcgcgagaaguccgccgccaucgacggggaguaccggcugaaaggcgaaucccgaaagacguucgucgagcucaugcgucgcggcgaccugccagugugguuagcccacaagguugccagcgaggggaucaaguauacagaccggaaguggugcuucgacggcgagagaaacaaccagauacucgaggagaacauggacguggagauuuggacgaaggagggggaaaggaagaagcugcggccgcgcuggcuggaugcccggacauacucagacccccucgcccugaaggaauucaaggacuucgccgccggccgcaaauccauugcgcuagaccuggugaccgagauaggucgaguucccucccaccuagcgcaucgcaccagaaacgcccuggacaaccucgucaugcugcacacgagcgagcacgggggccgcgccuaccggcacgcaguggaagaacugccggaaaccauggagacccugcugcugcucggccugaugaucuuguugaccggcggggcgauguuauuccugauuagcggcaaaggcaucgggaagacgucuaucggccuuaucugcgucaucgugucgagcgggaugcuguggauggccgacgugccccugcaguggaucgcgagcgccaucguccucgaguucuucaugauggugcugcugauacccgagcccgagaagcagcgcaccccccaggacaaucaacucgccuacgucgucauuggcauccuaacucuggcggccauugugaccgccaacgagaugggacuccuggagacgacgaaacgugaucugggcauguccaaggagcccggcguaguaagcccuaccuccuaccucgacguggaccuacaccccgccagcgccuggacguuguaugcuguggccacgaccgucaucaccccgaugcugcgucacaccaucgagaacuccacggccaacguaagccuggcagccaucgcuaaucaggccgugguccuuauggggcucgauaaggguuggcccaucucaaaaauggaccugggggugccccugcucgcccugggcugcuacagccaggugaacccccugacccucacggcugcgguacugcugcucgugacccacuacgcaaucaucggucccgggcuacaggccaaggcgacgagagaggcacagaagcgcacugcagccggcaucaugaaaaaccccacaguggacgggaucaugacaaucgaucuggaccccgucaucuacgacuccaaauuugagaagcagcucggccagguaaugcugcuggugcuaugcgccguccagcugcugcucaugcggacgagcugggcacugugcgaggcucugacccucgcaaccgggcccauuacgacgcugugggagggcuccccgggcaaguucuggaacaccaccaucgccgugagcauggcgaacaucuucaggggguccuaccuggccggcgcggggcucgccuucagcaucaugaagucugugggaaccggaaagcggggcacgggcagccagggggagacccugggcgagaaguggaagaagaagcugaaccagcucucacgaaaggaguuugaccuguauaagaaguccgggaucaccgaagucgaccggaccgaggccaaagagggccucaagagaggggagaccacacaccacgccgugagcagaggguccgccaaacuccagugguuuguggagcgcaacaugguuauccccgaggggcgggugaucgaccucggguguggacgcgggggcuggucguacuauugcgcugggcugaagaaggugaccgaaguucgcggcuacaccaaggguggccccggacaugaggagccggucccuauguccaccuacggguggaacauagugaagcucaugagcggcaaggacgucuucuacuugccgcccgagaagugcgacacguuacugugugacauaggggagaguagccccuccccgaccguggaggagagccggaccauccgcgugcucaaaauggucgagcccuggcugaagaacaaccaguucugcaucaagguacugaaucccuacaugcccaccgugaucgagcaccuggagcggcugcaacgcaagcauggcgguaugcuggugcggaacccucucucccgcaacagcacccacgaaauguacuggaucuccaacggaaccggcaacauuguguccuccgugaacauggucagccggcuucugcucaaccgcuucaccaugacccaucggcgccccaccauagagaaggacguggaccugggggccgggacccggcaugugaacgccgagcccgaaaccccgaacauggacguaaucggcgagcgcaucaagcggaucaaggaggaacacuccagcaccuggcacuacgacgacgagaaccccuacaagacgugggccuaccaugguuccuacgaagugaaggccaccggcagcgcgucauccaugauaaacggggucgugaagcugcucaccaagcccugggacgucguccccauggugacccagauggccaugacggacaccaccccguucggccagcagcgcguguuuaaggagaaggucgacacccggacgccccgccccaugcccgggacgcggaaggugauggagaucaccgcggaauggcuguggcguacccugggccggaacaagcgaccucgucucuguacgcgggaggaguucaccaagaagguacguaccaacgccgccaugggcgccgucuuuaccgaggagaaccagugggacagcgcccgcgccgccguagaggacgaggaguuuuggaaguuaguggacagggagcgggagcugcacaagcucgggaagugcggcuccugcgucuacaacaugaugggcaagcgagagaagaagcuuggcgaguucgggaaggcgaaagguagccgggccauuugguacauguggcugggcgcgcgguaccucgaguucgaggcccuggguuuccugaaugaggaccauugguucucccgggagaacagcuacuccggcguggagggggagggccuccacaaacugggguauauccugcgcgacaucucgaagaucccuggcggcgcuauguacgcggacgacacggccgguugggauacacggaucaccgaagacgaccuccauaacgaggagaagaucacccaacagauggaucccgagcaccgacagcuggccaacgccauuuucaaguugacguaccaaaauaaagugguuaaagugcagcggccaaccccgaaaggcaccguuauggacauuaucucccgcaaggaccagcgggggagcggccaggucgggaccuacggcuuaaacacuuucacgaacauggaagcccagcuggugcgccaaauggagggggagggggugcugucaaaggucgaccucgagaacccucaccuucuggagaagaagaucacccagugguuggagaccaagggcguagagcgacugcgucggauggcgaucagcggggacgacugcgucgucaagccaaucgacgaucgcuucgccaaugcccuacucgcccugaacgacauggggaaggugcgaaaggacaucccccaguggcagccgaguaaaggauggcacgacuggcagcaggucccuuuuugcagccaccauuuccacgagcugaucaugaaagacgggcgcaagcucgucgugcccugccgcccccaggaugagcugaucggccgggcacgcaucucccagggggcgggcuggucauuaaaggagacugccugccucgggaaggccuacgcccagauguggaguuuaauguacuuccaccggcgcgaccugcggcucgccucuaacgcgauuugcuccgccgucccgguucacugggugccaacgucccgcaccaccuggagcauccacgcccaccaccaguggaugacgacggaggacaugcugaccguguggaaucgggucuggaucgaagacaaccccuggauggaggacaagacgcccgugaccacgugggaggacgugccguaccugggcaagcgcgaggaccaguggugcggaucccucaucggacugaccagccgggcuaccugggcgcagaacauccugaccgcgauacagcaggugagaucguugauuggcgacgaagaguuccuggacuauaugcccagcaugaagcgcuuccggaaggaggaagagucggagggagccaucugguga

SEQ ID NO: 25924 - RNA, 9873 nt, Artificial Sequence
  derived and/or modified CDS sequence (opt11) from DENV-3__FJ744734__SS-prME
accagucugugccucaugaugaugcuucccgccacccuggccuuccaccuaaccagccgggauggcgagccccggaugauaguggccaagaacgaacgcggcaagaguuugcuuuucaagaccgccucuggcaucaacauguguacacucauagccauggaccugggagagaugugcgacgacaccgugaccuacaagugcccauugaucgccgaagucgagccugaggacauagacugcugguguaaccuaacaagcaccugggugaccuacgggacgugcaaccaggcuggugagcaccggagagauaagcggucaguugcgcuggcaccccacguuggcaugggccuggacacacgcacacagacauggaugagcgccgagggugcuuggcgccagguggagaagguagagacgugggcacucaggcaccccggcuuuaccauccuggcccucuuccuugcccacuacaucgggacgucccugacccagaagguggugaucuucauccugcucaugcuugugacgcccaguaugacuaugcggugugugggaguggggaaccgcgacuucguagagggcuuguccggcgcgacguggguagacguaguccucgagcaugggggcugcguaacgacgauggccaagaacaagcccacccuagacaucgagcugcagaagaccgaagcgacccaguuagcuacgcugaggaagcugugcaucgaggggaagaucacaaacauuaccacagauagccgaugccccacacagggugaggccauccucccagaggagcaggaucagaacuacgugugcaagcauacauacguagauaggggaugggguaacggcuguggacuauuugguaagggauccuuagugaccugcgcuaaguuucagugccucgagccgaucgagggcaaagugguccagcaugagaaccugaaauacaccgugaucaucacuguacacaccggggaccagcaccaaguagggaacgacacccagggcgucaccgucgagauaacgccacaggccagcaccguggaggcuauccugcccgaauacgggacauugggccuggagugcucgccgcgcaccggguuggacuucaacgagaugauccuccugaccaugaaaaacaaggccuggauggugcaccgacagugguucuucgauuugccccucccauggacuucaggcgccaccacagagaccccaacguggaaccgcaaagaacugcuggucaccuucaagaacgcucacgccaaaaagcaggaaguugugguccucggcucccaggagggugcgaugcacacggcucugacuggugccacggaaauccagaauucagggggcaccucgaucuucgccggccaccuuaaguguaggcugaaaauggauaaacuggagcuuaaaggaauguccuaugcaaugugucugaacaccuucgugcugaaaaaagaggucucggaaacgcaacacggcacgauccugaucaaagucgaguacaaaggugaggacgcuccuugcaagaucccuuuuagcaccgaggacggccaagggaaggcccacaacggucgccugauaacagccaacccaguagugacgaagaaggaagagccaguaaacauagaggcugaaccgcccuucggggaauccaauaucgugaucggcaucggcgacaaggcgcucaagaucaauugguacaaaaagggguccaguauaggcaagauguucgaggccacugcgagaggggcccgccggauggccauccugggcgacacagcuugggauuucggcuccgucggugggguccugaacagccuagggaagaugguucaccaaaucuucggguccgccuacaccgcccuguucagcggggugucuuggaucaugaagaucgguauaggcguccuucuuacguggaucggacugaacucuaagaacacgucuaugaguuucucuuguaucgugaucggcauaauuacucucuaccucggggccguugugcaggccgacauggguugcgugauaaacuggaaggggaaggagcuuaagugcgguagcgguauauucgugaccaacgagguccacacuuggacugaacaguacaaguuccaagcggacuccccgaagcgccucgcgaccgccauugcuggagccugggagaauggcgugugugguauucgcagcacaacccggauggagaaccuuuuguggaaacagaucgcgaacgagcucaauuacauuuugugggaaaacaacaucaaguugacggugguggucggugauaucaucggggugcuggagcaggggaagcgcacguugacgccccagccgauggaacugaaauacuccuggaagaccugggguaaggcaaaaaucgucacggcggagacacagaacucguccuucaucaucgacgggcccaacacccccgagugccccagcgccuccagagccuggaacgugugggagguagaggauuacggcuucgggguguucacaacgaacaucuggcugaagcuucgcgaaguguacacccagagcugcgaucaucggcucaugagcgccgccaucaaggacgaacgcgccguucaugccgauaugggcuacuggaucgagucccagaagaacgguucguggaagcuagagaaagcauccuucauagagguaaagaccugcaccuggcccaagagccacaccuugugguccaauggagugcuugagagugacaugauuauccccaagucccuugcuggcccaaucagccaacacaaccaccguccgggcuaccacacgcagaccgccgggcccuggcaccucgggaaacuugaacuagacuuuaacuacugcgagggaaccaccguggucauaacggagaacugcggcacccguggacccucccucaggacgacaacggucagcggcaagcugauacaugaguggugcugccgcuccugcacucuucccccgcuccgguacaugggggaggacggcugcugguaugguauggagauccggccgauuaaugagaaagaggagaacauggucaagagccuagucagugccggcagcggaaaaauggacaauuucaccauggguauauuaugccucgccauccucuucgaggaggugaugcgaggcaaguucgggaagaaacacaugaucgccggcguauuguuuaccuucgugcuccuccuguccgggcagaucacguggcgugacauggcccacacccucauaaugaucggcagcaacgccagcgaccggaugggcaugggcgugaccuaccuggcccugauagccaccuucaagauccagccuuuccucgcccuaggcuucuuccuacgcaagcucacgagccgugagaaucugcugcucggcgucggauuagcaauggccacgacccugcagcugccggaggacaucgaacagauggccaacgguauugcgcucggucuaaugacccucaaacugauaacgcaauucgagacauaccagcuguggaccgcucucgucucccucacuugcuccaacacgaucuucacgcugaccgucgcguggcgcaccgccacgcuuauccuagccggagugagccugcugccucuaugccaauccagcuccaugcggaaaaccgacuggcugcccaugaccgucgcggcaaugggggugccuccccugccguuauucaucuucagccugaaggacacccccaagcgccguucauggccccucaacgagggcgucauggcgguggguuuagugagcauccuagccucuagucugcugagaaacgauguaccgauggccggcccguugguggcgggcgggcucuugauugccugcuauguuauaacgggcacauccgcagaucugaccgucgagaaggccgcagacguuaccugggaggaagaggccgagcagacgggugugucucacaauuuaaugaucacuguugacgacgacggcaccaugcgcaucaaggacgacgagacugagaacauccugaccgugcugcucaagacggcccuacucaucgugagugggauauuuccguacucgauuccggccaccuuacuggucuggcacaccuggcagaagcaaacccagcgguccggcgugcuaugggaugugcccagcccucccgagacacagaaggcagagcucgaggaaggcgucuaucgcaucaagcagcaggggaucuuuggcaagacccaggugggaguugguguccagaaggaggggguguuccacaccauguggcacgugacccgaggugccguccuaacgcacaacggcaagcgacuggagccgaacugggcgucggugaagaaggaucucaucagcuacggaggcgguuggcggcugucggcgcaguggcagaagggggaggaagugcaggucaucgcgguugaacccggaaagaacccgaaaaacuuccagacuaugccgggaauauuccagaccacaaugggcgaaaucggcgccaucgcgcuggacuuuaaacccggcacgagcgguagccccauuaucaaccgcgaggggaagguggucggccuguacgggaauggcgugguaacuaagaaugggggcuaugucaguggaauugcacaaaccaacgccgagcccgacgggcccaccccagaguuagaggaagaaauguucaagaagcgaaaucugacuaucauggaccugcaccccggcagcgguaagacccguaaguaccuucccgccaucgugcgagaagccaucaaacgccggcugcggacucugauccucgcccccacccggguggucgccgcugagauggaggaggcgcuaaagggccuccccauccgcuaccagaccacagccaucaaaucugagcacaccgggcgggagauaguggaccugaugugccaugccacuuucacgaugcgccugcugagccccguucggguccccaacuauaaccucaucaucauggacgaggcccacuuuacggacccagccuccauugccgcccgcggauacauaucaacucgggucggaaugggcgaggcggccgccauuuucaugaccgcgacgcccccuggcacugcggaggccuucccccaguccaacgcgccuauucaagacgaggagcgcgauauaccugagcgcaguuggaacuccgguaacgaguggaucacugauuuuguaggcaaaaccgucugguucgugccuagcaucaaggccggcaacgacaucgccaacugccugcggaaaaacggcaaaaaggugauccagcugucgcgcaagacguucgacaccgaguaccagaagacccggcugaaugauugggacuucguugugaccaccgacaucagugagaugggggcgaacuuuaaggcugauaggguaauugacccccgucgcugccugaagcccgugauccuaaccgacggccccgagcgcgugauccuggccggcccgaugccgguaaccgccgccuccgcggcccagcgcagggggcgugucggccggaacccccaaaaggaaaacgaccaguacaucuuuaccgggcagccuuugaacaacgacgaggaccacgcccacuggaccgaggccaagaugcuguuagauaauauaaacacuccggaaggcaucauccccgcacuauucgagccggagcgcgagaaguccgcagccaucgacggugaguaucgguugaagggcgaaucucgcaagaccuucgucgagcucaugcggcgcggcgauuuaccggucuggcuggcccacaagguagccucagaggggauaaaguauacagaucgaaaguggugcuucgacggggagcggaacaaccagauacucgaggagaacauggacguggagaucuggaccaaagagggugagcggaagaaauugcgcccgcguugguuagacgcccguacguauuccgacccccucgcgcugaaggaauucaaggacuucgcggcgggccgaaagagcauagcccuggaccucgucaccgagaucggcagaguucccucccaccuugcgcaucgcacccggaacgcgcuggacaaccucgugaugcugcacaccagcgagcauggaggccgcgccuaccggcacgccgucgaagagcugccggagacgauggagacccuccuucugcucgggcucaugauucuccucaccgguggggccaugcuguucuugaucagcggcaagggcaucgggaagaccuccaucggccugaucugcgugaucgugagcuccggaaugcucuggauggcggacguuccccugcaguggaucgcaagcgccauugucuuggaguuuuucaugaugguacuccugauccccgagcccgagaagcagcgcacuccgcaggacaaucagcucgccuacgucgugaucggcauccuuacccuggccgcgaucgugaccgccaacgagauggggcuccuggaaacgacaaagcgggaccuggggaugaguaaagagcccggcgucgugagcccgacauccuaccucgauguggaccugcacccagcuagcgcguggacccuauacgccgucgcaaccacggugauaacaccgauguuacgccauacgaucgagaacuccaccgcaaacgugagccuugccgcuaucgcgaaccaggcggugguacugaugggacucgacaagggcuggccuaucucuaagauggaccugggaguuccacugcucgcccugggcugcuacagccaggucaauccacugacucucacugccgccgugcuauuacucgugacccacuaugcaauuaucgggccgggccuccaagccaaggcaacccgggaggcgcagaagcgcacggccgcggggaucaugaagaaccccacggucgacgggauaaugaccaucgaccuggacccaguaaucuacgacuccaaguucgagaagcagcucggccaggugaugcugcuaguccucugugccguucaguuacugcucaugcggaccagcugggcccugugcgaggcccugacguuggccacagggcccaucacuacccuuugggagggcucaccuggcaaguuuuggaacacaaccaucgcggugagcauggccaacauauuucgcgggucauaccuggccggcgccgggcucgcauuuucuaucaugaaguccgucggcaccgggaaacgggggaccggcagccagggggagacgcugggugagaaauggaaaaagaagcugaaccagcugucucgaaaggaauucgaccuguacaagaaguccgguaucaccgagguggaccggaccgaagcuaaggagggccugaagcgcggggagacuacgcaccacgccgugucccggggguccgccaagcuccagugguucguggagcgcaacaugguuauccccgaaggccgcgugaucgaucuggggugcggucgcgggggguggagcuacuacugcgccggccugaagaaggugacagaagucaggggauacacaaagggcgguccuggucacgaggagcccgugccgauguccacuuacggguggaacaucgucaaacucauguccggcaaggacguguucuaccugccaccagagaaaugcgacacucuguugugugacaucggggaguccucgcccaguccgaccguagaggaaagcagaaccauucgaguccucaaaauggucgagcccuggcugaaaaacaaccaguucugcaucaaggugcugaaucccuacaugcccaccgugaucgaacaucuugaacggcugcagcgcaagcaugguggcaugcugguucggaacccacucagucgcaacagcacucacgaaauguacuggaucuccaacgggaccggcaacaucgugagcuccguaaauauggugagccggcuccuguuaaacagguucaccaugacgcaccggcgccccaccaucgaaaaagacguggaccugggggcgggaacccggcacgugaacgccgagcccgagaccccaaacauggacgugaucggcgagcgcaucaagcggaucaaggaggagcacuccagcacuuggcacuacgacgacgagaaccccuacaagaccugggccuaccacgggucuuacgagguaaaggccacgggcagcgccucaucaaugauuaacgggguagugaagcugcucaccaagcccugggacguagugccuauggugacccagauggcgaugaccgacacaacgccuuucggccagcaacgcguuuucaaggagaagguggacaccagaacgcccaggccuaugcccgggacacggaaggugauggaaaucaccgcugaguggcuuuggagaacuuuagguaggaacaaacgcccgcgccuauguacccgggaggaguuuacgaagaagguccgcacuaacgccgccaugggugcaguuuucaccgaggaaaaccaaugggacagugcgagagccgccguggaagacgaggaguucuggaaguuagucgaucgcgagcgggagcugcacaaacuugguaagugcggcucauguguguacaacaugauggggaagcgcgagaagaagcugggugaguucgggaaagccaagggcagcagagcgaucugguauauguggcuuggcgcccgcuaccucgaguucgaggcuuugggcuuccugaacgaggaccacugguucucccgggagaacucuuauuccggcgucgagggggagggccugcacaaacugggguauauccugcgcgacaucagcaagauaccuggcggcgccauguaugcugacgacacugcggggugggacacgaggaucaccgaggacgaccuccauaacgaggagaagaucacccagcagauggaccccgagcaucgccaguuggccaaugcaaucuucaagcugaccuaccaaaacaaggucgugaaagugcaaaggcccacgccgaagggcaccgucauggacaucaucucccgcaaggaucagcgggggagcggucagguggggaccuacggccucaauaccuucaccaacauggaagcccaacuagugcgccagauggaaggggaggggguccuguccaagguagaucucgagaauccucaccuccuggaaaagaaaaucacucaguggcucgaaacaaagggaguggaacggcugcgcaggauggccauaagcggggacgacugcgucguaaagcccaucgaugaccgcuucgccaacgcccugcucgcccugaacgacaugggcaaaguucgcaaagacauuccgcaguggcagccguccaagggcuggcacgauuggcaacagguuccguucugcagccaccauuuccacgagcugaucaugaaggacgggcgcaaacucgugguaccuugccgcccccaagaugagcugaucggccgggcccgcaucucccaaggggcgggauggucacugaaggagaccgcaugccuggggaaggccuacgcccagauguggucccugauguacuuucaccggcgcgaccugcgucuagcuucaaacgccaucugcucggcggucccaguccacugggugcccacgagucgcacuaccuggaguauccacgcccaccaucaguggaugacaaccgaagacaugcuuaccgucuggaaccguguguggaucgaggacaaccccuggauggaggauaagacgccugugacaaccugggaggacgucccguacuugggaaagcgcgaggaucaguggugugggucccuaaucgggcuaacgagccgcgcgaccugggcucagaacauucugaccgcgauccagcagguccgcagcuugaucggcgaugaggaauuccuggauuacaugcccagcaugaagcgguuccgcaaggaggaggaguccgagggcgccauuugguga

SEQ ID NO: 25925 - RNA, 9873 nt, Artificial Sequence
  derived and/or modified CDS sequence (opt11) from DENV-3__FJ744737__SS-prME
accagccugugucucaugaugaugcugcccgccacccuggccuuccaucucaccagcagggacggcgagccgcggaugaucguggccaagaacgagcgcggcaagucccuacuguucaagaccgcuucugggaucaacaugugcaccuuaaucgccauggaccugggugaaaugugcgacgacaccgugaccuacaaaugcccccugaucgccgagguggagcccgaggacauugacugcuggugcaaccucacguccaccugggugaccuacggcacaugcaaucaggccggggagcaccggcgcgacaagagguccgucgcucuggcgccccacgugggcaugggccuggacacccgcacgcaaaccuggaugagcgcugagggggccuggcggcagguggagaagguggagacgugggcgcuccgccaccccggguucaccauccuggccuuguuucucgcccacuacauagguaccucccugacacagaagguggugaucuucauccuucucaugcugguuacgccaucgaugaccaugcgaugugugggcguggguaaccgagacuucguggagggucuguccggggccaccuggguggauguaguacucgagcacgggggcugcgugaccacgauggccaaaaacaagcccacccuugauauagagcugcagaaaacugaagccacgcagcucgcuacgcuacggaaguuaugcaucgaggggaagaucaccaacaucacgaccgauagccgcugccccacgcagggcgaggccauucuuccggaggaacaggaccagaacuacgugugcaagcacaccuacgucgacagaggcugggggaacggcugcggguuguucggcaaggggucccucgugaccugcgccaaguuccagugucuagagcccaucgagggcaagguggugcagcacgagaaucugaaguauaccgugaucaucacggugcacaccggcgaccagcaccaggucggaaacgacacccagggagugaccgcugagaucacgccccaggcgagcaccgucgaggcaauacugcccgaguacgguacccucgggcuggagugcuccccgcgcaccgggcuggacuucaacgagaugauucuccugaccaugaagaacaaggccuggaugguccaucgacagugguuuuucgaccugcccuugcccuggacguccggagccaccaccgagacuccaacguggaaucgcaaggaguugcuugugaccuucaagaacgcccacgcgaagaagcaggaagucguggugcucggcagccaggagggggccaugcacaccgccuugaccggugccacagagauccagaacagcgggggcaccucuaucuucgccgggcaucugaagugccgacucaagauggacaaacuggagcugaaagguaugagcuaugcgaugugccuaaauaccuuuguccugaagaaggaggucucagagacccagcauggcacgauccugauaaagguggaauacaagggggaggaugcaccgugcaagaucccuuucagcacagaggacggccaggggaaggcccacaacggacgccugaucaccgcgaacccagucguuaccaagaaggaggagccggugaauauugaggcggagccgcccuuuggcgagagcaacaucgucaucggcaucggcgauaaggcccuuaagauuaacugguacaagaaagggagcucgauuggaaaaauguucgaggccacggcccgcggggcacgccggauggcgauccugggagacaccgccugggacuucgguuccguugguggcgugcugaacagccucggaaagaugguccaccagaucuucgggagugccuacaccgcccuguucagcggcgugagcuggauaaugaagauuggcauaggcgugcuacucaccuggaucgggcucaacagcaagaauacgucaaugucguucuccugcaucgucaucggcauaaucacccuuuaccuaggggcagugguucaggccgacaugggcugcgucaucaauuggaaggggaaggagcugaagugcggcagcggcauauucgugaccaacgaggugcacacuuggacggaacaguacaaguuccaggccgacucacccaagcgccuggcgacagccaucgccggggcgugggagaacggcgucugcgggauucguagcaccacccggauggagaaccuucuguggaagcagaucgcaaacgagcugaacuacauccucugggaaaauaacaucaagcugacagugguggucggagacauaaucgggguuuuagagcagggcaagcgcacccugacaccacagccaauggagcugaaguacuccuggaagaccuggggaaaggccaaaaucgucacagccgagacccaaaacagcuccuucaucaucgacgggcccaacacccccgaguguccaagcgcgucgcgggccuggaaugucugggagguggaagauuacggcuuugggguguucaccacaaacaucuggcugaagcucagagaggucuacacccagagcugcgaccaccggcugaugagugcggccaucaaggacgagcgagccguucacgccgacaugggcuacuggaucgagucacaaaagaacggcagcuggaaauuagagaaagcgaguuucaucgaagugaagaccugcaccuggcccaaaagccauacauugugguccaacgguguacuggagucggauaugaucauccccaagucccuggccggacccauaucacagcacaaucaccggccgggauaccacacgcagaccgccgguccauggcaccucgggaagcuagagcuggacuucaauuauugcgagggcaccacuguggugaucacggagaacugcgguacgcgcgggcccucccuccggaccaccacggucagcggcaaacugauccaugaauggugcugccguucaugcacccugccuccgcucagauacaugggggaggacggcugcugguacgggauggagauucgacccauuaacgagaaggaggaaaacauggucaagucucucguguccgcgggcagcggaaagauggacaacuucacgauggggauacuaugccucgcgauccucuuugaggaggucaugcgcggcaaguuugggaagaagcacaugaucgccggugugcucuucacauucguguuguuacugucagggcagauaacguggcgcgacauggcccacacccucaucaugaucgguagcaacgcgucugacagaaugggcaugggagucaccuaccuggcccugauugcgaccuucaaaauccagccauuccucgcccuaggcuucuuucuccgcaagcucacgagcagggagaaccugcugcucggggucgggcuggccauggccacgacccugcagcuccccgaggacauugagcagauggcaaacggcaucgccuuaggguuaaugacgcucaagcugaucacgcaguucgaaaccuaccagcuguggaccgcucuugugagccugacgugcuccaacacaaucuucacgcugacggucgccuggcguacagcuacucucauacuggcuggugugucucugcucccguugugccaguccuccuccaugcggaagaccgauuggcugcccaugaccguggcagccaugggugugccgccccugccguuauuuaucuucagccugaaggacacccccaagcgccgcaguuggccccucaaugagggcguuauggccgucgggcuugucucgaucuuggccuccucccuacugcggaaugaugugcccauggcggggccgcucgucgccggcggguugcuuaucgcaugcuacgugaucacuggcacguccgccgaccugaccguagagaaggccgcggaugugacaugggaagaggaagccgagcagacgggggugagccacaaccugaugaucaccguggaugacgacggcaccaugcgcaucaaggacgacgagaccgagaacauccugaccguccuuuuaaagacggcccugcugauuguguccgggaucuuccccuacucaauuccugccacccuucugguguggcacacuuggcaaaagcagacccagcgguccggcguccugugggacgugcccagcccgcccgaaacgcagaaggcggagcucgaggaggguguguaccgcauaaagcagcaggguaucuucggcaaaacucaagucggggucggcgugcagaaggaggggguguuccacaccauguggcacgugacucggggcgcgguccugacgcacaacgguaaacgcuuggagccgaacugggccuccgucaagaaggaccucaucuccuacggagguggguggcggcuuuccgcgcaguggcagaagggugaagagguccaggucaucgccguagagcccgggaagaacccgaagaacuuucagaccaugcccggcaucuuccagaccacaacuggcgagauuggggcgauagcccucgacuucaagcccgguaccagcgggagcccgaucaucaaccgcgagggcaagguagugggcuuguacgggaauggcguaguaaccaaaaauggcggguauguguccgggauugcccagaccaacgccgaacccgauggucccacgccugaauuagaggaggagauguuuaagaagcggaaccucaccaucauggaucugcacccuggcagcggaaagacccgcaaguaccuccccgccaucguuagagaggccauaaagcgcagacugcgcacccugauucucgcccccacgcggguaguggccgcugagauggaggaggcucucaaaggacugccgauacgcuaccaaaccaccgcgaucaaguccgaacacaccgggcgugaaaucguagacuuaaugugccacgccacuuuuaccaugcgcuuacuaagcccggugcgagugcccaauuauaaccuuaucaucauggaugaagcacauuucaccgauccggcgaguaucgccgcccgaggcuacaucagcacccggguggggaugggggaggccgccgccaucuucaugacggcgaccccccccggcaccgccgaggccuucccacagucgaaugcccccauucaggacgaggagagggacauccccgagcgcucauggaacagcgggaacgaauggaucaccgacuucgugggcaagacggugugguucguccccagcaucaaagccgggaacgacaucgcgaacugccugcggaagaacgggaagaaagugauccagcugucccgcaaaaccuucgacacagaguaccagaagaccagacucaacgacugggacuucguagucacaaccgacaucagugagaugggggccaacuucaaggccgaccgcgugaucgacccccggcgcugccugaagccagugauacugaccgacggccccgagcgcgucauacuagccggcccgaugcccguuacagccgcuuccgccgcgcagaggcgggggcgcgucggacggaacccccagaaggagaacgaucaguacaucuucacggggcagccccugaacaacgacgaggaucaugcccacuggaccgaggccaagaugcuguuggacaacauaaacaccccggagggcaucauaccagcgcuuuucgagcccgagagggaaaaguccgccgccauugacggggaguaucggcugaagggugagucccgcaagaccuucgucgagcucaugcgucgcggcgaccugcccguguggcuggcccauaagguggcgagcgaggggaucaaguauaccgacagaaaguggugcuucgacggcgagcgcaacaaccagauucucgaggagaacauggacguggagauauggacgaaggagggugagagaaagaagcugcgcccgcgcuggcuggacgcacggaccuacuccgacccccuugcucuaaaagaguucaaggacuucgccgccggccgcaagucuaucgcacucgaccuagugaccgaaauuggccgggugcccucccaccucgcccaccggacccggaaugcucuggacaaucucgugaugcugcacacgucugagcacgggggccgcgccuaccggcaugcuguggaagagcugccggagaccauggaaacccuguugcuguuggggcugaugauccugcucaccggcggggcgauguuauuccuuaucagcggcaaaggcaucgggaagacgucuauuggucucauaugcgucaucguaagcuccgggaugcuauggauggccgaugugccccugcaauggaucgccucugcaauaguccucgaguucuucaugaugguuuugcugauccccgagcccgaaaagcagcgcaccccacaggauaaccagcuagcguauguggucaucgggaucuugacccuggcggcuauagugaccgccaaugagaugggcuuacuggagacgacaaaaagggaccuggggaugucgaaggagcccggcguggucagcccgaccuccuaccucgacguggaccugcaucccgccagcgccuggaccuuauaugcgguggccacgaccgucaucacccccaugcuccgccauacuaucgaaaacuccaccgcuaacgucagccuggcugcuaucgcuaaccaggcaguaguccugaugggucuagacaagggcuggcccauuuccaagauggaucugggggugccccugcuugcccugggcugcuacagccaggugaacccucugacgcucaccgccgcggucuugcugcucgugacccacuacgcgaucaucggcccgggcuuacaggccaaagccacaagagaggcccagaagcgaaccgcggccgguaucaugaagaauccuacuguggacgguaucaugaccaucgaccuugaucccguaauauacgacuccaaauuugaaaagcaacucggccaggugaugcuccuggugcucugugccguucagcuacuguuaaugcggacgaguugggcgcucugcgaggccuugacccucgccaccgggccaauuaccacacugugggagggcuccccaggcaaguucuggaauaccaccaucgcggucagcauggccaacaucuuccgcgggucuuaccuggcgggcgcggggcucgccuucucuauaaugaaguccguuggcacagggaagcggggcacgggcucccaaggggagacccugggcgagaaguggaaaaagaagcuaaaccagcucagccgcaaggaauuugaccuguacaagaaauccggcaucaccgaggucgaucguaccgaggcaaaggagggacucaagcgcggggaaaccacgcaccacgcagugagccggggcucggcuaagcugcagugguucguggagcgcaauaugguuaucccagaaggccgggugaucgaucuggggugcggccgcggcggauggucguacuacugcgcgggccugaagaaggugaccgaaguccgcggcuacaccaagggcgggcccggccacgaggagcccgugccgauguccacauauggauggaacaucguuaagcuuaugucgggcaaggacguauucuaccugccgcccgaaaagugugauacccugcugugcgacaucggggaguccucucccucgccgaccguggaggagagucgaaccauccgugugcucaagauggucgaacccuggcugaagaauaaccaguucugcaucaaggugcuaaaccccuacaugcccacugugaucgagcaccucgaaagacuccagcgcaagcacgguggcaugcugguccggaacccgcucagucguaacucaacgcacgagauguacuggaucagcaauggcacgggcaacaucgugagcuccgugaacauggucagccgauugcuguuaaaccgguucaccaugacccaucggcgccccacgaucgagaaggacguggaccuaggggccggcacccgucauguuaacgcggagccggagaccccgaacauggacgucaucggagagagaaucaagaggaucaaagaagagcacaguaguaccuggcacuacgacgacgagaacccauacaaaacaugggccuaccacgguuccuacgaggugaaggcaaccggcagcgcgagcucuaugaucaacggggucgugaaacugcucaccaaacccugggaugugguccccauggugacacagauggccaugacagacacgaccccuuuugggcagcaacgcguguucaaagaaaaagucgacaccagaacgccccgccccaugccggggacccguaaggugauggagaucacagccgaguggcuguggcgcacccuggggcggaacaagcgcccgcgccucugcacgcgcgaggaguucaccaaaaaaguccguaccaacgcggcuaugggggcggucuucaccgaggagaaccagugggauagcgcgagggccgccguugaagacgaggaguucuggaaacuuguggaccgcgagcgggaacugcacaaacucgggaaaugcggguccugcguauacaacaugauggggaagcgcgagaagaaacugggggaauucgggaaggcgaagggcagccgggcaaucugguacauguggcugggcgcgcgcuauuuggaguucgaggcgcuaggguucuuaaaugaagaccauugguucucccgggagaacagcuacuccggcguggagggggagggccugcacaaacugggguauauccuccgcgauauuuccaagauccccggaggcgccauguacgcggacgacacagccggcugggauacccggaucaccgaggacgaccuccacaacgaggagaaaaucacccagcagauggaccccgagcacagacaguuagcgaacgccauauucaaguugacguaccagaacaagguggucaaggugcaacgacccaccccgaaaggcaccgugauggauauaauuucucgcaaggaccagcgagguucaggccaggucgggaccuauggccuuaacaccuuuacgaacauggaggcccagcuggugaggcagauggagggagaagggguacuguccaaggucgaucucgagaacccacaccuacuggagaaaaagaucacccagugguuggagaccaaaggcguugagcgucuacgccgaauggcgauuagcggggacgacugcguggucaagccuaucgacgaccgcuucgcgaacgcccuacucgcccugaacgacaugggcaagguucguaaagacauaccgcaguggcaaccauccaaaggcuggcacgacuggcaacagguccccuucuguucacaccacuuccacgaacugaucaugaaggaugggcgcaaguuggucgugcccugucgcccgcaggacgagcugaucggccgggcccggaucucccagggggcaggcuggagccugaaggagaccgcuugccucggaaaggcuuacgcccagauguggucucugauguacuuucaccggcgcgaccuucggcucgccagcaacgcgaucuguucggccgugccggugcacuggguucccacgagccgcaccaccuggucuauccacgcccaccaccaguggaugaccacggaggacaugcugacgguauggaacagaguauggauagaagauaaccccuggauggaagacaagacccccgugaccacgugggaggauguaccguaccugggcaaacgcgaggaccaguggugcggcucccucaucggccugaccagccgggccaccugggcucagaacauccugaccgccauacagcaaguccgcucucucauaggcgacgaggaauuccuggacuauaugcccucaaugaagcgguuccgcaaggaggaggagagugagggcgccaucugguag

SEQ ID NO: 25926 - RNA, 9873 nt, Artificial Sequence
  derived and/or modified CDS sequence (opt11) from DENV-3__FJ744739__SS-prME
accagccugugccucaugaugaugcugcccgcaacgcuggccuuccaccucaccagccgggacggggaaccccgcaugaucguggcgaagaacgagcgcggcaagagcuuacuguuuaagaccguuuccgggaucaauaugugcacccucaucgcgauggaccugggggagaugugcgacgacacuguaaccuacaagugcccgcugaucgccgagguggagcccgaggacaucgacugcuggugcaaccucaccagcaccugggucaccuacggcacgugcaaccaggccggggagcacaggcgcgacaagcggucaguugcccuggcgccccacgugggcaugggccuggacaccaggacccagaccuggaugagcgccgagggcgccuggcgccagguggagaagguggagacaugggcgcuccggcacccgggcuucaccauccuggcguuauuucuagcccacuacaucgggaccucccugacccagaagguaguuaucuucauucugcucaugcuggugacgcccagcaugaccaugcggugugugggcgucgggaaccgcgacuuuguggagggcuuguccggcgccaccuggguggacgucgugcucgagcacgggggaugcgugaccacgauggcaaagaacaagcccacccuggacaucgagcugcagaagaccgaggcgacccagcucgcgacccugcguaagcuaugcaucgaggggaaaauaacuaauaucaccaccgauucucgcugccccacacagggcgaagccauccucccggaggagcaggaccaaaacuacgucugcaagcacaccuacguggauagaggguggggaaacggcugcggacucuucggcaaggggucccuggugaccugcgccaaguuccagugucucgagcccaucgaggguaaggucgugcagcacgaaaaccugaaguacaccguaaucauaacgguccacaccggcgaucagcaccagguggguaaugacacccagggggucaccguggagaucacgccucaggccuccacgguggaggccauccugcccgaguacggaacccucggccuggaguguuccccgcgcaccgggcuggacuucaacgaaaugauucuccugacgaugaagaacaaggcguggaugguccaccgacagugguucuucgaccuacccuugcccuggacgagcggcgccaccacugagacccccacguggaaccgcaaggagcuccuggugacguucaagaacgcccacgccaagaagcaagaaguggucgugcucggcucacaggagggggccaugcacaccgcacugacgggcgcuacggagauccaaaauucugggggaaccuccaucuucgccgggcaccugaagugccggcucaagauggacaaacuugagcugaagggcaugagcuaugccaugugcuugaauaccuucgugcugaagaaggaggucuccgaaacccagcacggcacgauccugaucaagguggaguacaagggggaggacgcaccgugcaagauccccuucagcaccgaggacggccaggggaaggcgcacaauggucgcuuaauaaccgccaaucccguggucaccaaaaaggaggagcccgugaacauugaggccgagccgcccuucggcgagucaaacaucgugaucgggaucggcgacaaggcacucaagaucaacugguacaagaaagggucuagcaucggaaagauguuugaggcgacggcccgcggagcccgccggauggccauccugggcgacaccgcuugggauuucggcagcgucgggggcguccugaacucgcucgggaagauggugcaccagaucuuuggguccgcuuacaccgcccucuucagcggcgucuccuggaucaugaagaucgggauaggcgugcugcucaccuggaucgggcucaacagcaagaacacguccaugagcuucuccugcaucgugauaggcauuaucacacuguaccucggggccguaguccaagcggacauggguugugugaucaacuggaaggggaaagaacuuaagugcggaucaggcaucuucguaacuaacgaggugcacaccuggacggagcaguacaaauuccaggccgacucccccaaaaggcuggcgaccgcaaucgccggggccugggaaaacggcgugugcggcauccggagcaccacccguauggagaaccuacuguggaagcagaucgcgaacgagcugaacuauauccucugggagaacaacauaaaacuuacggucguggugggggacaucaucggcguccuggagcagggcaagcguacacucacgccccagcccauggagcugaaguacuccuggaagaccuggggcaaggcgaagaucgugacggcugagacucaaaacagcucuuucaucaucgacgggccaaacacccccgagugccccagcgccucgagagccuggaacgugugggaggucgaggacuacggauucggaguguucaccacgaacauauggcugaaguuacgcgagguuuauacgcagagcugcgaccaccggcugauguccgcggcuaucaaggacgagagggccguccacgccgacauggguuauuggaucgagucccagaagaacggcagcuggaagcuggagaaggccuccuucaucgaggugaagaccugcaccuggccaaagagccacacucucugguccaacggggugcuggagagcgacaugaucauccccaaguccuuagcuggacccaucagccaacacaaccaccggccgggcuaccacacccagaccgccggccccuggcaccucgggaaacuggagcucgacuucaacuacugugaggguaccaccgucgugaucacagagaacuguggcacccgcggccccucccucagaaccaccacagugagcggcaagcugauccacgagugguguugccgcuccugcacacugcccccgcuccgguacaugggggaggacggaugcugguacgggauggaaauccgccccaucaacgagaaggaggagaacauggucaaaucccugguguccgcaggaucaggcaagauggacaauuucaccauggggaucuuaugccuggcuauccuauucgaggaggugaugcggggcaaguucgguaagaagcacaugaucgccggcguccuguucaccuucgugcuccugcuauccggacagaucacguggcgcgacauggcgcauacgcucaucaugaucggcagcaacgccuccgaccguaugggcaugggggucacguaccuggcgcugaucgccacguucaagauccagcccuuccuugcccugggcuucuuccugcgcaagcucaccagccgggagaaccuccugcucggggucggccuggccauggccacaacccugcagcuccccgaagacaucgagcagauggccaauggcaucgcucuggggcugaugacccucaagcucaucacgcaguucgagaccuaccaacuguggaccgcgcuggugagcuugaccugcuccaacacgaucuucacgcugacgguggccuggcgcaccgccacgcucauucuggccggcgucucgcugcucccgcugugccaguccagcuccaugcggaagaccgacuggcugcccaugaccguugcggcgaugggagugccgccccugccgcuuuucauuuucagccuaaaggacacccccaaaaggcguuccuggccucucaacgagggcgugauggccguggggcuggucagcauccuggccuccagccuacugcggaaugacgugcccauggccggcccgcuaguagcgggcggacuccugauugcguguuacgucaucacgggcaccuccgcggaccugacuguggagaaggccgccgaugugacaugggaggaagaggccgagcaaacaggugucagccacaaccucaugaucaccguggacgacgacgguaccaugcgcauuaaagacgacgagacagagaacauccugaccgugcugcucaagacggcguuacugaucgucuccggcaucuuuccuuacagcaucccugcgaccuuacugguguggcauaccuggcagaagcaaacccagcgguccggcgugcuaugggauguccccagcccgcccgaaacgcagaaagcggaguuagaggagggcguguacaggaucaagcagcaggggaucuucggaaagacccaggugggagucgguguccagaaggagggaguguuccacaccauguggcacgucacccggggcgccguacugacgcacaacgggaagcgcuuagagcccaacugggccuccgugaagaaggaccucaucuccuacgguggaggguggcggcuuucagcccaauggcagaagggcgaggagguccaggugauugccguagagcccggaaagaacccgaagaacuuucagaccaugccaggcaucuuucagaccaccaccggcgagaucggagccaucgcucuggauuucaagcccggcacuuccgggagcccgaucaucaaccgcgaggguaaagucgugggucuguacgguaacggcgugguaaccaagaacggaggguacguguccggaaucgcacagaccaacgcggagcccgacggacccacccccgaguuagaggaggagauguucaagaaacggaaccuuacgauuauggaucugcacccgggcucugggaagacccgcaaguaucuccccgccaucgucagagaagccaucaaacgccggcugcggacucugauccuugcccccacgagggucguggccgccgagauggaggaagcgcugaagggacugcccauccgcuaccagaccaccgccaucaagagcgagcacaccgggcgggagauaguagaccucaugugccacgccacguucaccaugcgccuauuaagcccgguccgggugcccaacuacaaccucaucaucauggacgaagcgcacuucaccgaccccgccagcauagccgcucgcggcuacauuagcacacggguggggaugggcgaggccgcagcgauauucaugacggccacgccgcccggcaccgccgaagcguucccccaguccaacgcccccauucaggacgaggagcgcgauaucccggagcgcagcuggaacuccgggaaugaguggauaaccgauuucgucggcaagaccgugugguuugugcccagcaucaaggccggcaacgacaucgcgaacugucugcggaagaacggcaagaagguuauccagcuguccaggaaaacauucgauaccgaguaccagaagacccggcucaaugacugggacuucguggucacgaccgauauaagcgagaugggggccaacuuuaaggcugaccgcgucaucgacccccggcgcugccucaagcccgucauucuuaccgacggccccgaaagagugauccucgccgguccgaugccagucaccgccgcauccgcugcgcagcgccgagggcgcgugggccggaauccccagaaggagaacgaccaguauaucuucacggggcagccacuuaacaacgaugaggaccaugcccauuggaccgaggccaagaugcugcucgacaacaucaacaccccugagggcauuaucccagcccuguucgagcccgagcgcgagaagucggccgcgaucgacggggaguaccggcugaagggcgagucccgcaagaccuucguggagcuaaugcggcgcggcgaccugccagucuggcuggcccacaaaguugcgagcgaggggauaaaguacaccgaucggaaguggugcuucgacggcgagcgaaacaaccagauccucgaggagaacauggacguugagaucuggacuaaggagggggaacggaaaaagcugaggccgagguggcuggaugcccggaccuacagugacccccucgcguuaaaggaguuuaaggauuucgccgccggccgcaagagcaucgcccuagaccuagugaccgagaucggccgagugcccucccaccuagcccacagaacccggaacgcgcuggacaaucuagucaugcuucacacgagcgagcauggcggccgcgccuaucggcacgccguggaggagcugccggagaccauggagacccucuuacugcuagggcugaugaucuuacucacaggcggggcaaugcuguuccugaucagcggcaagggcaucggaaaaacguccaucggccucauaugcgugaucguaagcuccgggaugcuguggauggcggacgugccccugcaguggaucgcgucugccaucgugcucgaguucuucaugauggucuugcugauccccgagcccgagaagcagcgcaccccucaggacaaccaacuagccuacguagugaucgggauccugacgcuggcugcaaucgucaccgccaacgagaugggacuccuggaaacgaccaagcgggaccugggcauguccaaggagcccggcgugguaagccccaccuccuaccucgacguagaccugcaucccgccuccgccuggacgcuguacgcuguagcuacgaccguuaucacuccgaugcuccgccacaccaucgaaaacagcacggcgaacgucagccuagccgcaauagccaaccaggcgguggugcugauggggcucgacaagggguggcccaucuccaaaauggaccugggcgucccccugcucgcccugggcugcuacagccaggugaacccccugacgcucaccgccgccgugcugcugcucgucacccacuacgccaucaucgggccgggccugcaggcgaaagccacgcgggaggcccagaagcgcacggccgccggcauaaugaagaaccccaccguagaugggaucaugaccaucgaccuugacccugugaucuacgauuccaaguucgaaaaacaacucggccaggucaugcugcugguucugugcgcggugcagcugcuucucaugcggacgucaugggcccugugcgaggcccuaacccucgccaccgggcccaucaccacguugugggagggauccccgggcaaguucuggaacacuaccaucgccgucucuauggcgaacaucuuccgagggucuuacuuggccggcgccggacucgccuuuagcaucaugaagucugugggcaccgggaagcggggcacgggcagccagggagagacccucggcgaaaaguggaagaagaaacuuaaccaguugagccgcaaggaguucgaccucuauaagaaauccgggaucaccgagguggaccggaccgaggcgaaggagggccucaagagaggggaaaccacgcaccacgccgucagccggggcuccgccaagcuccaaugguuuguggagcgcaacauggugaucccggagggucgggucaucgacuuggggugcggccgcgggggauggagcuauuacugcgccgggcugaagaaggugaccgaggugcgcggcuacaccaaaggcgggcccggucacgaggagcccgucccgauguccaccuacggguggaacaucgucaagcucaugagcggcaaggacgucuucuaucugccgccagagaagugcgacacgcuacugugugacaucggagaaagcucgcccagcccuaccgucgaggagagcaggacuauccgcguguuaaagaugguggagcccuggcugaagaacaaccaguucugcaucaagguacugaaccccuauaugccaaccgugaucgagcaccucgagcggcugcagcgcaagcauggcggcaugcuggugcggaacccgcucucccguaacucaacgcacgagauguacuggauuaguaacgggacuggcaacaucgucagcuccgugaacaugguaagccggcugcuccucaaccgcuucaccaugacucaccggcgacccacaaucgagaaagacgucgaccugggggcagggacccggcacgugaacgcggagcccgagaccccgaacauggacgucaucggcgagcgcaucaagcggaucaaggaggagcacucgagcaccuggcacuacgacgacgagaaccccuacaagaccugggccuaccacgggaguuaugaggugaaagcuacuggcagcgccagcucaaugauuaauggcgugguuaagcugcucaccaaacccugggacguggugcccauggucacccaaauggccaugacggacaccaccccguucggucaacaacggguguucaaggagaagguggacacccgaacaccccggcccaugcccgggacacggaaggucauggagauaaccgcggaguggcuguggcgcacacugggccguaacaaacgcccgcgccucuguacgcgggaggaguuuacuaagaaggugcgcacuaacgccgccaugggcgccguguucaccgaggagaaccagugggacagcgcccgggcagcagucgaagacgaggaguucuggaaacugguggaccgggaacgggagcugcauaagcucgggaagugcggcagcugcguguacaacaugaugggcaagcgcgagaagaagcugggcgaguucgggaaagcgaagggcucacgagccauuugguacauguggcugggggcgcgcuaccucgaguucgaggcccuaggguuccugaaugaagaccacugguucucccgggagaacagcuacuccggcgucgaaggggaaggcuuacacaagcugggcuacauucugcgcgacauuagcaagauccccgguggcgcgauguaugccgacgacacagccgguugggacacccggauaaccgaggacgaccugcacaacgaggaaaagaucacccaacagauggacccugaacaucgccagcucgcgaacgcaauauucaaacuuaccuaccagaacaagguggugaagguccagcggcccacuccgaagggcaccgugauggacaucaucuccaggaaagaccagcgggggagcggccaggugggcaccuacgggcucaacaccuucacgaacauggaggcucaguuaguccgccagauggagggcgaggggguccuguccaaaguggaccucgagaacccccaccuccuggagaaaaagaucacccaguggcucgagaccaaaggcgucgagcgauuacgccggauggccaucagcggcgacgacugcguggucaagcccaucgacgaccgcuucgccaacgcccuucucgcccugaacgacaugggcaaggucagaaaggacaucccgcaguggcagccguccaagggcuggcacgacuggcagcaggucccguucuguagucaccacuuccacgagcugaucaugaaggacgggcgcaagcuagugguccccugccguccccaggacgaacugaucggcagggcacgcauaucccagggggccggcuggucccugaaagagaccgccugccucgggaaggcuuacgcacagauguggucccugauguacuuccaccggcgcgaccuccgguuagcuagcaacgccaucugcuccgcggugccggugcacuggguaccaacgagccgcaccaccuggaguauccacgcgcaucaccaguggaugacaacggaggacaugcugacaguauggaaccggguguggauugaggacaaccccuggauggaggacaagacucccgucaccaccugggaggacgugccguaccugggcaagcgcgaggaccaguggugcggcuccuuuaucggucucacuagccgggccaccugggcccagaacauccugaccgccauccagcagguccgcucccuuaucggagacgaggaguuccucgacuacaugcccagcaugaaacgguuccgcaaggaggaggaguccgaaggggcgaucugguga

SEQ ID NO: 25927 - RNA, 9873 nt, Artificial Sequence
  derived and/or modified CDS sequence (opt11) from DENV-3__FJ744740__SS-prME
accagccugugccucaugaugauguuaccggcuacgcuggccuuccaccucaccagccgggacggggagccgcggaugaucguggcaaaaaacgagcggggaaaaagccugcuguucaagaccgcuuccggcaucaacaugugcacgcucaucgccauggaccugggggagaugugcgaugacaccguuaccuacaagugcccccugaucgcagagguggagccagaggacaucgacugcuggugcaaccucaccagcaccugggugacauacggcacgugcaaccaggccggggagcaccggcgcgacaagcggucggucgcgcuggccccccacgugggcaugggccuggacacccgcacccagaccuggaugagcgccgagggggccuggcgccaggucgagaagguggaaacgugggcgcuccgccacccgggcuucaccauccuggcccuguuccucgcccacuauaucgggaccucccugacccagaagguggugaucuucauccugcucaugcuggucacgcccagcaugaccaugaggugcgugggcguggggaaucgcgacuucgucgagggccuguccggcgccaccuggguggacguaguccucgagcaugggggcugcgugaccacaaucgccaagaacaagcccacccuggacaucgagcuucagaagacagaggcaacccagcucgcaacgcugagaaagcugugcaucgagggaaaaaucaccaacaucaccaccgacagcagaugccccacgcagggcgaggcgauacucccggaggaacaggaccagaacuaugucugcaagcacaccuacgucgaccggggcugggggaacgguugcgggcuguucggcaaagggucccuggugaccugcgccaaguuccaaugccucgaacccaucgagggcaaggugguccagcacgagaaccugaaguauaccgugaucaucacggugcacaccggcgaccagcaccaggucgggaacgacacccagggggucaccgucgagaucacgccccaggccagcaccguggaggcuaucuuacccgaguacgggacccucggccuggagugcuccccgcgcacaggccuugacuucaacgagaugauucuccugaccaugaagaacaaggccuggaugguacaccggcagugguucuucgaccugccccuccccuggacaagcggcgccaccaccgagacccccacguggaaucgcaaggagcugcuggucaccuucaaaaacgcccacgccaagaagcaggagguagugguccucggcucccaggagggggcgaugcacaccgcccugaccggcgccacggagauccagaacagcgggggcaccuccaucuucgccgggcaccugaagugccggcucaagauggacaagcuggagcugaaaggcaugagcuacgccaugugccucaacaccuucgugcugaagaaggagguguccgagacgcagcacggcaccauacugauaaaggucgaauacaagggggaagacgcgccgugcaagauccccuuuagcaccgaggacggacaggguaaggcccacaacgggcgccugaucaccgccaaccccguggugaccaagaaggaagagcccgugaacauagaggccgagccgcccuucggcgagagcaacaucgugaucggggugggugacaaggcgcucaagaucaacugguacaagaagggguccagcaucgguaaaauguucgaggccacggcucgcggggcccgccggauggccauccugggggacaccgcgugggacuucggcuccgucgggggcgugcugaacucccucgggaagauggugcaccagaucuucggcuccgccuacaccgcccuauucagcggcgucuccuggaucaugaagauaggcauaggcgugcugcucaccuggaucgggcugaacagcaagaacacuuccaugucguucuccugcauuguaaucgguaucauaacccucuaccucggggccgugguucaggccgauauggggugcgugaucaauuggaagggaaaagagcugaagugcggcagcggcaucuucgucaccaacgaggugcacaccuggacggagcaauacaaguuccaggcggauucccccaaacgccuggccaccgccaucgccggggccugggaaaacggcgucugcgggauccgcagcaccacccggauggaaaacuugcuguggaagcagaucgcgaacgagcugaacuacauccucugggagaacaacauuaagcugacggucguggugggcgacaucaucgggguccuggagcagggcaagcgcacccucacgccacagcccauggaguuaaaguauaguuggaagaccuggggcaaagccaagaucgugaccgccgaaacccagaacagcucuuucaucaucgacgggcccaacacccccgagugcccaagcgcaucccgggcguggaacgugugggaggucgaggacuacggcuuugggguauucacaacgaacaucuggcugaagcuccgcgagguguacacccagucuugcgaucaccguuuaaugagcgccgcuaucaaggacgagcgcgccguccaugcugacaugggcuacuggaucgaaucccaaaagaacgggagcuggaagcuggagaaagcgagcuucaucgaggucaaaacaugcaccuggcccaagucacacacccucugguccaacgggguccuggagagcgacaugaucauccccaagagucuggccggccccaucagccagcacaaccaccggccgggguaccacacucagaccgcgggacccuggcaccucggcaaacuggagcuggacuucaacuacugcgagggcaccacagucgugaucacggagaacugcggcacccgcgggcccucacucaggaccaccacggucuccggcaaacugauccacgaguggugcugccgcuccugcacccugcccccguugcgguacaugggggaggacggcugcugguacggaauggagauacgccccaucaacgagaaggaggagaacauggucaagagccuggugucggccggcagcggcaagguggauaacuucacgauggggauccugugccucgcgauccuguucgaggaggucaugcggggcaaauucgggaagaagcacaugaucgcgggcgugcuguucaccuucgugcuccuguugucggggcagaucacuuggcgcgacauggcccacacccuaaucaugaucggcagcaacgccuccgaucggaugggcaugggggucaccuaccuggccuugauugccaccuucaaaauccagcccuuccucgcgcugggcuucuuccuccgcaaguuaacgagccgggagaacuuacugcucggggugggccucgccauggcgaccacccugcagcuccccgaggacaucgagcagauggccaacggcauagcgcuggggcugaugacacucaagcugauuacgcaguucgagaccuaucagcuguggaccgcgcucgugagccugaccugcuccaacacgaucuucacccugacggucgccuggcgcaccgccacgcucauccuugccggcgugagccugcucccguuaugccaguccagcuccaugcgcaaaaccgacuggcugcccaugaccgucgcagccaugggggugccgccacuuccccuguucaucuuuagccugaaggacacccccaagcgccgcuccuggccccucaaugagggcgugauggccgucgggcuggucagcauccuggccuccagccuacugcggaaugacgugcccauggccggcccgcuggucgcgggcgggcuccugaucgccugcuacgugaucacgggcaccuccgccgaccugacuguggagaaggccgccgacguaaccugggaggaggaggcagagcagacgggggugagccacaaccucaugauuacaguggacgacgacggcaccaugcgcaucaaagacgacgagaccgagaauauccugaccguccugcucaagacggcccugcugaucgugagugggaucuuccccuacagcaucccggccacccuccugguguggcacaccuggcagaagcagacccagcggucuggcguccugugggacguucccucuccgcccgagacgcagaaggccgagcucgaggagggaguguaccgcaucaagcaacaagggaucuucggcaagacgcaggucggggugggcgugcagaaggagggggucuuccacaccauguggcaugucacacggggcgccguacugacgcacaacggcaagcgccuggagcccaacugggcguccgucaagaaggaccucaucagcuacggaggcggguggcggcuguccgcccaguggcagaagggcgaggagguccaggugaucgccgucgagcccgggaagaacccgaagaauuuccagaccaugcccgggaucuuccagaccacgacgggcgagaucggggccaucgcgcuggacuucaagcccggcaccucagggagcccgaucaucaaccgcgaggggaagguggugggccuguacggaaacgggguggugaccaaaaacggcggcuacguguccgggaucgcucagacuaacgccgagcccgacggccccacgcccgagcucgaggaggagauguucaagaagcguaaccugaccaucauggaccugcacccgggaagcgggaagacccgcaaguaccuaccugccaucgugcgggaggcaaucaagcgccggcuccggacccugauccucgcacccacgcggguaguggccgccgagauggaggaggcgcugaagggccugcccauccgcuaccagaccaccgccaucaaguccgagcacaccgggcgggagaucgucgaccucaugugucacgcgaccuucacgaugcgccugcugagcccgguucgggugcccaacuacaaccucaucaucauggacgaggcccacuucaccgaccccgccuccaucgccgccaggggcuacauuagcacucgggucgggaugggcgaagcggccgccaucuucaugacggccacuccgcccggcaccgcggaggccuucccucagucgaacgcccccauccaggacgaggagcgugauauccccgagagaagcuggaacuccgggaacgaguggaucaccgacuucgugggcaagacggucugguucgugcccagcaucaaagccgggaacgacaucgccaacugccugcggaagaacggcaagaaagugauccagcugucgcguaagaccuucgacacggaguaccagaagacccggcucaaugacugggacuucguggucacgaccgacaucagcgagaugggggcgaacuucaaggccgacagggugaucgacccccggcgaugccugaagcccgucauccucaccgacggccccgaacgggucauccucgcuggcccgaugcccgugaccgcggccuccgcggcccagcgccguggacgcgugggccguaacccucagaaggagaacgaccaguacaucuucacggggcagccccugaacaaugaugaggaccacgcgcacuggaccgaggccaagaugcugcucgacaacaucaacaccccggagggcaucaucccggcccuguucgaacccgaacgcgaaaaguccgcggccauagacggggaguaccggcuaaagggcgagagccggaagacuuucgucgagcucaugcggcgaggcgaccugccaguguggcuggcccacaaggucgccagcgaggggaucaaauacaccgaccggaaguggugcuucgacggcgagcgcaauaaccaaauccucgaggagaacauggacguggagaucuggacgaaggagggggagcggaagaaguuacgcccgagauggcuggacgcgcggaccuacuccgacccccucgcccugaaggaguucaaggacuucgcugccggccgcaaaucgaucgcccuggaccucgugaccgaaaucggccggguccccucgcaccuagcgcaccgcacccggaacgcccuggacaaccuagugaugcuucacaccagcgagcacgggggcagagccuaccggcacgccguggaagagcucccggagaccauggagacccuccuucugcucggccugaugauccugcucaccggcggggccaugcuguuccugaucucuggcaagggcaucgggaagacgucgaucggucucaucugcgucaucgucucauccgggaugcucuggauggcggaugugccccugcaauggaucgccagcgcgaucguccucgaguucuucaugauggugcugcugauccccgagccugagaagcagcgcaccccgcaggacaaccaacucgccuacguggucaucggaauacugacccuggccgcgaucgugaccgccaacgagaugggccuccuggagacgaccaagcgggaccugggcauguccaaggagcccggcguagugagccccaccuccuaucucgacguggaccugcaccccgccagcgccuggacccuguacgccguggcgacgacugugaucaccccgaugcuccgccacaccaucgagaacuccacggccaacgugagccuggcagccaucgcaaaccaggccguuguccucaugggccucgacaagggcuggcccaucuccaagauggaccugggggugcccuugcucgcccuggggugcuacagccaggugaacccgcugaccuugaccgcugccguccugcugcucgugacccauuacgcgaucauagggccgggccugcaggccaaagccacgcgggaggcccagaaacgcaccgcagcgggcaucaugaagaaucccaccguggacggcaucaugaccaucgaucuggaucccgucauauacgacagcaaguucgagaaacagcucggccaggugauguuacugguguugugcgccguccaguugcugcucaugcgcacgagcugggcccugugcgaagcccugacccucgccaccgggcccaucaccacgcugugggagggcuccccgggcaaguucuggaacaccaccaucgcgguuucuauggccaacauuuuccgcggguccuaccuggccggcgccgggcuagcuuucagcaucaugaaauccgucgggaccgggaagcggggcacgggcagccaaggggaaacccugggcgagaaguggaagaagaagcuaaaccagcucagccgaaaggaguucgaccucuacaagaaguccgggaucaccgaggucgaccggaccgaggccaaggagggucuaaagcgcggugagaccacgcaccacgccgugucacggggcuccgcgaagcuccaaugguuuguggagcgcaacauggucauccccgagggccgggugaucgaccuggggugcggccgcgguggauggagcuacuacugcgccgggcugaaaaaggugaccgaggucaggggcuacaccaaaggcgggcccggucacgaggagcccgugccgauguccaccuacggguggaacaucgugaagcucaugagcgguaaggacguauucuaccugccacccgagaagugcgacacgcugcugugcgacaucggggaaucuaguccaucgccgaccguggaagagagccggaccauacgcgugcucaagaugguggagccauggcugaagaacaaccaguucugcaucaaggugcugaaucccuacaugcccaccgugauugagcaccucgagcggcugcagcgcaagcacggcgggaugcucguccggaacccgcucucccgaaacagcacgcacgagauguauuggaucuccaacgggaccggcaauauagugagcuccgugaacauggucagccgucugcugcucaaccguuucacgaugacccaccggcgccccacgaucgagaaggacgucgaccugggggcgggcacccggcacguaaacgccgagcccgagaccccgaacauggacgugaucggagagcgcaucaagcggaucaaggaggagcacuccagcaccuggcacuacgacgacgagaaccccuacaagacuugggccuaccacggguccuacgaggugaaagcaaccggcagcgcaagcuccaugaucaacggagucgugaaguugcucaccaagcccugggacgugguccccaugguaacccagauggcaaugacugacaccaccccguucggccagcagcgcguguucaaagaaaaggucgacacacggacgccccgccccaugcccgggacccggaaggugauggagauaaccgccgaguggcucuggcgcacuuuaggccggaacaagcggccccgccucugcacgcgggaggaguucaccaagaagguucgcaccaacgccgccaugggcgccgucuucaccgaagagaaccagugggacagugcucgggccgccguggaggacgaggaguuuuggaaauuaguggaccgagagcgggagcugcacaaacucgggaagugcggcucaugcguuuacaacaugauggggaagcgcgagaagaaguuaggcgaguucggaaaggccaagggcagccgcgcgauuugguacauguggcugggcgcccguuaccucgaauucgaagcccugggauuccugaacgaggaccacugguucuccagagagaacagcuacagcgguguagagggggaaggccugcacaaacugggauacauacugcgcgacauuagcaagauucccggcggcgccauguacgccgacgacacggcggggugggacacucggauuaccgaggacgaccuccacaaugaggagaaaaucacccagcaaauggaccccgagcaccgccagcuggcaaacgccaucuucaaacugacguaccagaacaagguggugaagguacagcggcccacgccgaaggggaccgugauggacauaaucucccgcaaagaccagcgugggagcggccaagucggcaccuacggacucaacacguuuacgaauauggaggcucaguuggugcgccagauggagggcgagggggugcuguccaaaguagaccucgagaacccccaccuccuggagaaaaagaucacccaguggcucgagacgaagggcguagagcgacugcgccggauggcgaucagcggggacgauuguguggucaagccaaucgaugaucgcuucgcgaacgccuuauuagcccugaacgacaugggcaaggugcgcaaggacaucccucaguggcagcccuccaagggcuggcacgacuggcagcaggucccuuucugcucgcaccacuuucacgagcugaucaugaaggacgggaggaaguuagucgugcccugccgcccacaagacgagcugaucggccgggcucgcauaucccagggggccggcuggagccugaaggagaccgcgugccucggcaaggccuacgcccagauguggucccugauguacuuccaccggcgcgaucugagauuggccagcaacgccaucugcuccgcagugccgguccauugggugcccacgagccgcacgacauggagcauucacgcccaccaccaguggaugaccacggaggacaugcugaccguguggaaccgggucuggaucgaggauaaccccuggauggaggacaagacccccgugaccacgugggaggacgugccauaccugggcaaacgagaagaccaguggugcggcuccuugaucgggcugaccagccgggccaccugggcccagaauauccugaccgcgauacagcagguccgaagucucaucggagacgaggaguuccuggacuacaugcccagcaugaagcguuuccgcaaggaggaggaguccgaaggggccaucugguag

SEQ ID NO: 25928 - RNA, 9873 nt, Artificial Sequence
  derived and/or modified CDS sequence (opt11) from DENV-3__GQ868593__SS-prME
accagccuuugccucaugaugaugcugccggcuacacuggcguuccaucuuacuagccgggacggcgaaccccggaugaucguggggaagaacgaacgcggcaagucgcugcuguucaagaccgcgucggggaucaacaugugcacccucaucgcgauggaucucggagagaugugugacgacacagugacguacaagugcccccacauugccgagguggagcccgaggacaucgauugcugguguaaccugacaucuacguggguuaccuacgggaccugcaaccaagccggcgagcaucggcgcgacaagcgguccguugcccucgcgccccacgugggcauggggcuggacaccaggacucagaccuggaugagcgccgagggcgccuggagacaggucgagaagguggaaaccugggcgcugcgccaccccggauuuaccauccucgcgcuuuucuuggcccacuacaucggcacuucccuaacccagaagguggugaucuucauccugcugauccucgucacccccagcauggccaugcggugcguggggguagggaaccgcgacuucgucgagggcuuguccggugccaccuggguggacgugguccuggagcacggcgggugcgugaccaccauggccaagaacaagccgacacuggacaucgagcugcagaagaccgaggcuacccagcuggccacccuccggaagcugugcaucgagggcaagaucacaaacauuacaaccgacagccgcugcccaacccagggcgaagcgaucuugcccgaggagcaagaucagaacuacgugugcaagcacacguacguagaccgcggguggggcaaugggugcggcuuguucgguaagggcucccuggugaccugcgcuaaguuccagugccuggagagcaucgaaggcaaggugguccagcacgagaaccucaaguauaccgugaucaucaccgugcacacgggagaucagcaccaggucggcaacgagacccagggagugaccgccgagaucacgccccaggcguccacaguugaggccauccuccccgaguauggcacccucgggcucgagugcagcccacgcacuggcuuagacuucaaugagaugauccugcucaccaugaagaacaaggccuggauggugcaccggcagugguucuucgaucugccgcugccuuggaccuccggcgccaccaccgagacccccaccuggaaccgcaaggagcuucuggugacguucaagaacgcccacgcgaagaagcaggagguagugguucuggggagccaggagggagccaugcacacagcccucaccggagccaccgagauccagaacuccggcgggacgagcaucuuugccggccaccugaagugccgguugaagauggauaagcucgagcugaaggggauguccuacgcgaugugccugaacaccuucguccucaagaaggaggugagcgaaacccagcacgggaccauccugaucaagguggaguacaaaggcgaggacgcuccauguaaaauccccuucagcaccgaggacgggcagggcaaggcccacaacggacgccugauuaccgcaaaucccgucgugaccaagaaggaggagcccgugaauaucgaggcggagcccccguucggggaguccaacaucguaaucggcaucggagacaaggcccuuaagauuaacugguacaagaagggcagcucaaucgggaagauguucgaagccacagcccggggcgcccgccggauggcgauucucggcgacacggcgugggacuucgggagcgugggcggugugcugaacucccugggcaagaugguccaucaaaucuucgggagcgccuauaccgccuuguucuccggcgugucuuggaucaugaagaucggcaucggggugcugcuaaccuggaucggcuugaacuccaagaacaccagcauguccuuuagcuguaucgccauugggauaaucacguuguaccugggcgccgugguucaggccgacauggggugcgugauuaacuggaagggcaaggaacucaagugcgguagugguaucuuugucacaaaugaggugcacacguggaccgagcaguacaaguuccaggccgacagccccaagcgccuggccaccgcuaucgcgggcgccugggagaacggggugugcggcauccgcucuaccacccggauggaaaaccugcucuggaaacagaucgccaaugagcuaaacuacauccugugggagaacaauaucaaauugacagucguggugggggacaucaucggcguccuugagcagggaaagcguacgcucacaccccagcccauggaguugaaguauagcuggaagaccugggggaaggcgaagaucgucaccgcggagacgcagaacuccagcuuuaucauagacggaccgaacacccccgagugcccgagugccagcagggccuggaacgugugggagguggaggacuacggguucggaguguucaccaccaacaucuggcugaagcugcgcgagguguauacgcagcucugcgaucaccgguuaauguccgccgcggucaaggacgagcgagcggugcacgccgacaugggcuacuggaucgagagucagaagaacgggagcuggaaacuggaaaaggccuccuugaucgaggugaagaccugcaccuggcccaagucgcacacccucugguccaacggcgucuuagagagcgacaugauaaucccgaagucccucgccggaccaaucagccagcacaaccaucggccgggcuaccacacccagacggccggcccguggcaccugggcaaacuggagcuagacuucaacuacugcgaggguacaacugucgugaucaccgaaaacugcgggacgcgcggcccgucccugcggaccaccacggucagcgggaagcugauccacgagugguguugccgcuccugcacgcugccaccccuccgguacaugggcgaagaugggugcugguacggcauggaaaucagacccaucaacgagaaggaagaaaacauggucaagagucuggcguccgccgggagcggcaagguggauaacuucaccaugggggugcucugccuggccauccuguucgaagaagucaugcgggguaaguucggcaagaagcauaugaucgccggggugcuccugaccuucgucuuacucuuauccggacaaauuaccuggcgcgauauggcacauacguugaucaugaucggaucgaacgcuuccgaccgcauggggaugggcgugaccuaucucgccuuaaucgccaccuucaaaauccagccguuccuggcucucggguuuuuccugcgaaagcugaccagccgugaaaaccuccugcuaggcgugggcuuagcgauggccacgacccuucagcugcccgaggacaucgagcagauggccaacgggaucgcccucggccugauggcccuaaagcucaucacccaguucgaaaccuaucagcuguggacugcgcuggucagccugaccugcuccaacaccauuuucacccugacaguggccuggcgcaccgccacccugaucuuggcgggggugagccugcuccccgugugccaauccuccuccaugcggaagaccgacugguugccgauggccguggcggccaugggcgugccgcccuuaccgcuguucaucuucagccucaaggacacacugaagcgccgcuccuggccgcuuaaugagggugugauggccgugggauuagucagcauccuggccuccucacuguuacguaacgauguucccauggcuggcccccuaguggccggcgggcugcucaucgccugcuacgugaucacugggacguccgcugaccugaccguggaaaaagccgccgaugugacuugggaagaggaggcggaacagaccggggucagccauaaccugaugaucaccguggacgacgacgguacgaugcgcaucaaggacgaugagacggagaauauccucaccgugcugcugaagaccgcucuccugaucguuuccggcaucuuccccuacagcauuccggccacccuucucguguggcacaccuggcagaagcaaacgcagcggagcggcgugcuaugggacguccccuccccgcccgagacccagaaggccgagcuugaggaggggguguaccggaucaagcagcaaggcaucuucgggaagacccaggugggcgucggggugcagaaggagggaguguuccacaccauguggcacgucacgcggggcgcaguccucacccacaacgguaagcgccuggagccgaacugggcguccgugaagaaggaccugauuucguacggagggggcuggcggcuguccgcccaauggcagaagggagaggagguccagguaaucgccguugagccuggcaagaacccaaagaacuuccaaaccaugcccgguauauuccagacaaccaccggggagaucggagccauagcgcucgacuucaagccugguacaagcggcagucccaucaucaaccgcgagggaaaagucguagggcuguacggcaacggaguggugacaaagaacggcggguacgugagugguaucgcucagacgaacgccgaacccgacggcccgacccccgagcucgaggaggagauguucaagaaacggaaccuuaccaucauggaccugcacccggggagcggaaagacucgcaaguaccugcccgccaucguccgagaggccaucaagaggcggcuccguacgcugauccuggcgccuacccgggucguggccgccgagauggaggaggcacucaaggggcuuccaauccgcuaccagaccacagccacgaaguccgagcacaccggccgggagaucguggaucugaugugucacgcgacauucaccaugcgccuccugagccccguucggguucccaacuacaaucucaucaucauggacgaggcccacuucacggacccggcuuccaucgcagcacgcggguacaucagcacccgggugggcaugggcgaggccgccgccaucuucaugaccgccacgccgcccgggacggcggacgccuuuccccagagcaacgccccgauccaagacgaggagcgagacauccccgagcgcagcuggaacuccgggaacgaguggaucaccgacuucgucgggaagacugugugguucguucccagcauuaaagccggcaacgacaucgcuaacugccugcggaaaaacggcaagaaggucauccaacugagucgcaagaccuucgacacggaguaccaaaagaccaagcugaacgacugggacuucgucguaaccacagacaucagcgagaugggcgcgaacuucaaggccgaccguguaaucgacccccgccggugccucaaaccgguuauccucacagacgguccagagcgugugauccucgcgggucccaugccggucaccgccgccuccgcggcccaacggcgcggacggguggggcgcaacccgcaaaaggagaacgaccaguacauauucaccggccaaccgcucaacaacgacgaggaucacgcccacuggaccgaggccaagaugcuucuggacaacaucaauacgcccgaggggaucauccccgcccucuucgagccagagcgggagaaauccgccgccaucgauggcgaguaccgacugaaaggcgaaucucggaagaccuucguggaacugaugcgcagaggggaccuccccgucugguuggcccauaaaguggccagcgagggcaucaaguacaccgaccgcaaguggugcuucgacggggagcggaacaaccagauccuggaggagaacauggauguagaaaucuggaccaaggagggcgagaagaagaagcuccgcccccgguggcuggacgcgcgaaccuacuccgacccacuggcccuaaaggaguucaaggacuucgccgccggaagaaagagcaucgcucuggaccuggugacugagauagggagagugccgucccaccucgcgcaccgcacccgcaacgccuuggacaaccuggucauguuacacaccagcgagcauggcggucgcgccuaccggcacgccguggaggagcugccugaaaccauggaaacucuguugcugcugggccugaugauccugcugaccgggggcgccaugcuguuccugaucagcggcaaagggaucggcaagacauccaucgggcugaucugcgugaucgcgagcuccggaaugcucuggauggccgacgucccucugcaauggaucgcgagcgcaaucgugcuggaguucuucaugauggugcuccuaaucccggagccugagaagcagcgcacgccccaggauaaccagcuggccuacgucgugaucggcauucuaacgcuggcggccaucguggccgccaacgagaugggucugcucgagacuaccaagcgggauuuaggcauguccaaagagcccggugucgugaguccgaccuccuaccuggauguggaccuccacccagcgagcgcuuggacacuuuacgcggucgcaaccaccgugauaacccccaugcugcgccacacgauugagaacagcaccgcgaacgugagccucgcggccaucgccaaccaggccguuguucugaugggacuggacaaggguuggccgauaucaaagauggaccucggcgugccgcuucuugcccuugggugcuacagccaggucaacccacugacccugacagcagccgugcugcugcuggcaacgcacuacgccauaauuggcccuggccuccaggccaaggccacgcgggaggcccagaaacgcaccgccgccgggaucaugaaaaacccuaccguggacgggaucaugacgaucgaccuggacccgguuaucuacgacaguaaguucgagaagcagcugggccaggucaugcuccuugugcugugcgcgguccagcuccugcugaugcggacuuccugggcgcucugcgaggcccugacccuggccaccgggcccauuacgacccucugggagggaucccccgggaaguucuggaacaccaccaucgccguuagcauggcuaacaucuuccgcggcuccuacuuagcgggggccggccuggccuucagcaucaugaaaagcgugggaacaggaaagcgggggaccgggucccagggcgagacccucggggagaaguggaagaagaagcugaaccaacugucgcgcaaggaguuugaccucuacaagaaauccggcaucaccgaagucgaccggacggaggccaaggaggggcuaaagcgcggcgagaucacucggcacgcggugagccgcggcuccgccaagcugcagugguucguggagcggaacauggucauccccgagggacgcguaaucgaccucggcugcggccgaggcggguggucuuacuacugcgcuggccugaaaaaggugaccgagguaagaggcuacaccaagggcgggccgggacacgaggaacccguacccaugucuaccuacggcuggaacaucgucaagcugaugagcggcaaagacgucuuuuaccugcccccggagaagugcgacacgcuccuuugcgacaucggcgaguccagccccucccccaccguggaggagagcaggacuauccggguacugaagauggucgagccguggcucaagaacaaccaguucugcaucaaggugcugaacccguacaugcccacggugauugagcaccuggagcgccuucagcggaagcauggagggaugcuggucagaaacccccugucccggaacucgacgcacgagauguacuggaucucuaacggcaccgggaacauuguaagcucggugaacauggucagcagacuccugcugaaccgguucaccaugacccaccgccgaccuacgaucgagaaggacgucgaucucggcgccgguacgcgacacgugaacgccgagccggagaccccaaacauggacgucauuggggagcgcaucaagcgcauuaaagaggagcacaacucaaccuggcacuacgacgacgagaaccccuacaaaacgugggcguaccacggcagcuacgaggugaaggccaccggguccgccagcagcaugaucaauggcgucgucaagcugcugaccaagccuugggaugugguucccauggugauccaaauggccaugacggacaccacgcccuucggccagcagaggguguucaaggagaaggucgacacccgcacuccccgaccgaugcccggcacacgcaagguuauggaaauuaccgcggaauggcucuggcggacccugggucggaacaagcggccccgccucugcacccgagaggaguuuacgaagaaggugcggaccaaugccgcaaugggcgccgucuucaccgaagaaaaccagugggacuccgcccgcgcggccguggaggacgaagaguucuggaagcucguugacagggagcgcgaguuacacaaacuugggaagugcggaagcugcgucuacaacaugaugggcaagcgcgagaagaagcucggggaguucggcaaagcgaagggcagccgcgccaucugguacauguggcugggagcccgguaccuggaguucgaggcgcucggcuuccugaacgaggaccacugguucagccgcgaaaacagcuacagcggcguggagggcgaggggcuucacaaauugggcuacauccuccgggacauuucgaagaucccgggcggggcuauguacgccgacgacaccgccggcugggacacgcgcaucaccgaggacgaucugcacaacgaggagaagaucacccagcagauggacccggagcaccggcagcucgccaacgcaaucuucaaacugaccuaccaaaacaagguggugaaggugcagcgccccacuccgaaggggaccgugauggacaucaucaguaggaaagaccagagaggcaguggccaggucgggaccuauggccugaacacguucacgaacauggaggcccagcucgugcggcagauggagggggagggcgugcugucuaaggccgaccuggaaaacccgcaccuacuggagaagaagaucacgcaguggcuagaaacuaaaggggucgagcgccuuaagagaauggccauuuccggggacgacugcguggugaagccgaucgacgaucgcuucgccaaugcauuacuggcccucaaugauauggggaagguucguaaggacaucccccaguggcaacccagcaaaggguggcacgacuggcaacaggucccuuucugcucccaccacuuccacgagcugaucaugaaggauggccgcaagcugguggugccuugccggccccaggacgagcucaucgggcgcgcucgcaucagucagggcgccggguggucccugaaggagacagcgugucugggcaaagccuacgcccagauguggagcuugauguauuuccaucggcgcgaccuucggcuggcgucuaacgcuaucugcagcgcgguacccgugcacuggguaccuaccucccgcacgaccuggagcauacacgcccaccaccaguggaugacaaccgaagacaugcucacgguguggaaccgaguguggaucgaggacaacccuuggauggaggauaagacccccguuaccaccugggaggacguucccuaccugggcaagcgcgaggaccagugguguggcagccugaucggccucacaucccgggccaccugggcccagaacauccugacagccauccagcagguccgcagccuaauagggaacgaggaguuucucgacuacaugcccucuaugaagcgcuucaagaaagaggaggagagcgaaggcgcgaucugguga

SEQ ID NO: 25929 - RNA, 9873 nt, Artificial Sequence
  derived and/or modified CDS sequence (opt11) from DENV-3__FJ898459__SS-prME
accagccuaugccugaugaugauccuaccagcggcacucgcauuccacuuaaccucaagggacggggagccccguaugaucguugggaaaaaugaacguggcaaaucacuccuguucaaaaccgcaucagggaucaauaugugcacccuuauagcuauggaucuaggcgagaugugugacgacacagugacguacaaaugcccacauaucacugagguagagccagaggauauagauugcuggugcaaucuuacaucaacgugggucacauacggcacaugcaaccaagcuggagaacacagaagagauaaacguucagucgcgcuagccccacaugucgguaugggacucgacacuagaacgcaaacuuggaugucagcagagggggcauggcgacagguggaaaaagucgaaacaugggccuuaaggcaucccgguuucacuauucuggcacucuuccucgcacacuauauuggaacgagucuaacgcaaaaaguagugaucuuuauacugcuaaugcucguaacgccaaguaugaccaugagaugcgucggcgugggaaacagggacuucgucgagggccuuagcggggccacauggguagacgucgugcuagagcacggaggguguguaacaacaauggcgaaaaacaaaccgacauuggacauagaacuucagaaaacggaggcaacacagcuggccacacuacgcaaauugugcauugaaggcaaaauaacaaauaucacaaccgacaguagaugcccaacucagggcgaagccgugcugccugaagaacaagaccaaaacuacgugugcaagcacaccuaugucgacagagggugggggaacggaugcggccuauuugggaagggcagucuaguaaccugugccaaauuccagugccucgaaccgauagaaggcaaaguuguacaauacgaaaacuuaaaauacacagucauaauaacgguucauacaggcgaccagcaucaagugggcaacgaaacgcagggaguaacagcagagauuacaccccaagcauccaccacagaggcaauacugccugaauacgggacgcucggcuuggagugcucgccccgcaccggccucgacuucaaugaaaugauacucuugacaaugaaaaacaaagcauggaugguacacagacaaugguucuucgaucugccccuacccuggacaucaggggccacaacagaaacaccuaccuggaacagaaaggaacuccuaguaacauucaagaacgcgcacgcuaagaagcaagaagucguagucuuagggucacaagagggcgcgaugcacacagcccuaacgggugcgacagaaauccaaaauagcggagggacgucaaucuucgcgggccaccuaaagugcagacugaagauggacaaacucgagcucaaagggauguccuacgccauguguacuaacacauucguccucaagaaggagguaagcgaaacccaacacggcaccaucuugauaaagguagaguacaagggagaggacgcgcccugcaagauaccauucagcacugaggaugggcaaggaaaggcccacaacgggagacucauaacggcgaacccaguagucacuaagaaagaagaacccgugaacauagaagcggagcccccauuuggugaaagcaauaucgucauagggauuggagacaacgcgcucaagauaaauugguacaagaaagggagcucaaucgggaaaauguuugaagccacagcacggggagcacgucggauggcuauccuaggcgauacggccugggacuucgggagcguaggagggguacugaacucguuggggaagauggugcaucaaauauucgggagcgcauacaccgcacuguucucaggcgugagcuggguaaugaagauaggcaucggcguccugcugaccuggaucggucugaacaguaagaacacgagcaugagcuucagcuguaucgccaucggaauaauaacccuguaccucggggcgguaguucaagcugacaugggcugcguuauaaacuggaagggcaaagaacuuaaaugugggaguggaauauucguuacaaaugaggugcacaccuggaccgagcaguacaaauuucaagccgauagccccaagcgccucgccacagccauagccggggcgugggagaacggcgucuguggcauacggagcacgacccgaauggagaacuuacuuuggaaacaaaucgcgaacgagcucaacuacauccugugggaaaacaacauaaaacucaccgucgucgucggcgauaucaucggaguacucgagcagggcaaacggacacucacaccgcagccaauggagcugaaguacucauggaaaacauggggaaaagccaaaauagugaccgccgagacacagaauagcucuuucauaaucgacggucccaauacuccagaauguccaagugcaucccgugcuuggaacgugugggagguugaagauuacggcuucggcguauucacaaccaacaucuggcucaagcugagagagguguacacacaacuaugugaccauagacucaugagcgcagcgguaaaagacgaacgcgcgguacaugcagacaugggguacuggaucgaaagccagaaaaacggcuccuggaaacuggagaaggcuucacuaauagaaguuaagacuuguaccuggcccaaaucacacacccucugguccaacggcguccuggaaucugacaugauaauaccgaaaagccuagcagggcccaucucccaacauaaucauaggcccggcuaccauacacagaccgccggccccuggcaccuuggcaaacucgaacuagacuucaauuacugugaggguacaacagucgucaucaccgaaaacuguggcacccgcggaccaagccuacggaccaccacagucagcggcaaacucauacacgaguggugcugcagauccuguacccucccuccacuccgcuacaugggcgaggacggcugcugguauggcauggaaaucagacccauaagcgaaaaagaggagaacauggucaaaucauuaguaucggccggauccgguaaagucgacaauuucacgaugggcguacucugccucgcgauucucuuugaggaggucaugagaggcaaguucggaaagaaacacaugaucgcaggcguauucuuuacauucguccuacucuugaguggccagaucacauggcgugacauggcacacacgcugauuaugauagguaguaacgcgagugacagaauggguauggggguaacauaccuagcacugaucgcgaccuucaagguccaaccguuccucgcucucggguuuuuccuaagaaagcuaacuagccgagagaaucuccuccucggagugggacuggcuauggccacgacucugcaguuaccggaagacauagagcagauggcgaauggcaucgcccuaggccucauggcacucaaguuaauaacgcaguucgaaaccuaccaacuuuggaccgcgcucaucucucuaaccugcuccaacacaauguucacccuaacaguggcauggagaacggccacgcuaauccuagcaggaguaucgcucuugccggugugucagaguagcaguaugcguaagacagacuggcucccaauggccgucgcggcaaugggcgugccaccacuaccucuguucauauuuagccucaaagacacucucaaacgaagaucauggccucuuaacgaggguguuauggccgucggacuggugagcauccuagcaucaucgcugcugcgcaacgacgucccuauggcuggcccauugguggccgguggccuacuaaucgcauguuauguaaucacugguacgagugccgacuuaacggucgaaaaggcugcugacaucacaugggaggaagaagcugaacaaacaggggugagccacaacuuaaugauaacagucgacgacgacggaacuaugcgaauaaaagacgacgagaccgaaaacauccuuacagugcuauugaagaccgcauugcuuaucgugagcggaguuuucccauacucgaucccagcaacccuccuuguauggcacacauggcaaaaacaaacccaacggucuggaguacuaugggacgugccauccccaccagagacgcagaaggcagagcucgaagaagguguauaccguauaaaacaacaaggaauauuuggcaagacucaggugggggucggcgugcagaaggaaggugucuuccacacgauguggcacgucacuagaggugcaguccuaacguacaacggaaaacgacucgagcccaacugggcaagcgucaagaaagaccuaauuagcuacggaggaggauggcgacucucagcccaauggcaaaaaggagaagagguccaagugauagcuguugagccggggaaaaaccccaaaaacuuccagacuaugccgggaacauuucaaaccacgaccggugaaauuggcgccauugcguuggacuucaaaccgggcacaucaggcaguccgaucauaaaucgagagggaaaaguaguaggccuguacggcaacggcguggugacaaagaacggcggauaugucucuggcauagcgcagaccaaugccgaacccgacggaccgacccccgagcuagaagaggaaauguucaagaaaaggaaccucacaaucauggaccuacacccgggauccgguaaaacacgaaaauaccugccagccaucguaagagaagcgaucaaacggcgguuacgaacacuaauccucgcaccaacacgagucgucgcggcugagauggaggaagcccuaaaaggcuuaccaauacgguaucagaccacagcaacgaaguccgaacacaccggucgagagaucguugaccuaaugugccaugcgacguucacaaugaggcuacucucaccaguuaggguaccaaacuacaaccuaaucauaauggacgaagcacacuucacggacccggcauccauugcagcaagaggguauaucagcacgcguguggggaugggugaagcagcugccauauuuaugaccgcaacaccaccggguaccgccgaugcguuuccccaaucaaacgcaccaauacaagacgaagaacgagacauuccagagcguucauggaacucagguaacgaauggauaacagacuuugcaggcaaaaccguaugguuugucccgaguauaaaagcugggaacgauaucgcuaacugucuccgcaaaaacggcaagaaggucauacaacucagcaggaagacauuugauaccgaauaccaaaagacuaaacuuaaugacugggacuuuguggucaccacggauauaucagaaaugggagccaacuucaaagcagaccgggugaucgacccgaggcggugucucaaacccguaauccuaaccgacggcccugaacgggugauccucgcgggcccgaugccugucaccgccgcaagcgcggcucagcggagggguagagucggacgcaacccacaaaaagaaaacgaccaauacauauuuacgggccaaccauuaaacaacgacgaggaccacgcucacuggacagaggcgaaaaugcugcucgacaacaucaacacgccggaaggaauaauuccugcacucuucgaaccggaaagggagaaaagcgcggcaauagauggggaauaccgccuaaagggugaaucccgaaaaaccuucguagaacugaugagacgaggcgaucucccuguuuggcuugcgcacaaaguggcaagcgagggcauaaaauacacagaccgcaagugguguuuugacgggcagaggaacaaucaaauccucgaagaaaauauggauguugaaaucuggacgaaagagggugaaaagaaaaagcuaagacccagguggcuagacgccaggacuuacagcgacccacuggcacugaaggaguucaaagacuuugcagcgggacgcaaguccaucgcccuugaucuuguaacggagauaggaagggucccuagucaccuagcacauagaacccgcaacgcacuagacaaccuagugauguugcauacaagcgaacacggaggccgggcauaccggcacgcgguagaagaacuaccagaaacgauggagacacuacuguugcuuggacuaaugauacugcuaacuggcggggcaauguuauucuuaaucagcggaaaagggaucgggaaaaccucgauagggcuaaucugcgucauagccucuucaggcaugcuguggauggcagaaaucccgcuccaauggauugccucagcaauaguccuggaguucuucaugaugguacuucucaucccagagcccgaaaagcagcgaacaccucaagacaaccaauuagccuacgugguaauagggauacuaacccucgcggccauaauagcagcgaacgaaauggggcuacuagaaaccacgaaaagagaccucgggaugucgaaagaaccgggugucguaucccccaccucauaccuggauguagaccuccauccggcgucagcauggacucuuuacgcagucgcuacaacagucauaaccccuaugcuccgccacacgaucgaaaacuccacagcaaaugucucccuagccgcaauugcaaaccaagccguggugcugauggggcucgauaaaggauggcccauaucuaaaauggaccugggcguaccacuccucgcacuaggguguuauagucaagugaacccccuuacccucaccgcagcuguacuacuccugauaacacacuacgccauuauaggucccggacuccaggccaaagcaaccagagaagcacaaaagcgaacagcagcgggcauuaugaaaaaccccaccguggacgguauaaugacaauagaccucgauccuguaauauacgacagcaaauucgagaagcaacuaggacaaguaaugcuccuaguacuaugugccguacagcugcuucuuaugaggaccaguugggcauugugcgaggcacucacccucgccaccggaccgauaacgacccucugggaggguagcccagguaaauucuggaauacgacaaucgcggucagcauggcaaacaucuucaggggaucguaucucgccggugcggggcuggcauucaguauaaugaagucagucggaacggggaaacgagggaccgggagccagggcgaaacccucggugagaaguggaagaagaaacucaaucagcucucgcguaaggaguucgaccuauacaagaaauccggaaucacagagguggaccguaccgaagccaaggaaggccuuaaacguggagaaaccacccaucacgcaguuucccgcggaucugcaaaacugcaaugguucguagagaggaacauggugauuccggaggguaggguaauagaccuugggugcgggagagguggguggagcuauuacugcgccgggcucaaaaagguaaccgaaguacgaggcuacaccaaaggagggccaggacacgaggaaccagucccaaugaguacguacggauggaauauaguaaaauugaugucgggcaaagacguguucuaccugccgcccgaaaaaugcgacacccuacucugugacaucggggagaguucaccaaguccgaccgucgaagaaagucguacaauccgaguccuaaaaaugguggagccauggcuuaaaaauaaucaguucugcauaaaaguucucaaucccuacaugccgacagugaucgaacaccuagaaagacuccagcgaaaacacggcggaaugcucgucaggaacccacugucaaggaacagcacccacgaaauguauuggauauccaacggaacaggaaauauagucgcaucugugaacaugguaucacgccuacuauugaacagguucaccaugacacauagacgccccacaauagaaaaagacguugaccuaggcgcgggaacccggcacguuaacgcggaaccagagacuccaaacauggauguaauaggugaacggauaaagagaauaaaagaggaacacaacagcaccuggcacuacgacgacgaaaaccccuacaaaaccugggccuaccacgguuccuacgaggucaaagcuacgggaucagcuucaagcaugaucaauggaguuguaaaacucuugacuaaacccugggacguggugcccaugguaacacaaauggcaaugaccgacacgaccccauuuggccagcagcgggucuucaaagaaaaagucgacaccaggacgccaagguccaugccagguacacgccgggugauggguaucacagcagaaugguuauggaggacucucggccggaacaagaaaccacgacucuguacacgcgaagaguucaccaagaaagugcgcaccaacgcggcaaugggugcgguauuuacagaagaaaaccaaugggacucagccaaagcagcagucgaagaugaggacuucuggaagcucguagauagggagcgggaacuacauaaacucgguaagugcggcucgugcguauacaacaugaugggaaaacgggagaagaaacugggagaguucggaaaagccaaaggauccagagcgauaugguacauguggcucggagcuagauaccucgaguucgaggcgcuugguuuccuaaacgaagaucacugguucucgcgagaaaauucguacuccggcgucgaaggagagggacuccacaaacuaggcuacauacugagggacaucaguaaaauccccggcggagcgauguacgcggacgacacggcagguugggacacaaggauuacggaggaugaucuccacaacgaagaaaagauaacacaacagauggacccagaacacaggcaguuagcaaaugccaucuucaagcugaccuaccaaaacaagguggucaaaguacaacguccuacaccuaccggaaccgucauggacaucauaucgaggaaagaccagcgagguagcgggcaaguaggcacauacggccucaacaccuuuacaaacauggaagcgcaacuaauccggcagauggaaggcgagggcguacugagcaaggcugaucuugaaaacccacaccucccagagaagaaaauaacucaauggcuagaaacgaaaggugucgaaaggcuuaagagaauggcgauaucaggagacgacugcguaguuaagccaauugacgacagauuugccaacgcguugcuagcacucaacgauaugggaaaagugcgaaaggacauuccucaguggcagccuuccaaaggauggcacgacuggcaacaaguacccuucugcagccaucacuuccaugaacuuauaaugaaagacggacgaaagcucgucguaccaugccguccgcaagacgagcuaaucggccgggcacgaaucucacagggggcuggguggucacuucgggaaacugcgugccucgguaaggccuacgcccaaauguggucucuaauguacuuccaccggcgggaccuacgacucgcaagcaaugcaaucugcagcgcggugccgguacacuggguacccacaucaaggacaacauggucuauacacgcacaucaccaguggaugacgacagaggauauguuaacgguauggaaucgcguuuggauagaggacaacccuuggauggaggacaaaacccccgucacaacaugggaaaacgucccguaccuggggaagcgggaggaucaauggugcgggagucugaucggcuuaacaucgagagcaaccugggcccagaacauucccaccgcuauacaacaaguuaggagccuuauagggaacgaggaguucuuagacuacaugcccuccaugaaacgguuccgaaaagaagaggaguccgaaggggcgauaugguag

SEQ ID NO: 25930 - RNA, 9873 nt, Artificial Sequence
  derived and/or modified CDS sequence (opt11) from DENV-3__EU482555__SS-prME
accuccuuaugccucaugaugauucuacccgcggcucucgcguuccaccucacuucgcgcgacggagaacccaggaugaucguaggcaaaaaugaaagagggaaaagucugcuauucaaaacggcgagcggcauaaauauguguacgcugaucgcaauggaccucggcgaaaugugugacgacacuguaaccuauaaaugcccgcacaucaccgaaguagaaccggaagacaucgacugcuggugcaaccugaccucgacgugggucacauacggaaccugcaaucaagcuggugaacauagacgcgauaaacgcagcguggcacuggccccacaugucggcaugggguuagauacccgcacccaaacguggauguccgcagaaggggcauggcgacagguggaaaaaguagaaacgugggcauuaagacacccgggguucaccauccucgcccuuuuucuggcgcauuacauagggacaucguugacgcagaaagucgugaucuucauccuccucaugcucgugacuccaucgaugacuaugcgaugcguugggguagguaaccgagacuucguagaaggccucuccggggcaacgugggucgacguaguguuggagcauggaggguguguaacaaccauggccaaaaauaaacccacacuggacaucgaauugcagaagacugaagcgacacagcuggccacacugaggaaacuaugcaucgagggaaagaucacuaauaucacaacagacuccaggugcccgacccagggcgaggcugugcuccccgaagaacaagaccaaaacuacguauguaaacacacauauguggaccgaggaugggggaacgggugcggccuguucggcaaaggaucccugguaaccugcgcuaaauuucagugucuagagcccauagaaggcaaggucguucaguaugagaaucugaaauacacgguuaucaucaccguccacaccggcgaccaacaccaggucggcaacgagacacaagggguaacggccgaaaucacuccacaggcaucaacgacagaagcaauacuacccgaauacgggacccucggacuggagugcucaccaagaaccggucuggacuucaaugaaaugaucuuacugacaaugaagaacaaagcguggaugguccaccgccaaugguucuucgaucugccccuaccuuggaccucuggagcaaccaccgaaacgccuacuuggaaccggaaagaacugcugguuaccuucaagaacgcccaugcuaagaaacaggaggucgugguccuaggcucucaggaaggggcuaugcacacggcacucacaggggccaccgaaauccagaauagcggagggacgucgauauuugcgggccaccucaagugucgcuugaaaauggauaaacuugagcucaaagggaugucguaugccauguguacuaacacuuuuguuuugaaaaaggaaguauccgaaacacaacacgggaccauacucaucaaaguugaguacaaaggagaagacgcgcccugcaagauccccuucaguacagaggacggacagggcaaggcgcacaacggaaggcuaauaaccgcaaauccagucgucaccaaaaaggaagaaccugucaauaucgaggcagaaccgccuuuuggagaaagcaacaucgucaucggaauaggagacaacgcacuaaaaauuaacugguacaagaaagguaguuccauaggaaaaauguuugaagcaaccgcacgaggcgcacgucguauggcgauacuaggagauaccgcuugggacuuugguaguguaggagggguacuaaacucccuaggcaagauggugcaucagauauuugguagcgcguacaccgccuuguuuuccggugucagcugggucaugaaaauaggaauaggcguacuacucacuuggauagggcucaacuccaaaaauaccaguaugucauuuagcugcaucgcaauuggaguaauaacgcuuuacuugggcgccguagugcaggcagacaugggaugugucaucaauuggaaggggaaagaacuaaaaugcggcucagggauauucguuacaaacgaaguccacacguggacagaacaguacaaguuccaagcagacucccccaagcgguuggcgacggccaucgccggugccugggagaauggcgucugcggcauacguaguaccacgagaauggaaaaccuuuuauggaaacagaucgcgaaugagcucaacuacauacucugggagaacaacauaaaacucacggucguuguuggagacaucauaggcguccuagagcagggaaagcgcaccuugaccccacaaccgauggagcuuaaauacagcuggaagaccugggggaaagcgaagaucguaacagcugaaauucagaacuccucuuucaucauagacggcccaaauacccccgagugcccgagcgccagccgcgcguggaacguuugggaagucgaagacuauggauuugggguuuuuaccaccaacauaugguuaaaacugcgugaagucuacacccaacuaugcgaucacaggcuaaugagcgcagcuguaaaggacgaacgagccguacaugccgacaugggauacuggaucgagucccagaaaaacggcagcuggaagcuagaaaaggcgucacuaaucgaggucaagaccuguaccuggccaaagucacauacccuauggagcaacggugugcucgaaagcgauaugauuauucccaaaucccuggcgggaccuaucucacaacacaacuaccggcccggauaccacacacaaacagcuggccccuggcaccuaggcaaguuagaccuggauuuuaauuauugcgaggggacgaccgucgucauuacugagaacugcggaacgaggggaccaucacuccgcacaaccacuguaucgggaaaguugauacacgaauggugcugucgcagcugcacccuaccaccgcuaagauacaugggagaagacggcuguugguacgggauggagaucaggccgauaagcgagaaagaggaaaacauggucaagagccugguuucagcuggcagcggcaagguagauaacuucacaaugggcguuuuaugccucgcgauccuguucgaagaggugaugagaggcaaauucggcaaaaagcacaugauagccgggguauucuucacauucgugcuccugcuaagcggccaaaucacguggcgagauauggcccauacgcugauuaugauaggcucuaaugccagugacaaaaugggcaugggugucacguaccuagcucuaauugccacauucaaaauccaacccuucuuggcguugggauuuuuccucaggaaacugacgucccgagagaaucuuuuacugggcguagggcucgcuauggccacgacauugcagcuaccagaagacauugagcaaauggccaacggcaucgcgcucggucucauggcacuaaaacucauaacgcaauuugaaaccuaucaacucuggacagcucucaucucacuaaccugcuccaauacaauguuuacccucacuguagccuggagaacugccacccuaauucuagcaggcguaucauuacuaccgguuugccaaucguccuccaugaggaaaacagacuggcugcccauggcaguagcggcuaugggagucccaccccuaccacuauuuauauucucacuaaaagacacccuaaagcggagauccuggccacugaacgaaggagucauggcgguaggccuggucagcauacuagcaagcagccuauuacgcaaugauguaccgauggcagguccucucguugccggaggauugcuaauagccugcuaugugauaaccggcacuucagccgaucucacaguagagaaagcggcggauaucacgugggaggaagaagcagagcagacgggcgugagccacaaccugaugaucacaguagaugacgacggaacuaugcguauaaaagacgacgaaacagaaaacaucuugacggucuuacuuaaaacggcucuacugauagucuccggggucuuucccuacaguaucccagcgacauuguuagucuggcacaccuggcaaaaacaaacacagcggucgggagucuugugggacguccccagcccacccgagacgcaaaaggcugaacucgaagaaggaguauacagaaucaaacagcagggaauauuugggaagacccaagucggaguaggugugcagaaggaaggcgucuuucacacgauguggcacgugaccagaggcgccguacugaccuacaacggaaaaagacucgaaccgaauugggccuccgucaagaaagaccuaaucagcuauggaggcggauggcgacugagugcucaauggcaaaaaggcgaagaaguucaagugaucgcuguagaaccaggcaaaaaccccaaaaacuuccaaacgaugccaggaaccuuucagacgacaacaggggaaauuggagcgauagcgcuggacuucaagccagggacgucgggaucaccuaucauuaacagagaaggcaaagugguuggccuauacgggaacgguguaguaacgaaaaacggcggauaugucuccgguauagcacaaaccaacgcugagccggacgguccgacaccagaguuagaagaggaaauguucaaaaagcggaaccuuacgaucauggaucuccauccaggcagcgggaagacucgcaaauaccuaccggccaucgugcgggaggcgauuaaaagacgccugcggaccuugauccuagcgccaacacggguaguggcagcggagauggaggaagcgcuaaagggucuacccauccgauaucagacaaccgccacgaaaagcgaacacaccggucgagaaaucguagaccucaugugccacgcaaccuucacaaugaggcucuugucgcccguacgcgugcccaacuacaaccuaaucauaauggaugaggcacauuucacagaccccgcgucaaucgcagccagaggcuauaucucgaccaggguuggaaugggcgaggcggcugcgauauucaugacggcuaccccgccaggcacggcggacgcguuuccccaaagcaacgcaccaauacaggacgaggagcgggacauacccgaaagguccuggaacucgggaaacgaauggaucacggacuuugccgggaaaacagugugguucgucccuucaaucaaagcaggcaacgacaucgcaaacugccuacgaaagaacgguaagaaggucauccaguuaaguagaaagacauuugauacggaguaccagaagacuaaacuuaacgacugggacuucguggugacaaccgacauuucugaaaugggggcgaacuucaaggccgauagagucaucgacccucgccgcugucucaagccaguaauccucaccgacggaccagagcgagucauacuagcaggacccaugcccguaacggcggccuccgccgcccagaggagaggacgcguaggcaggaacccacaaaaagaaaacgaccaguacaucuucacaggacaaccacuaaauaaugacgaggaccacgcccauuggacagaagcaaagaugcuacuggacaacauaaacacgcccgaaggaaucauuccggcacucuucgagccagaacgugagaaauccgccgcaaucgacggagaauacaggcugaagggagaaucucgaaaaacguucgucgagcucaugcgaagaggcgaccuaccuguuuggcuugcgcacaagguagcaagcgaaggcauaaaauacaccgaccgcaagugguguuuugacggacaacggaacaaccaaauuuuggaggaaaacauggacgucgaaauauggacaaaggaaggcgaaaagaagaaacucaggcccagauggcucgacgcuaggaccuacagugacccacuagcucuaaaggaguucaaagacuucgcagcgggcaggaaaagcauugcacucgaucuagucacggaaauagggagagugcccucgcaccuggcgcaccgaaccagaaacgcauuggauaacuugguaaugcuacacacaucugaacaugguggcagggccuacagacacgcaguagaagaacugccggaaacuauggagacacugcugcuucuaggauuaaugauccugcucacaggcggagccaugcuauuccucauuagcgggaaggggaucgggaagacuuccauaggccuaauuugcguaauagccucaucaggcaugcuauggauggccgaaaucccgcuccaauggauagccucagccauaguccuagaguucuuuaugaugguacuauuaaucccggaaccagagaaacagaggaccccgcaggacaaccagcuagcauacgucgugauaggcauauugacccuagccgcaaucauugcagcgaaugaaaugggacugcuagaaacgaccaaaagagaucuggggaugucaaaggagccugguguggugagucccacaucguaucucgauguagaucuccauccugcauccgccuggacguuauaugccguagcgacgacggugaucacgccuaugcuccgccacacgaucgagaacaguacagccaacgugucccuggcggcuaucgcgaaucaagccguagugcuaaugggccuagacaaaggguggccgaucuccaaaauggaccugggcguaccccuccuagcgcucggcugcuacagccaagucaauccccucacacugacagcagcaguccuucuacucauaacgcacuacgcaaucaucgggcccggucuucaagcuaaagcuacgagagaagcccagaagcgcacugccgccggaaucaugaagaacccgaccgucgacggcauaaugacaauugacuuggaccccguuaucuaugacagcaaauucgaaaagcaacuaggacaaguaaugcugcuuguccucugcgccguccaacugcugcucaugagaaccaguugggcgcuaugcgaggcguuaacacucgccacgggaccgaucaccacgcucugggagggcagcccgggaaaauucuggaacacaacaauugccgucucaauggcgaauaucuuccgggggagcuacuuagcaggcgcgggucuggcauucaguauaaugaaauccgucggaacaggcaaacggggcacgggaucccaaggcgagacguugggcgaaaaguggaaaaagaaacuaaaccagcucucacgaaaagaguucgacuuauauaagaaaucagggauaacagaaguagaccgaacggaagcaaaggaagggcucaaaaggggcgaaaccacccaccaugccguaagucguggcacggcgaaacuccaaugguucguggaacggaacaugguaauaccagagggacguguaauagaccucggcugcggcaggggaggaugguccuacuauugcgccggccugaagaaagugacggaggucaggggauacacaaaaggaggacccgggcacgaggaaccagugcccaugucgacauauggcuggaacauaguaaaacucaugucaggaaaggacguauucuaucuucccccggaaaagugcgacacacucuuaugcgacaucggcgagucaucaccgagcccuacagucgaagagucgcgaacgauccgaguacuaaagaugguagagcccuggcugaaaaacaaccaguucugcaucaagguacuaaaucccuacaugcccacugucauagaacaccuagagcgacuccaacgcaagcacggcgggaugcuaguccgcaacccucugucacggaacaguacucaugaaauguacuggaucucgaauggcacagggaacauagucgcaagcguaaacaugguaagucgccuucuucucaacagauuuacgaugacgcaccgucgcccgaccauagagaaggacguagaccuuggcgcggguacacggcaugucaacgcagaaccagaaacccccaacauggacgugaucggcgagaggaucaagcgaaucaaagaagaacacaacaguaccuggcacuacgacgaugaaaauccguauaaaacuugggcauaccacggaucauacgaggucaaagccaccgguuccgcauccaguaugaucaacggcguaguaaagcucuugacgaaaccaugggauguaguaccaaugguaacgcaaauggcaaugaccgauacuacaccuuucggacaacaaagaguauuuaaagaaaaagucgauaccagaacaccccggucgaugccaggcacgagacgugucaugggcaucaccgccgaauggcuauggaggacgcucggccgcaacaagaagccacgccuaugcacgagagaggaguucacgaagaaaguacgaaccaacgcggccaugggugcaguuuuuaccgaggaaaaccagugggacagcgcaaaagcagcuguugaggacgaagacuucuggaaacucguagaccgggaacgugagcuacacaaacugggcaaaugcgguagcuguguauacaacaugaugggcaaaagggagaagaaacucggcgaauuugggaaggcgaagggcucacgagcuauaugguacauguggcuaggagcgcguuaccucgaguucgaagcacucggguuccuuaacgaagaucacugguuuucacgagaaaauagcuauucagggguagagggggagggauuacacaaauugggguacauccuacgagacaucagcaagauaccagguggggcaauguacgcggaugacacagcaggaugggacacgcgcauaacagaagacgaucuacauaaugaagagaaaauuacccagcaaauggacccagagcaccggcaacuagccaacgcaauauucaaacucacguaccaaaacaaagucguaaaaguccaacgacccacccccacgggcacagucauggacauaauuucacgaaaggaccagcgcggauccgggcaggucggcacguacggccugaacaccuuuacgaacauggaggcccagcugauacgacaaauggagggugaaggcgugcugaguaaagcagaccuagaaaacccacaucugccagaaaagaagauuacacaguggcuugagacaaagggaguugaacgacuacgucguauggcuauaucaggugacgacugcguggucaaaccgaucgacgaccgauucgccaacgcgcugcucgcacuaaaugauaugggaaagguacgcaaggacauaccccaauggcaaccgucaaaaggauggcaugacuggcaacaaguccccuucugcucacaccauuuccaugagcucauaaugaaagauggcaggaagcuagucgucccgugucgaccccaggaugaacucauaggucgagccagaaucagccaaggagccggguggagccuuagagaaaccgcuugucucggaaaagccuacgcccaaauguggagccugauguacuuccaccgcagagacuuaagacuugcgagcaacgcaaucugcucagcagugccaguccacuggguccccacaucacgcacgacauggucaauacaugcgcaucaccaguggaugaccaccgaagacaugcuuacuguuuggaaccgugucuggaucgaggacaacccauggauggaagacaagaccccugucacgacaugggagaacgucccauaucucggaaagcgggaagaccaauggugcggaagucuaauaggccugaccuccagggccaccugggcucagaacauuccgaccgcuauucaacagguccgcagccuaaucgggaaugaggaguuccucgauuauaugccuaguaugaaacgauuuagaaaagaggaagaguccgaaggcgcuauaugguaa

SEQ ID NO: 25931 - RNA, 9873 nt, Artificial Sequence
  derived and/or modified CDS sequence (opt11) from DENV-3__EU529692__SS-prME
acuucacuaugccucaugaugauccuaccagcggcguuagcguuccaccucaccagucgugacggggaaccacggaugauaguagggaaaaacgaaagagggaaaucguuacuguucaaaacagcaagcggaaucaacauguguacccuaauagcuauggaccuaggugaaaugugcgacgauacaguaaccuacaaaugcccacacauaacagaagucgaaccggaagauauugacuguuggugcaaccugacgagcacguggguuacauacggaacauguaaccaagccggcgagcacaggagagacaaacggagcguggcccucgcgccucacguuggaaugggucuugacaccagaacccaaaccuggaugagcgcagaaggagcuuggcgacaaguugaaaagguggaaaccugggcguugagacacccuggauuuacaauacuugcacuguuccuggcgcacuacaucgguacaucgcugacacagaaaguaguaauauucauacuucugaugcugguaacaccaucaaugacgaugcgaugcguggggguugggaaccgggacuucguugaaggacuaagcggggccacauggguggacgucguucucgaacauggaggcugcguaaccacgauggccaagaauaaaccuacccucgacaucgaacuucaaaagacagaggccacacagcuugccacacuaagaaaacuguguauagaagggaagauuaccaacaucaccacggacagccggugucccacucagggagaagccguccucccagaagaacaagaccaaaacuaugucuguaaacacacauacgucgaccgcggguggggcaacggcuguggccucuucggaaagggcagcuuaguaaccugcgccaaauuccaaugccuggagccaaucgaaggcaaggucguacaguacgaaaaccugaaguacaccguaaucaucacgguacacacaggcgaccaacaccaaguagggaaugaaacacaagggguaacagcggaaauaacuccucaagccuccaccaccgaggccauccuccccgaguacgggacccuagggcuagagugcuccccacgcaccggcuuagauuuuaaugaaaugauccuucugaccaugaaaaacaaagccuggaugguccauaggcaaugguucuucgaccuuccguuacccuggacuagcggagccaccaccgaaaccccgacauggaauaggaaagaacuucucguaacauucaagaacgcgcaugcgaagaaacaggaagugguaguucuaggcagccaagaaggagcgaugcauacggcacucacgggugcgacagaaauccaaaacuccgggggcaccuccauauucgcuggucauuugaagugccgccuaaagauggauaaguuagaauugaaaggaauguccuacgcaaugugcacaaacacauucguacugaaaaaggaggucuccgaaacacagcacgggacgauucuuauuaagguggaauauaagggagaagaugcgccuugcaagauuccuuucagcaccgaagacggccaggggaaagcacacaacggacgacuaauuacugcgaaucccgucguaacaaagaaagaggaaccaguaaacauagaagcugagccaccuuucggcgagucaaacaucgucauaggaaucggagacaacgcauuaaaaauuaacugguacaagaaagggucgucaauaggaaaaauguucgaagcaaccgcacgcggcgcaagacgaauggcgauauugggagauacugcaugggauuuugggaguguaggcgguguacucaacagucuggguaaaaugguucaucagauauucgguuccgcuuacacggcccuauucucuggugugucaugggucaugaagauaggcauaggggugcugcuaaccuggaucggccucaacucgaaaaacaccuccaugucuuucucaugcaucgccauaggggucauaacccuauaucucggagcggucgugcaggcugauauggggugcgucaucaacuggaaaggaaaagagcuaaaguguggguccggaaucuucgucacuaacgaggugcacacauggacagaacaguacaaauuucaggccgacagccccaagagacucgcaacagcgauagcaggcgccugggagaacggcgucugcggaauacggagcacaaccagaauggagaacuugcuauggaaacaaauugcaaacgaacucaacuacauccuaugggaaaacaacaucaagcuaacuguaguugugggcgacauaauuggagugcuagagcagggaaaacggacacuuacgccccaacccauggaacucaaauacagcuggaaaaccuggggaaaagccaaaaucguaacggccgaaauccaaaauagcucguucauaaucgacggacccaacacccccgaauguccauccgcaagcagagccuggaacguuugggaaguagaagacuacggauucggagucuucacaacaaauauauggcucaagcugcgggagguauauacacaauuaugugaccaucgccugaugagugcagccguaaaggaugaacgagcaguccacgccgacaugggcuacuggauagaaagccagaaaaauggaucguggaaacucgaaaaagccuccuugauugagguaaaaacuugcacuuggccuaaaucgcauaccuuauggagcaacggaguacuagaaagcgauaugauaauccccaaaucacucgcaggcccgaucucgcaacacaacuaucgucccggauaucacacccagacggcaggccccuggcaucucggaaaauuagaucuugacuucaacuauugugagggaacaacgguugucauaacggaaaauugugggaccagagggccgagucuccgaacaaccacagucucaggcaaacucauccacgaauggugcugccggucuugcacacuacccccgcucagauauaugggggaggacggcugcugguacgggauggaaauaaggccaauaucggagaaagaagagaauaugguaaagagcuuaguguccgcaggaagcggaaagguggauaacuucacaaugggcgugcuaugccuagcgauccucuucgaggaagucaugagaggaaaauucgggaaaaagcauaugauagccgguguauucuucacauucguacuguuacucuccggccaaaucaccuggcgagacauggcccacacauuaaucaugaucggaagcaaugccagcgauaaaaugggcauggggguaaccuaccucgcccuaauagcaaccuucaagauccaacccuuccuggcgcuaggauucuuucuccgcaaacuaacgagcagggaaaacuuacucuuaggaguaggccuggcuauggcaacaacacuccaacucccagaggauauagagcagauggcuaacggaaucgcacuuggacucauggcacuaaagcuaauaacgcaauuugaaaccuaccaauuauggacagcccuaaucuccuuaacuugcagcaacaccauguuuacacucacaguggcauggagaaccgcuacccucauuuuggcuggagucaguuuauuacccguuugucaauccuccuccaugcgaaaaacagacuggcuaccgauggccgucgcggcaaugggggugccgccucucccacuguucauauucagcuuaaaggacacgcucaagagaagauccuggccacuaaacgaaggcguaauggcagucggacuggugagcauccucgcgagcagccuccuaagaaaugacguaccaauggcgggaccgcuaguagcaggagggcugcugaucgcaugcuacgugaucaccgggaccucagccgaccucaccguagagaaagcugcggacauaacaugggaggaagaggccgagcaaacgggcguuucgcacaaucuaaugauuacaguggaugaugaugggacaaugaggaucaaagacgacgaaacagagaacauauugaccguauugcucaaaacggccuuacugaucgugucgggcguauuuccauauagcauccccgccacucuccuagucuggcacacauggcagaaacaaacacaaagaagcgguguucuaugggacguaccgagcccgccagaaacucaaaaggcagaauuggaagaaggcgucuaccgaauaaagcagcaggggauauucgggaagacacaaguaggugucggaguacagaaagaaggggucuuccacacgauguggcacgugacccgcggagcggugcucaccuauaacgguaaaaggcuggagccgaacugggccuccguuaaaaaggaccugaucucuuacgguggggguuggagauuaucagcacaguggcaaaagggugaagagguccaagucauagcagucgaacccggcaaaaacccuaagaacuuccaaaccaugcccgggacauuccagacgacaacgggagaaaucggggcgauagccuuagacuucaaaccgggaacgagugggagucccauuauaaaccgagaaggcaaagucgucggccucuauggaaacggcgugguaacgaagaacgggggcuacgucagcgggaucgcccagacuaaugcagaaccggacggcccaaccccggagcucgaggaagagauguuuaagaagaggaaccuuaccauaauggacuugcauccgggaagcggaaagacucggaaguaucuacccgccgucguacgggaagcaaucaagcggaggcuaaggacguuaauacucgccccuacuagagugguggccgccgagauggaggaagcccucaaaggauuacccaucagauaucaaacgaccgcaacaaagucagaacacacgggacgggagaucguagauuugaugugccacgcuaccuucaccaugcgccuacucagcccagugagggucccgaacuacaaccugauaauaauggacgaggcccacuucacggauccugcaagcauagcagcccggggauacauauccacacgaguaggcaugggagaagcggcagcaaucuucaugaccgcaacgcccccaggaacagcggacgcauucccccaaucgaacgccccaauacaggacgaggaaagagacauucccgaaagauccuggaacagcgguaacgaguggauaacggacuucgcggggaaaaccgucugguuuguacccucuaucaaagccggaaaugauauagcaaacugccugaggaaaaacggcaagaaagugauacaguuaucacgcaagacauucgacacggaauaccagaaaaccaaacugaaugacugggauuucguggucacuacggauauuagcgaaaugggggcaaauuucaaagccgaccgaguaaucgacccgcgccgaugccugaaaccgguuauccucaccgacggaccagaaagagucauacucgccggccccaugcccgucacggcagcgucggccgcccaacgcaggggaagaguagguagaaacccgcaaaaggaaaacgaucaguacaucuucaccggccagccccugaauaacgaugaagaccacgcucauuggacggaggccaaaaugcuucuugacaacaucaauacaccagaaggaaucauccccgcccuuuucgaacccgagagagagaaaagcgccgcgauagacggagaauacaggcuuaagggagaaucacgaaaaaccuuuguggaacugaugcgacgcggagaccuacccguguggcuugcccauaagguggcuuccgaagggauaaaguauacugaccgaaaauggugcuucgauggucaacgaaacaaccaaauccuggaagaaaacauggacgucgaaauuuggacgaaggagggcgagaagaagaaacuucgcccacgcuggcuggaugcacgaacguacagcgacccccucgcccuaaaagaguucaaagauuucgccgccgggcggaaauccaucgcacuugaccuaguaacggaaauagggcggguacccucacaucuugcucacagaacccggaacgcacuagauaaucuaguuauguuacacacaucggagcacggagggcgagcauaucggcacgccguugaagaacuuccagagaccauggagacccuccuacugcuaggauuaaugauacuccuaaccggcggggccaugcuauuccuaauuagcgguaaaggaaucggaaaaacauccaucgggcucauuugcguuauagcgucgaguggaaugcucuggauggccgagaucccgcuacaauggaucgccuccgccauaguacucgaguucuucaugaugguccugcugauucccgagccagagaagcagcgaacaccacaggacaaccaacuagccuaugugguaauuggcauccuaacacuagcagcuaucauagccgcgaaugaaaugggccuacucgagacgacgaaacgggaccugggaaugagcaaggaaccgggaguagugucucccaccagcuaccucgacgucgaccugcacccggccagugcauggacccuguacgcaguggcuacaaccgucauaacccccaugcugaggcacacaaucgaaaacucgaccgccaacguaucguuagcagcgaucgcuaaccaggcggugguccugaugggccucgauaaaggguggccaaucucgaaaauggaccucggcguaccgcuacuggcacuuggcugcuacagccaggugaauccgcugacacucaccgcggcaguauuacuucuaauuacccauuacgcaaucauaggacccggguuacaagcgaaggccacaagagaagcccaaaagcggaccgcagccggcaucaugaagaacccaacaguagacggcauuaugaccauagaccucgacccuguuauuuacgacagcaaauucgaaaaacagcuaggucaggucauguuacucguccuaugcgcgguacagcuccuauuaaugcguaccuccugggcccucugcgaagcacuaacacucgcaaccgggccaauaacaacacuaugggaggggaguccggguaaauucuggaacacgacaauagcagucucuauggccaauauuuucagaggcagcuaccuagcaggagccggauuggcuuucagcauaaugaaaagcguaggaacagguaaacggggcaccggaagucaaggcgaaacucuuggggagaaauggaagaagaaauugaaccaacucucaaggaaagaguucgaccuguacaagaaaucagguaucacggaagucgaccguacagaagccaaggaaggauugaaacgaggcgagacaacacaucaugccgugagcagggguacugccaagcuccagugguucgucgagagaaauauggugauuccugaaggaagaguaaucgaccuugggugcggccggggaggcugguccuacuacugcgccgggcugaagaaaguaacugaaguacgcggguacacuaaaggaggaccgggccacgaagaaccaguucccaugucaacauacggguggaacauugugaaacuuaugucaggaaaagauguauuuuaccucccaccggaaaagugcgacacacuccuuugugauauaggcgaauccaguccaucgccaacaguagaagagagucgaaccauuagaguauugaaaauggucgagccuuggcucaaaaauaaccaauuuugcauaaaggugcucaaucccuacaugcccaccguuaucgagcaccuggagcgcuuacaaaggaaacauggagguaugcugguacgcaauccgcucagcaggaacucuacccacgagauguacuggauuucgaauggaacagggaauauagucgcgagcgugaauaugguaucccgucuccuucuaaaccgauuuaccaugacccacaggcggcccaccaucgaaaaggacguagacuuaggagcugggacucggcacgugaacgccgaaccggagacaccuaacauggacguuaucggcgagaggaucaagcgaauaaaggaggaacauaacucaacguggcacuaugacgacgaaaacccguauaaaacaugggcauaccacggcuccuacgaagugaaagccacggggucagcaagcagcaugaucaacgggguaguuaaacuacucacuaaaccuugggacguaguacccauggugacccaaauggcaaugacagacacgaccccguucggccaacagagaguauuuaaggagaaagucgauacucggaccccacggucaaugcccggcacgagacgcgugaugggcauaacagccgagugguuguggaggacacuaggccgaaacaaaaagccccgacucuguacaagggaggaguucacgaagaagguacgaacaaaugcagcgaugggggcuguuuucacggaggaaaaccaaugggauucagcaaaagcggcgguugaagaugaagacuuuuggaagcuagucgaccgggaaagggagcuccacaaacucgguaagugcggaagcugugucuacaacaugaugggcaaaagggaaaagaaacuuggcgaguuuggaaaagcgaaaggcagcagagcaauaugguacauguggcuaggggcccgcuaucuugaguucgaagcacugggauuccugaacgaagaccacugguuuucacgagaaaacuccuacaguggcguagaaggcgagggacugcauaaguuaggauacauucugagagacaucagcaaaauaccugguggcgcaauguaugcggacgacaccgccggcugggauacgcguaucaccgaagacgaccuacacaacgaagagaaaaucacgcagcaaauggacccggaacaccgucagcuugcaaacgcgauuuucaaacugaccuaccagaacaagguuguaaaaguccaaaggccgacgccgacaggaacagugauggauauaaucucaagaaaggaucaaagggggucaggccagguagguacguacggacucaacacuuucacgaacauggaaguacaauuaaucaggcagauggaaggugaaggcguccucagcaaggcagaucucgaaaacccucaccuuccggagaagaagauaacccaauggcuggaaaccaaaggagucgaaaggcugcgucgaauggcgaucaguggugacgacugugucgucaaaccgauagacgaccgguucgccaaugcucuauuagcacuuaacgauaugggcaaggugcgaaaggacaucccccaguggcaaccaucaaaaggguggcaugacuggcaacaagucccguucugcucgcaccacuuucacgaacugauuaugaaagacgggcgaaagcuaguagucccaugcagaccacaagacgaacucauaggucgcgcgcgaaucagucaaggagccggguggucacuccgcgagacggcaugccuagguaaagcguacgcgcagauguggagcuugauguacuuucaccgccgagauuuaagacuagccuccaacgcuauaugcucagcggugccaguucauugggucccaacaagcaggacgacauggucaauucaugcucaccaccaauggaugaccacggaagauaugcuuacgguauggaacagagucuggaucgaagacaacccuuggauggaggacaaaacgccaguuaccacaugggaaaacguccccuaccuuggaaagcgugaagaccaauggugugggucgcuaauagggcucaccucccgugcuaccugggcccaaaacauaccuacagcgauacaacaggugaggagccuaauaggaaacgaagaguuccuggacuacaugccaagcaugaaaagauuucgaaaagaagaggaaucagagggggcgauaugguag

SEQ ID NO: 25932 - RNA, 9873 nt, Artificial Sequence
  derived and/or modified CDS sequence (opt11) from DENV-3__EU482558__SS-prME
accagccucugcuuaaugaugauccuucccgcggcgcuggcguuccaccucaccucgagggauggggagccccggaugauagucggaaagaacgaacggggcaaaagccugcuguuuaagaccgccuccgguauuaacaugugcacccucauagccauggaccugggcgagaugugcgacgauaccguaacauacaaaugcccgcauaucacggagguggaacccgaggacauagauugcuggugcaaucugaccucgacuugggugacuuacggaacaugcaaucaggccggugagcaccggcgcgacaagcgguccgucgcccucgcgccccacguuggcauggggcuggacacccgaacccagaccuggaugagugccgaaggcgccuggcgccagguggagaagguagagacgugggcacuacgccacccgggguucaccauccucgcgcuguuccuugcccauuacaucggcacaucccucacccaaaaggucgucaucuucauccuguuaaugcucgucacucccagcaugaccaugcgaugcguggggguaggcaaucgcgacuucgucgagggauuguccggggccaccuggguggacguggugcuggagcacggcggaugugucaccacgauggcaaagaacaagcccacccucgacaucgaacuacagaagacggaggccacgcaauuggcgacgcuccggaaauugugcaucgaaggcaaaauuaccaauauuaccaccgacagucggugcccgacgcagggcgaggcgguacugccggaagagcaggaccagaacuacguaugcaagcacaccuauguggaccguggguggggcaacggguguggacucuucgggaagggcagucuggugaccugcgccaaauuccagugccuggaacccauagagggcaaggucgugcaguacgagaacuuaaaauacacugugaucaucacuguccauacuggggaucaacaucaggugggcaacgaaacucagggcgucacagccgagaucaccccccaagccagcacuacugaggcgauccugccugaguacggcacacuggggcucgagugcuccccgcgcaccggccuggacuucaacgagaugauccugcucacuaugaaaaacaaggccuggauggugcaccgacagugguuuuuugaccucccccuucccuggacuagcggcgccaccaccgagacgccaaccuggaaccgcaaagagcuucugguaaccuucaagaaugcccacgccaagaagcaggagguuguggugcuggggucccaggagggcgcgaugcacacagccuugacgggggcgacugagauccagaacucaggcgggacuuccauauucgccggacaccugaagugccggcugaagauggauaagcucgaauugaagggcaugagcuacgccaugugcacaaacacguucguccugaagaaggaggucuccgagacccagcaugggaccauuuugaucaaaguggaguauaagggcgaggacgucccgugcaagauccccuucagcaccgaggacggucagggcaaggcucacaacggccgccugaucacggccaauccuguggugaccaagaaggaggagcccgucaacaucgaagcugaaccgcccuuuggggagagcaacaucgugaucggcaucggcgacaacgccuugaagaucaacugguacaaaaagggcuccagcaucgggaagauguucgaggcgaccgcgcggggugcccgccguauggcuauccuuggcgacaccgccugggacuucggguccgugggcgggguacucaacucgcugggaaagauggugcaccagauauucggguccgcauacacggcgcuguucagcggcguguccuggguaaugaaaaucggcaucggagugcuccugaccuggaucggucugaauaguaagaacaccuccaugagcuucuccugcaucgccaucgggaucauaacccucuaccuaggcgcugugguccaggccgacauggggugcguuaucaacuggaaggggaaggagcucaaaugcggaagcgguaucuucgugacuaacgagguccauaccuggaccgagcaguacaaauuccaagcggacagcccgaagcgucuagccaccgccaucgcaggcgccugggagaacgggguguguggcauccgcagcacgacccggauggagaaccuucuguggaagcagaucgcgaacgaguuaaacuacauucugugggagaacaacaucaagcugacaguuguggugggggacaucaucggcguacucgagcagggcaagcgcacuuugacgccccagccgauggagcugaaguacuccuggaagacgugggggaaggccaagaucgucaccgccgaaacccaaaacagcuccuucaucauugacggccccaacacgcccgagugccccagcgccucucgggccuggaacgugugggaaguggaggacuacggcuucggugucuucacuaccaacaucuggcuuaagcugcgcgagguauacacccagcugugcgaccaccggcucaugagcgccgccgugaaggacgagcgcgcuguccacgcugacaugggcuacuggaucgaaucccagaagaacgguuccuggaaacuggagaaggcuagccuaauugagguuaagaccugcacguggccgaagucccacacacucuggagcaauggcguucuggagucggacaugaucauacccaagagucuggccgggcccaucucccagcacaauuacagacccgguuaccacacccagaccgccgggcccuggcaccucggcaagcuggaguuggauuuuaauuauugcgagggcacuaccgucgugaucacugagaauugcggaacccggggccccagucuccggacuaccaccgucucugggaagcugauccacgagugguguugccgcagcugcacccugcccccgcugcguuacaugggcgaggauggcugcugguauggcauggagaucaggcccaucagcgaaaaggaggagaacaugguaaaaucucugguguccgccgguagcgggaagguagacaacuucacuaugggcguccugugccucgccauccuguuugaggaagugaugcgggguaaguucggcaaaaagcacaugaucgcugggguguucuucaccuucguccugcuacuguccggccagaucaccuggagagacauggcgcacacccugauuaugauaggcagcaacacguccgaccggauggggauggguguaaccuaccucgcccugaucgccaccuucaagauccagcccuuccuggcucucggguucuuccugcgcaagcucacuagccgggagaaccugcuauugggcgugggccucgcgauggccacgaccuuacagcugcccgaggacaucgagcaaauggcaaaugguaucgcacucggccugauggcgcugaagcucauuacccaguuugagacguaccagcuguggacggcgcugaucagcuugaccugcuccaacaccauuuucacgcugacgguugcuuggcggacagccacccugauccuggccggggugagccuacuaccgguaugccaauccagcuccaugcggaagaccgacuggcuccccaugacgguggccgccaugggcgugccuccuuuaccgcuguucaucuuuucccucaaggacaccuuaaagcgccgcuccuggccccugaacgaggggguuauggccguaggccucguaagcauccuggccuccagccugcuccggaacgacguccccauggcaggcccccugguggccggcggacuguugauugccugcuacgugauaacgggaaccucagccgaccucacagucgagaaagccgccgacgugacaugggaagaagaggcugagcaaaccggggugagccacaaucugaugaucaccgucgacgacgacgggaccaugcgcauaaaagacgacgagacggagaacauccucaccguguugcuuaagaccgcacuccuuauaguguccggcaucuucccguacagcauccccgccacccugcucguauggcacacuuggcagaagcagacacagcgguccggaguuuugugggacgugcccagcccgcccgaaacccagaaggccgagcuggaggagggggucuaccgcaucaagcagcagggcauauucgggaagacccagguggggguggguguccaaaaagagggcguguuccacacgauguggcacgugacccgaggcgccguccucaccuacaaugggaagagacuggagcccaauugggcgucaguuaaaaaggaccugauaagcuacgggggggguuggcggcucucugcccaauggcagaagggggaggaggugcaggucaucgccguggagccuggcaagaauccgaagaacuuccagaccaugcccggcacuuuccagaccaccacuggggagauuggggccaucgcgcuggacuucaaaccggguacgucaggcagccccaucauaaaccgugagggcaaaguggucgggcuguacggcaacgggguggugaccaagaacggcggguacgucuccggcaucgcucagaccaacgccgagccggacgguccuacccccgaacuggaggaggagauguucaagaagcguaaccugacuaucauggaccugcaccccggcagcgguaaaacccgcaaguaccugccggccauugugcgggaggcgauuaagcgcagacuccgcacccugauccuugcgccaacccggguggucgccgcggagauggaggaggcacucaaaggguugcccauccgcuaccaaacgacggccaccaaguccgaacacaccggccgugagaucguggauuugaugugccacgcgacguucaccaugcgucuccugagcccagugcgggugccgaacuauaaccugaucaucauggacgaggcccacuucacagaccccgccuccaucgccgcacguggcuacaucagcacccgugugggcaugggagaggcggcagccaucuucaugacugccacgccucccgggacagcagacgccuuuccgcaguccaacgcccccauccaggacgaggagcgcgacauucccgagcgcaguuggaacuccggcaacgaauggauaaccgacuucgccgggaagacggugugguucgucccuuccauaaaggccggaaaugacauagccaacugucuccggaagaacgggaagaagguuauacaacuguccagaaagaccuucgacaccgaguaccaaaaaacuaagcugaacgacugggacuuuguggugaccaccgacauauccgagaugggugccaacuucaaggccgaucgagugauugacccgcgcaggugccucaagcccgugauuuugaccgacggccccgaacgcgucauucuggcagggcccaugccugugacagcagcgagcgccgcucagcggcgcggccggguggggcgcaacccacagaaggagaacgaccaguacaucuucacagggcaaccccucaacaacgacgaggaucacgcccacuggacagaggcaaaaauguuacucgauaacaucaauacccccgaggggaucauccccgccuuguucgagcccgaacgggaaaaguccgccgccauugacggcgaauaccggcugaagggcgagucccggaagacauuugucgagcugaugcggcggggggaucuccccguguggcuggcgcacaaggucgccagcgagggcauuaaauacaccgaccguaaguggugcuucgacgggcagcggaauaaccagauccuggaggagaauauggacguagaaauuuggacgaaagagggcgagaaaaagaaauuacguccccgguggcuggacgcgagaaccuacucggacccgcuugcccucaaggaauucaaggacuucgccgcuggccgcaaaaguaucgcgcuagacuuaguuaccgagaucggacggguccccucccaucucgcgcacagaacccggaacgcucuggacaaccuggugaugcugcacacaucggagcacggcgggaaggccuaucgccacgccguggaagagcugcccgagacuauggagacccugcuccugcuugggcugaugauccugcugaccggcggcgcgaugcuguuccugaucagcggcaaggggauuggcaagacguccauuggccugaucugugucaucgccagcucgggcaugcucuggauggcagagauaccgcuacaguggauagccagugcgaucguccuggaguucuucaugaugguacuccugauccccgaacccgagaagcagaggacuccucaggacaaccagcuggcguacgucgugaucggcauccuaaccuuagcugcaaucauagccgccaaugagauggggcugcuugagaccacgaagagggaucugggcaugaguaaggagccggguguuguuagucccaccucauaccuggacguggaccuccacccggcgagcgccuggacccuguacgcuguagccaccacggucauaacgcccaugcugcggcauacuauugagaacucaaccgcaaacguuagccuggccgccauugccaaccaggcgguuguccugaugggccuggacaaaggguggccgaucuccaagauggaccucggugugccccugcuggcgcugggaugcuacagccaggugaacccacucacguuaaccgccgccguccucuuguuaaucacacacuacgccaucaucggaccgggacuccaggccaaggcgacccgcgaggcccagaaacggaccgccgccgggaucaugaagaacccgaccguggaugggaucaugaccaucgaccuggaccccgugaucuacgacuccaaguucgaaaaacagcuggggcaggucaugcuccugguccugugugccgugcaacuacuguugaugaggacuuccugggcgcucugcgaggcucugacgcuggcaaccgggcccauaacaacccucugggaaggcucccccgggaaauucuggaacacgaccaucgcggucagcauggcgaacaucuuucgggggagcuaccucgcaggggccggccuugccuucuccaucaugaaguccguagggacuggcaagcgcggcaccgggagccagggcgaaaccuugggagagaaguggaagaagaagcugaaccagcugagccggaaggaguucgacuuguacaagaaguccggcaucacugaggucgaccgaaccgaggccaaggaggggcuaaagagaggagaaaucacacaccacgcggugagccgcggguccgccaagcuacaaugguuuguggagaggaacauggugaucccggagggucgugucaucgaccucggcuguggccggggcggguggagcuacuacugugccggccugaagaaggugaccgaagugcgcggcuacacgaagggggggcccgggcaugaggagcccgugcccaugagcaccuacggcuggaacaucgugaagcugaugucagguaaagacguguucuaccucccccccgagaagugcgacacccugcugugugacaucggcgaguccagccccuccccuaccguugaggagucucggacgauccgcguucugaagaugguggagccguggcucaagaacaaccaguucugcaucaagguccugaaccccuacaugcccaccgugaucgagcaccuggagcgccuucagcggaagcacggcggaaugcuggugcgcaauccccugucccggaacagcacccacgagauguacuggaucuccaacggcaccgggaacaucgucgcuagcgugaacaugguaucccgccuccugcugaaucgguucacgaugacacacaggcggccgaccauugagaaggacguagaucucggcgcgggcaccagacauguaaacgcggagcccgaaacgcccaauauggacguaaucggggagcgcaucaagagaauuaaggaagagcacaacucaaccuggcauuaugacgacgagaacccauacaagaccugggccuaucauggaucauacgaagucaaggccacggggagcgccuccagcaugaucaacggaguggucaagcugcugacgaagccuugggacguggugcccauggucacccagauggccaugaccgacacaacgcccuucgggcagcagcggguguucaaggagaagguggacacccgcaccccacggagcaugccgggcacccgccgggucaugggcaucaccgcagaaugguuauggcgcacccuagggcggaacaagaagcccagauugugcacccgagaggaguuuacgaagaagguacgaacaaacgccgcgaugggggcaguguuuaccgaggagaaccagugggauuccgcgaaggccgccguagaggacgaggacuucuggaagcucguggaccgggaacgggaacugcacaagcucgguaaaugcggcagcugcguguacaacaugauggggaagagggagaagaagcucggcgaguucggcaaggcuaaggggucacgagccauuugguacauguggcugggggcgcgcuaccuagaguucgaggccuugggguuccuuaacgaagaucacugguucagccgcgagaacaguuauagcggcguagagggggagggccugcacaaacugggcuacauccugcgcgacauauccaagauccccgguggggccauguacgcugacgacaccgccgggugggauacccggaucacugaagacgaccugcacaaugaggagaaaauuacccagcagauggacccugagcaccgccagcucgcgaacgccaucuucaagcugacauaucagaacaagguggugaaaguacagcggcccacccccaccggcacagugauggauaucaucucacgaaaggaccagcggggcuccggccaggugggcacauacggacugaacaccuucaccaacauggaggcccaacucauccgccaaauggagggcgaggguguccuaagcaaggccgaccuggagaacccccaucugccagagaagaagaucacgcaguggcuggagacuaagggcguggagaggcugaagagaauggccaucuccggcgacgacugcgucgucaagcccaucgacgaucgguucgccaacgcccuccuggcccugaacgacaugggcaaggugcgcaaggacaucccucaguggcagccuucuaaaggcuggcacgacuggcagcaagucccguucugcucccaucauuuucacgagcucauuaugaaggacggacggaagcuggucgucccaugccgcccccaggacgagcugauuggccgggcccgcaucagccagggggcuggcuggagccuccgggagacagcgugccugggcaaggcauacgcccagauguggucucugauguacuuccaccgccgagaccuccgacuggccuccaacgcgaucugcagcgccgugccgguccacugggugccgaccucccgcacgaccuggagcauucacgcccaucaccaguggaugaccaccgaggauaugcugacagucuggaaccgggucuggauugaggauaaccccuggauggaggacaagacccccguaaccaccugggagaacgugcccuaccuugggaagcgcgaggaucaguggugcggcucccugaucggacugacgucccgcgcaacaugggcgcagaacauaccuacugcaauccagcagguccgcucgcucauuggcaaugaggaguuccuggacuacaugcccuccaugaagcgguuccgcaaggaggaggagagcgagggggccaucugguaa

SEQ ID NO: 25933 - RNA, 9873 nt, Artificial Sequence
  derived and/or modified CDS sequence (opt11) from DENV-3__EU482563__SS-prME
accagccuuugccuuaugaugauucugcccgcagcccuagccuuccaucucaccucgagggacggggagccccggaugaucgucgggaagaacgaacgcggcaagucccuucuguucaagaccgccuccgggaucaacaugugcacccuaaucgcgauggaccuuggcgagaugugcgacgacaccguuaccuacaagugcccacacaucgccgaggucgagcccgaggauauagacugcugguguaaccugaccucuaccugggugacauaugggacuugcaaccaggcaggcgagcaccggcgugacaagcggagugucgcucucgcgccccaugugggcauggggcuggauacgcgcacccagacauggaugagcgccgaaggggccuggaggcaaguggagaaagucgagacgugggcacugcgccacccgggguucacgauucucgcccuguuccuggcccacuacaucggcaccucccucacucaaaaggugguuaucuuuguccugcuuaugcucgugacccccagcaugacgaugcggugcguggggguaggcaaccgugacuuuguggaaggucugucuggagccacuuggguggacgucgugcuggagcacggggguugcgugacuacgauggccaagaauaagccgacgcuugacaucgagcuacaaaagaccgaggccacgcaguuggccacccuccggaagcuuugcaucgaaggaaagaucacgaacaucaccaccgauagcaggugcccaacccaaggagaggcaguccugccggaagagcaggaccagaacuacguguguaagcacacguacguugauagaggguggggaaaugggugcggacuauucgggaagggaucgcuaguuacuugcgcaaaguuucagugccuggagccgaucgaagggaagguggugcaguacgagaaccucaaguauacagucauaauaacuguucacacgggggaccagcaccagguagguaacgaaacccagggagugaccgccgagauaacuccccaggcgagcaccaccgaagcaauccugcccgaguacggcacacuagggcuagaaugcaguccucgcacagggcuggacuucaacgaaaugauucuguuaaccaugaaaaauaaagccuggauggugcaccggcaaugguuuuucgaccuuccccugccguggacgagcggcgccaccaccgaaacacccacuuggaaccgcaaggaguugcuuguuacguuuaagaacgcacaugcuaagaaacaagaggucguggugcucggcucccaggagggcgccaugcacacugcacucaccggggcaacggaaauacagaacagcggagggacauccauauucgccggacaucugaagugucggcugaagauggacaaacucgaacuuaagggcaugagcuacgcaaugugcaccaacaccuuugugcugaaaaaggaagugucggagacccagcacgggacuauccugaucaaagucgaguauaagggggaggaugccccgugcaagauccccuucucgacagaggacggccagggcaaagcccauaacggcaggcugaucaccgcgaacccuguggugacgaaaaaggaggaacccguuaacaucgaggcggagccgcccuucggggagagcaacaucgugaucggcaucggggauaaugcccuuaagaucaauugguacaagaagggcucgagcaucgggaaaauguuugaggcaaccgcccggggcgcgcgccguauggcgaucuuaggcgacaccgcgugggacuucgguucagugggcggaguacucaauagccucggcaagaugguacaccaaaucuucggaagcgcguacacagcacuguucagcggcguaucguggguuaugaagaucggcauuggggugcuccugacguggaucggcuugaacagcaagaacaccucaaugagcuucuccugcaucgcgauaggaaucaucacccuuuauuuaggcgcggugguacaagccgacaccggcuguguaaucaacuggaagggcaaagaguuaaagugcggcagugguaucuucgugacgaacgagguccacacguggacugagcaguacaaguuccaagccgacucccccaagcgucuugccacugccaucgcgggggccugggagaacggggugugcgguauucguuccacgacccggauggagaaccugcuguggaaacaggucgcaaacgaacugaacuacauuuuaugggagaacaauauaaagcugacggucguugucggagacaucauuggcguauuagagcagggcaagcguacucugacgccccaaccaauggaacugaaauacucguggaagaccugggggaaggccaagaucguaacagcggaaacccagaacuccuccuucaucaucgauggccccaauacgcccgagugucccuccgccucccgcgcauggaacgugugggaagucgaggacuauggguucgguguuuucaccaccaacaucuggcucaagcugcgugagguguauacccaacuaugcgaucaccgguuaaugucagccgcggucaaggacgaaagagcggugcacgcggauaugggcuacuggaucgagucccagaagaacgguuccuggaaacuggaaaaggcaucacugaucgagguaaagacuuguaccuggcccaagagccacacacucuggucaaacggcguuuuagagucugacaugaucauccccaagagccuggcggggcccaucucccagcacaauuaccggccaggcuaccacacacaaaccgccgggcccuggcaccucggcaagcuagagcuggacuuuaacuauugugagggcaccaccguagugauaaccgagaacugcggaaccaggggaccuagcuuacggacaacaacggucucaggaaagcugauacaugaauggugcugccgcagcugcacccugcccccucuccgauacaugggcgaggaugggugcugguacgguauggagauuagacccauauccgagaaggaggagaacauggugaagagccuggucagcgcgggcucuggaaaaguagauaacuucacuaugggaguacucugcuuggcuaucuuguucgaggaggugaugcgggguaaauucgguaagaagcacaugaucgccggggucuucuucacuuucguucugcuucugucaggccagaucacauggcgcgacauggcccacacccugauuaugaucgguaguaacgcgucugaccgcauggggaugggcgugaccuaccucgcccugauugccaccuucaagauccagcccuuccucgcgcuaggguuuuuccugcguaaauugacaucacgggagaacuuacuguugggcgugggcuuggccauggcaaccacgcugcagcugcccgaggauauugagcagauggccaacgggauugcucucgguuuaauggcccugaagcuuaucacacaguucgagaccuaccagcuguggaccgccuuaauuagccuaacaugcuccaacacgauuuucacgcugaccgucgcuuggcggacggcgacacugauucucgcaggagucagccugcuccccgucugccaauccucgaguaugaggaaguccgauuggcugccaaugacaguugccgcgaugggcgugccgccccuaccguuguucaucuucucgcuaaaagacacgcugaaacgccgcagcuggccccugaacgagggggugauggcagugggccuuguauccauccuggccagcucccugcucagaaacgacguacccauggcuggucccuugguugcuggcgggcugcucauagcaugcuacguaauuacggggaccucagcggaccuuacaguggagaaggccgccgacgugaccugggaagaggaggcagaacaaacgggcgucucccacaaccugaugauuaccguggacgacgaugggaccaugcgcauuaaggacgacgagaccgagaacaucuuaaccgugcuccugaagacggcacugcugauugugucaggcauauucccguacagcauuccggcgacccugcucguauggcacaccuggcagaagcaaacacggcguagcggggugcuuugggacguaccuagcccaccggagacucagaaagccgaacuggaagagggggucuaucggaucaaacagcaaggcauuuucggcaaaacccagguaggcgucggggugcagaaggagggcgucuuucacaccauguggcacgucacucgcggggcggucuugaccuacaacgggaaaagauuggaacccaauugggccagcgugaagaaggaccugaucuccuacggcggggguuggcgucucagcgcgcaguggcagaagggggaggagguccaggugaucgccguggagccaggcaagaaccccaagaacuuccagaccaugcccggcaccuuucagaccacgaccggcgaaaucggcgccaucgcccuggauuucaaacccgggaccagcggcucgccaaucaucaaccgggagggcaaggugguugggcuguacgguaaugggguagucaccaagaacggaggguacgugucggggaucgcucaaacgaacgccgaaccggacggccccacccccgagcuugaggaggagauguucaagaaaaggaaucucaccauuauggaccugcacccuggguccggcaagaccaggaaguaucugccggcaaucgugcgugaagccaucaagcgacgccuccggacucucauccuggcgcccaccagaguagucgccgcggaaauggaggaggcccucaaaggacugcccauccgguaucaaaccacagccacaaagagugagcacaccggcagagagauuguugaccuuaugugccacgccacauuuacgaugcggcuccugucccccguccgcgugccaaauuacaaucugaucaucauggacgaggcccauuuuacggaucccgcaagcaucgccgcgaggggcuacaucucgacacgcguuggcaugggcgaggccgcugccaucuuuaugaccgccaccccgcccgggacggccgaugcuuucccgcaaagcaacgcgccuauccaagacgaggagcgcgacaucccggagcggucguggaauagcggcaacgaguggaucacugacuucgcggggaaaaccgugugguucgugcccucuaucaaggccgggaacgacaucgccaauugccuccgcaagaaugguaagaaggugauccaacugucccggaagaccuucgauacggaguaucagaagaccaagcugaaugacugggauuucguggugaccacggauaucucugagaugggcgccaacuucaaagcugaccgcgugaucgacccacggagaugccucaaacccgucauccuuaccgauggcccagagcgggugaucuuggcggggccaaugccugugacagcggcauccgccgcgcaacgucggggccgcguggggcgaaauccccagaaggagaaugaucaguacaucuucaccggacagccccucaacaaugacgaggaccacgcacacuggaccgaggccaagaugcugcuggauaauaucaacacgccagaggggauaaucccggcucuguuugaaccggaacgugagaaaucagcggcgauugacggugaguaccggcugaagggcgagucaaggaagacguuuguugagcucaugcggcgcggggaccuccccguuuggcuggcccauaagguggcuuccgaggggauuaaguacaccgaccggaaauggugcuuugacggccagcgaaacaaccaaauccuggaggagaacauggacguggaaaucuggacgaaagagggcgagaagaaaaagcugaggccccgcuggcucgacgcaaggacauauagcgacccccuagcgcucaaggaauucaaagacuuugccgccggcaggaaauccaucgcccuugaccuggucacggaaaucgggcgugugcccucucaccuggcgcaccgaacgcguaaugcccucgacaacuuggugaugcuccacaccagcgagcauggcgggaaagcguacaggcacgccgucgaggaacuaccugaaaccauggagacgcugcuccugcucgggcucaugaucuuacuuacugggggugcaaugcuguuccugauaucgggcaaggggauuggcaagaccuccaucgggcugaucugcgugaucgccaguucgggaaugcuuuggauggcggagaucccacugcaguggauagccucggccaucguucuugaguucuucaugaugguucuccugauucccgaacccgagaagcaacgcacgccacaggauaaucagcuggccuacguggugaucgggaucuugacgcuggcugcgauuaucgccgcgaacgaaaugggacugcucgagaccacuaaacgggaccuggguaugagcaaggagccuggggucgugucccccacuucauacuuggacguggaccuccaccccgcguccgcauggacucuauacgcggucgcaaccacggucauaacccccauguuacggcacaccaucgaaaacagcaccgccaacgugucccuagccgcgaucgcgaaccaggcugugguccucauggggcuggauaaaggauggccaaucucgaagauggaccucggcgugcccuugcuggcccuagggugcuacucccaggucaacccucucacccugacggcugcggugcucuuauuaauaacgcacuacgccaucaucggcccgggccuccaggcaaaggccacccgggaagcucagaaacgcacagcggccgguaucaugaagaaucccacuguggacggcauuaugaccaucgaccuggacccggugauuuaugacagcaaguucgagaagcagcugggccaggugaugcuacuaguuuuaugcgccguucagcuucuacucaugagaacauccugggcucucugcgaggcguuaacgcuggccaccggccccauaacgacucugugggagggcagcccugggaaguuuuggaacaccacuaucgcggugaguauggcgaacauauuccggggaagcuaucuggcgggagcaggccuggccuucuccaucaugaagaguguggggacgggcaaacggggcacagggucucagggugagacccucggcgaaaaauggaagaagaaacugaaucaacugagucgcaaagaguucgaccuuuauaaaaagucagguauaaccgaggucgaccgaaccgaagccaaggaggggcuaaagcggggagagauaacccaccacgcgguaagccggggcucugccaaguugcagugguucguggagcggaacauggucauucccgaggggcgaguuaucgaccucggcugcgggcgcggcggauggucguacuacugugcuggacugaaaaagguuaccgaaguccgaggcuacaccaagggcgggccggggcacgaggaaccggugccgauguccaccuacgguuggaacaucgugaaauuaauguccgggaaggacgucuucuaccuaccgcccgagaagugcgauacgcugcugugcgacaucggcgaguccucccccagccccaccguagaggagucccgcaccauccgcgugcugaagaugguugaacccuggcucaaaaauaaucaguucugcauaaagguuuugaaccccuacaugcccaccgugaucgaacaccuggaacggcuccaacgcaagcacggagggaugcuuguccggaacccauugagccgcaauuccacgcacgagauguacuggauuagcaacggcaccggcaacaucguggccucggugaauauggucucacgacuccugcugaauagauucaccaugacccaccgacgcccgacgaucgagaaagacguugaucucggugccggcacucggcacgugaacgccgagcccgagacgcccaacauggacgucaucggggagaggaucaagcggauaaaggaggagcauaacaguaccuggcacuacgacgaugaaaacccguacaagacgugggccuaucacggcuccuaugaggugaaggcgaccgggucggccagcucuaugaucaauggagucgugaagcugcugaccaaacccugggacgugguucccauggugacgcagauggcgaugacagauaccacccccuucgggcagcagagaguuuucaaagagaaaguagacacaagaacuccgcgcuccaugcccggcacccggcgcgugaugggcaucacggccgagugguuauggcggacgcuggggcguaacaagaagccccgcuuaugcacacgcgaagaguuuaccaagaaagugcgaaccaaugcggcgaugggcgccguguucacugaggagaaccagugggacagcgccaaggccgcaguggaggacgaagauuucuggaaacucgucgaucgggagcgcgagcugcacaagcuugggaaaugcgguucaugcgucuacaacaugauggggaaacgggaaaaaaaguuaggugaguucgggaaggccaaggggucacgugccaucugguacauguggcugggcgccagguacuuggaauuugaggcacuuggguuucugaacgaggaucacugguuuucccgcgagaauagcuacuccggcguggagggggaaggacugcacaagcucggcuacauccugcgagacaucagcaaaauccccgguggggccauguacgcggacgacacggccgggugggacacacggauuacggaggacgaccuccacaacgaggagaagauuacccagcagauggacccggaacaccgccaguuagcuaacgccaucuucaagcuaaccuaccagaacaaggugguaaagguacaacguccaacccccaccggcaccgugauggacauaaucucgcgcaaggaccagcgagggucgggccaggucggcaccuauggucucaacacguuuaccaacauggaggcgcagcucauccggcagauggagggggagggaguacugaccaaggcggaccuggagaacccucaucucagcgagaagaagauaacccaauggcuagagacgaaaggggucgagcgccugaaacggauggcaaucucgggggaugauugcguagugaaaccuaucgacgaccgcuucgcaaacgcccugcuggcguuaaacgauauggggaaggugcggaaggacaucccccaauggcagccuuccaaggguuggcacgacuggcagcagguccccuucugcagccaccacuuucacgaguugaucaugaaggacgggcggaaacucguagugccaugccggccccaggaugaguuaaucggccgcgcacgcaucucccagggggccggauggucccuccgcgagacggcaugucugggaaaggcuuacgcccaaauguggucacuaauguauuuccacaggcgagaccugcgccuggcaagcaacgccaucugcucugcagucccagugcacugggugccaaccucgcgaaccacaugguccauccaugcacaccaucaguggaugacgacugaggacauguugaccgucuggaaccgcguguggaucgaagacaacccauggauggaagacaaaacgcccguaaccaccugggagaacguccccuaucucgguaagcgggaagaccaguggugcggaucccuuauaggguuaaccagccgcgccacgugggcccagaacaucccuaccgcaauccaacaaguacggucccucauuggaaacgaggaguuucuugauuacaugcccaguaugaagcgcuuccggaaggaggaggaaagcgagggggccauaugguga

SEQ ID NO: 25934 - RNA, 9873 nt, Artificial Sequence
  derived and/or modified CDS sequence (opt11) from DENV-3__EU529696__SS-prME
accagccucugccucaugaugauccugccggccgcccuggcauuccaucucaccagccgcgacggugagccccggaugaucguggggaagaacgagcgcggcaagagcuugcuguuuaagacagcgucuggaaucaacauguguacccugaucgccauggaccugggcgagaugugcgacgacaccgucaccuacaaaugcccacauaucacggaggucgagcccgaggacauugauugcugguguaaucuaaccagcaccugggugaccuaugggacaugcaaccaggccggcgagcaccgccgcgacaagcgaaguguggcccucgcgccgcacgucgggauggggcucgacacucgcacgcagaccuggaugagcgccgagggcgcuuggcgccagguggaaaaagucgaaacgugggcacugcgccaccccggguucaccauccucgccuuguuccuugcccacuacaucggcaccucccucacacagaagguggugaucuucauuuugcugaugcuggucacgccaagcaugacgaugcggugcguggguguaggcaaccgagacuucgucgagggccugucuggggccaccuggguggacgugguccuggagcacggcggcugcgucacuaccauggccaaaaauaaacccacccucgacaucgaacugcagaagaccgaagccacccagcuagcgacgcuccggaagcugugcauugagggcaagaucaccaacaucaccacugauagccgcugcccaacgcagggcgaggcagugcugccggaggagcaagaccagaauuacgucuguaagcacacuuauguggaucggggcugggguaacgguugcggccucuucgggaaggggucucuggugacaugcgccaaguuccaaugccuggagcccaucgagggcaaggucguucaauacgagaaccucaaguacaccgugauuaucacuguccacaccggcgaucaacaucaggugggcaacgagacccaagggguuaccgccgagaucacgccccaagccucuacaacggaggcuauccugcccgaguauggcacucuuggucuugagugcuccccccgaaccggucuggacuucaacgaaaugaucuuacucacgaugaagaacaaggcuuggauggugcaucggcagugguuuuucgaccugccccugccauggaccucgggcgcaaccaccgagacccccacguggaaccgcaaggaacuccucgugacauucaaaaacgcgcacgccaagaagcaagaagucgugguguuagggucccaggaaggcgcgaugcacacagcccuuacgggugcuaccgagauucagaacucaggcggcaccucgaucuucgcgggucaccuaaagugccgacugaagauggacaagcuagaacuaaagggcaugagcuacgccaugugcaccaacacauucguccuaaagaaggaggugucggaaacccaacacgggacgauccucauuaaaguagaguauaagggcgaggacgcgccuuguaaaauccccuucagcaccgaggaugggcaaggcaaggcccauaacggccgacugaucacagccaaccccgucguuaccaagaaggaggagcccguaaacaucgaggccgagccgcccuucggggagagcaacaucgucaucggcaucggggacaacgcgcuuaagauaaacugguacaagaagggcuccagcaucgggaagauguucgaggcgaccgcucggggggcacgccggauggcuauauuaggcgacaccgcuugggacuucggguccgugggcggggugcucaacagccuagggaagaugguccaucagaucuucgguuccgccuacacggccuuguucagcggggugucguggguaaugaaaaucggcaucggcguucuccugaccuggaucggucugaacagcaagaacacgagcaugaguuucuccuguaucgccaucgggguaaucacccucuaccuaggcgcagugguccaggcggacauggggugcgugaucaauuggaagggcaaggagcuuaaguguggcagcggaaucuucgugacuaacgagguucacaccuggaccgagcaauauaaauuccaggcagacuccccaaagcgacucgccacggcaaucgccggagcuugggagaacggggugugcggcauccgaucuacaacccggauggagaauuugcuguggaaacagaucgcaaacgagcucaacuauauccuaugggaaaauaacaucaagcugaccguggucguuggggacaucaucggcgugcucgaacagggcaagaggaccuugacgccccagccgauggaacugaaguacuccuggaaaaccugggggaaagccaagauugugacggcggagauccagaacagcuccuucaucaucgacggccccaacaccccagagugccccagcgcgagucgggcuuggaacgugugggaaguugaggacuacggguucggcguguucacgaccaacaucuggcucaaacugcgggagguguacacccaacugugcgaucaccggcucauguccgcggcggugaaggacgagcgggccguacaugccgacaugggcuacuggaucgaaagccagaagaauggguccuggaaguuggagaaggccagccugaucgagguaaagaccugcaccuggccgaaaucccacacgcucuggucuaacggcgugcuugagucggacaugaucauuccgaagagccuagccgggccaaucucccagcauaacuaccggccgggcuaccacacccagaccgccgggcccuggcaccuagggaagcuagaccuugacuucaacuauugcgagggcacaacggucgugaucaccgaaaacugcgggacucgcggccccagccuccggacgacgacuguguccgguaagcugauucacgaauggugcugcagaagcugcacucugccaccccuccgguacaugggcgaggacgggugcugguacggcauggagauuagaccaaucuccgagaaggaggaaaacauggucaagagccuaguguccgccggcagcgggaaggucgacaacuucaccaugggugucuuauguuuagcgauccuguucgaagaggugaugagagggaaauucggcaagaagcauaugaucgcggggguguucuucacguucguccugcuccugucaggccagaucaccuggcgcgauauggcccacacccucaucaugaucggcagcaacgcauccgacaagauggggaugggcgucacauaccucgcccugaucgcgaccuucaagauacagccuuuccuggcccucgguuucuuccuaaggaaauuaaccagcagggaaaaccuccuguugggcgugggccucgcuauggcgacaacccugcagcugcccgaagauaucgaacagauggcgaaugggauugcccucggcuuaauggccuuaaagcuaaucacgcaguucgagaccuaccaauuauggaccgccuugaucucucugaccugcuccaacacgauguucacccugaccguagccuggcggaccgcuacguuaauccuugccggggugucgcugcugccggucugccaguccagcuccaugcguaaaacggacuggcucccaauggccguugccgccaugggcgugccacccuuaccgcuuuucaucuucagccucaaagauacccugaaacggcgguccuggccccugaaugagggaguuauggcgguggggcucgugagcauccuggcguccagccugcuccgcaacgauguccccauggccggcccacuuguggccgggggccugcucaucgccugcuacgugauaaccgguacuagcgccgaccugaccguggagaaagccgccgacaucacuugggaggaggaggccgagcaaacaggugugagccauaaccuaaugaucacgguggacgacgacgggacaaugcggaucaaagaugacgagaccgagaacauacucaccguucuacugaaaaccgcacuccugaucguuucuggaguguucccuuauagcauuccagcgacacugcuaguuuggcauaccuggcagaagcagacucagagauccggcgugcugugggacgugccuucgccaccggagacccagaaggcagagcucgaggagggaguuuaccguauuaagcagcaggggaucuuugggaagacccaaguaggcgucgggguccagaaggaaggcguguuccacaccauguggcacgugacccgcggcgccguccucaccuacaaugggaagcgccuggagcccaacugggcuagugugaaaaaggaccugaucagcuacggcgggggcuggcgccuguccgcgcaguggcagaaaggggaggaagugcagguuauugccguggagccgggcaagaauccuaaaaauuuccaaaccaugcccggcaccuuccaaacaaccacgggggagaucggcgccaucgccuuagacuuuaagcccggcaccagcggcagccccaucauuaacagagaaggcaagguagucggguuguacggaaacgggguagugacgaagaacggcggguacgucuccggcaucgcccagacuaacgcggagccggacggaccuacgcccgagcuagaggaggagauguucaaaaaacggaauuugacuauaauggacuugcaccccgggaguggcaaaacgcgaaaguaccugcccgcagugguccgcgaggccaucaagcggcgcuugcggacgcucauccuggcccccacgcgcgucgucgccgcggaaauggaagaggcguugaaggggcuacccauccgguaccagacuaccgcaaccaaguccgaacacacgggccgcgaaauuguggaccugaugugccacgcaaccuucaccaugcgguuacugagcccugucagagugccaaacuacaaccugaucauuauggaugaggcccacuucacggacccugcuuccaucgccgcccgcggguacauaagcacgcgcgugggcaugggagaggcugccgcuaucuuuaugacugccacgccgcccgggacggcugacgccuucccgcaguccaaugcgccuauacaagacgaggagcgggacaucccggaacgcucguggaacuccgguaacgaauggaucacggacuuugccgggaaaaccguuugguucgugccuuccauaaaagcaggcaacgauaucgccaacugccuccggaagaacgggaagaaggugauccagcugucccggaagaccuuugauaccgaguaucagaagacgaaauuaaaugauugggacuucguuguaacgaccgacauuagcgaaaugggcgcgaacuucaaggcggaucgugucauagacccacggcggugcuugaagccaguuauacugaccgauggccccgagcgggucauccuggccgggcccaugccgguaaccgccgccuccgccgcgcagaggcgcggcagggucgggagaaacccccagaaggagaacgaucaguacaucuuuacuggccagcccuuaaacaacgacgaagaccacgcccacuggacggaggccaaaaugcugcuggacaacaucaauacaccugaggggaucaucccugcccucuucgagccggagcgcgagaaauccgcggccaucgacggcgaguaccggcugaaaggggagucccgcaaaaccuucguggagcucaugcggagaggcgaccugcccguaugguuggcacauaagguagcgagcgagggcauuaaguacaccgaccggaaaugguguuucgacgggcaaaggaacaaccagauccuggaggagaacauggauguggagaucuggaccaaggagggugagaagaagaaacuccguccccgcuggcuggacgcccggaccuauuccgauccgcuggcccucaaggaauucaaggacuucgccgcgggacgcaagagcauugccuuagaccugguaaccgagaucggucgcgugcccucccaccucgcccauagaacccgcaaugcgcuggacaaccuagugauguugcauacaagcgagcauggcgggcgggccuaccgccacgcagucgaggaacugcccgagaccauggagaccuuacuccugcugggccucaugauacugcugacuggcggagcgaugcuguuccugauaagcgguaaagggaucggcaagaccuccaucgggcugaucugcgucaucgccagcagcggcauguuauggauggcggaaaucccgcuacaauggaucgcgucggcaauaguuuuagaguucuucaugaugguacuccucaucccggagcccgagaaacaacggacgccccaggauaaccagcuggccuacguggugauagguauccucacacuggccgcgaucaucgcagccaacgagaugggccuguuggagacgaccaagcgcgacuuaggcaugucuaaggagccgggggucgugucccccacaucguaccuggacguggaccuacaccccgcaucagcguggacccuguacgcaguugccacuaccgugaucaccccuaugcugcggcacaccaucgagaauuccacggccaacguuagccucgcugcgaucgccaaucaggcggucguucugaugggguuggacaagggguggccgauauccaagauggaccucggcgugccucugcuggcccucgggugcuacagccagguaaacccgcuuacccuaaccgccgcugugcugcuguugaucacacacuacgccaucaucggcccuggucuccaggccaaggccacucgcgaagcccagaaacggacugcggcagggauaaugaagaauccaacaguagauggcaucaugaccauagaccuggauccugucaucuacgacucgaaauuugaaaagcagcuaggccaggugaugcucuugguucugugugccguccagcuccugcugaugcgcacuucaugggcccucugugaggcgcugacccuggccacgggccccaucaccacgcucugggagggcuccccaggaaaguucuggaauaccaccaucgcggucagcauggcgaacaucuuccggggcuccuaucuggccggggcgggcuuggccuucaguaucaugaaguccguaggaaccggcaaacgcggcacugggagccaaggcgagacccucggggaaaaauggaagaagaaacugaaccagcugucucggaaagaguucgaccucuacaagaaguccgggaucacagaggucgaucgcacugaagccaaggaggggcucaagcggggagagacaacacaccacgccguguccagaggcaccgcgaaguugcaaugguucguggaaaggaacauggucaucccggaggggcgcgugaucgaccucggcugcggaagaggcgggugguccuacuacugcgcuggcuugaagaaggucacugaggucagaggcuacacgaagggcgggccaggucacgaggaacccgugccaaugagcacguacggcuggaacaucgugaagcugaugagcgggaaggaugucuucuaccucccucccgagaagugugauacccugcugugugacaucggcgagucguccccauccccaaccguggaggagaguagaaccaucagagugcucaagauggucgagccuuggcugaagaauaaccaauuuugcaucaaggugcugaaccccuacaugcccacugucaucgagcaucuggagcgccugcaacggaaacauggcgggaugcugguccgcaacccucuuagccguaacuccacccacgagauguacuggaucagcaacgggaccggcaauauuguggccuccguuaacauggucagccgcuuguuacugaaccgguucaccaugacgcaccgccggccgaccauagagaaggacguggaccucggcgccggcacccgccacgugaacgccgagccagagacccccaacauggacguuauuggggagcggaucaagcgcaucaaggaggagcacaacuccaccuggcacuaugacgacgagaacccauacaagaccugggccuaccacggcagcuacgaggucaaggcgaccgggucggcuagcuccaugauuaauggcgucgugaagcuuuuaaccaagcccugggacguagucccgaugguuacgcagauggccaugaccgauaccacuccauucgggcagcaacggguguucaaggagaaggucgacacgcgcaccccgaggagcaugcccggcacacgcagggugaugggaauuacggcggaguggcuauggcggacacuggggcggaacaagaagccaagacuguguacccgggaggaguucaccaagaaggugcgcacuaacgcggccaugggcgccguguucacggaggagaaucagugggacagcgccaaggccgcgguggaggaugaggauuucuggaagcucguagaccgcgagcgugagcugcacaagcugggaaagugcggcuccugcguuuacaauaugaugggaaagcgggaaaaaaaacuuggcgaguucgguaaggccaaaggaucacgggccauaugguacauguggcugggcgcccgcuaucuggaauuugaggcgcucggguuccugaaugaggaccacugguucucccgggaaaacagcuacuccggcguggagggggaagggcuacacaagcugggcuacauccugcgcgacaucagcaagauccccgggggcgcuauguaugccgacgacaccgcggggugggacacccggaucaccgaggaugaucugcacaacgaggagaaaaucacgcagcagauggacccugagcaccgacagcucgccaacgccauuuuuaagcugacguaucaaaacaagguggucaaggugcagagaccgacucccaccggcacggugauggacaucauaucacggaaggaccagcgggggagcgggcaggucggcacguaugggcugaacaccuucacuaacauggaggcgcaacucauccgccagauggaaggcgagggagugcuguccaaggccgaccuagagaauccccacuugccggagaagaagauuacccaauggcuggagacaaaaggcguggagcguuuacgcagaauggccaucagcggcgacgacugcgucgugaagcccaucgacgacagauucgcgaacgcucucuuggcacugaacgacauggggaaggucagaaaggacaucccccaguggcaacccaguaagggcuggcaugauuggcagcaggucccguucugcagccaucacuuccacgagcucaucaugaaagacgggcgaaagcugguugugccaugccggccccaagacgaacugaucggacgggcgcggaucucccagggggccggcuggucucuucgcgagaccgccugccugggcaaggcguacgcccaaauguggucucugauguacuuccacagacgggaccuccgccuugccagcaacgcgaucugcucugcggucccugugcacugggucccgaccucccggaccacuugguccauucaugcucaucaccaguggaugacgaccgaggacaugcugaccgucuggaaucgcguguggaucgaagauaaccccuggauggaggacaaaacgcccgugaccaccugggaaaauguccccuaucuugggaagagagaggaccaguggugcgguagccucaucggguugaccagccgcgccaccugggcccagaacaucccgacagcaauccaacagguccggucgcucauaggcaacgaggaauucuuagacuacaugcccagcaugaagcgcuucaggaaggaggaggagagugagggggccaucugguaa

SEQ ID NO: 25935 - RNA, 9873 nt, Artificial Sequence
  derived and/or modified CDS sequence (opt11) from DENV-3__EU529697__SS-prME
accagccuuugccucaugaugauccugcccgccgcccuggcguuucaccucacgucccgggacggggagccccggaugaucguggggaagaacgagcgcggcaagagccuccuuuucaagacagccagcgguaucaacauguguacccucaucgccauggaccucggagaaaugugugacgacaccgugaccuacaaguguccucacaucgccgagguggagccggaggacauagauugcugguguaaucugaccagcaccuggguaacauacgggaccugcaaccaagcgggcgagcaccggcgcgacaaacgguccguggcgcucgcgccccacgucgguauggggcuggacacgagaacgcagaccuggaugagugccgaaggcgccuggcggcagguugagaaggucgagaccugggcgcugagacaccccggguuuacaauccucgcccuguuccuggcccacuacaucggaaccagucugacccagaagguggugaucuucgucuugcugaugcucgugacccccaguaugacgaugcggugcgugggggucggcaacagagacuucguggaaggccuguccggagccaccuggguagauguagugcuggagcacggcgggugcgugaccaccauggccaagaauaaacccacgcucgacauugagcugcagaagaccgaggcgacccagcuagccacccuccggaagcuaugcaucgaaggcaaaaucacgaacaucaccacugauagcagauguccaacgcagggcgaggccgcccugccggaggagcaggaccagaacuacgucugcaagcacacguacguggaucgcggcuggggcaacgggugcggccucuucgggaaaggcucccuggugaccugcgcaaaguuccagugccuggagcccauugaaggcaagguugugcaguacgagaaccucaaguacaccgucaucaucaccguccacacuggggaccagcaccaggugggcaacgagacccagggggucaccgccgagauuacgccccaggcgagcacgacugaggccauccugccugaguacggcacacuggggcucgagugcuccccgcgcaccggccuggacuucaaugagaugauccugcucaccaugaagaacaaagccuggauggugcacaggcaaugguucuucgaccugccucugcccuggacgucuggcgcaacuaccgagacucccacauggaaccggaaggagcucuuagugacauucaagaacgcgcaugccaagaaacaggagguagucgugcuggggucccaggagggcgccaugcauaccgcucucacgggggccacggagauccagaacagcggcggcaccuccaucuuugcgggccauuuaaagugucggcuaaagauggacaagcucgagcugaaaggcaugagcuaugccaugugcaccaacacguucguuuugaagaaggagguuuccgagacgcagcacggaacgauccucaucaaggucgaauacaaaggcgaggacgccccgugcaagaucccguucucaaccgaggacggucaggguaaggcgcacaacggacggcugauaaccgcgaaccccgucguaacaaagaaggaggagcccguuaacaucgaagccgagccacccuucggcgagagcaacauugucaucggcaucggggacaacgcgcugaagauaaacugguacaagaaagguuccaguaucgggaagauguucgaggccaccgcccggggcgcgaggcggauggccauccugggcgacacugccugggacuucggguccgugggcgguguccucaacagccuggggaaaaugguccaccagaucuucggguccgccuacacggcccuguucagcggggugagcugggugaugaagauugggaucgggguucucuuaacguggaucgggcugaacagcaagaacacaucuaugagcuucaguuguaucgccaucgggaucaucacccucuaccugggagccguggugcaagccgacaccgggugugucauaaacuggaaggguaaagagcugaagugcggcagcggcaucuucgugacaaacgaaguccacaccuggaccgagcaguauaaguuccaggccgacuccccaaaacgccuggcaaccgcgauagcgggcgccugggagaacgggguaugcggcauccgcucgacgacacggauggagaacuuacuguggaagcagguugccaacgagcucaauuacauccucugggagaauaacaucaaacugaccgugguggugggggacaucaucggggugcucgagcaggggaagaggacccugacgccccagccgauggagcugaaguacuccuggaagaccuggggcaaggcgaagaucgucaccgccgagacccagaacagcuccuucaucaucgacggcccaaacacgccagaaugcccgagcgccucccgugccuggaacgugugggagguggaggacuauggguucggcgucuucaccaccaauauaugguuaaagcugcgcgagguguacacccagcuaugcgaccaccggcucaugagcgccgcggugaaggaugaacgugcuguccacgcugacaugggcuacuggaucgagucucaaaagaauggguccuggaagcuggagaaggccagccugaucgaagugaagaccugcacguggccaaagucccacacccucuggagcaacggaguucuugaauccgacaugauaaucccuaaaagucuggcugggcccaucucacagcauaauuaccgacccggauaccacacacagaccgcggggccauggcaucugggaaagcuagagcuggacuucaacuacugcgagggcacgacgguugugaucacugagaauugcgggacacgcggccccagccuccgaacgaccaccguguccgggaagcuuauccacgaguggugcugcaggagcugcaccuugcccccguugagguauaugggggaggacggguguugguacggcauggagauccgccccaucuccgagaaggaagaaaacauggucaagucacuggugagcgccggcagcggcaagguggacaauuucaccaugggcguuuuaugccucgcaauccuguucgaggagguaaugaggggcaaguuuggcaagaagcacaugaucgcggggguguucuucaccuucgucuugcuccuguccggucagauuacguggcgcgacauggcacacacccugaucaugauuggcucgaacgcuagugaccggauggggaugggcguuacgcaccucgcccugauagccaccuucaagauccagcccuuccuggcccucggcuucuuccugcgcaagcugacuagcagggagaauuuauuacugggcgugggccuggcgauggccaccacccugcagcuacccgaagacaucgagcagauggccaacggaaucgcacucggacugauggcucuaaagcucauuacccaguucgagaccuaccaauuauggaccgcgcugaucagcuuaacgugcuccaacaccaucuucacccuaaccgucgcauggagaaccgccacccugauccucgcgggggugagccugcugccggucugccaauccuccuccaugcggaaguccgacuggcuucccaugaccguggccgcgaugggcgugccgccccuaccccuguucaucuucucccucaaggacaccuuaaagcgccgcucuuggccacugaaugagggugucauggccgugggccucgugucgauauuggccucaagucuucuccggaacgacguccccauggccggccccuugguagccggagggcugcucaucgcguguuauguuauaacggggacauccgcugaucugaccgucgagaaggccgccgacguaaccugggaggaggaggccgagcagaccggggugucccacaaucuaaugauaaccgucgacgacgauggaaccaugcgcaucaaggacgacgagacugaaaacauccucaccgugcugcuaaaaacagcucucuugaucgugucagggauauuuccguacuccauccccgccacccuccucgucuggcacacguggcagaaacagacccggcgcagcggcgugcugugggacguccccucaccgccggagacgcagaaggcagagcuggaggagggggucuaccggaucaagcagcagggcaucuucgggaagacccaagucggcguugggguccagaaggagggcguguuccacacuauguggcacgugacucgcggcgccguccucacguauaauggaaagcggcuggagccaaacugggcgagugugaagaaggaccugauauccuacggcgggggcuggcgccucagcgcccaguggcagaagggagaggagguucaggucaucgccguggagccuggcaaaaaccccaagaacuuccagaccaugcccgguacauuccagaccacgaccggugagaucggcgccaucgcccuggacuuuaagcccgggaccagcgggucgcccaucaucaaccgggaggggaaggugguagggcuguacgguaacgggguugugaccaagaacggaggguacgucagcggcaucgcgcagacgaacgccgaaccggauggccccaccccagagcuggaggaggagauguucaagaagcgcaacuugaccauuauggaccugcaccccgguucaggcaagacccguaaguaccugccggccaucgugcgcgaggccaucaagcggagacuccggacauugauccuggcucccaccagggugguggcagcggagauggaggaggcucucaaggggcugcccauccgguaucagaccaccgcaaccaagagcgagcacaccggucgcgagaucguggacuugaugugucaugccaccuucacuaugcggcuccugucccccgugcgcguccccaauuauaaccuuaucaucauggacgaagcucacuucacggacccggccagcauagccgcccggggguauauuuccacccgcgugggcaugggcgaggcggccgccaucuucaugaccgccacgccgccugggacugccgacgcuuucccacagagcaacgcccccauccaggacgaggagagagacauccccgagcgguccuggaacagcgggaaugaguggaucaccgacuucgccggcaagaccgucugguucguccccuccaucaaggccggaaacgacauagcaaacugccuucgcaagaaugggaagaaggugauucaacuaagccggaagacauucgacacggaguaccagaagacaaagcugaaugacugggacuucguagucaccacugacauauccgagaugggcgcgaacuucaaagcagauagggugaucgacccgcgacgcugcuuaaaacccgugauccugacagacggccccgagcgugucauccuggccgggcccaugccggucacggcggcaagcgcggcgcagcgccggggccgcguggggcgcaauccccagaaggagaacgaccaguacaucuucacuggacagccucucaacaacgacgaggaccacgcccacuggaccgaggccaagaugcugcucgacaacaucaacaccccugaggguaucauaccggcccucuucgagcccgagcgugagaaguccgcagccauagacggcgaguaccggcugaaaggcgagagcagaaagacguucguugagcucaugcggcggggggaccucccaguguggcuggcccacaagguagccuccgaaggcaucaaguacacggaucggaagugguguuucgacgggcagcgcaacaaccaaaucuuggaggagaauauggauguggagauauggaccaaggaaggcgagaagaaaaaguuacgucccagguggcucgacgcgcgcaccuauagcgacccgcuggcccucaaagaguucaaggauuucgccgccggacggaagucgauagcucuggaucuggucacggagaucgggcguguacccagccaccucgcucaccggacccguaacgcccuggacaaccuggugaugcuccauaccuccgaacacggagggaaggccuaccggcaugccguggaggagcuucccgagaccauggaaacgcugcuccuccugggccucaugauucugcugaccgggggcgccaugcuguuccugaucuccggcaaagggaucggcaaaaccuccaucgggcugaucugugucaucgcgagcucugguaugcucuggauggccgagaucccgcuucaguggaucgccuccgccaucgugcuggaguucuucaugauggugcucuugauccccgagccggagaagcagcgcacgccacaggacaaccagcuggccuacgucguaauagggauacucacgcucgcggcaauaaucgcugcuaaugagaugggguuauuagaaaccaccaaacgggaccuaggaaugucuaaggaaccggguguagucucuccgacgagcuacuuggacgucgaucuccaccccgcgucagccuggacgcuguacgcgguggccacgaccgucaucacucccaugcugcgccacacgaucgagaacagcacugccaauguguccuuggcagccaucgcgaaccaggccguggugcucaugggacugaacaagggguggccgaucagcaagauggaucucggcguacccuugcuggcgcuugggugcuauucccaggugaacccccugacccugaccgcggccguccuccugcugaucacgcacuacgcuaucaucgggccgggccuccaggccaaagcuacccgggaggcccagaagcgcaccgccgcagggauuaugaaaaacccgaccguagacggaaucaugacgaucgauuuagaucccgugaucuacgauucaaaguucgagaagcagcuggggcagguuaugcuccugguguugugugcugugcagcuccugcugaugcggaccuccugggcgcucugcgaggcccugacacuggccaccggccccaucacgacccucugggagggcucuccggggaaguucuggaacacaaccaucgccgucaguauggcgaacaucuuccgcggcucuuaccucgcgggcgccggccucgccuucuccauuaugaagucaguagggacgggaaagcgaggcacugguagccagggcgagacccucggggagaaguggaagaagaaguuaaaccagcucucccguaaggaguucgaccucuauaagaaguccgggauuaccgaggucgaccggacagaggccaaggaaggccugaagcgcggcgaaauaacgcaucacgccgucucccggggcucggcgaagcuucaaugguucgucgaacggaacaugguuaucccugagggucgggucaucgaccuaggcugcggucgcggcggguggucauacuauugcgccggccucaagaagguaaccgaggugcggggcuacaccaagggcgggcccgggcacgaggagccggucccgaugaguaccuacggcuggaacaucguaaagcugauguccggaaaggauguguucuaccucccgcccgagaagugcgacacucugcugugcgacauuggcgagucgucgcccucccccacgguagaagagucccgcaccauccgcgugcugaaaaugguggagccgugguuaaagaacaaucaguucugcaucaagguucugaaucccuacaugccaaccgugaucgagcaccuggagcggcugcagcgcaagcacggcgggaugcuggugagaaauccccugagccguaacuccacacacgagauguacuggaucagcaacggaaccgggaauaucguugccuccguuaacauggugagccgucuacugcugaaccgcuucaccaugacccaccggcgcccaacgaucgagaaggacgucgacuugggagccggaacccgacacgugaacgccgagccggagacccccaacauggauguaauaggagagcgaaucaagcgaaucaaggaggaacacaacuccaccuggcacuaugacgacgaaaacccuuacaagacgugggcauaucacggcagcuacgaggucaaggccaccgguuccgccagcagcaugaucaacggcguggucaagcugcugaccaagccgugggacguggugcccauggucacgcagauggccaugacggauaccacacccuucggccagcagcgcguguucaaagagaaaguggacacacggacgccgagaagcaugccuggcacccggcgcgucaugggcaucaccgcggagugguuguggcggaccuuaggucgcaacaagaagccccggcugugcacgcgcgaggaauucaccaagaaggugcgcaccaacgccgccaugggcgccguguucaccgaggaaaaccagugggacagcgccaaggccgccgucgaggacgaggacuucuggaagcucguagaucgggaacgugagcuccacaagcuggguaaguguggcuccugcgucuacaauaugaugggaaagcgggagaagaagcuaggugaauucgguaaagccaaagguagccgcgccaucugguacauguggcucggcgcccgguaccuggaauucgaggcgcucggguuccugaacgaggaucacugguucucccgagagaacagcuacuccggcguagagggggaagggcugcauaagcuuggcuacauccugcgggacaucucgaagauccccgggggcgcgauguaugccgacgacacggcugggugggacacccgcaucacggaggacgaccugcacaacgaggagaagaucacccagcagauggacccggagcaccggcagcuggccaacgcgauauucaaacugacguaucagaacaagguggugaagguccagcgacccacacccaccggcaccgugauggacaucauaucccggaaggaccagagggguagcgggcaggucggaaccuaugggcugaacacguucacgaacauggaagcccagcucaucaggcagauggagggcgagggcguccugaccaaggccgaccuggagaacccccaccucuccgagaaaaagaucacccaaugguuagagacgaagggaguggagcgccugaagcggauggccaucagcggcgacgacugcguggucaagccgaucgaugaccguuucgcaaacgcguuacuggcccugaacgacauggggaagguuaggaaggacauuccucaguggcagcccuccaagggcuggcacgauuggcagcaaguucccuucugcagccaccacuuccacgaguuaauuaugaaggacggccgcaagcuagucguuccuugccgaccccaggaugagcugaucggccgcgcgcggaucucccagggggccggcuggucucuccgggaaaccgcuuguuuaggcaaagcuuacgcccagauguggucccugauguacuuccaccgcagggaccuccgccuggcgagcaacgcaaucugcuccgcagugcccguccacugggugccaaccagucggaccacguggagcauccacgcccaccaccaguggaugaccaccgaggacaugcucaccguguggaaccgcguguggaucgaggacaacccguggauggaggacaagacgcccgugaccaccugggagaacgugccauaccucgguaagagggaagaccaguggugcggcucccugaucgggcugaccagccgugcaacgugggcucaaaauauccccaccgccauccagcagguacgcucccucauagguaacgaggaguuccuggacuauaugccgagcaugaaacgauuucggaaagaggaagaguccgaaggcgcgaucugguga

SEQ ID NO: 25936 - RNA, 9873 nt, Artificial Sequence
  derived and/or modified CDS sequence (opt11) from DENV-3__EU482564__SS-prME
accagccucugccucaugaugauucugccggccgcccuagcuuuucaccucaccucgcgugacggagagccuaggaugaucguggggaagaacgagaggggcaagucccugcuauucaaaacggccuccggcaucaauaugugcacccucaucgcaauggaccucggggagaugugcgacgauaccguaacauauaagugcccccauaucacggaaguggaaccugaagauauagacugcuggugcaaccugaccagcaccuggguuaccuacgggacguguaaccaggccggcgaacacagacgggacaagcgguccgucgcuuuagcgccgcacguggguauggggcuggacacccgcacgcagacauggaugucugcagagggagcuuggcgccagguggagaaggucgaaaccugggcccugcgccacccaggauuuaccauccuagcccuguuucuggcacauuacaucgggaccucccucacccagaagguggugaucuuuauccugcugaugcucgucacgcccagcaugaccaugcguugcguugggguuggcaaccgggacuucgucgagggccuguccggggcgaccuggguggacgucguuuuggagcacggcgggugcgugacgacgauggccaaaaacaaaccuacgcucgauauagaacugcagaaaaccgaagcuacucaauuagccacccuccguaaacugugcaucgagggcaagauaaccaauauuaccacugauagccgcugccccacacagggcgaagccgugcugccggaagagcaggaucagaacuacgugugcaagcacacauacguggaccggggguggggcaacgguugcggucuguucgggaagggcucccuggugaccugcgcaaaguuccaaugccuggagcccaucgaagguaaggucgugcaguaugagaaccucaaauacaccguuaucaucacgguccauaccggggaccagcaccaggugggcaacgaaacgcagggcgucaccgcugagauaacgccccaggccagcaccacggaggccaucuugcccgaguacggaacccugggacuggagugcucgccgcguacgggccuugacuucaacgagaugauacuucuaacgaugaagaacaaggccuggaugguucacagacaaugguuuuucgaccugccgcugcccuggacuagcggcgccacaaccgagacgccaacguggaaccgcaaggagcuccuggugaccuucaagaaugcccaugccaagaagcaggaggucguggugcuggggucccaggagggcgcgaugcacaccgcccucacgggggccaccgagauccaaaacucaggagggaccaguaucuucgcuggccacuuaaaaugccggcucaagauggacaagcuggaauuaaagggcaugaguuacgcaaugugcacgaauacguucguccugaagaaggaaguuuccgagacccagcacggcaccauccugaucaaaguugaauauaagggugaggacgcgccgugcaagaucccguucagcacagaggacgggcagggcaaggcacacaaugggaggcucaucacugccaacccggucguaacgaaaaaggaggagccgguaaacauagaagccgagccacccuucggcgagucuaauaucgucauaggcaucggggacaacgcguugaagaucaacugguauaagaaaggcuccucuaucggaaaaauguuugaggccaccgcucggggcgccaggcgcauggccauacugggcgacacagcgugggacuucggguccguagggggagugcucaauucccugggcaagaugguccaccaaaucuucggguccgccuacacugcccucuucagcggcgugucuugggucaugaaaauaggaaucgggguccuccuaaccuggaucgggcucaacucaaagaacaccuccaugagcuuuuccugcaucgccaucggugucauaacucucuaccuaggagcgguaguacaagcagacauggggugcgucauaaacuggaaggggaaggagcucaagugcggaagcggcauauuugugacgaaugagguccacaccuggaccgaacaauacaaguuccaggccgacuccccuaagcgccuugccaccgccaucgccggcgcgugggagaacggggugugcgguauccgcagcacgacccggauggagaaucugcuguggaagcaaauugcuaaugaguugaacuacauacuaugggaaaacaacaucaaguugacggucgucgugggcgacauuaucggcgugcuggagcagggcaagcgcacccugacaccccaaccuauggagcugaaguacuccuggaagaccuggggcaaggcaaagaucgucaccgccgaaauccaaaacucaaguuucaucaucgacggcccaaauacgcccgagugcccaucggcuucccgagcguggaacgugugggaagucgaggacuacggguucgguguuuucaccaccaacaucugguugaaauugcgcgagguauacacacagcucugcgaccaccggcucaugagcgcugcggugaaggacgagcgcgcgguccaugcugacaugggcuacuggauugagagccagaagaacgguaguuggaagcuggaaaaggccagccugauagaggugaaaaccuguaccuggccgaagagucacaccuuauggagcaacggugugcuggaguccgacaugaucauccccaagagcuuggccgggccuaucucucagcacaauuaccggccgggcuaccacacccagacggccgggcccuggcaccuuggcaagcuggaccuggauuucaauuacugcgagggcaccacgguugugaucaccgagaauugcgggacucgacggcccucucuccgaaccacgaccgugucggggaagcugauccaugaauggugcugccggagcugcacucuuccgccccuccgcuauaugggcgaggacggguguugguacgggauggagauccggcccauauccgagaaggaggaaaacauggucaaaagccugguguccgccggcaguggcaagguggacaauuuuaccauggggguccucugucuagcgauccuguucgaagaagugaugcgcggcaaguucgggaagaagcacaugaucgccggagucuucuucacauuugucuugcuccugagcgggcagauaaccuggcgggacauggcccacacccuuaucaugaucggcagcaacgccucagauaagauggguaugggggugacauacuuagcacuaaucgcgacguucaaaauucaacccuuccuggccuuaggcuucuuccuccgcaaacucacuucacgcgagaaccuauuacugggggucggccuugccauggccaccacacuucagcugcccgaggacauagagcaaauggcgaauggaauugcccuaggguugauggcgcugaagcucaucacgcaguucgagaccuaccagcuguggacagcucugaucagccugaccugcuccaacacgauguuuacuuuaacgguggcguggcgcacggcgacauuaauccucgcuggugugagcuugcugcccguuugccagucgucaucuaugcggaagaccgauuggcuccccauggcgguggcagcgaugggggugccgccccucccgcuguucaucuucucccucaaggacacccucaagcgccgcuccuggccccuuaacgagggcgucauggcgguagggcucgugaguaucuuagccagcagccugcuccguaacgacguccccauggcgggcccgcugguggccggcggucugcucauagcuugcuacgucaucacaggcacgagugccgaucugaccgucgaaaaagccgcggacaucaccugggaggaggaggcagagcagaccggggugucucacaaucugaugaucacgguggacgaugauggcacgaugcgaaucaaggacgaugagacggagaauauccucacaguccuccugaagacggcacuccugauagucucgggaguuuucccguacagcauccccgcgacgcugcuagucuggcauaccuggcagaagcagacccagcgguccggcgugcuaugggacgugcccagcccgcccgagacccagaaggcugagcuggaggaaggcgucuacagaaucaaacaacaggggaucuucggcaagacacaggugggaguuggcguccagaaggaagggguguuucauacaauguggcacgugacccggggcgcagucuugacauacaacgguaagaggcuggagccaaacugggccuccgugaagaaagaucucaucagcuacggaggcggguggcgacucuccgcccaguggcaaaagggggaggagguccaggucaucgccgucgagcccgggaagaacccgaagaacuuccagacuaugccaggcacguuccagacuacgaccggagagaucggggccauugccuuagacuucaagcccggcacuagcggaagcccaauuauuaaccgugaaggcaaaguggucggccuguacgggaauggcguuguuaccaaaaacgggggguaugucucugguaucgcccagacgaacgcggaaccagacggccccacgcccgagcuagaggaggagauguucaagaaacgcaaccucacaaucauggaccugcaucccggcucagggaagacacgcaaauaccugccggccguugugcgggaagcaaucaagaggcggcuccgcacccugauucuggcaccaacgcgggucguggcagccgagauggaggaagcccucaaaggccucccgauccgcuaccagaccaccgcgacuaagagcgagcauacugggcgggagaucguggauuuaaugugccaugcgaccuucaccaugcgccuccucagcccgguccgcgugcccaauuacaaccugaucauuauggacgaagcccacuucacagaccccgcgucaaucgccgcgcgcggcuauauuuccacacguguagggaugggcgaagccgccgcuaucuuuaugaccgccacgccgccugguaccgccgacgcauucccccaaucaaacgcacccauccaggacgaggagcgcgacauuccugagaggagcuggaacuccgggaacgaauggaucacggauuuugccggcaagacagucugguucguacccucgaucaaggccgggaaugacauagccaacugcuugcggaagaacggaaagaaagugauucagcuauccagaaagaccuucgacacugaguaccagaagacuaagcucaacgacugggacuucgucguuaccacagacaucagugagaugggggccaacuucaaggcggaucgggugaucgacccgcgccggugccucaagccagucauccugaccgacggucccgagcgcgugauauuagccggccccaugccggugacggccgccuccgcggcacaacggagagggcgggucggucgcaacccacagaaggaaaacgaccaguacaucuuuaccgggcaaccgcucaacaacgacgaggaccacgcccacuggacggaggccaaaauguugcuugauaauaucaacacucccgaggggauaaucccggcccucuucgagcccgagagagagaaguccgccgccauagacggggaauaccgccugaaaggcgagucccggaagacauucguggagcugaugaggcggggggaccucccagucuggcuagcccauaagguugcaagcgaggguauuaaguauacugauagaaaguggugcuucgacggccagcggaacaaccaaauccuggaagagaacauggauguggaaaucuggaccaaggagggugagaagaagaaguugcgcccgcgguggcuggacgcccgcaccuacuccgacccgcuggcucucaaggaguuuaaagacuuugccgccggcagaaagagcaucgcccuggaccuggucaccgagauagggcgggugccaucccaucucgcccaccgcacgcggaacgcgcuagauaaucuggucauguuacacaccagcgagcaugggggccgcgccuaccggcacgcggucgaagaacugcccgagaccauggagacccuucugcuacuggggcucaugauccugcugacgggcggggccaugcuguucuuaauaagcggcaaggggauagggaaaaccuccaucggacugaucugcgugaucgcaucuuccggcaugcuuuggauggcggaaaucccgcugcaguggaucgccagcgccaucgugcuggaguuuuucaugaugguccuacugauacccgaacccgagaaacagagaacgccccaggacaaccagcuggcguacguggugaucggaauccucaccuuagccgcgauaaucgccgcgaaugaaauggggcugcucgaaacaaccaaaagggaucucggcauguccaaggagccgggaguagugucccccaccaguuaccuggacguggaccugcaccccgccagcgcguggacccuauacgcagucgcaacgaccgugaucaccccaauguugcgccacacaaucgagaauuccacggccaacgugucgcucgccgcgauagccaaccaagcggucgugcugauggggcuggacaagggcuggccgaucuccaaaauggaccucgggguuccgcugcuggcgcucggcuguuauagccaagugaacccacugaccuugaccgccgcggugcuuuugcuuauaacccacuacgccauaaucgggcccgggcuccaggcuaaggccacgcgugaggcccagaagaggacagcggccggaaucaugaagaacccgacggucgacgggauaaugacgauagaucuggaucccgucaucuacgauucuaaguuugagaagcaguuggggcaagugaugcucuuagugcugugcgccguccagcuccugcuaaugcggacgagcugggcgcucugcgaggcgcuaacccuggcgaccgggccuaucaccacgcuaugggaaggauccccgggcaaguucuggaauaccaccaucgccguuucgauggcaaauaucuucagaggauccuaucuggccggcgccgggcuugccuuuuccaucaugaaguccguaggcaccggaaagcggggcacgggcagccagggggagacccugggcgagaaguggaaaaagaaacuuaaccagcuuagccgcaaagaguucgauuuauacaagaaguccgggaucaccgaggucgacaggaccgaggccaaggagggccugaagcgcggggagaccacacaucacgcugucucccggggcaccgccaagcuccagugguucguggagcgcaacauggucaucccagaagggcgcgugaucgaccucgggugcggucgcgggggcuggucauacuacugcgcagggcugaaaaagguaacagaaguccgugguuacacgaagggcgggccuggccacgaggaaccagugcccaugagcaccuauggcuggaacaucgugaaguugaugaguggcaaggacgucuucuaccucccucccgagaagugcgacacccugcugugcgacaucggcgagucaucgcccagcccaaccguagaggagucccgaaccauccgcgugcugaaaauggucgagccguggcucaagaacaaccaauucugcauaaaggugcuuaacccuuacaugcccacggugaucgagcaucuggagcggcuccagcgcaagcacggcggcaugcugguaaggaacccuuuaucuagaaauuccacccaugagauguacuggaucucgaacggcaccgggaacaucguugcauccgugaacauggucagccggcuccugcugaacagauuuacuaugacacaccggcgcccgacaaucgaaaaggacguggaccucggagccggcaccaggcacgugaacgccgaaccagagacaccgaacauggaugucauuggagagcgcaucaagcggaucaaggaggagcacaacuccacguggcauuaugacgacgagaacccguacaagaccugggcuuaucacggcagcuaugaggugaaggcuacuggcagcgccuccuccaugaucaacggggucgugaagcugcuaaccaagccgugggacguggucccaauggugacgcagauggccaugacggacacgacccccuucggccagcagcgcguguucaaagagaaggucgacacucggacuccgcggaguaugccaggaacccggcguguuauggguaucacggcagaguggcuguggcgaacccuggggcgaaacaaaaagcccagacugugcaccagagaggaauuuacuaagaagguacgcaccaacgcugccaugggggcagucuucacggaggagaaccaaugggacagcgccaaggccgcuguugaagacgaagacuucuggaagcuggucgaccgggagcgcgagcugcacaaguuagguaaguguggguccugcgucuacaacaugaugggcaagcgggagaaaaaacuuggggaguucggcaaggccaaggggagcagagccaucugguauauguggcugggggcccgcuacuuggaauuugaagcccucggcuuccugaacgaggaucacugguucagucgcgagaacuccuacuccgggguugagggcgaaggauugcacaagcucggcuacauccugcgggacaucagcaagauucccggcggggcgauguaugccgaugacacugcaggcugggacacccgaaucacagaggacgauuuacacaacgaggagaagauaacgcagcaaauggauccggagcaccgccagcucgcuaaugccaucuucaaacugaccuaccagaacaagguggucaagguucaacgccccacgcccaccggcacggucauggacaucauuuccagaaaagaucaaaggggcucaggccaaguggggacguacggacuuaacacguuuaccaacauggaggcacagcuuauccgucagauggagggcgaaggcguauuguccaaggccgaccuugaaaacccccaccuccccgagaagaagauaacccaaugguuggagacaaaagguguggaacgacugcggaggauggccaucuccggcgaugacuguguagugaagccuauagacgaucgguucgcuaacgcccuacuggcgcugaacgacauggguaagguucgcaaagacauaccgcaguggcaaccauccaagggguggcacgacuggcaacaggucccguuuuguagucaucacuuccacgaguugaucaugaaggacggccggaaacuagugguccccugccgcccacaggacgaacuuauagggcgcgcacgcaucucccagggggccggguggucccugcgcgagaccgcgugucugggcaaagccuacgcccagauguggucccugauguacuuccacagacgcgaucuccggcuggccucuaacgcaauuuguucggcgguccccguacacugggugccaaccagucgcacgacguggucuauccaugcgcaccaucaguggaugaccaccgaagacaugcugaccgucuggaacaggguuuggaucgaggacaacccuuggauggaagacaagaccccagugaccaccugggaaaacguccccuacuuaggcaagagggaggaccaauggugcgggagccugaucggacucaccagccgggcgacaugggcccagaauaucccgacggccauucagcagguccgcagccuuaucgggaaugaagaauuccuugacuacaugcccagcaugaagcguuuccgcaaggaggaggaguccgagggcgcaaucugguga

SEQ ID NO: 25937 - RNA, 9873 nt, Artificial Sequence
  derived and/or modified CDS sequence (opt11) from DENV-3__EU529699__SS-prME
accagccucuguuugaugaugauccugcccgcugccuuagcguuucacuuaacaagccgggacggagagccccggaugauaguggggaagaaugagcgcgggaagagccugcuguucaagaccgccagcgggaucaacaugugcacccuaaucgcuauggaccugggcgagaugugcgaugauacagugacuuacaagugcccacacaucaccgaaguagagccggaggacaucgacuguugguguaaccuaaccagcaccugggugaccuaugguaccugcaaccaagccggcgagcaccggcgcgacaagagauccguggcacucgcgccccauguggguaugggccuggacacccgaacccagaccuggaugucugccgaaggcgccuggcggcaggucgaaaaggucgagacgugggccuuacgccacccgggcuucacuauccucgcgcuguucuuggcacacuauaucggcaccuccuuaacccagaagguggucaucuucauccugcugaugcucgucacacccagcaugaccaugcgguguguaggcgugggaaaccgcgacuucgucgagggcuuaucuggggccacguggguagacguaguccuugagcacggcggcugcgugacuacaauggcgaagaacaagccuaccuuagacaucgaacugcagaagacagaggccacccagcuagcuacauugcggaagcugugcaucgagggcaagauuaccaauaucacgaccgacagccgcugucccacgcaaggcgaagccguguugccggaagagcaggaccagaacuacgucugcaagcacaccuacguggaccggggguggggcaacgggugcggccucuucgggaagggauccuuggucaccugcgccaaguuccagugccuagagccuauagagggcaaagucguccaauacgagaauuuaaaguauaccguaaucaucacgguccauacuggggaccagcaccaggugggcaacgagacccaaggggucaccgcugaaaucacgccccaagccagcaccaccgaggcaauccugccagaauacggcacccugggccucgaguguuccccgcguaccggccuggacuucaacgagaugauccuacucaccaugaagaauaaggccuggaugguccaccgucagugguucuucgaucugccccuccccuggacgagcggagccaccacugagacgcccaccuggaaccgaaaggagcuccuggugacauuuaagaacgcacacgcuaagaaacaggaaguaguggugcuuggcucccaggagggugcgaugcacaccgcucugacgggagccaccgagauucagaacagcggggggacuuccaucuucgccggucacuuaaagugucggcugaaaauggauaagcucgaacugaagggcaugagcuacgccaugugcaccaacacguuugucuugaagaaagaagucagcgagacccaacacgggaccauccuuauuaagguugaguacaagggggaggaugucccguguaaaauccccuuuagcaccgaggacgggcagggcaaggcacacaacggccggcuuauuacugccaacccaguggugaccaagaaggaagagccggucaacauugaggccgaaccgcccuucggggagucgaauaucgugaucggcauuggggacaacgcacuuaaaaucaacugguacaagaaaggguccagcaucgguaagauguucgaagcgacugcgcggggcgccagacgcauggcgauccugggcgacaccgcuugggacuucggcuccgugggugguguccucaacagccugggcaaaauggugcaucaaauuuucggguccgcguacacggcccuauucucuggcgugucaugggucaugaagaucggcauuggugugcuccugacguggauagggcugaacagcaagaacaccuccaugagcuucaguugcauugccaucgggauuauaacacuguaucugggcgccguaguacaggccgacaugggaugcguaaucaauuggaaggguaaggaauuaaaauguggcucggggaucuucgugaccaacgaggugcacacauggaccgaacaauacaaguuccaggcggauagucccaaacgcuuagccacugccaucgcaggcgcgugggagaacggugucugcggcauccgguccacgacgcggauggagaaccuguuauggaagcagauagcgaacgaacucaacuacauccugugggagaacaacaucaagcuuaccgugguugucggagacacgaucggcgugcucgaacagggcaagcgcacgcugacaccccagccgauggagcugaaguacuccuggaagacaugggggaaggccaaaauagucaccgccgagacgcagaauagcucguucauaaucgauggccccaauacccccgagugcccuagugcaucccgggcguggaacgugugggagguggaagauuacggguucggaguauucacuaccaauaucuggcucaaacugcgcgaaguguacacccaacugugcgaucaucgacucaugagugccgccgucaaggacgaacgcgccguccacgccgacaugggcuauuggaucgaaagccagaagaacgggagcuggaagcucgaaaaggcgagccugauugaaguaaaaaccugcaccuggccgaagucgcacacccucuggagcaacggcgugcuggaguccgacaugaucauccccaagucccuggcaggucccaucucccagcacaacuacaggccgggcuaccacacccagacggccggucccuggcaccucggcaaguuagagcuggacuucaacuauugcgagggcacaaccguaguuaucaccgaaaacuguggaacccgcgguccgagccuccgaaccacuaccgugucugggaaauugauccaugaguggugcugucgcagcugcacccugccaccgcuccgguauaugggcgaggacgggugcugguauggcauggagauccgcccagucucagagaaggaggagaauauggucaagagccugguguccgccgguagcgggaaggucgauaacuucaccaugggcguccugugccucgcgauacuguucgaggaagugaugcggggaaaauucggcaagaaacacaugaucgcgggagucuucuucacuuucgugcuccuacuuucgggucagauuaccuggcgggacauggcccauacacuaaucaugaucggcucuaacgccucugaccgaauggggaugggcgugacauaucucgcccugaucgccaccuucaaaauccagcccuuccucgcguuaggguucuuccuucgcaagcugaccagcagagagaaucuccugcuaggcguaggccucgccauggccacgacccugcagcugccugaagacaucgagcagauggccaacgguauugcgcucggcuuaauggcacugaagcucaucacccaguucgagacauaccagcuguggacggcgcugaucagccuuacguguuccaacacgauuuucacucuuacgguagccuggcgcaccgccaccuuaauccucgcgggggucagccugcugccggugugccaguccagcucaaugcgaaagaccgauuggcuccccaugacugucgcagccaugggcgugccgccgcucccguuguucaucuucagcuuaaaggacacccugaagcgccgcuccuggccguugaacgaggguguaauggcugucgggcucgucagcauccuggccucaucucuguugcggaacgacgugcccauggcgggcccccugguagccgggggccugcucauagccugcuaugugauuaccggcaccagcgccgaccugacggucgagaaggcugcggaugugaccugggaagaggaggccgagcagacuggcgucucacacaaccugaugauuacaguugacgacgacgguaccaugagaaucaaggaugacgagacagagaacaucuugaccgucuuguuaaagaccgcccuccugaucgucucuggcaucuuuccguacagcaucccggccacccugcucgucuggcacacguggcagaaacagacccaacggucgggcgugcugugggauguccccucaccgcccgagacccagaaggcagaacuggaggaggggguguaccgcaucaaacagcagggcaucuucgggaagacucaggugggcgucgggguccaaaaggaaggcguguuccacacgauguggcacgugacccggggcgcgguauuaaccuacaacggaaagcgccuugaaccgaacugggccucagugaagaaggaccucaucagcuacggcggcggcuggcggcucucggcccaguggcagaagggggaggagguacagguaaucgccguggagcccgguaagaauccuaagaacuuccagacaaugcccggcacguuucagaccaccaccggcgaaauaggcgccauugcccuggacuucaagccaggcacgagcggcagccccauaaucaaccgcgaggggaaggucgugggucucuacggcaacgggguggucacuaagaacggcggguacguguccgguaucgcccaaaccaacgcagagccggauggucccacacccgagcuagaggaagagauguucaaaaagcggaaccucaccaucauggaccuccaccccgguucuggcaaaacccgcaaguacuuaccggccauuguccgcgaggcgauaaagcgccggcuccgcacccugauacuggcucccacccgggucguggccgccgagauggaggaggcucucaaagggcugcccaucagguaccagacaaccgcuacuaagucagagcacaccggccgggagaucguggacuuaaugugccacgcuacguucacaaugagacugcucagccccguccgggugccgaacuacaaccugaucaucauggaugaggcccacuucaccgacccagccagcaucgccgcgcgcggguacaucucuacacggguuggcaugggugaggccgccgccaucuucaugacggcaacgccgcccgggacagccgacgcguucccucaguccaacgcccccauccaggacgaggaacgcgacauacccgagagaagcuggaacuccggcaacgaguggaucaccgacuuugccgggaagacgguuugguuugugcccagcaucaaggcgggcaaugacauugcuaacugucuucggaaaaacgggaagaaggugauccagcuaucccgcaaaaccuucgacaccgaguaucagaagacuaaacugaaugacugggacuucgucgugacuaccgacauaagcgagaugggggccaauuuuaaggcagaccgggugaucgacccgcgccgcuguuugaagcccgucauccugaccgacggaccggaacguguaaucuuggcggggcccaugccggucaccgcggcaucugcugcgcagcgucgcgggcggguugggcgcaauccucagaaggagaaugaccaauauauuuucaccggucagccccucaauaacgacgaggaccacgcccacuggacggaggccaagaugcugcuggauaacaucaacaccccagaagggaucaucccggcccucuucgagcccgagcgggagaaguccgccgccauagacggcgaguaccgccugaagggcgaaucucguaagaccuucguggagcugaugcgccgcggggaccucccagucuggcuggcgcacaagguggccuccgagggcauaaaguacaccgaccgcaaguggugcuucgauggccagcgcaacaaccagauccuggaggaaaacauggacguggagaucuggacuaaggagggagagaagaagaagcugcgucccaggugguuggacgcgcgcacauacuccgauccauuggcccucaaggaguucaaggauuuugccgcgggccgcaagucgaucgcccuggaccuggucacggagauaggacggguuccgagccacuuagcccacaggacccggaacgcucucgacaaccuggugaugcuccacacgagcgagcacggggggaaggccuaucgccacgcagucgaagagcugccagagacuauggaaaccuuacucuuacugggccucaugaucuuguugacgggaggcgcaaugcuauuccugaucaguggcaaggggaucggcaagaccucaauaggccucaucugcguaaucgcuuccucgggcaugcucuggauggccgagaucccccugcaguggaucgcaucugccaucguacucgaauucuucaugaugguccuccugauccccgagcccgagaagcagcgcacgccacaagacaaccagcuggccuacguggugauagggauccuaacucucgccgccaucauugccgcgaacgagaugggccugcucgagaccacgaagcgggaccuugguauguccaaagaaccuggugucgugagccccaccuccuaccuggacguggaccuccaccccgcuuccgccuggacucuguacgcggucgccaccacggugaucacucccaugcugcggcauaccaucgagaacuccaccgccaaugugagccucgccgcgaucgcaaaccaggcggucgugcugaugggccuggauaagggcuggccgaucaguaagauggaccucggcgugccccugcuggcacucgggugcuacagccaggucaacccucugacucugaccgccgccgugcuccugcugaucacucacuacgccauuaucggccccggucuccaggcgaaagccacccgcgaggcccagaagcggacggccgcggggauaaugaaaaacccaacuguugacggaaucaugacaaucgaccuggacccagucauauacgacuccaaguucgaaaaacagcugggccaggugaugcucuuggugcugugcgcugugcagcuccugcugaugcgcaccagcugggcucugugcgaggcccucacucuggcaaccggccccauaacuacauugugggaggggucccccgggaaguuuuggaacacgacgaucgcgguaagcauggcgaacaucuucagaggauccuaccuggccggggcuggccuggccuuuagcaucaugaagucaguggguaccggcaagcgcggcaccgguagucagggcgagacccugggugagaaauggaagaaaaagcugaaccagcugagccggaaagaguucgaccucuacaagaaguccggcaucacggaggucgaccggaccgaggcgaaggaaggucuaaaacggggagagauuacccaucacgccgugagcagaggcucugccaagcugcagugguucguggagaggaacauggugaucccggaagggcgcgugaucgaccugggcugcgggcguggaggguggagcuauuacugugccggcuugaagaaggugacagaggucagagguuauaccaagggagggcccggacacgaggaacccgugccaauguccaccuauggauggaacaucguaaagcugaugagcggaaaagacgucuucuaccucccaccugaaaagugcgauacccuguugugcgacauuggcgaguccagucccucccccaccguggaagaaagccggacgaucagagugcugaagauggucgaaccuuggcucaagaacaaccaauucugcaucaaggugcucaaccccuacaugccuaccguuauugagcaccucgagcgcuuacagcgcaagcacggagggaugcuggucagaaacccccuaagucggaacucaacccacgagauguacuggaucuccaauggcaccgguaacaucguggccucggugaacauggucucccgucuacugcugaaccgguucacgaugacccaucgccgcccgacaaucgagaaggacgucgaccucggugcgggcacacgacacguaaacgccgagcccgagacgcccaacauggacgucaucggggagcggaucaagcgcaucaaggaagagcacaacuccaccuggcacuacgacgacgagaacccguacaagaccugggccuaucacggguccuaugagguuaaggccaccggaucugccuccagcaugaucaauggugucgugaaacugcucacaaagccaugggauguaguuccaaugguuacccagauggcuaugaccgacacgacgcccuucgggcagcagcggguguucaaggagaaggucgacacccgcacaccgaggaguaugcccggcacucgcagagugauggguaucaccgccgaauggcucuggcguacccuggggcggaacaagaagccccgccuaugcacacgggaggaguuuacuaagaaggugcguacgaaugccgccaugggcgcugucuucaccgaggagaaccagugggacucugccaaggccgccguggaggacgaggacuucuggaaguugguggacagggagcgggaacugcacaagcugggcaagugcggcuccugugucuacaacaugaugggcaaacgcgagaagaagcucggcgaguucggcaaggccaaggggucccgggccaucugguacauguggcugggagcccgauaccuggaguucgaggccuuaggcuuucugaacgaggaccacugguucagucgggagaauuccuauucuggcgucgaaggagagggccugcacaagcucgguuacauccuccgcgacaucucuaaaauccccgggggugcgauguacgccgacgauaccgcggggugggauacucggaucacggaggacgaccuacacaacgaggagaagaucacgcagcagauggauccggagcacagacagcucgccaacgccauauucaagcugaccuaccaaaauaaggugguuaaaguucagaggcccacucccaccggcacagucauggacauuaucagccgcaaagaccagcgaggcucggggcaggucggcacuuacgggcuaaacaccuucaccaacauggaggcacagcucauacgacagauggagggagagggggugcuuucuaaagccgaccuggagaauccccaccucccggagaagaaaaucacgcaguggcuggagaccaagggcguugagcggcuuaagaggauggcgauauccggcgaugacugcguggugaagcccaucgacgaucgguucgccaaugcccuccuggcguuaaacgacauggggaaggugcgcaaggacauuccacaguggcagcccucuaagggcuggcacgauuggcagcaggugccuuucugcucccaccacuuccacgagcucaucaugaaagacgggagaaagcugguaguucccugccggccccaggacgaguuaaucggccgggcccgcaucagccagggagcgggguggucccugcgggagaccgccugccugggcaaggcauacgcccagauguggagccugauguauuuccaccgccgcgaccuucgucuugcguccaacgccauuugcucugccguccccguccauugggugccaaccucccggacgaccuggagcauacacgcccaucaccaguggaugaccacagaggacaugcuuacggucuggaaccggguguggaucgaggacaacccuuggauggaggauaagacccccgugaccaccugggagaacgucccguaccucggcaaacgcgaggaccagugguguggcagucugauagggcugacgucucgggcaacuugggcgcagaacaucccaaccgccauccagcagguccgcucucucaucggcaacgaagaguuucuggacuacaugcccucuaugaagcguuuccgcaaggaggaggaaagcgagggggcaauaugguaa

SEQ ID NO: 25938 - RNA, 9873 nt, Artificial Sequence
  derived and/or modified CDS sequence (opt11) from DENV-3__EU482566__SS-prME
acuucucucugccugaugaugauccuccccgccgcccuggcuuuccaucuuaccucaagggauggggaaccccggaugaucgucgggaagaacgagagaggcaagagccugcuguucaagaccgcuuccgguaucaacauguguacccugaucgccauggaccugggagagaugugcgaugacacugugaccuacaaguguccccacaucaccgagguugagccggaggacauagacugcugguguaaccuaacuagcaccugggucacuuacgggaccugcaaccaggccggcgagcaccggcgcgacaagcgauccgucgcacucgcgccacacgugggaaugggacucgacacacgcacccaaaccuggaugagcgccgagggugccuggcgccagguggagaagguugaaaccugggccuugcgccacccgggguuuaccauccucgcauuguuccuggcgcacuacaucggcacaucccucacccaaaagguggugaucuucacgcuguugaugcuagucaccccgagcaugaccaugaggugugugggugucgggaacagagacuucgucgagggacugaguggggcgaccuggguagacgugguccuggagcauggcgggugcgugacgaccauggcgaagaacaagccuacucucgacauugaacugcagaaaaccgaggcaacccaacuggcuacccuccggaagcuauguaucgaggguaaaaucaccaacaucaccaccgacucacgaugcccuacgcaaggagaggccgugcuaccugaggagcaggaccagaacuacgucugcaagcacacuuacguggaccgagggugggggaauggcugcggccucuucggaaagggaucccuggugaccugcgcgaaguuccaaugccucgaacccauugaaggcaaaguugugcaauaugagaaccuaaaauacacuguaauuaucacgguccacaccggcgaccaacaccaggugggcaacgagacccagggagucacggcugagauuacuccacaagccagcacaaccgaagcuaucuuacccgaguacggaacccuggggcucgagugcaguccgagaacuggccuggacuucaaugagaugauccugcuuaccaugaagaacaaggccuggaugguccaccggcaaugguucuucgauuugccacugcccuggaccagcggcgccaccacggagacccccaccuggaaccguaaagaauuguuaguuaccuucaaaaaugcucaugccaaaaagcaggaggucgucguguuggggucacaggaaggggccaugcacaccgcccucaccggggccaccgaaauccagaacagcggcggcacuucgaucuucgccggacauuuaaaaugccgccugaagauggacaagcuugagcugaagggcaugagcuacgccaugugcaccaacaccuuuguccugaaaaaagagguguccgagacccaacacgggaccauccuuaucaagguggaguacaagggugaggaugucccuuguaagauucccuucagcacggaggacgggcaagggaaggcgcacaauggucgccugaucaccgccaaucccguggugacuaagaaggaggaacccgucaacauugaggccgaaccgccauuuggggagucuaacauagugauuggcaucggugacaacgcccugaagauuaacugguacaaaaagggcuccagcaucggaaaaauguucgaggcgaccgcccgaggcgcccgucggauggccauccugggcgacacagccugggacuuuggguccgugggcgggguccucaacagccuagggaaaauggugcaccaaauauucgggucugcguacacggcuuuauuuagcggcguuagcugggugaugaagauuggcaucggggugcuccucaccuggauuggucugaacagcaaaaacacgucaaugagcuucucgugcaucgccaucgggaucaucacccucuaccuuggcgccgugguccaggcggauauggggugcguaauaaauuggaaaggaaaggagcuuaagugcgguucugggauauucgugacgaacgagguccacaccuggaccgagcaguauaaguuccaggcggacuccccgaagcgccucgccacggccauugcuggcgccugggagaacggggugugcgggauccgcucgaccacccguauggaaaacuuacuguggaagcagaucgcgaacgaacucaacuacauccugugggagaauaauaucaagcucaccguggucgucggugacaucaucggcgugcucgagcagggcaagcgcacacugacgccgcagccgauggagcugaaguacuccuggaaaaccugggggaaggccaagauaguaacagcagagacgcagaacagcaguuuuauuaucgacggcccaaacacccccgagugccccagcgcuuccagggcguggaacgugugggaggucgaagacuacggguuuggcgucuucaccacuaacaucuggcucaaguugcgcgagguguacacccaguuaugugaucaccggcucaugagcgccgccgugaaggacgagcgggccguucacgccgacauggguuacuggaucgagagccagaagaacgggucauggaagcuggagaaggcgagccugaucgaggugaagacaugcacuuggccgaagucccacacucuguggagcaauggaguccuggaguccgacaugaucauaccuaagucacuggccgggcccauuucccagcacaacuaccgacccggguaccacacccagaccgccgggccauggcaccucgguaaacuggagcuggacuucaacuacugcgagggcacaaccgucguuaucacggaaaauugcgggaccaagggcccaagccugcgcaccaccaccguguccgggaaacugauccaugaauggugcugcaggaguugcacccugcccccauuacgguacaugggcgaggacgggugcugguauggcauggagaucagacccaucucggagaaggaagagaauaugguaaagucgcugguguccgccgguagcggaaagguggauaacuuuacuaugggaguccucugcuuggcaauccuguucgaggaagugaugcgcgggaaguucggcaaaaagcacaugaucgccgggguguucuuuacguuuguccugcuccugagcggccagauaaccuggcgggacauggcccacacucugaucaugaucggcagcaacgcauccgaccgcauggggaugggagugaccuaccucgcccuuaucgccaccuucaaaauacagcccuucuuagcgcugggguucuuucugcggaagcugaccagccgcgagaaccuccuauuaggugugggccuggccauggccacaacccugcagcugcccgaggacaucgaacaaauggccaacgguauugcgcucggacugauggcccucaagcuuaucacccaguuugagacuuaccagcuguggacggcgcugaucagccugaccugcagcaacaccauuuuuacacugacgguugcuuggcggaccgccacucugauccuugcgggggugagccuacuaccggucugccaguccagcuccaugcgcaagacugacuggcucccgaugacgguagccgccaugggcgugccgccacucccgcuguucaucuucagccucaaggacacccuuaaacggcgcuccuggcccuuaaacgagggggucauggccgugggccucgugagcauauuggccagcagccugcuccgcaacgaugucccgauggcgggcccucucguagccggcggucuguugaucgccugcuacgugaucaccggaaccucugccgaccucacagucgaaaaggccgcggacgucacuugggaggaggaggccgagcagaccggaguuucacauaaccugaugaucaccgucgacgacgacgguaccaugcggauaaaggacgacgagacggagaacauucucaccguucugcugaagaccgcccuucugauuguguccggcaucuuccccuacucgauccccgcaacccugcugguguggcauacguggcagaagcagacgcagcguuccggcgugcucugggacguccccucgccgcccgagacccagaaggcggaguuggaggaaggagucuauaggaucaaacagcagggcauauucgggaagacacaggugggaguugggguccagaaggaggguguguuccacacgauguggcacguuacuaggggugccguccucaccuauaacgggaagcguuuagagcccaacugggccuccgugaagaaagaucugaucagcuacggcggaggguggcggcucuccgcccaauggcagaagggggaggaaguccaggucaucgccguggagccgggcaagaacccuaagaacuuccagaccaugcccggcacguuccaaaccaccacgggcgaaaucggugcgaucgcccucgacuucaagcccgggacgagcgggagccccauaaucaaccgcgagggaaagguggucgggcuguauggcaacggcguagugacuaagaacggaggguacgucuccggcauagcucagaccaacgcugagcccgacggaccgacccccgagcuggaagaggagauguucaaaaagaggaaccuaacgauuauggaccuucaccccgggagcggcaagacgcguaaauaccugccggccaucguccgcgaggcgauaaagagacgccuccguacacugauccuggcccccacacgcguggucgcggccgagauggaggaggcacucaagggucugcccauccgguaucagaccaccgcgaccaagucugagcauacaggccgcgagaucguggaccugaugugucacgccacguucacaaugcgccuccugagcccgguccgcgucccgaacuacaaccucaucaucauggacgaggcccacuucacugaucccgcgaguaucgcagcgcggggguacaucagcacccgugugggcaugggcgaagccgccgcuaucuucaugacggccacgccgcccgggaccgccgacgccuucccgcaauccaacgcucccauccaggacgaggaacgggacauccccgagcgaagcuggaacuccggcaacgaguggaucaccgacuuugccgggaaaacggugugguuuguccccagcaucaaggcgggcaaugacaucgccaauugccuacgcaaaaaugggaagaaaguaauccagcugagucgcaagaccuucgacaccgaguaccagaagaccaagcugaacgauugggacuucguggucacgaccgacaucagcgagaugggggccaacuuuaaggcggaucgaguuaucgauccgaggcggugucuuaagcccgugauccugacagacggccccgagagggucaucuuagcggggccuaugccggugaccgcggcuucugccgcccagcgccggggcaggguggggcggaauccccaaaaagagaaugaccaauauaucuucaccggccagccccucaacaaugacgaggaccacgcccauuggacggaggcuaaaaugcugcuggacaacaucaacacgccugaggggaucaucccggcccucuucgagccggagcgggaaaaguccgccgccaucgauggcgaguaccggcugaagggcgaaucccgcaagaccuucgucgagcuuaugcgaaggggggaccuccccguguggcuggcccacaagguugccagugaggggauuaaauacacugaccggaaauggugcuuugacggccagcgcaauaaccagauccuggaggaaaacauggacguggagaucuggacgaaggagggcgaaaaaaagaagcuccggccgcgcuggcuagaugcccggacguauucugacccgcuggccuugaaggaauucaaggacuuugccgccggccgcaagagcaucgcgcuggaccucguuaccgagauaggccgcgugccgucgcaccuggcucaccggacucgcaacgcucuggacaaccuagugaugcugcacacgucugagcacggagggaaagccuaccgucacgcuguggaggagcuccccgaaacaauggagacacugcugcuacugggccucaugauccuucucaccgguggggcgaugcuguuccucauaagcggcaaggguauaggcaagacauccauaggguugauaugcgucaucgccagcuccggcaugcucuggauggccgagauuccucuccaguggaucgccagcgcgaucgugcuggaguucuucaugauggugcuccugaucccugagccugagaagcagcguacgccccaggacaaccagcuggccuacgucgugaucgggauccucacguuagcagccaucaucgcggccaacgagaugggacugcuggagaccacgaaaagagaucuggggauguccaaagagccugggguggucagccccacguccuaccuggauguggaccuucaccccgcaagugccuggacccuguacgccguggcaaccacggucauuacccccauguuacgccacaccaucgagaacaguaccgcuaaugugucccucgccgcuaucgcaaaccaagcugugguacuuaugggacuagacaagggauggccaaucagcaaaauggaucucggggugccccugcuagccuuagggugcuacagccaggucaacccuuugacuuugaccgccgcuguguuacugcucaucacccauuacgccaucaucggcccaggguugcaggcgaaagccacgcgugaggcccagaagcgcacggccgccgggaucaugaaaaacccuaccgucgacggcauuaugaccaucgacuuagacccagucauauacgauuccaaauuugagaagcagcuggggcaggucaugcuguugguucugugugcgguacagcugcugcugaugcggaccucgugggcccucugcgaggcucugacucuugcgaccggccccaucacuacccugugggaggguagucccggaaaguuuuggaauacgaccauugcgguaagcauggcaaacaucuuucgcggcuccuaccucgcaggagcaggccuggccuucagcaucaugaaauccguggguaccggcaagcgugguaccgggagccagggagagacccucggggagaaauggaagaagaagcugaaccagcugagccgcaaggaguuugaccucuauaagaaaagcggcauaacggagguggaccgcacagaggcgaaggaagggcuaaagcgcggggagauuacacaccacgccgucagccggggcuccgccaagcugcagugguucguggaacgaaauauggugaucccggagggacgggucaucgaccucgggugcgggcgcggugguuggucauacuacugcgccggccugaaaaaggugaccgaggugcggggcuacacgaagggggggccgggccacgaggaacccguccccauguccaccuauggcuggaauaucguuaaauuaauguccgguaaagacguauuuuaucucccgcccgaaaagugcgacacccuccugugcgacauaggugaguccucccccagucccacgguagaggagagcaggacgaucagaguguuaaagaugguggaaccauggcucaagaauaaccaauucugcaucaagguacugaaccccuacaugcccaccguuaucgaacaccuggaacgccuccaacgcaagcauggcgggaugcuagugcgaaacccgcugucccguaauagcacacacgagauguacuggauuuccaacgguacugggaacaucgucgccagcgugaacauggugucccggcuccugcugaaccgcuucacgaugacccacagacguccgaccaucgaaaaggacgucgaccucggcgcgggcacccgccacgucaacgccgagcccgagacgccuaacauggacgugaucggggaacguaucaagcgaaucaaggaggagcauaacucaacauggcacuaugacgacgaaaacccguacaagacuugggccuaccacggguccuacgaggucaaggccaccggaucagccuccagcaugaucaacggggucgugaaacugcugacgaagcccugggacguggugcccauggucacccagauggcuaugacagacacaacucccuucgggcagcaacguguguucaaggagaagguugacacccggaccccgcgcucgaugcccgggacccggcgcgugaugggcaucacggcagaguggcuuuggcggaccuuggggcgcaauaagaagccgagacuguguacccgcgaggaguuuaccaagaagguccgcacgaacgccgccaugggagcgguguuuaccgaggagaaccaaugggacucugccaaagccgccgucgaggacgaagauuucuggaagcugguggaccgcgaacgcgagcugcacaaguuagggaagugcgggucuugcguuuacaacaugaugggcaagcgggagaagaagcucggcgaguucggcaaggcaaaggggucccgcgcuaucugguauauguggcugggcgcccguuauuuggaguucgaggcccucggguuccucaacgaggaccauugguucagccgcgagaacucguacagcggagucgagggggaggggcuucacaagcucggcuacauccugcgugacaucuccaagauccccgguggcgccauguaugcugacgacaccgccgggugggacacucguaucacggaggacgaccugcacaacgaagagaagaucacccagcaaauggaccccgagcaccgucaguuagccaacgccauauucaagcuuaccuaccagaacaagguggugaagguccagcggcccacccccaccggcacuguaauggacaucaucagccggaaagaccagcgcggcuccggacaagugggaaccuauggucugaacaccuucaccaacauggaggcgcagcucauacggcagauggagggugaggggguucugucuaaggccgaccuggagaacccgcaucucccggaaaagaagaucacccaauggcuugaaaccaaagggguggagcgccugaagcggauggcgaucuccggugacgauugcguggugaagccaauugacgaccgcuucgccaacgcccucuuagcccugaacgacaugggcaaggugcggaaagacaucccccaauggcaacccagcaagggcuggcacgauuggcagcaggucccauucugcucccaccacuuucacgaacuaaucaugaaggaugggcgcaagcuggucguucccugccggccccaggacgagcugaucggccgcgcccggaucagccagggggcgggcuggucguuaagagagacggcuugccugggcaaggcauaugcacagauguggagccuaauguacuuccaccggcgcgaccugcggcuggcgucuaacgccaucugcagcgcgguacccguccacugggugcccaccucccggacgaccuggucgauccacgcccaucaccaguggaugaccacugaggacaugcugacgguguggaaucgcguuuggaucgaggacaaucccuggauggaggacaagacccccguuaccaccugggagaaugucccguaccuugggaagcgagaggaccaguggugcggcucacugaucggguuaacgucccgcgccacuugggcgcaaaacaucccgaccgcgauacagcaggucagaagccucauuggcaacgaggaauuccuggacuauaugcccucuaugaagcgcuuccggaaggaggaggagagcgagggggccauuugguga

SEQ ID NO: 25939 - RNA, 9873 nt, Artificial Sequence
  derived and/or modified CDS sequence (opt11) from DENV-3__EU529702__SS-prME
accucgcucugccucaugaugauucugcccgcagcccuggcguuccaccucaccagccgggacggggaaccccguaugauaguggggaagaaugaacgcggcaagagccuucuguuuaagaccgccagcgggaucaauaugugcacccucaucgcaauggaccugggggagaugugugacgauaccgugaccuacaagugcccccacaucacggaagucgagccugaggacaucgauugcuggugcaaucugacgagcacgugggugaccuacgggacuuguaaccaggccggggagcaccgucgcgacaagcgguccguugcccucgcgccgcacguggguauggggcuugacacccgcacccagacuuggaugucggcggagggggccuggcggcagguagagaagguggagacgugggcccugcgacauccgggguucaccauccucgcgcuguuucuggcccacuacgugggcaccucccucacccagaagguggugaucuucauccugcugaugcucgugacucccagcaugaccaugcggugcgugggggucggcaaucgcgacuucguugagggacuguccggggcaaccuggguggacguaguccuggagcacggcgggugcgugaccacgauggccaagaauaaacccaccuuggacaucgagcugcagaagaccgaggccacccagcuggcgacucuccggaagcugugcaucgaaggcaagaucacgaacaucacgaccgacaguaggugccccacgcagggcgaggcuguucugcccgaggagcaggaccagaauuacgugugcaagcacaccuacguugacagaggguggggcaacgggugcggucucuucgggaagggcucccuggugaccugcgccaaguuccaaugccuggagcccaucgaggggaagguagugcaguacgagaaccucaaguacaccgucaucaucacugugcauaccggggaccagcaccaggucggcaacgagacccagggggugacggccgaaauaacgccucaggccucgaccaccgaggccaucuuacccgaguacggcacgcuggggcucgagugcuccccgcguacgggccuggauuucaacgagaugauccugcucacgaugaagaacaaggccuggauggugcaccggcagugguuuuucgaccugccccugcccuggaccagcggcgccaccacugagacgcccaccuggaaccguaaagaacuccuggucaccuucaagaacgcccacgcgaagaagcaagaagucguaguucuagguagccaggagggcgcgaugcacacagcccucacaggagccaccgagauccagaacagcggcgggaccuccaucuucgccggccacuuaaaaugcagacugaagauggacaagcucgaacugaaggguaugagcuacgccaugugcaccaacacguucgugcugaagaaggaaguguccgagacucaacacgggaccauccucaucaaggucgaguacaagggcgaggacgugccgugcaaggugcccuucagcaccgaggaugggcagggcaaggcgcacaacggucgguugaucacggcaaaccccguugucaccaagaaagaggagcccguaaacaucgaggcagaaccgcccuucggggagucaaauaucgucaucggcauuggggauaacgccuuaaaaaucaacugguauaagaagggcuccucaaucgggaagauguucgaggcgaccgccaggggcgcacgccggauggccauccugggagacaccgccugggacuucgguuccgugggcggggugcucaauucgcugggcaaaaugguccaccagaucuucgggucugcguauacggcccuguucagcggcgugagcugggucaugaagaucggaaucgggguccuccugaccuggaucgggcuaaacagcaagaacaccuccaugagcuucucauguaucgugaucgggaucaucacccucuaccugggcgcagugguccaggccgacauggggugcgugaucaacuggaagggcaaggagcugaagugcggcagcgggauauucgugacgaacgagguccacaccuggacugagcaauacaaguuccaagccgacucccccaagcgacucgcgaccgccaucgcaggcgccugggagaacggggugugcggcauucgcagcacaacgcggauggagaaccugcuuuggaagcaaaucgccaacgaguuaaacuacauccugugggagaacaacauuaaacuuacgguugucguuggggacaucaucggcguccucgagcagggcaagcgcacccugacgccacaaccgauggaguugaaauacagcuggaagaccugggggaaggccaagaucgugacugcggagacccagaacagcaguuucaucaucgacggucccaacacucccgagugccccucugccucccgggccuggaacgugugggagguggaggacuacgguuucggcgucuucagcaccaauaucuggcucaaacuccgugagguguacacccaacugugcgaccaccggcucaugagcgcggcagucaaagaugagcgcgccguccacgcggacaugggcuacuggaucgagucccagaagaacggaagcuggaagcuggagaaggccucccugauugaggugaagacaugcaccuggccuaagucccacacguuguggucaaacggcgugcuggaguccgacaugauaauccccaaaucccuggcggggccuaucagccagcauaacuaccguccgggcuaccacacccaaaccgccggaccguggcaccucggcaagcuggaacuggacuucaacuacugcgaggggaccacgguggucaucaccgagaacugugggacccgcgggcccucccuccggaccacaaccgucucggggaagcugauucacgagugguguugccgcuccugcacccugcccccgcuccgguacaugggugaggacggauguugguacggcauggagauacgcccuaucagugagaaagaagagaacauggugaagucccuugugagcgccggcuccgggaagguggacaacuucaccaugggcgcccugugucucgccauccuguuugaggaagucaugcgggggaaguucggcaagaaacacaugaucgcugggguguucuucacguucguucugcuccugaguggacagaucaccuggcgcgacauggcucacacccugaucaugauuggcucaaaugccagcgaccggauggggaugggcgugaccuacuuagcccuaauagccacuuucaaaauccagccauucuuggcccucggguucuuccugcgcaaauugacuagcagagaaaaccuccuucugggcguuggcuuggccauggccaccacccugcagcugcccgaggacaucgagcaaauggccaacgggaucgcgcucggucucauggcacugaagcuaaucacgcaguucgagaccuaccagcuguggaccgcccugaucucgcugaccugcagcaacacgauuuucacccugaccguggcguggaggacggccacauugaucuuggcgggggugucccugcugccgguuugccaaagcagcagcaugcgcaagaccgacuggcucccuaugaccgucgccgccaugggcgugccgccccucccgcuguuuaucuucucccucaaggacaccuugaagcgccggagcuggccucugaacgagggcgugauggcuguuggccucgugucgauccuugccagcuccuuauugcggaacgacgugcccauggcgggcccgcuggucgccgggggacugcucaucgcauguuacgugauaacggggacuagcgccgaucugaccguggagaaagccgcggaugucaccugggaagaggaagccgaacagacgggcgugucccacaaccugaugaucaccguggacgacgacgggaccaugcgcaucaaggacgaugagaccgagaacauccucaccgucuuacugaagacagcccuccuuaucgugagcggcaucuucccguauuccauccccgccacgcuucuuguguggcacaccuggcaaaagcagacccagcguagcgguguccugugggacguuccuagcccgccagagacgcagaaggccgagcuggaggagggaguguaccgcaucaagcagcagggcaucuucgggaagacccagguaggcgugggggugcaaaaagaaggcgucuuccacaccauguggcacgugacgcggggcgcggugcucaccuacaacgggaaacguuuggagcccaacugggccuccgucaagaaggaccugaucuccuacggcgggggcuggcggcucagcgcucaguggcagaagggggaggaggugcagguuaucgccgucgaacccggcaagaaccccaagaacuuccagaccaugccgggcacuuuucaaaccacaacuggggagauuggagcaaucgcucuggacuucaagcccgggaccagcgguaguccgaucaucaacagagagggaaaggugguggggcuguacggcaauggcgucgugaccaaaaacggcggguacgugagcggaaucgcccagacuaacgccgagcccgauggcccgaccccugaacucgaggaggagauguucaaaaagcggaaccucaccaucauggaccugcaucccggguccgguaagacccggaaguaccugccggcgaucguccgggaggcgaucaagcgccggcuccgcacgcuuauacuggcgccgacccgugugguggccgcggagauggaggaggcccucaaggggcugccuaucagguaccagaccacagccacaaagagcgagcacaccgggcgggagaucgucgaccugaugugccacgccaccuucaccaugcgccuucuguccccggugcgggugccgaauuacaaccugaucaucauggacgaggcccacuucacggaucccgcaagcaucgccgcacgcggguauauaucuacccgggucggcaugggcgaggccgccgccauuuucaugaccgcgacgccgccgggcacggccgacgccuucccucaaucuaacgccccaauccaggacgaggagcgcgauauccccgaacgcuccuggaauagcggcaacgaguggauaaccgacuucgccgggaagaccgugugguucgucccuucgauuaaggcggggaacgauaucgccaacugucuccggaagaaugggaagaaggucauucagcugagccgcaagacauucgacacggaguaccagaagacuaaacugaacgacugggacuucguggugaccacggauaucuccgagaugggcgccaacuucaaggcagaucgggucaucgacccgcggcgcugcuuaaaacccgugauccugacggacggcccagagcgcgugauccuggccggucccaugccgguaacagcggccagcgccgcgcagcggcgcggacggguggggcgaaacccgcagaaggagaacgaccaguacaucuucaccggccagccauugaacaacgacgaagaccacgcccacuggaccgaggcuaagaugcuucuggacaacauuaacacccccgaggggaucaucccagcccucuucgagcccgagcgggagaaauccgccgccaucgacggcgaguaccgccugaagggcgagagcagaaagacguucguagagcugaugcgacgcggcgacuugccuguauggcuagcgcacaagguugccagugaggguaucaaauacaccgaccguaaguggugcuuugacggucagcggaacaaccagauucuggaagagaacauggacgucgagauuuggaccaaagagggcgagaagaagaagcuccgcccccgauggcuggacgcccgcaccuauagcgacccguuggcccugaaggaguucaaggacuucgccgcagggcguaaguccaucgcgcuggaccuggugacggagaucgggcgggugcccagccacuuggcccaccgcacccggaaugcccuggacaaccucguaaugcuccacaccucugagcacggcgggaaagccuaccggcacgcgguggaggagcugcccgagaccauggagacucugcuccugcugggccucaugauccugcugaccgggggugccaugcuauuucugaucagcggcaaggggaucggcaagaccagcauuggguuaaucugcgugaucgccuccagcggcaugcucuggauggccgagaucccgcugcaguggaucgccuccgcgaucguccuggaguucuucaugauggucuuguugauccccgagccugaaaagcagcgcacgccccaggacaaucagcuggcauacguggucaucggcauucucacgcuggccgcaaucauugccgcuaacgagaugggccugcucgagaccacgaagcgcgaucugggcaugagcaaggagccugggguagugucuccaaccagcuacuuagacguggaccuccaucccgccuccgcuuggacgcuguacgccguggcgaccaccgugaucaccccuaugcugcggcacacgaucgagaacuccaccgcaaacgucagucucgccgccaucgccaaccaggcggucgugcugaugggccuugacaagggguggccgauuagcaagauggaucucggcgugccgcuguuggcgcucgggugcuacagucaggugaauccccugacgcuuaccgccgccgucuugcugcugaucacccacuaugccaucauaggccccggccuccaagcgaaagccacucgcgaggcacagaagaggaccgccgccgggaucaugaaaaacccgaccgucgacggcaucaugacgauagaucuggaucccgugaucuacgacucaaaguucgagaaacagcugggccaggugaugcuccugguccugugcgcuguccagcuccugcugaugcgcaccuccugggcccuaugcgaggcccugacccuagccaccggccccaucacgacccucugggagggcagccccggaaaguucuggaacaccaccaucgcugugucuauggccaacaucuuccggggaagcuaccuggccggugcgggccuggccuucuccaucaugaaaagcgucgggacggggaaaagagguaccgggagccagggcgagacccucggggagaaguggaagaaaaaguuaaaccaacugucccgaaaggaguucgaccucuacaagaaguccggcaucaccgagguggaccgcacugaggcgaaggaagggcugaaacggggagagaucacgcaccacgccgugucgcgcggcagcgcuaaacugcagugguuuguugagcggaacaugguuauaccugaggggcgcgugauugaccucggcugcgggcggggagggugguccuacuacugcgccggcuuaaagaaggucaccgaagugcguggcuacacuaaaggcgggcccgggcacgaggagcccgugcccaugagcaccuauggauggaacauagucaaacugaugagcgggaaagacguuuucuaccuaccacccgagaagugcgacacguugcugugcgacauaggcgagagcucccccagccccaccguggaggaguccaggaccaucagaguccuaaagaugguggagccuuggcucaagaacaaccaguucugcaucaaggugcugaaccccuacaugcccaccgucaucgagcaucuggaacgccuccagcggaagcacggcgggaugcuggugcgcaauccccugagccggaacagcacgcacgagauguacuggaucagcaauggcaccgggaacaucguggccuccgucaacauggugagccgccuccugcugaaccgguucaccaugacucaccgccggccgacgauugagaaggaugucgaucucggcgcgggcaccagacacguuaacgcggagcccgaaacgcccaacauggacguuauuggggagcggaucaagcgcaucaaggaggagcacaacucuacauggcacuacgacgacgagaacccguacaagaccugggcuuaccauggcagcuaugaggucaaggccaccgggucagcgagcagcaugaucaacggcguggugaaguugcugaccaaacccugggacgucguacccauggugacgcagauggcgaugacagauacgacccccuucggucagcagcgggucuucaaagagaagguggacacccgcacgccucgguccaugcccgggacgagacgggugaugggaauuacggccgaauggcuuuggcgcacccuggggcguaacaagaagccucgucuaugcacccgggaagaguucaccaagaagguccgcacaaacgccgcgaugggcgcgguguucaccgaggagaaccagugggacagcgccaaggccgccgucgaagacgaggacuucuggacguuaguggaccgcgagcgggagcugcacaagcuggggaagugcggcucgugcguguauaacaugauggggaagcgugagaaaaagcucggcgaguucggcaaggccaaggggucacgggcgauaugguacaugugguugggcgcccgcuaccuggaguucgaggcccuuggguuucugaaugaagaccacugguucucucgagagaacagcuacucuggcguggaaggcgagggucugcacaagcucggcuacauacugcgcgacaucagcaagaucccugggggcgccauguacgccgacgacacagcgggcugggauacccggaucaccgaggaugaccuccacaacgaggagaagaucacgcagcagauggacccggagcaccggcagcucgccaacgcgauauuuaagcugaccuaccagaacaaagucgugaaggugcagcggcccacgcccaccggcaccguaauggacaucaucucccgaaaggaucagcgggggucuggccaggugggcaccuacggacuuaacaccuucaccaacauggaggcccagcucauccgccagauggagggcgaggggguucuguccaaagcagaccuggagaacccccaucugccggagaagaaaauuacccaguggcuagaaaccaagggcgucgagcggcugaagcggauggcgaucagcggcgacgauugcguggugaagcccaucgaugaccgguucgccaacgcccuccuggcccugaacgacaugggaaaggugcgcaaggacaucccccaguggcagccuuccaaaggcuggcacgauuggcagcaaguuccguucugcagccaccacuuccacgaauuaaucaugaaggauggccggaagcugguaguccccugccgcccccaggacgagcugaucggccgggccagaaucucccagggcgcgggcuggagccuccgggaaacagccugucugggcaaggccuacgcccagauguggucccugauguacuuccaccgacgcgaccugcggcuggcgagcaacgccaucugcuccgccgugcccgugcacugggucccuaccagccgcaccacauggagcauccacgcgcaccaccaguggaugaccaccgaggacaugcugacgguauggaaccgggucuggaucgaggauaaccccuggauggaggacaagacacccguuaccacgugggagaacgugcccuaccuggggaagcgcgaggaucaguggugcggcucccugaucggguugaccagccgugccacgugggcgcagaacauaccgaccgcaauccagcagguccgcucccucaucggcaacgaggaguuucuggacuauaugccgagcaugaagcgguuccggaaggaggaggaguccgaaggggccauaugguga

SEQ ID NO: 25940 - RNA, 9873 nt, Artificial Sequence
  derived and/or modified CDS sequence (opt11) from DENV-3__EU529703__SS-prME
accagccugugucucaugaugauacugccggcggccuuggcguuccaccucaccagccgggacggggaaccccggaugaucguggggaagaacgagcgcggcaagagccugcuguuuaagacugccuccgggaucaacaugugcacucuuauagcaauggacuuaggagaaaugugcgaugacacagugaccuacaaaugcccacacaucaccgaaguggagccagaggacaucgacugcuggugcaaccucacgagcacgugggucaccuacgggaccugcaaccaggcgggagagcaccggcgcgauaaacgcucaguggcccuagcgccccacgugggcaugggguuagacacccgcacccagaccuggaugucggccgagggcgccuggcggcaagucgagaagguggagacaugggcccugagacaucccggauucaccauccucgcccuguuccuggcacacuacaucggaaccucccucacccagaagguggugaucuucaucuugcuaaugcuaguuacgcccagcaugacaaugcgcugugucggcgugggcaaccgcgauuucguugagggccugucaggggcaaccuggguggaugugguucuagaacacggcgggugugugaccacgauggccaagaacaagcccacccucgacaucgagcugcagaagacugaggccacccagcuggcgacgcuccggaaacuguguaucgagggcaagaucaccaacaucaccaccgauagccgcugcccaacacaaggugaggccgcccuucccgaggaacaggaccagaacuacgucugcaagcauaccuauguggacaggggguggggaaacggaugcggccuguucgggaagggcucccuggugaccugcgcgaaguuccagugccuggagcccaucgagggcaaggugguccaguacgagaaucucaaauacaccgugauuaucacggugcacaccggcgaccaacaccagguuggaaacgaaacucagggggugaccgccgagaucaccccucaggccagcaccaccgaggcaauccugcccgaguauggaacccuggggcuugaaugcucuccgcgcaccggccuggacuuuaacgagaugauuuuacucacgaugaagaacaaggccuggaugguacacagacagugguucuucgaccuuccccuccccuggaccaguggggcaacgaccgagacgccgaccuggaaccgcaaagaacuacuggugaccuucaaaaaugcccacgcuaaaaagcaagaagugguugugcuagggucccaggagggcgccaugcauaccgcgcucacgggggccaccgagauccagaacucgggggggaccuccaucuucgcuggacaccugaagugccggcugaagauggacaagcuugaguuaaagggcauguccuacgcgaugugcaccaauacguucgugcugaaaaaggaagucuccgagacacagcauggaacuauccuuauaaagguggaguacaagggcgaggacgccccaugcaaaauuccuuucagcaccgaagacggacagggcaaggcccacaacggcagacuaauaaccgccaacccagucgucacaaagaaagaagagccgguuaacaucgaggcagagccgcccuuuggggaaucaaacaucgugaucggcaucggggacaacgcacugaagaucaacugguauaagaaaggcuccagcaucgggaaaauguucgaggccaccgcccggggcgcccgccgcauggcgauacugggcgacacggccugggacuuuggguccgucgggggugugcucaacagccuaggcaagauggugcaccaaauuuuugggagcgccuacacggcccuuuucucaggcguauccugggugaugaaaaucggcaucggggugcucuugaccuggaucggccugaacuccaagaacaccagcaugagcuucucgugcauugccaucgggauuaucacccucuaccugggcgcgguugugcaggccgacauggggugcgugauuaauuggaagggcaaggaguugaagugcggcagcgggaucuucgucaccaacgaggugcauaccuggaccgagcaauacaaguuucaagccgauucgccgaagcgucucgccaccgcgaucgcgggggccugggagaacggagugugcggcauucguucaacgacccguauggagaaccuguuguggaagcagauugccaacgagcucaauuacauccugugggagaacaacaucaagcucaccguaguggucggggacaucaucggcgucuuggagcagggaaagcgcacgcugaccccccagccaauggaguuaaaguacucuuggaaaaccugggggaaagccaagaucgugacggccgaaacccagaacucuucguucauuauugacggccccaacacgcccgaguguccgagcgcgucucgugccuggaacgugugggaggucgaggacuauggguucggcguguuuacaacgaacaucuggcucaagcugcgcgagguauacacacagcugugcgaccaucggcuaaugucagccgcgguaaaggaugagagggcgguccacgccgauaugggcuauuggaucgaaucucaaaagaacggguccuggaaguuggagaaggccagccugaucgagguaaagaccugcacguggccgaagagccacaccuuguggagcaacggcguucuggaguccgacaugaucauccccaagagccucgcgggaccaaucagccagcacaaccaucggccuggcuaucacacccagaccgccgggccauggcaucucgguaaacuggaacuugauuucaacuauugcgagggcacgaccguggugauuaccgaaaacugcgggacccgcggacccucucugcgcacgaccacagucuccggaaagcugauccacgaauggugcugccguagcugcacgcugcccccgcuccgguacaugggggaggacgggugcugguacggcauggagauccguccuaucucggagaaagaggaaaacaugguaaagucccugguguccgcgggcucggggaagguggacaacuucaccaugggggugcugugccuugccauccuuuucgaggaaguaaugcggggaaaauucggcaagaagcacaugauagccggggucuucuucacguuugugcuguuacuuucuggucaaaucaccuggcgggacauggcacacacccugauaaugaucggcagcaacgccuccgaccgcauggggaugggcguuacguaccucgcguuaauagcgacauucaagauccagcccuuccuggcccuaggguucuuccuucgcaagcugaccagccgcgagaaccugcuguuaggcgucggcuuggcgauggcgaccacgcuucagcugcccgaggauauagagcagauggccaacgguaucgcccucggccugauggcccugaagcucaucacgcaguucgagaccuaccagcuguggacugcccugaucucgcucacgugcucgaacacuaucuucacucuuaccguggcguggcgcacggcaacccugauccucgcggggguaagccugcucccggucugccagaguucguccaugcggaaaaccgauuggcuccccauggccguggcggccaugggcgugccgccccucccgcuguucaucuuuagcuuaaaagacacccugaagcgccgcucuuggccccugaaugagggcguuauggcgguuggccucguaagcauacuggccucgucucugcuucguaacgacgugccuauggcgggcccauugguggccggcggccugcucaucgccugcuauguuaucacggggacauccgccgacuuaaccguggagaaggccgccgacaucaccugggaagaggaagccgaacagaccgguguuagccacaaccugaugaucaccgucgaugaugauggcacuaugcgcaucaaagacgacgagaccgagaacauacucaccguguugcugaagacagcgcuccucauaguguccggaaucuucccuuauagcauucccgcgacgcugcucgucuggcacacguggcagaagcagacacagcggaguggcguucugugggacguucccucaccccccgagacgcagaaggccgaacuggaagagggugucuaccgcauuaagcagcagggcaucuucgggaagacccaggugggcgugggggugcagaaggaagguguauuccacaccauguggcacgucacucggggggcaguucugacguacaacggaaaacgucuggagcccaacugggcgucggugaagaaggaccugaucagcuacggcggagguuggcggcucuccgcccaguggcagaagggggaggagguucaggucauagcugucgagcccgguaagaacccuaagaacuuccagaccaugcccggcacguuccagaccacgacgggugagaucggcgccaucgcucuggacuuuaaacccgggaccagcggcucucccauuaucaauagggaggggaaaguggucgggcuguacgggaacgggguggugaccaagaacggcggguaugucuccggaaucgcacagacaaacgccgagcccgacggcccgacccccgaacuggaggaggaaauguucaaaaagcguaacuuaaccauuauggaccugcaccccgggaguggcaagacucgcaaauaccugccggcgauugugcgggaggcaaucaagcgccgguuacgaacgcugauuuuagcccccacccgggucguugcggccgaaauggaggaggcccuuaaggggcuucccauccgcuaccagaccaccgcaacaaaguccgagcacacugggcgggagauuguggaccugaugugccacgccaccuucaccaugcgcuugcugucgcccgugcgaguccccaacuacaaucugauaauaauggacgaggcgcacuucacggaccccgccaguauagcugcucgcggguauaucaguacccgcguggguaugggcgaggcggccgccaucuucaugaccgccacgccgccagggacggccgacgcguuuccgcagucaaacgcccccauccaggacgaagagcgcgacauccccgaacgcagcuggaacuccggcaacgaguggaucaccgacuucgccgggaagaccgugugguucguccccagcaucaaggccgggaacgacaucgcaaacugcuuacguaaaaauggaaagaaggugauccaacucucgcgcaaaacauucgacacggaguaccagaaaaccaaacugaacgacugggacuucguggucaccaccgacauuuccgagaugggcgcgaacuucaaagccgaccgugugauagauccccggcggugccucaaacccgugauccuaacggacggcccggaacgugucauccuggccgggcccaugccggugacugccgcauccgcggcccaacggagaggccgggugggccgcaacccucaaaaagagaacgaccaguacaucuucaccggccagccccucaacaaugacgaggaucacgcccacuggacugaggccaaaaugcugcuagacaacauuaacacacccgaggggaucaucccggcccucuucgaacccgaacgcgagaaguccgcugccaucgauggcgaguaccgccugaagggcgagagucggaagacguucgucgagcugaugcgccggggggaccucccgguguggcuggcccacaagguggccagcgaggggaucaaguauacagacaggaaauggugcuucgacgggcagcgaaacaaccaaauccuggaagagaacauggacguagagaucuggaccaaggagggagagaagaaaaagcucagaccccgguggcuggacgcgcgcacauauuccgacccgcucgcccucaaggaguucaaggacuucgcggccggcagaaaguccaucgcacuggauuuagugacggagaucgggcgggugcccucccaccucgcgcacagaacacggaacgcguuggauaaccuggugauguuacauaccagcgagcauggagggcgcgccuauaggcaugccguggaggaacugccugagaccauggaaacucuucuccugcuaggccucaugaucuuacuaaccgggggcgccaugcuguuccugaucaguggcaaaggaaucggcaagaccuccaucgggcugauuugcgucauugcgucauccggcaugcucuggauggccgagaucccgcugcaguggaucgccagcgccaucgugcucgaguuuuucaugaugguguuacugauccccgagccugaaaagcagaggacuccccaagacaaccaguuggccuacgucgugaucgggauccucacgcuagcggccaucaucgcagccaacgagaugggccugcucgaaaccaccaagagagaccugggaauguccaaggagccggggguagucagccccacuuccuaccuggacguggaccuccaccccgcguccgccuggacccuguaugccgucgcaaccacaguuauaacgcccauguuacgccacacgauagaaaacucaacugccaauguaucacucgcagccauugccaaucaagccguggucuuaaugggcuuagauaagggguggcccauaaguaagauggaccucggcguaccccugcuggcccucgguugcuacagccaggucaacccccugacucugacugcggcaguccugcuguuaauuacgcacuacgcgaucaucggucccggccuccaggccaaggccacccgugaggcgcagaagcgcaccgccgccgggaucaugaagaaccccaccguagacggcaucaugacgauagaccuggaccccgucaucuacgacaguaaguuugagaagcagcuuggucagguuaugcuccuggugcugugcgcggugcagcuccugcugaugcggaccucuugggcgcuuugugaggcucugacucuggcaaccggacccauaaccacgcucugggagggcuccccagggaaguuuuggaacacgaccaucgccgucagcauggccaacaucuuccgcggcagcuaccuggcgggggccggccuugccuucucaaucaugaaaucgguggggacgggcaagcggggcaccggaucacagggcgaaacccucggggagaaguggaaaaagaagcuaaaucagcuuagccgcaaggaauucgaccucuacaagaaguccggcaucaccgagguugacaggaccgaggcaaaggaagggcucaagcgcggcgagauaacucaucaugcuguaagccggggcucugcgaagcugcaaugguuuguggagcgcaacauggugauaccggaggggcggguuaucgaccucggcugcggacguggcgggugguccuacuacugcgcugggcugaagaaggugaccgaggugagggguuacacaaagggcgggcccggccaugaggaacccguacccauguccaccuauggcuggaacaucgugaagcugaugagcgggaaggacguguucuaccuuccaccagagaagugcgauacucugcugugcgacaucggcgaguccucuccuucucccacugucgaagagucucgcacuauccgcgugcugaagaugguggagcccuggcucaaaaacaaccaguucugcaucaagguccugaaccccuacaugcccaccgugauagaacacuuagaacggcuccaacgaaagcacggcgguaugcuagugcggaauccccugucccgcaacucuacgcacgagauguacuggaucucgaacggaaccggcaacaucguggcauccgugaacaugguuucacgguugcugcucaacagauucacaaugacacaccggagaccuacgauagagaaagauguggaccucggcgccgggacccgacaugugaacgcagagcccgaaacccccaacauggacgugaucggugagcgcauaaagcggaucaaggaggagcacaacagcaccuggcauuaugacgacgagaacccauacaagacgugggcguaccacggauccuacgaggucaaggccaccggguccgccuccagcaugaucaacggcguggugaagcugcugaccaagccgugggauguugugcccaugguuacacaaauggccaugacggauaccacccccuucgggcagcagcgagucuucaaggagaagguugacacgcggacgccccgcucgaugcccggcacgcggcguguaaugggcaucacagcagaauggcuuuggcggacccucgggagaaacaaaaagccucggcuuuguacacgcgaggaguucaccaagaaggugcgcaccaaugcugcgaugggcgcggucuucaccgaggagaaccagugggacuccgccaaggcggccgucgaggacgaggacuuuuggaagcucguggaccgggagcgcgagcugcacaagcucgggaagugcggcagcugcgucuacaacaugauggggaaacgggagaagaagcuaggcgaguucggcaaagcuaaggggagucgcgcgauuugguauauguggcugggggcuagguacuuagaguucgaggcgcuaggguuccugaacgaggaccacugguucagucgcgagaauucuuacagcggcgucgagggggagggccugcacaagcucggcuacauccugcgggacauauccaagauacccgggggggccauguacgccgacgacacagccgguugggauacccgcaucaccgaggacgaccuucacaacgaggagaagaucacccagcagauggacccugaacaccggcaacucgcuaacgccaucuucaagcugacguaucaaaacaagguggugaagguccaacgucccacaccuaccggaacaguuauggauaucauuagccggaaggaccagcgcggcagcggccagguagggaccuacggcuugaacacguucaccaacauggaggcccagcugauccggcagauggagggcgaggggguacugagcaaggccgaccuggagagucaccaccucccagagaagaagaucacccaguggcuggagaccaaaggcgucgagcgccugaagcggauggccaucagcggggacgacugcguggucaagcccaucgacgaccgcuucgcaaacgcgcuccuggcccugaacgacauggguaaggugagaaaggacauaccccaguggcagcccuccaagggcuggcacgacuggcagcaggucccuuucuguagccaucacuuccacgaacugaucaugaaggacgggcggaaguuggucgugcccugcaggccccaagacgagcugaucggacgugcccggaucucucagggggcuggcuggucacuccgcgaaacggccugccuaggcaaggccuacgcccagauguggucccugauguacuuccaccgccgggaucuccggcuggcuaguaacgccauaugcuccgcggugccgguccacugggugcccacaucacggaccacguggucuauccaugcccaccaccaguggaugacgaccgaggacaugcucacuguuuggaaucgcguauggauagaagacaaccccuggauggaggauaagacccccgucacgaccugggaaaacgugcccuauuuagggaagcgggaggaccaguggugcggaucccugaucggacuuacaagccgcgccaccugggcucagaacauuccaacagccauccagcagguuaggucgcucauuggaaaugaagaauuccuggauuacaugccaagcaugaagcguuuccggaaagaggaggaguccgagggagcgaucugguga

SEQ ID NO: 25941 - RNA, 9873 nt, Artificial Sequence
  derived and/or modified CDS sequence (opt11) from DENV-3__EU529705__SS-prME
accucacucugccugaugaugauccuucccgcggcacuggccuuccaccucaccaguagagauggcgaaccaaggaugauugugggaaagaacgagcgggggaaauccuuacuguucaaaacagccagcgggaucaacaugugcacccucaucgccauggacuugggcgagaugugugacgacaccgugaccuacaaguguccccauaucacugagguagagcccgaggacaucgacugcuggugcaacuugaccagcacuugggugaccuacgggacgugcaaccaggccggcgagcaccggcgcgauaagcgcagcguggcccucgcgccccacguuggcauggggcuggauacucggacccagacguggaugucugccgagggcgccuggcgccagguagagaaggucgagacgugggcuuugaggcacccgggcuucaccauccucgcgcuguuccucgcccacuacaucggaaccucccucacccagaagguuguuaucuucauccugcugaugcucgucacgcccagcaugaccaugaggugcgugggaaucggcaaccgugacuucguggagggccuguccggggccacgugggucgacguggugcuggaacacggcgguugcgucacgacgauggccaaaaauaagcccacgcucgacaucgagcugcagaagaccgaagcuacccagcuggcgacgcuccggaaguuguguaucgaagggaaaauuaccaacaucaccaccgacucucgcugucccacgcagggcgaggccguguuaccggaggagcaggaccagaacuacgugugcaagcacacuuacgucgauagagguuggggcaacgggugcggccuauucggaaagggcucgcugguuaccugcgccaaguuccaaugccucgagcccaucgaggggaaggugguccaguacgagaacuugaaguacacggugauuaucacaguacacaccggggaucagcaccaggucggcaacgagacccaaggggugaccgcagaaauaacgccccaggccagcaccaccgaggcgauccuucccgaguacggcaccuuaggccucgagugcucaccccgcaccgggcuggacuucaacgagaugauccugcucaccaugaagaauaaggcguggaugguccaccgccaaugguucuucgaccugccccugcccuggacaagcggcgcgaccaccgagacgccgacguggaaccgcaaggaacucuuaguaaccuucaaaaacgcccacgccaagaaacaggaaguagucguccugggaucccaggagggggcgaugcacaccgcccucacuggggcuaccgagauccagaacucgggcgggaccuccaucuucgccggccaccugaaaugccggcugaagauggacaagcucggccugaaagggaugagcuacgccaugugcaccaauacguucgugcugaagaaggaggucuccgaaacccagcacgguaccauccucaucaagguggaguauaagggggaggacgugccgugcaagguucccuucagcaccgaggacggccaggggaaggcgcauagugggagacuuaucacggccaacccgguggugaccaagaaggaggagcccgucaauaucgaggccgagccgcccuucggcgaguccaauaucguuaucgggauaggcgacaacgcccuaaagaucaacugguacaagaaggggagcucuaucggcaagauguucgaggcgaccgcucggggcgcccgccgcauggccauccugggggacacagccugggacuucggcagcgucggugguguucucaacucccuggggaagauggugcaccaaaucuucggaagcgcauacacggcccuguucuccggcgugagcugggucaugaagaucgggauuggcauccucuuaacuuggaucggucugaacuccaaaaacacaagcauguccuuuucauguaucgugaucggcaucaucacguuauaccugggagccgucguccaggccgacaugggcugcgugaucaacuggaaggggaaggagcugaagugugggagcggcauauucguuacgaacgagguucauaccuggaccgagcaguacaaauuccaagccgacagucccaagcgucucgcgaccgccaucgcaggggccugggagaacggggugugugggauccgcuccacgacccgcauggagaaccuccuguggaagcagauugccaacgagcuaaacuauauacugugggagaacaauauuaagcucaccguagucgucggcgauauuaucggcgugcucgagcaggggaaaagaacguugacgccacagccaauggagcugaaguacagcuggaaagcguggggcaaggccaagaucgucaccgccgagacucagaacuccagcuucauaauagacgggcccaauacccccgagugucccuccgccucucgggcguggaacguaugggagguggaagauuacggcuuuggggucuucacgacgaacaucuggcucaagcugcgcgagguuuacacccaacugugcgaccaccggcucaugagugccgccgugaaggacgagcgagccguccacgccgacaugggcuacuggaucgagucccagaaaaauggcaguuggaaacuggagaaggcgucccugaucgaggugaaaaccugcacauggcccaagagccacacgcucuggucgaacgguguacuggaaucggacaugaucauaccaaagucccuggccggacccaucagccagcacaauuaccguccgggguaucacacccagacggccggccccuggcaucucggcaagcuggagcuggauuucaacuacugcgaggggaccacgguggugauuaccgaaaacugcggcacucgcgggcccucccugcggaccacuacggugagcggaaaguuaauccacgagugguguuguagaucaugcacacuacccccgcuccgguacaugggggaggacggaugcugguacggcauggagauccggcccaucagugaaaaggaggagaacaugguuaagucccucgugagcgcgggcuccgguaagguagacaacuucaccaugggggucuuguguuuagccauacuguucgaagagguaaugcggggcaaguucgggaagaaacacaugaucgcgggcgucuuuuucacguucguccugcuuuuaagcggccagaucacguggcgugacauggcacacacccugaucaugaucggauccaacgcgagcgaccggaugggcaugggcgugaccuaccucgcccugaucgccacguucaaaauccagcccuuccuggcacucggcuuuuuccugcgcaagcugaccagccgggagaaccuccugcugggcguggggcucgccauggcaacaacccugcagcugcccgaggacaucgagcagauggcaaacgggaucgcguuagggcugauggccuuaaagcucaucacgcaguucgaaaccuaccagcuguggacagcccugaucucccugaccuguucuaauacgauuuucacccucaccguugccuggcgcaccgccacgcugauccucgcgggcgugucacugcugccggucugccagagcuccagcaugcggaagaccgacuggcuccccaugaccguggcggccaugggggugccuccccucccguuauucaucuucucccuuaaggacacucucaagaggcguagcuggccccugaacgagggugucauggcggugggccuugucuccauccuggcaagcucccuccuccggaacgacgugcccauggcggggccccugguugccggugggcugcucaucgccugcuacgugaucacaggcaccagcgccgauuugacaguagagaaggccgcggacgugaccugggaggaagaggccgagcagacuggggugucccacaaccugaugaucaccguagacgacgacggcaccaugcgcaucaaggaugaugaaacagagaacauccucacugugcugcugaagacggcccuccugaucgugagcggcaucuuuccguacuccauacccgccacccugcuggucuggcauacuuggcagaagcagacgcagcguagcggggugcuaugggauguacccucuccgcccgagacgcaaaaggccgagcuggaggagggugucuauagaaucaagcagcaggggaucuucggaaagacccagguuggggugggcguccagaaggagggcguguuucacaccauguggcaugugacgcgcggagcggucuuaacauacaacggcaagcgccuugagcccaauugggccucggugaagaaggaccugauuuccuacggcggcggguggcgccucagcgcccaguggcagaagggugaggaggugcaggucauugccguggagccugggaagaaccccaagaacuuccaaaccaugccagggaccuuccagaccaccaccggagagaucggcgcgaucgcccuggacuucaaaccggguaccagcggcucucccaucaucaaccgcgaagggaaggugguaggucuguacggcaacggaguggucaccaaaaaugggggcuacguaagcggcaucgcccagacgaacgccgagccagacgggccaacccccgaacuggaggaagagauguuuaagaagcggaaccucaccauuauggaccugcaucccggcuccgggaagacccgcaaguaccugccggccauagugcgggaggcgaucaagcgccggcuccgaacgcugauacuggcuccuacccggguggucgcagcagaaauggaggaggcccucaaggggcugcccauucgcuaccagaccaccgcgacgaaaagcgagcacacuggacgggagaucguggaccugaugugccacgcaaccuucacaaugcgccuccuguccccaguucgggucccgaacuacaaccugauaauuauggacgaagcccacuucacggaucccgccagcauagccgcgcgugguuacaucagcacccgggugggcaugggggaggccgcggcgauauuuaugaccgcgacaccgcccggcaccgccgacgcguucccucaaagcaaugcccccauacaggaugaggaacgggacauucccgagcgcagcuggaacucggggaacgaguggaucacugacuucgccggcaagaccgugugguucgucccaucuaucaaggcgggcaacgauaucgccaacugccuccggaaaaacggcaagaaggugauacagcugagccgcaaaaccuucgacacggaauaucagaagacuaagcugaacgacugggacuuuguaguaaccaccgacaucuccgaaaugggcgccaacuucaaggccgaccgggugauugauccgcgccggugccuuaagcccgugauacugacggauggucccgagcgagucaucuuagccgguccuaugccggugaccgcagccagcgccgcccagcggcgcggacgggugggccggaacccccagaaggagaacgaccaauauaucuucaccgggcaaccacucaacaacgaugaagaccacgcgcacuggaccgaggcuaaaaugcuguuggacaauaucaauacccccgaagguaucauuccugcccuuuucgagcccgaacgggagaaguccgcggcgaucgacggcgaguaccgcuuaaagggggagucacggaagacguuugucgagcugaugagacggggcgaccuccccguauggcucgcccacaaagucgccucagaggggauaaaguacaccgaccgaaaguggugcuuugacggccagcggaacaaccagauccuagaagagaacauggacguggagaucuggaccaaggagggcgagaagaaaaagcucagaccccgguggcuggacgcccguaccuacucggacccucuggcccucaaagaguucaaggacuuugcagcggggcguaaauccaucgcccucgaccuggugacggagauuggccggguccccagucaucucgcccaccgcacccgcaaugcccuggacaaccugguuaugcuccacaccagcgagcacgggggccgagccuaucggcacgcuguagaggagcugcccgaaacaauggagacgcugcuccuccuggggcuaaugauucugcugacgggcggcgccaugcuuuuccugaucucugggaagggaaucgggaaaaccagcaucggccugaucugcgucaucgcauccagcggcaugcucuggauggccgagauaccguugcaguggaucgcuucugcgaucguacuggaguucuucaugaugguguugcugauucccgagcccgagaagcagcgcacgccccaggacaaccaguuagcauacgucgucaucggcauacuaacacuggccgcgaucauugccgcgaacgaaauggguuugcucgagaccaccaagcgcgaccuggggaugucaaaggagccggggguagucucccccaccucguaccucgacguggaucuucacccagcuuccgccuggacgcuauacgccguggcaaccaccgucaucacacccaugcugcgccacacgaucgagaacagcaccgccaacgugucccucgccgccaucgccaaccaggcugugguccugauggggcuggacaaaggcuggccgaucagcaagauggaccucggggugccuuuguuagcccucggcuguuacagucagguuaacccccugacgcugaccgcugccgucuugcugcugaucacgcacuacgccaucaucggccccgggcuccaggcaaaggccacucgggaggcucagaagcgcacugccgccggcauuaugaagaauccgaccguggacgggaucaugacuaucgaccuggaccccgugaucuacgauagcaaguucgaaaagcagcucggccaggucaugcuccugguacugugcgcggugcagcuccugcugaugaggaccuccugggcccucugcgaggcucuuaccuuggcgaccggcccuauuaccacacucugggaggggagccccggcaaguucuggaacaccaccaucgcggucuccauggccaacaucuuucgagggagcuaccucgccggugccgggcuggcuuucucaaucaugaaguccgugggcaccggcaagcgaggcacgggcagccagggagagacccucggggaaaaguggaagaaaaagcugaaccagcugucccgcaaggaguucgaccuuuauaaaaaguccggcauuaccgagguggaccguaccgaagcgaaggagggccugaagaggggcgagaucacgcaccacgccgucucccggggcagcgccaagcugcagugguucguagagcgcaacauggugauuccggaaggcagagucaucgaccugggguguggccgcgggggcugguccuacuacugugccggucugaagaaggugaccgaagugcggggguauaccaaaggcgggccaggucacgaggagcccguaccaaugagcaccuacggcuggaacaucgugaaacugauguccggcaaagauguguucuaccucccucccgagaaaugcgacacgcugcugugcgacaucggagagagcuccccgagccccacggucgaagagucccgcacgauccgcgugcugaagaugguggagccguggcuuaaaaacaaccaauuuugcauaaagguccugaaccccuacaugccgaccgugaucgagcaucuggagcggcuccagcgcaaacacggcggcaugcuggugcggaacccccucucucgcaacuccacccacgaaauguacuggaucagcaaugggacaggcaacaucguagccuccgugaacauggugagccgacugcugcugaacagauucaccaugacccacagacgccccaccaucgagaaggacgucgauuugggugcggggacccggcacgugaacgccgagcccgagacccccaauauggacgugaucggugaacgcaucaagcggauuaaagaggagcauaacucuaccuggcacuacgacgaugaaaacccguacaagacgugggccuaccaugggagcuacgaggucaaggccaccggcuccgccucguccaugaucaacggggugguaaagcugcugaccaagccaugggacgucgugcccaugguaacccaaauggcgaugacggauaccaccccguucggccaacagcguguguucaaggagaagguugacacgcggacgccacgcucgaugccaggaacacggcgcgucaugggcaucaccgccgagugguuauggcggacccugggccggaacaagaagccccggcuaugcacucgcgaagaguucacgaagaaagugaggacuaacgccgccaugggggcgguguucaccgaggagaaccaaugggauuccgccaaagcagccguggaggacgaggacuucuggaucuuggucgacagagagcgcgagcugcacaagcugggcaagugcgguucaugcguguauaauaugaugggcaagcgggagaagaagcucggggaguucgggaaggcgaagggcucgcgcgcaaucugguacauguggcuuggggcccguuaccuggaguucgaagcccucggcuuccugaacgaagaccacugguuuucccgcgagaauaguuauuccgggguggagggcgagggccugcauaaacucggguacauccugcgggacaucagcaaaauccccggcggggcaauguacgccgacgacacggcgggcugggacaccagaaucaccgaggacgaucuucacaacgaggagaaaauaacccagcagauggacccggaacaccggcagcucgcguccgccauauucaagcugacguaucagaauaaggucgugaagguccaacgcccuacccccaccggcaccgugauggacauuaucagccggaaggaccagcgcgguuccggccagguuggaaccuacggccuaaacacguucaccaacauggaggcccaacuuaucagacagauggagggcgagggcguccugagcaaggccgaccuggaaaacccgcaucuccccgagaagaaaauaacccaguggcuggagaccaagggcguggagagacuuaagcggauggcgaucuccggggaugacugcguggucaagccaaucgacgaucgcuucgccaacgcgcuccuagccuugaacgacauggguaagguccggaaggacauuccucaguggcagccgaguaagggguggcaugacuggcagcaggucccguucuguagucaccacuuccacgaauugauuaugaaggauggccgcaaguuggucguacccugccggccccaggacgaguugaucgggcgcgcccggauaucucagggcgcgggcugguccuugcgcgagacggccugucuggggaaggcuuacgcccagauguggagccuuauguacuuccaccgccgggaccuccgucuggcguccaacgccaucuguagcgccgugcccguccacugggugccgaccagccggaccaccuggucaauccacgcgcaccaccaguggaugaccaccgaagacaugcugaccguguggaaucgcgucuggauagaggacaaccccuggauggaagacaagaccccugugacgaccugggagaauguccccuaccuuggcaaacgggaggaccaguggugcgggucacugauagggcugacaagucgugccaccugggcgcaaaauaucccgacggccauccaacaggugcggagccucaucgggaacgaggaguuccuggacuacaugcccagcaugaagcgcuuccggaaggaagaggaaagcgaaggcgccaucugguag

SEQ ID NO: 25942 - RNA, 9873 nt, Artificial Sequence
  derived and/or modified CDS sequence (opt11) from DENV-3__EU596492__SS-prME
accagccuaugccucaugaugauccuccccgccgcccuggcguuccaucucaccucccgggacggggagccccguaugaucguggggaagaacgagcgaggcaagagucugcuguuuaaaaccgccucugggaucaauaugugcacccucaucgccauggaccugggcgagaugugcgacgacacagugaccuacaagugcccccacaucgcggagguggagccggaggacaucgacugcuggugcaaccugaccucgaccugggugacuuacgggaccugcaaucaagccggggaacaucggcgcgacaagcgauccguggcgcucgcgccucacgugggcaugggucuggacacgcgcacacagaccuggaugagcgccgaaggcgccuggcggcaggucgaaaagguggagaccugggcgcucagacacccgggguucacaauucuagcccuguuccuggcccacuacaucggcaccucucucacccagaagguggugauuuucguccuguugaugcucgucacccccagcaugacuaugcggugcguggggguaggcaaccgcgauuucguggagggccugucaggcgccacauggguggaugucguguuagagcacggcgggugcgugaccaccauggccaagaacaagcccacgcucgauauugagcuacagaagaccgaggcuacccagcuggccacccuccggaaguugugcaucgagggcaagaucacgaacaucaccaccgauagcaggugcccuacccagggcgaggccgcccugccggaggagcaggaccagaacuacgucugcaaacacacguauguggaccggggauggggaaauggaugcggccucuucgggaagggcucccugguaacaugcgccaaguuccaaugccuggaacccaucgaaggcaagguuguacaauacgagaaccucaaguacaccgugauaaucaccguccacacgggggaccagcaccaggucggcaacgaaacccagggggucaccgcugaaaucaccccccaagccagcaccaccgaggccauucugcccgaguacggcacacugggacucgaauguuccccacgcaccgggcuggacuucaacgagaugauccugcucacgaugaagaacaaggccuggauggugcaucggcagugguuuuucgaccuuccccugcccuggacgagcggggccacaaccgagaccccuacguggaaucguaaggagcucuuggugaccuucaagaacgcccacgcuaagaagcaggaggucguaguucuggggucccaggagggcgccaugcacaccgcgcucacuggggccacggagauccagaacucaggcgguaccuccaucuuugcgggccaucugaaaugccggcugaagauggacaagcucgagcuaaaagggaugucauacgccaugugcacaaacaccuucguccugaagaaggaaguguccgaaacccaacaugggaccauccucaucaaaguggaguacaagggcgaggacgccccgugcaagauccccuucagcacugaggacgggcagggcaaagcucauaauggccgccugaucacagcgaacccuguagugacuaaaaaggaggagcccgugaacaucgaggccgagccucccuucggggagucgaacaucgucauagguaucggcgacaacgcccuaaagaucaacugguacaagaagggguccagcaucgggaagauguucgaagcuaccgcccggggcgccaggcggauggcuauuuuaggggacaccgccugggacuucgggucagucggcgggguacucaacagccugggcaagaugguccaccagauauucggguccgcguacaccgcucuguucagcggcguguccugggugaugaagaucgguauugggguccuccugacguggauaggccugaacagcaaaaacaccuccaugagcuucuccugcaucgcgaucgggaucaucacccucuaccugggugccguggugcaggccgacaccgggugcgucgugaacuggaaggguaaagagcugaaaugcggcagcgggauauucgugacgaacgagguccauacauggaccgagcaguacaaguuucaggcagacagucccaagcgccucgccaccgcgaucgccggagccugggagaacgggguguguggcauccgcucgacgacccggauggagaaccugcuauggaagcaagucgccaacgagcucaacuacauacugugggagaacaauaucaagcugacugucgucgugggagauaucaucgggguccucgagcaggggaaacgcacccugacgccacagccaauggaacugaaguacaguuggaagaccugggggaaagccaagaucgugacggcagagacccagaacagcuccuucaucauugacggcccaaacacacccgagugccccagcgccuccagggccuggaacgugugggaggucgaggacuacggguucggcguguucaccacgaacauuuggcucaagcuccgcgagguguacacacagcugugugaccaccgccucaugagcgccgcggucaaggacgagcgcgcugugcacgccgacaugggcuauuggaucgagagccagaagaacggauccuggaagcucgaaaaggccagccugaucgaggugaagaccugcacguggccuaagucccacacccucuggagcaacggcguacuggaauccgacaugaucaucccuaaaagccuagccgggcccaucucccaacacaacuaccggccgggcuaccacacccagacagccgggcccuggcaccucggcaagcuggagcuugacuuuaacuacugugagggcacgaccguugucauuaccgagaacugcgggacccgcggccccagccugcggacuacgaccgucucaggaaagcugauccacgaauggugcugccgcagcugcacccugcccccgcuccgguacaugggcgaggacgggugcugguacggcauggagauccgacccauuuccgaaaaggaagagaacauggucaagagccugguuuccgccggcucagggaaggucgauaacuucacuaugggcgugcugugccucgccaucuuguucgaggaggugaugagagggaaguucgguaagaagcacaugauugccgggguauucuucaccuucgugcuccuccuuuccggccagaucaccuggcgcgacauggcgcacacgcugaucaugaucggcuccaacgcguccgacaggauggggaugggcgugaccuaccucgcccugauagccaccuucaagauccagcccuuucuggcgcucggguucuuccugagaaagcugaccuccagagaaaaccuccugcuaggcgucggccuagcgauggcaacgacgcugcagcugcccgaggacaucgaacaaauggccaacgggaucgcgcucggccugauggcgcuaaagcucaucacccaguuugagaccuaccaacuguggaccgcgcugaucagccucacgugcaguaacacaaucuucacccugacgguggccuggcgcacggccacccugauccucgccggggucagccuucugccggugugccaguccagcuccaugcggaaguccgacuggcuccccaugaccguggccgcaaugggcgugccgcccuugccucucuucaucuucucccucaaggacacccugaagcgccgcagcuggccccugaacgaaggggugauggccgugggccucgucuccauauuagcgagcucccugcuccggaacgaugugcccauggccggcccccugguggccggaggacuauuaauugcgugcuacgucaucacggggacgagcgcugaccugaccguggagaaggcggccgacgugaccugggaggaggaggccgaacaaaccggcgucucccauaaucugaugaucaccguggaugacgacgggaccaugcgcauaaaagacgacgagacagagaacauccucaccgugcugcugaagacggccuugcugaucguauccggcaucuucccguacaguauccccgccacccuucucguguggcacaccuggcagaagcagacacggcgcagcggcgugcugugggacguacccagcccgcccgagacgcagaaggcugaguuggaggaggggguguaccggaucaagcagcagggcauuuucgggaagacccaggugggcgucgggguccaaaaggagggcguguuucacaccauguggcacgucacccgcggcgccguucucacguacaacgggaagcggcuggagcccaacugggcgagcgugaagaaggaccugaucaguuacggcgggggcuggcgccugagcgcccaguggcagaagggggaggagguccaggugaucgccguggagcccggcaagaaccccaaaaauuuccagaccaugcccggcacauuccagaccacgacuggggagaucggcgccaucgcccuagacuucaagccaggcaccagcggcaguccuaucaucaaccgggaggggaagguuguagggcuguauggcaacgggguagucaccaagaaugguggguacguuagcggcaucgcgcagacgaacgccgagcccgacggccccaccccggaacuggaggaggaaauguuuaagaaacgaaaucucaccaucauggaccuccaccccggguccggcaagacccggaaguaucuuccggccaucgugcgcgaagcaauaaagcggcgccugcggacgcugauccuggcacccacccgcgucguggcugccgagauggaggaggcccuuaaagggcugcccauccgguaccaaaccaccgccaccaaaagcgagcacaccggccgcgagaucguggaccugaugugccacgccacauucaccaugcggcuccugucccccguccgcgugccgaacuauaaccugaucaucauggaugaagcucacuucacggaccccgccagcaucgccgcccggggguauaucuccacccgcgugggcaugggcgaggcggccgcgaucuucaugaccgccacuccgcccgggacggccgacgcuuucccgcagucgaacgcccccauccaagacgaggagcgcgacauccccgagcgcuccuggaacagcgggaacgaguggauuaccgacuucgccgggaagaccgucugguucguccccuccaucaaggccggcaaugauaucgccaacugccuucgcaagaacgggaagaaggugauccagcugagccggaaaaccuucgacacugaguaccaaaagaccaagcugaaugacugggacuucgucgugaccaccgauaucuccgagaugggcgcgaacuucaaggccgaccgcgugauugacccgcggcgcugccucaaacccgucauccuaacggacgggcccgagcgggugauucuggccgggcccaugccugucacugccgccagcgcggcccagcgacggggccgcguggggcggaauccgcagaaagagaacgaccaguacaucuucaccggccagccccucaacaacgacgaggaccacgcccacuggacugaagccaagauguuacuggacaacaucaacacccccgaggguaucaucccggcccucuuugagcccgagcgcgagaaguccgccgccaucgacggggaauaccggcugaagggcgagucgaggaaaacguucguggagcugaugcggcgcggggacuugcccguauggcuggcccacaagguggccucagagggcaucaaguauaccgaccggaaguggugcuucgacgggcagcggaacaaucagauccuggaggagaacauggauguggagaucuggaccaaggagggagagaagaagaagcuccggccccgcuggcuggacgcgagaaccuauagcgacccgcuggcccuaaaagaguucaaggacuucgccgccggccggaaguccaucgcccuggauuugguuacggagaucgggcgggugcccagccacuuagcgcaccgcacccgcaacgcccuggacaaccuggugaugcuacacaccagcgagcauggcgguaaggccuaccggcacgccgucgaggagcugcccgagaccauggaaacgcugcuccugcuggggcucaugauccuucugacugggggcgccaugcucuuccugaucuccggaaaggggauaggaaagaccagcauaggucugaucugcgugaucgcgaguagcggcauguuauggauggcagagaucccgcugcaguggaucgccucagcaaucguucuggaguucuucaugauggugcugcuuauccccgagccagagaagcaacgcacgccacaagacaaccagcuggccuacguggugaucgggauacucacccuggcggccaucaucgccgccaacgagaugggccugcucgaaaccaccaagcgugaucuaggcaugagcaaggagccgggggucgugucccccacuagcuaccuggacguggacuuacacccggcguccgcuuggacgcuguacgccgucgccacgaccgugaucaccccgaugcuacgccacacaaucgagaacaguaccgccaacgugagccucgcggccaucgccaaccaggcgguagugcugaugggccugaacaagggcuggccuaucagcaagauggaccuaggagucccccugcuggcccucgguugcuacucccaggucaacccccugacccugaccgcagccgugcuccugcugauuacgcacuacgcaaucaucggccccggccuccaggccaaggccacccgggaggcgcagaagcgaaccgccgcggggauuaugaagaacccgaccguggacggcaucaugacgaucgaccucgaccccgucaucuacgacucgaaauucgagaagcaguuggggcaagugaugcuccugguucugugcgcuguucagcuccugcugaugcggaccucaugggcgcuuugcgaagcccugacccuggccaccggccccauuacgacacugugggagggcuccccggggaaguucuggaacaccacaaucgccgucuccauggccaauaucuuuaggggcagcuaccuggccggggccggccuggccuucuccauuaugaaguccgugggcacuggcaagaggggcaccgggagccagggcgaaacccucggggagaaguggaagaagaagcugaaccagcugucacgcaaggaguucgaccucuacaagaaaucuggcaucacagaggucgaccggaccgaggccaaggaggggcuuaagaggggcgagaucacgcaccacgcugugucccggggcagcgcuaagcugcagugguucguugagcgcaacauggucauuccggaggggcgggugaucgaucucggcugcgggcgcggcggcuggagcuacuacugugcgggauugaagaagguaaccgaggugcggggcuacaccaagggugggcccgggcaugaggagcccgugcccaugagcacguacggcuggaacaucgugaaguuaauguccgggaaggacguauucuaccuuccgcccgagaagugcgacacgcugcugugcgacaucggggagucgucccccucaccaaccguggaggagucccgcaccauccgcguucugaagauggucgagccguggcucaaaaacaaccaauucugcaucaaggugcugaaccccuauaugcccaccguuaucgagcaccuggagcgacuccagcgcaagcauggcgggaugcugguccggaacccccugagccgcaacuccacgcaugagauguacuggaucagcaacggcaccgggaacaucgucgccuccgugaacauggucagccggcuccuacugaaccgauucaccaugacacaccgaagaccgacgaucgagaaggacguggaccucggcgccgggacccggcauguaaacgccgagcccgaaacacccaauauggacgugaucggggagcgcaucaagcguaucaaggaggagcacaacucgacauggcauuacgaugacgagaacccguacaagacgugggcguaccacggcagcuacgaagugaaggcgaccgguuccgccagcagcaugaucaacggcgucgugaagcuguuaaccaagcccugggacgugguacccauggugacacagauggcgaugacagacaccaccccguucgggcagcagcgcguguuuaaggagaaggucgacacccgaacgccgcgcuccaugcccggcacccgacgcgugaugggcauuaccgcugaguggcucuggcggacucuggggcgcaacaagaagccccggcugugcacuagggaggaguucaccaagaagguucgcaccaaugccgcaaugggcgcugucuucacugaggagaaccagugggauagcgccaaggcggccguagaggacgaggacuucuggaagcucguagaccgcgagcgcgaacugcacaaguuggggaaguguggcuccugcguguauaacaugauggggaaacgggagaagaagcucggcgaguucggcaaagccaaggggucgcgcgccauaugguauauguggcugggcgcccgguaccuagaauuugaggcguugggguuccugaacgaggaccacugguucucgcgcgagaacagcuacuccggcguggagggagagggauugcacaagcucggcuacaucuuacgggauaucucuaagaucccugggggcgccauguacgccgacgacacggccgggugggacacucgaaucaccgaagacgaccugcacaacgaggaaaagaucacccagcagauggacccggagcaccggcagcucgccaaugcgaucuucaagcugacguaccagaacaagguggucaaggugcagcgccccaccccgaccggcaccgugauggacauaaucucacggaaggaccagaggggcucagggcagguuggaaccuacgggcugaacacguuuacaaacauggaggcccaacucauccggcagauggagggagaggggguacugaccaaagcggaucuggagaacccccaccucuccgagaagaagaucacacaguggcucgagacgaagggcguggagcgccugaaacggauggcaaucagcggcgacgauugcgucgugaaaccgaucgaugaccgcuucgcuaacgcacuccucgcgcugaacgacaugggaaaggugcgcaaggacaugccccaguggcagccguccaagggcuggcacgauuggcagcaggucccauuuugcagccaccacuuccacgagcucaucaugaaggaugguagaaagcugguggucccgugccggccccaggaugagcuaaucggccgcgcccggaucucccagggggccggcuggucgcuccgagagacagcgugcuuaggcaaggccuacgcccagauguggagcuugauguacuuucaccggcgggaccuccgucuagccagcaacgccaucuguuccgcgguccccgugcacugggugcccaccagccggacuacguggaguauacacgcccaccaccaauggaugacgaccgaggacaugcugaccgucuggaaucgcguuuggaucgaagacaacccguggauggaggacaagacccccgugaccaccugggaaaauguccccuaccucggaaagcgggaggaccaaugguguggaucccuuauagggcugaccagccgcgccacgugggcccagaacauccccacagccauccagcagguacgaucccucauaggcaacgaggaguucuuagacuacaugccgagcaugaagcgcuuccggaaggaggaggaguccgagggcgcgaucugguaa

SEQ ID NO: 25943 - RNA, 9873 nt, Artificial Sequence
  derived and/or modified CDS sequence (opt11) from DENV-3__EU596493__SS-prME
accagccugugccucaugaugauccugcccgccgcccuggcauuccaccucaccagccgggacggggaaccccggaugaucgucgggaagaacgagcgcggcaagagucuacucuucaaaaccgccucugguaucaacaugugcacccuuauugcgauggaccugggcgaaaugugcgacgacaccgugacguacaagugcccucacaucgccgagguggaaccggaagauauagacugcuggugcaaccugacaaguaccugggugacuuacgggaccugcaaccaagcaggcgagcaccgccgcgacaagagguccguggcgcucgcgccccacgugggcaugggacuggacacccgcacgcaaaccuggaugagcgccgaaggcgccuggcggcaggucgagaaggucgagaccugggcgcugagacauccgggcuucacgauccuagcccuguuccuagcccacuacaucggcaccucccucacccagaaaguggucaucuuuguucuguugaugcuagugaccccuuccaugacgaugcggugcgugggggucggcaaucgcgacuucguggagggccugucgggggccacauggguagacgucgugcuggagcacggcgggugcguuaccaccauggcgaagaacaagcccacacuagacaucgagcugcagaagaccgaggcaacccagcuggcaacccucaggaaacuuuguaucgagggcaagaucaccaacauuaccaccgauagccgcugccccacccagggcgaggccguccucccggaggaacaggaccagaacuauguaugcaagcacacguacguggaccgggggugggggaacgggugcggccuguucgggaagggcucccuggugaccugugccaaauuccagugccuggagcccaucgagggcaaaguggugcaguaugaaaaccucaaguacacugucaucaucaccgugcacacgggggaccagcaucaggucggaaacgagacccagggggucaccgccgagaucacgccacaggcgucgacgaccgaggccauccugcccgaguauggcacccuggggcucgaaugcuccccgcgcacuggccuggacuuuaacgagaugauccugcucaccaugaagaacaaggcauggauggugcaccgacagugguucuucgaccuuccgcugcccuggacgagcggggcaaccaccgaaacccccacuuggaaucgcaaggagcuccuggucacuuucaagaacgcacacgcaaagaagcaggagguggugguccugggaucccaggagggcgcaaugcacacggcccucaccggggccacggagauccaaaacagcggugggaccuccaucuucgccggucaucuaaaaugccggcuaaagauggauaagcuggagcugaaaggaaugucguacgcgauguguacuaacaccuucgugcugaagaaggagguguccgagacucagcacgggaccauucugaucaaagucgaguacaagggggaggacgccccgugcaagauccccuucagcacagaggacgggcagggcaaggcccacaacggcagacucaucaccgcgaaccccguggugacgaagaaggaggagcccgucaacaucgaggcggagccgcccuucggggagaguaacaucgugaucggcaucggggacaacgcucugaaaaucaacugguacaaaaagggguccuccauuggcaagauguucgaggcaacggccaggggcgcacgccggauggcgauccugggcgacacagccugggacuucggguccgugggcgggguccucaacagccuggguaagauggugcaccagaucuucggcuccgccuacacggcucuguuuagcggcguguccugggucaugaagaucggaauugggguguuacugacguggaucggccugaacaguaagaacacgucuaugagcuucuccuguauugccaucgggaucaucacucucuaucugggcgcggugguccaggcugacaccgggugugugaucaacuggaagggcaaggagcugaagugcggcagcgggaucuuugugacaaacgagguccacacguggaccgaacaguacaaguuccaggccgacagccccaagcgccucgccaccgcaauugcgggcgccugggagaacggagugugcggcauucgcagcacgacccggauggagaacuuacuguggaagcagguugccaacgagcucaauuacaucuugugggagaacaacaucaaacuuaccgucguggucggggacaucauaggcguccuggagcagggcaagcgcacccugacuccgcagccgauggaguugaaguacuccuggaagaccugggggaaggcuaagaucgugaccgcggagacccagaacagcaguuucaucaucgauggccccaacacacccgagugccccagugccucccgggcuuggaaugugugggaggucgaggacuacggguuuggcguguucaccacaaacaucugguugaagcugcgcgagguguauacccagcugugcgaccaccggcucaugagcgccgccgucaaggaugaacgcgcggugcaugccgacaugggcuacuggaucgagagccagaaaaacgguuccuggaaacuagagaaggcgagccugaucgaggucaagaccuguacguggccgaagucacacacccucuggucuaacggcguccuugaguccgacaugaucauccccaagagccuggccgggcccaucucccagcacaacuaccggcccggcuaccacacccagaccgccgggcccuggcaccucggcaagcuggagcuggacuuuaauuacugcgagggcacgaccguggugaucaccgaaaacugcggaacccgcggccccucccuccggacgacaacugucuccgggaaacuuauccacgaguggugcugccgcagcugcacccucccaccgcuccgcuacaugggcgaggacgggugcugguacgguauggagauuaggcccauuuccgagaaggaagagaacauggucaagagcuuaguguccgcgggcagcgggaaggucgacaacuucacgaugggcgugcuaugucucgccauacuguucgaagaggugaugcgggggaaguucggcaagaagcauaugaucgccggcguauucuucaccuucgugcugcuccuguccggccagaucaccuggcgcgacauggcccacacccugaucaugaucggcagcaaugcguccgaccggauggggaugggcgugacguaccucgcucuaaucgccaccuucaagauccagcccuuccuggcacucggguucuuccugcguaagcugaccagccgggagaaccuacugcugggcguuggacucgccauggcgaccacgcugcagcugcccgaggacaucgaacagauggcuaacgggaucgcccucggccugauggcccugaagcucauaacccaguucgagaccuaccaguuauggaccgcacugaucagccucacguguucaaacaccaucuucacccugaccguggcuuggcgcaccgcuacccugauccucgccggggugagccugcucccggugugccaguccagcucuaugcggaaguccgacuggcuccccaugaccguggccgccaugggcgugccgccucuaccgcuuuucaucuucagcuuaaaggauacacugaagcgccgcaguuggccccugaaugagggggugauggcgguuggccucgucagcauccuggccagcucucuguugcggaaugaugugcccauggccggcccuuuaguggccgggggucugcucaucgccugcuacgugaucacggguacgagcgcggaccucaccguggagaaggccgccgacgugacuugggaggaggaggccgagcagaccggugucucccacaaccugaugaucaccguggacgacgacgguacuaugcgcaucaaggacgaugagaccgagaacauucucaccguucuacugaagacggcccuccugaucgugucaggcaucuucccuuauucgaucccugcgacccugcucguguggcauaccuggcagaagcagacucggcguuccggcguccugugggacgucccuuccccucccgagacgcagaaggccgagcuggaggaggggguguaccggaucaagcagcagggcaucuucgggaagacacagguuggugucggcgugcagaaggaaggcguguuccacaccauguggcacguuacacgaggcgccgugcucacguacaaugggaagcgacuggagccuaacugggccagcgucaagaaagaccuuauuuccuacggcgggggauggcgccucaacgcgcaguggcagaagggggaagagguccaagugaucgccguagagcccggcaagaaccccaagaacuuccagacuaugcccgggaccuuccagaccacgaccggggaaaucggcgcaauagcgcuggacuucaagcccggcaccagcggcagccccauaaucaauagggaaggcaaagucgugggacuguacggcaacgguguggucaccaagaacggaggguacguuuccggcaucgcccaaacgaacgcagagccagacgggcccacccccgagcuggaggaggagauguuuaagaagcgcaaccucaccaucauggaccugcaccccgggucgggcaagacacgaaaguaccugccggcaaucguaagagaggcaaucaagcggcgccuccggacgcugauccuggcucccacucgcguuguggcggccgagauggaagaggcccuaaagggccugccuauccgguaccagacaaccgccaccaaguccgaacacacuggccgcgagauaguggaucugaugugccacgccaccuucaccaugagacuccuguccccuguccgcgugccaaauuacaaucugaucaucauggacgaagcccacuucacggaccccgcgucaaucgccgcacggggguacaucagcacccgcguggggaugggcgaagccgcggccauauucaugaccgccacgccgccggggacggccgacgccuucccgcaaaguaacgcgcccauccaggaugaggaacgugauauacccgagcggagcuggaacaguggcaacgaguggaucaccgacuucgccggaaagacagugugguucgugcccagcaucaaggccggcaacgacaucgcuaacugccuccggaagaacgggaaaaaggugauccaguugucccggaagaccuuugacacggaguaccagaagaccaagcugaacgacugggacuucguagugacgaccgacaucagugagaugggcgccaacuucaaagcggaccgcgugauugauccgcggcgcugccucaagcccgucauccugacggauggucccgagcgggugauccuggccggacccaugccgguaaccgccgccuccgccgcgcaacgccggggcagagucgggcgaaacccccagaaggagaacgaccaguacaucuucaccggccagccgcucaacaacgacgaggaccacgcccacuggaccgaagccaagaugcugcuggacaauaucaacacgccggaggggaucauccccgcucucuucgagcccgagagagaaaagagugcggccaucgauggcgaguaccgccugaagggcgaaucccggaagacguucguggagcugaugcggcgaggggacuugcccguguggcuggcucacaagguugccagugagggcaucaaguacacugaucggaaguggugcuucgacgggcagcguaacaaccagaucuuggaggagaacauggacgucgagaucuggaccaaagagggcgagaagaaaaagcuccggccacgcuggcuggacgcacgcaccuauuccgacccguuagcguuaaaggaguucaaggacuucgccgccggccggaaaucaaucgcccuggaccuagucacggagauagggagagugcccucgcaccuugcccaccggacccgcaacgcucuggacaaccugguuaugcuccacacaagcgaacacggcgggaaagccuacagacacgccguggaagaacugcccgagacgauggagacgcugcuucugcugggacucaugauacugcugaccgggggcgccaugcuguuccuaauuagcggcaaagggaucggcaagaccuccaucgggcugaucugcgugaucgcgucgucugguaugcucuggauggcagagaucccgcugcaguggauagcaucugccauagugcuggaguucuucaugaugguccucuuaauccccgagcccgagaagcagcgcacgccacaggacaaucagcuggcauacguugugaucgggauccucaccuuagccgcgauaauugcagccaacgagaugggccugcucgaaaccaccaaacgggaccugggaauguccaaggagcccggggucgugucgcccacuuccuaccuggacguggaccuccaccccgccucggcguggacgcucuacgccgucgccaccaccguaaucacccccaugcugcggcauacgauagagaacuccaccgccaacgugagccucgcagcgauugccaaccaggccgucgugcugaugggcuuggacaagggcuggccgaucuccaagauggacuuaggcgugccccugcuggcccuagggugcuacagccaggucaacccccugacccugaccgccgcggugcuccuccugaucacgcacuaugccaucaucggccccggccuccaggccaaagccacaagggaggcccagaagcgcacagcggccgggaucaugaagaacccgacaguggauggcaucaugacgaucgaccuggaccccgucaucuacgacuccaaguucgagaagcagcugggccaggugaugcuccuggugcugugcgccgugcagcuccugcugaugcggaccagcugggcccucugcgaggcgcugacccuggccaccggaccaaucacgacccucugggaaggcucccccggcaaguucuggaauaccaccaucgccgugucaauggccaauaucuuccguggauccuacuuagcuggggcgggccuggccuuuagcaucaugaagucaguggggacgggcaaacggggaaccgggagccagggcgagacacucggugagaaguggaagaagaagcugaaccagcugagccgcaaggaguuugaccucuacaagaaguccggcauuacagaggucgaccggacugaagccaaagagggucugaaacgcggcgagaucacgcaccacgccgugagccggggcuccgccaaacuacagugguucgucgagcgcaacauggucaucccugagggacggguaaucgaucucggcugcgggcgcggagguuggagcuauuacugcgcgggucucaagaagguaacagagguccggggauacaccaagggcgggccagggcacgaggagcccgugcccauguccaccuacggauggaacaucguuaaacugaugagcgggaaggacgucuucuaccuaccgcccgagaagugugauacgcugcugugcgacaucggcgaguccagccccucccccaccguggaggaaagccgcaccauccgcgugcugaagauggucgagcccugguuaaagaacaaucaguucugcaucaagguccugaaccccuauaugcccaccgugauugagcaccuggagcggcuccagcgcaaguacggcgggaugcugguccggaacccgcugucccgcaacaguacacaugagauguacuggauuuccaauggcaccgguaacaucguggcgagcgugaacauggucagccggcuccugcugaaccgauucaccaugacccaccggcgcccgacuaucgagaaagacguggaccucggcgccggcaccagacaugugaacgccgagcccgagacccccaacauggacgucaucggggagcgcaucaagcguauuaaggaggagcacaacagcaccuggcacuacgacgacgagaacccguacaaaacgugggccuaccacggcuccuaugaggugaaggcgacagggagcgccuccuccaugaucaacggagucgugaagcugcuaaccaagcccugggauguaguccccauggugacccagauggccaugacggacaccacccccuuugggcagcagcgcguguucaaggagaaggucgacacccggacgccgcgcagcaugcccggcaccagacgcgucaugggcaucaccgcagaguggcucuggcggaccuuagggcgcaacaagaaaccccggcuuuguacgcgcgaggaguucaccaagaagguacgcaccaacgcagcuaugggcgccgucuucaccgaggagaaccagugggacuccgcgaaggccgcgguggaggacgaagacuucuggaaguuaguggaccgggagagggagcugcacaaacuggggaagugcgggagcugcguauacaacaugauggggaagcgggagaaaaaguuaggggaguuuggcaaggccaaggggucccgcgccaucugguacauguggcugggggcccgguaccuggaguucgaggcacucggguuccugaaugaggaccauugguuuagccgcgagaacuccuacuccggcguggagggggagggcuugcacaagcucggcuauaucuugagggauaucuccaagauccccggaggagcaauguacgccgacgacacugccgggugggacacccgcaucaccgaggacgaccuccacaaugaggaaaagauaacccagcagauggacccggagcaccggcagcucgcgaacgccaucuucaagcugacguaccagaacaagguggucaaggugcagcgacccacccccaccggcaccgugauggacaucauuucgcgaaaggaccagcgcggcuccggccaggugggcaccuacgggcugaauaccuucaccaacauggaggcgcagcucauccgccagauggagggcgagggggugcugaccaaggccgaccuggaaaacccccaucucagcgagaagaagauaacccaauggcuugagacgaaaggcguggaacgccucaagcggauggccaucagcggcgaugauugcgucgucaagccgaucgacgaccgcuucgccaacgcccuccuggcccugaacgacaugggaaaggugcggaaagacauuccccaguggcaaccgagcaagggcuggcacgacuggcagcaagucccuuucugcucccaucauuuccacgagcuaaucaugaaggacggccgcaaacuuguugucccgugccggccgcaggacgaguugaucggccgagcccggaucucgcagggagccggauggucuuuacgcgagacugccugucugggcaaggcauacgcccaaauguggagccuaauguauuuccaccgccgggacuugcgccuggccuccaacgccaucuguagcgccguccccguucacugggugcccaccagcagaaccacguggucgauccacgcgcaccaccaguggaugaccaccgaggacaugcugaccgucuggaaccgcguguggaucgaggacaaucccuggauggaggacaagacgccagugacaaccugggagaauguccccuaccuaggaaagcgggaagaccaguggugcgguagccugaucgggcugaccucccgugccacgugggcccagaacauaccuacagccauccagcaaguacggagucucaucggcaaugaagaguuucuggauuacaugccgagcaugaagcgcuucagaaaggaggaagagagcgagggggcgaucugguga

SEQ ID NO: 25944 - RNA, 9873 nt, Artificial Sequence
  derived and/or modified CDS sequence (opt11) from DENV-3__EU596494__SS-prME
accagccucugucucaugaugauccugccugccgcccuggccuuccaccucaccagccgggacggcgagccgcguaugaucguggggaaaaacgagaggggcaagucccuguuguucaagaccgccagcgggaucaacaugugcacccucauagcgauggaccugggcgaaaugugcgacgacaccgugaccuacaaaugcccccacaucgccgaagucgagccugaggauaucgacugcuggugcaacuugaccagcaccugggugaccuacgggaccugcaaccaggccggagagcaccggagagauaagcggucugucgcguuagcgccccacguggggauggggcuggacacgaggacccagaccuggaugagcgccgagggcgccuggcggcagguagagaagguggagacgugggcgcugcgccacccgggguuuaccauccucgcgcuguuccuggcccacuacaucgguaccagccucacccagaaaguggugaucuuugucuugcugaugcucgugacccccagcaugacgaugcggugugugggggucgggaaccgcgacuucguggagggcuuaucgggagccaccuggguggauguagugcuggagcauggcgggugcgugaccaccauggcaaagaacaagccgacgcuggacaucgaguuacaaaagaccgaggcgacccagcuggcgacccuccgaaagcugugcaucgagggcaagaucacgaacaucaccaccgacagccgcugccccacccagggcgaggccguccugccggaagaacaggaccagaacuacgugugcaagcacacguacguggaccggggguggggcaacgggugcggcuuauucggcaaggguucccuggugaccugcgcuaaguuucagugccuggagcccaucgagggaaaggucgugcaguacgaaaaccucaaguauaccgucaucaucacgguacacacuggggaucaacaccaggucggcaacgagacccaagggguuacagccgagaucacgccccaggcgagcacgaccgaggccauucugcccgaguacggcacccuagggcucgagugcagcccgcgcacgggccuggacuucaacgagaugauucugcucacgaugaagaacaaggcuuggaugguucaccggcagugguucuucgaccugccguuacccuggacgagcggcgccaccacugagaccccgacguggaacaggaaggagcuccuggucaccuuuaagaacgcccacgcgaaaaagcaggagguggugguccugggaucccaggagggcgccaugcacacagcccucaccggaagcacggagauccagaacuccggagguaccagcaucuuugcuggccaccuuaagugccggcugaagauggacaagcucgagcugaagggcauguccuacgccaugugcacaaacaccuuugugcugaagaaggaggugagcgaaacgcagcacgggaccauucucaucaaagucgaguacaagggcgaggacgcgccgugcaaaauuccuuucucaaccgaggacgggcagggcaaggcccacaacggccgccugaucaccgcaaacccuguggugacgaagaaggaggagccggucaacaucgaggccgagccgcccuucggagaauccaacaucgugaucggcaucggagacaacgcgcugaaaaucaacugguacaagaaggggagcuccaucgggaagauguuugaagccaccgcccggggagcccgccggauggccauuuuaggugacacugcgugggacuuugguagcgugggcggggugcucaauagccugggcaaaauggugcaccagauauucgggucggccuacacugcccuguucucuggcguaagcugggucaugaagauaggcauaggugugcuccugacguggauaggccuuaacuccaagaacaccagcauguccuucuccuguauagccauuggaaucaucacccucuaccugggcgccguaguccaggcggauaccggcugcgugaucaacuggaagggcaaggagcugaaaugcgguuccgggaucuucguuacaaacgagguccacaccuggacagagcaguacaaauuccaggccgauucucccaagcgccucgccaccgcaaucgcgggcgcgugggagaacggggugugcgggauccgcuccacgacccggauggagaaccugcuguggaaacaggucgccaacgagcucaacuacauccugugggagaacaacaucaagcugaccguaguggugggagauaucaucgguguccucgagcagggaaagagaacccugacgccccaaccgauggagcugaaauacagcuggaagaccuggggcaaggccaagaucgugacugccgaaacccagaacagcucauuuaucauagacggccccaacacccccgagugccccagcgcgucccgggccuggaacgugugggaggucgaggacuacggguucggcguguucaccaccaacaucuggcugaagcugcgcgagguauacacccagcuuugcgaccauaggcuaaugucugccgcugucaaggacgagcgcgccgugcacgcagacaugggcuauuggaucgagucccagaagaacgggagcuggaagcuggaaaaagcgucccugaucgaggugaagaccugcacguggcccaagagccauacccucugguccaacgguguacuggagagcgacaugaucauucccaaaucccuggcggggcccaucagccagcacaacuaucguccgggguaccacacccagaccgcugguccauggcaccucgguaagcuggagcuggacuuuaacuacugcgagggcacaaccguggugauuaccgagaauugcgggacccgcggccccagucuccggacgaccaccgucagcgggaagcugauccacgaauggugcugccgcagcugcacccuacccccgcuucgguacaugggugaggaugggugcugguacggcauggagauccgccccaucagcgagaaggaggagaacauggugaagucacuggugagcgccggauccgguaaggucgacaacuucacgauggguguguugugucucgcaauccuguucgaggagguaaugcgggguaaguucggcaaaaagcauaugauagccgggguuuucuucaccuucgugcuucuucugucgggucagauuaccuggcgcgacauggcccacacccugauuaugauuggcucuaacgcgucugaccggauggggaugggagugacguaccucgccuuaauugcgacguucaagauccagcccuuccuggcccucggguucuuccuucgcaagcuaacuagccgggagaaucucuuacugggcgugggccucgccauggccaccacgcugcaacuaccagaggacauagagcagauggcgaaugggaucgcccucggccugauggccuugaagcucauaacgcaauuugagacauaccagcuguggacugcccugaucucgcucacgugcagcaauaccaucuuuacgcugacugucgcuuggcgcacggcgacccuaauccucgcgggggucuccuuacugccagucugccagagcuccagcaugcggaaguccgacuggcuccccaugaccgucgcggccaugggagugccgccccucccgcuguucaucuucagccucaaggauacccucaagcgccgcucauggccgcugaacgaggggguaauggcuguaggccuagucagcauccuggcgagcagucugcuccggaaugaugugccuauggccggcccccuggucgccgggggccugcucauagccugcuacgucauaacugggaccuccgcggaccuuaccguggagaaggcggccgacguuaccugggaggaggaagcggagcagacgggcgucagccauaaccugaugaucaccguggacgacgacgggaccaugcggaucaaagaugacgagacugagaacauacucaccguguugcugaagacggcccuccugaucguuuccggcaucuucccguacagcauccccgccacccugcucguguggcacacauggcagaagcagacccggcgcucgggcgugcugugggacguccccucaccgcccgagacgcagaaagcggaguuagaggaggggguauaccggaucaagcagcaagguauauucgggaagacccaggugggcgucggggugcagaaggagggcguguuccacaccauguggcacgucaccagaggcgccgugcucacguauaacgggaagcgguuagagcccaacugggccuccgugaagaaggaccugaucagcuacggagggggguggcgccucagcgcccaguggcaaaaaggagaggagguccaggucaucgcgguggagccaggcaagaaccccaagaacuuccagaccaugcccggcaccuuccagaccacgaccggagagaucggcgcaauagcccuagacuucaagcccgggaccaguggcagccccaucauaaacagagaggguaaggucguggggcuguacggaaacgggguggucaccaagaacggcggguauguguccggcaucgcccagacgaacgcagagccggauggccccacccccgagcuagaggaggagauguucaagaagcgcaaccucaccaucauggaccugcaccccgggucggggaagacucgaaaguaccugccggccaucgugcgcgaggccaucaagcggcgccuccggacgcuaauccuggcccccacgcgagucguggcugccgagauggaggaggcgcucaaggggcugcccauacguuaccagacaaccgccacgcgcagcgagcacaccggcagagagaucguggaccugaugugccaugccaccuucaccaugcgccuccugucacccguccggguuccaaacuauaaccuaaucauaauggacgaggcccacuuuacggaucccgccucgaucgcggcccgcggguacaucagcacacgcgucggcaugggcgaggcugccgcuaucuucaugaccgccacgccgccggggacagcugacgccuuuccgcaguccaaugccccaauccaggacgaggagcgggacaucccggagcgaaguuggaacuccggaaacgaguggaucacugauuucgcggggaaaaccgucugguuuguacccagcaucaaggcgggcaaugacaucgccaauugccuccggaagaacgggaagaaggucauccagcugucccgcaaaaccuucgacacggaguaccagaagaccaagcuaaacgacugggauuucgucgucacgaccgacaucagcgagaugggcgccaacuucaaggccgaccggguuaucgacccucgucggugccucaagcccgucauccugacggacggucccgagcgcgugauccuggcaggccccaugccggugaccgccgccuccgccgcacagcgccgcggccgggucgggcgaaacccccagaaggagaacgaccaguacaucuucaccggccagccccugaacaacgacgaggaccacgcgcacuggaccgaagccaaaaugcuccuggauaacaucaacacccccgaggggauuaucccagcccuauucgagcccgaacgggagaaguccgccgcgaucgacggcgaguaccgccugaagggcgaaucccgcaagaccuucguggaacuaaugcgaaggggugaccuccccgucuggcuugcacacaagguggccucggaaggcaucaaguacaccgaccgcaaguggugcuucgacggccagcggaacaaccaaauccuggaggagaacauggacguggagaucuggaccaaggaaggcgagaagaagaaacuccgucccagguggcuggacgcacggaccuacagugauccgcuggcccucaaggaguucaaggacuucgcggccggucgcaagagcaucgcccuggaccugguaacggagaucgggcgugugcccagccaccucgcccaccgcacccggaacgcgcuagacaacuuagugaugcuccacaccucagagcauggagggaaggcguaccgccacgccgucgaggagcugcccgagacgauggagacgcugcuacugcugggccucaugauccugcugaccggaggcgccaugcuguuccugauaagcggcaaggggaucggcaagaccuccaucgggcugaucugcgugauugccuccuccggcaugcuguggauggcggagaucccgcugcaguggaucgcgucagccaucgugcuggaguucuucaugaugguccuccugauuccugaacccgagaaacagcgaaccccccaggacaaccagcuggccuacguugugauagggauccucacucuggccgcaauaaucgcggccaaugagauggggcuguuggagacuaccaagcgcgaccugggaauguccaaggagccgggggucgugagccccaccuccuaccuggacguugaccuccaccccgccagugccuggacgcuauacgcggucgccaccaccgugaucacccccaugcugcggcacacaaucgagaauuccaccgccaacgucagccucgccgccaucgcaaaccaggccgucgugcugaugggucuggacaagggguggccgaucuccaagauggaccucggugugccccugcuggcccucggauguuacucgcaggugaacccccugacucugaccgccgccgugcuccugcuaaucacgcauuacgcgauaaucggccccggccugcaggccaaggccacccgggaagcccagaagcggaccgcggcggggaucaugaaaaaucccaccguggauggaaucaugacgauugaccuggaccccguaaucuacgacuccaaguucgagaagcagcugggccaggugauguuguuagugcugugcgccguccagcuccuacuuaugcgcaccucuugggcccucugcgaagcucucacguuggcgaccggccccaucacgacccucugggagggcagccccgggaaauucuggaacacaaccaucgccgugagcauggccaacaucuuccggggcuccuaccuggccggggccgggcuggcguucagcaucaugaaguccguggggacgggcaagcgcgguacggggucccagggcgaaacccucggggagaaguggaagaaaaaacugaaccaacugagccggaaggaguucgaccucuacaagaagucugguauaacagaagucgaccgcaccgaggccaaggagggccugaagcggggcgagaucacgcaccacgccgugagccgcggcucagccaagcugcagugguucguggagcgcaauaugguaaucccggagggacgcgugaucgaucucggcugcgggcggggcgguugguccuacuacugcgcgggccugaagaaggugacugagguccgcggcuacacgaagggugggcccggacaugaggagcccguccccaugagcacauacggcuggaacaucgugaagcugaugucugggaaggaugucuucuaccucccucccgagaagugugacacccuuuuaugugauaucggcgaguccagcccuucccccaccguggaagagagccgcaccauucgugugcuaaaaaugguggagccguggcucaagaauaaucaguucugcaucaaggugcugaaccccuauaugcccacugugaucgaacaccuggagcgucuccagcggaagcacggcgggaugcuggucagaaaccccuugucccggaacagcacgcacgaaauguacuggaucucgaacgguacagggaacauuguggcgucagugaacauggucucccgccuccugcugaaucgguucaccaugacacaccgccggccgacgauugagaaggacguugaccuuggggccggcacccgucacgugaacgccgagcccgagacccccaacauggaugucaucggggagcggaucaagcgcaucaaggaggagcacaacagcaccuggcacuacgacgacgagaacccguacaagacgugggccuaccacggcucuuacgaggugaaggccacgggaagcgcgagcucgaugaucaacgguguagugaagcugcugaccaaacccugggacgugguccccauggugacccagauggcuaugacggacaccaccccauuugggcagcagcggguguucaaggagaaggucgacacccgcacuccucggagcaugcccggcacccgccgggugaugggcaucaccgcugaguggcucuggcgcacccuggggcggaauaagaaaccucgccugugcacgcgcgaggaguucacgaaaaaggugcggaccaacgcugcgaugggcgccgucuucaccgaagagaaccagugggacuccgccaaggccgccguggaggacgaggauuucuggaagcucguggaccgcgagagagagcuacacaaauuagggaagugcgggagcugugucuauaacaugauggggaaacgcgagaagaagcucggcgaguucggcaaggccaagggcuccagggcaauaugguacauguggcugggcgcccgcuaucuugaguucgaggcacucggguuccugaacgaggaucauugguucagccgggagaauuccuacagcggaguggagggggagggauuacacaaacucggcuacauccugcgcgacaucucaaagauacccgggggugccauguacgccgacgacacggccgggugggacacccggaucaccgaggacgaccugcacaacgaggagaagauaacccagcagauggacccggagcaccgccagcucgccaacgccaucuucaagcugacguaccagaacaaggugguuaagguccagcggcccacacccaccggcacugucauggacaucaucucuaggaaggaucagcggggcucugggcaggugggcaccuacggccugaauaccuucaccaacauggaggcccagcucauccgccaaauggaaggcgagggggugcugaccaaggcggaccuggagaauccccacuugagugagaagaagaucacccaguggcuggagacgaagggcguggagaggcucaagcgcauggccaucuccggugacgacugcgucgugaagccaaucgaugaccgguucgccaacgcccuccuggcccugaacgacauggggaagguacgcaaggacaucccacaguggcaaccgucaaagggcuggcacgacuggcagcagguaccuuucugcucccaccacuuccaugagcucaucaugaaggacgggcggaagcuaguggugccuugccgcccccaggacgagcugaucggucgggcccgcaucagccaaggggcaggguggucccuccgcgagaccgcuugccuagggaaagccuacgcccagauguggagccugauguauuuccaccggcgcgaucucagguuagcuuccaacgccauaugcagcgccguucccgugcacuggguucccaccucccguacuacgugguccauccacgcgcaccaccaguggaugaccaccgaagacaugcuaacagucuggaacagaguguggaucgaggacaaccccuggauggaggacaagacgcccgugaccacuugggagaacguccccuaccucggaaaacgggaggaccaguggugcggcucuuuaaucgggcugacgucccgggcaacgugggcccaaaacauccccacagccauacagcagguccggagccucaucggcaacgaggaguuccuggacuacaugccgucuaugaagcgguuccgcaaagaggaggagucggagggggccauuugguaa

SEQ ID NO: 25945 - RNA, 9873 nt, Artificial Sequence
  derived and/or modified CDS sequence (opt11) from DENV-3__EU687218__SS-prME
accagccugugucucaugaugauacugccugcagcccucgcguuucaccucaccagccgagacggggaaccccggaugaucgucgggaaaaacgaacggggcaagagcuuacuguucaaaacggcaucugguaucaacaugugcacccuuaucgccauggacuugggcgaaaugugcgaugauacggugacuuacaaauguccccauauaacggaaguggaacccgaggacauagauuguuggugcaaucucaccagcaccugggugaccuacgggacuuguaaccaggccggugagcaccgucgcgacaagcggagcguugcccucgccccacacgugggcaugggucucgacacccgcacccaaaccuggaugagcgccgagggcgccuggcgccagguagagaaagucgaaacgugggcacugaggcaccccggguucacuaucuuagcacucuuccuggcccacuacaucggcaccagucucacccagaaaguggugaucuuuauacugcugaugcucgucacgcccuccaugaccaugcggugugugggggugggcaaccgcgacuucguggagggccuguccggggccaccugggucgacgugguucuagaacauggugggugugugacgacgauggccaagaacaagccgacccuagacauagagcuucaaaagacggaggccacgcaacucgcgacgcuccgaaagcuaugcauagaggggaaaaucaccaacauaaccaccgacagccgcugccccacgcaaggcgaagccgugcuuccggaggaacaggaccaaaacuaugucuguaagcacaccuacguugaccggggguggggcaauggauguggacucuucgggaagggcucacuggugaccugcgccaaguuucagugccuggaacccaucgaaggcaaagucgugcaguacgagaaccucaaguacaccgugaucauaacggugcacacuggcgaccaacaccagguggguaacgagacccagggagugacagccgaaaucacgccccaggccagcacaaccgaagcgauacugccugaguacggcacccuggggcucgagugcuccccucgcacgggacuagacuucaacgagaugauuuuacuaacgaugaagaauaaggccuggaugguccacaggcagugguucuuugaccugccccugcccuggaccagcggcgccaccaccgagacuccgacauggaaccgcaaggagcuccuaguaaccuucaaaaaugcccacgcaaagaagcaggagguaguugugcuggggucccaagagggcgcgaugcacaccgcccucacuggggccaccgagauccaaaauagcggagguaccuccauuuucgccggccacuuaaagugccguuuaaagauggauaagcucgagcugaagggaaugucuuaugcuaugugcacaaacacguucguccugaagaaggaaguguccgagacccagcacgggaccauacucauuaagguggaguacaagggggaagacgugccgugcaagauacccuucagcaccgaagacgggcaggggaaggcacacaacgguagacuaaucacggccaacccaguggucaccaaaaaggaagaacccgucaacaucgaggccgagccgccguucggggagagcaacaucguuaucggcauuggcgacaaugccuuaaagaucaacugguauaagaaaggcagcagcaucgguaaaauguuugaggcgacggcccgaggcgcacgccggauggccauauugggcgacaccgccugggauuucgggaguguaggagggguccucaacucucugggcaagaugguucaccagauauucgggagcgcguacacggcccuguucucagggguguccuggguaaugaagauaggaaucgggguucuucugaccuggaucggacugaacagcaaaaauaccuccaugucuuuuaguugcauagcaauaggcaucaucacccucuaucugggggcggugguccaggcagacauggggugcguuauuaacuggaagggcaaggaguugaaauguggcagcgggaucuuugugacgaacgaaguccauacuuggacagagaaguauaaguuccaagccgacuccccuaaacgccucgccacagccauugccggcgccugggaaaauggggucugcggcauccgcucaacgacccggauggagaaccuucuguggaaacagaucgcaaacgaguuaaacuacauucugugggagaacaacaucaagcugacgguggucguaggggauaucauuggcgugcucgagcagggcaagcguacccuuacgccccagccgauggaguugaaguauuccuggaagaccugggggaaagccaagauagucacggcggagacccaaaauuccagcuucaucaucgacggccccaacacgcccgagugccccagcgccagucgggcguggaacgucugggagguggaagacuacggguucggcgucuucacaacuaacaucuggcuaaaacucagggagguguauacccagcugugugaccaccggcuuaugagcgccgccgugaaggacgagcgcgccguacacgcggauaugggguacuggauugagagccaaaagaacggauccuggaagcuggagaaagcgucacugaucgaaguaaagaccuguacuuggcccaaaucgcacacacucuggagcaacggugugcuggaguccgacaugaucauccccaaaagccuggccgggcccauaucccagcacaacuaccgcccaggauaccauacccagaccgcuggacccuggcaccuuggcaagcuggagcuggacuuuaauuacugcgagggcacaaccguaguaauuacagagaacugcgggacccgcggccccagcuugcggaccacaaccgugucggggaaacugauccacgaauggugcugccgcagcuguacccuacccccauuacgauacaugggugaggacgguugcugguacggcauggagauccguccaaucuccgagaaggaagagaacauggucaagagccugguaucagccgggagcgggaagguggacaacuucacgaugggcguucugugucuggccauucuguucgaggaagugaugagggguaaguuuggcaagaagcacaugaucgcggggguguucuucaccuucguccuguuacucuccggccagaucaccuggcgcgacauggcccacacacugaucaugauugguaguaacgcaucugaucggauggguaugggugucacguaccucgcacugaucgccacuuucaagauccagccuuucuuagcacucggguucuuccuucgaaagcucacuagccgggagaacuugcugcuaggggugggccuugccauggcuaccacgcugcaacugcccgaggacaucgagcagauggccaacggaauagcacucggccugauggcguuaaaauuaaucacccaguucgagaccuaccagcucuggacggcgcugauaucucucacgugcuccaauacgaucuucacccugaccguagcuuggcgcacagcuacccugauccucgccggggugagccuacugccggucugccagaguagcuccaugcgcaagacagauuggcuccccaugacaguggcugcuaugggcgugccaccccucccgcuguuuaucuuuagccucaaagacacgcugaagagaagauccuggcccuuaaacgagggggucauggccguaggccucgugagcauccuggccuccagccugcuccggaacgacgucccuauggccggcccccugguggcuggcggucugcuuaucgccugcuacguuauaacugggaccuccgccgaucugacaguagagaaggccgcggacgugacgugggaggaggaggccgaacagacagguguuucgcauaaccucaugaucaccgucgacgacgacgggacuaugcgcaucaaggacgaugagaccgaaaauauacucacgguucuucucaagacggcccugcucaucgugaguggcaucuucccguacagcaucccugccaccuuacucgucuggcauaccuggcagaagcagacgcagcggagcggcgugcuuugggacguucccucgccgcccgaaacucagaaggccgagcuggaggagggcguuuaccgaauaaagcagcaaggcauauucggaaagacacagguggguguggggguucagaaggagggugucuuucacaccauguggcaugugacgcggggagcgguccucaccuacaaugggaagaggcuggaacccaacugggccuccgugaagaaagaccuaaucagcuauggcgggggcuggcggcucucagcucaguggcagaaaggcgaggaggugcaagucaucgccguggagccuggcaagaaucccaagaacuuccagacaaugccuggcacuuuucagacgacaacuggggagaucggugcgaucgcacuugacuucaagccugggaccagcgggagccccaucauaaaccgcgagggcaaagucgucgggcuguacggcaacggcgucgugacgaaaaacggcggguacguuuccggaauagcucagaccaacgccgaacccgacggccccacccccgagcuggaagaggaaauguucaagaagcggaaccucaccaucauggaucuccaucccgggagcggcaagacgcguaaauacuugccggccaucgugcgcgaggcgauaaagcgcagguuaaggacccugaucuuggcgccgacgagggugguagcagcggaaauggaggaggcccucaagggguuaccaauucgcuaccagaccaccgcgaccaaguccgagcauaccggccgggaaauuguggaucuaaugugccacgccaccuucacgaugcgccucuuaucucccgucagggucccgaauuauaacuuaaucaucauggaugaggcccacuucaccgaccccgccuccaucgccgcgcgaggguacaucagcacccggguugguaugggcgaggccgccgcaaucuucaugacagcgacaccgccagggaccgccgacgccuuuccccaauccaaugcccccauccaggacgaggagcgagacauacccgaaaggagcuggaacuccggcaacgaguggaucacugauuucgcuggcaaaacggucugguucgucccgagcauuaaggcggguaacgacaucgccaauugccuccgcaaaaacgggaagaaagugauccaguuauccagaaagacguuugacaccgaguaucagaagaccaaacugaaugacugggacuucguagugacaacggacaucucugagaugggcgccaacuuuaaagccgaccggguaaucgacccgagacgcugccuaaagcccgugauccugaccgacggcccagagcgugucaucuuggccgggccuaugccugugacagcugccuccgccgcccagcggcgcggacgggugggucgcaacccacagaaggagaacgaccaguacaucuucaccggccagccccucaacaacgaugaggaccacgcccacuggacagaggcgaagaugcugcucgacaacauaaacacgcccgaggggauaaucccugcccuuuucgaaccugagcgugagaagucggcagcgaucgauggggaguaucgccuaaagggcgagucccggaagacauucgucgagcugaugcgccgcggggaccucccuguauggcuggcgcauaaagucgccagcgagggcaucaaguacaccgaccguaaguggugcuucgacggucagaggaacaaucaaauacuggaggaaaacauggaugucgagauauggaccaaagagggcgagaagaagaaguuacgaccccgguggcuggacgcucgcacguacagcgacccgcuggcgcucaaggaguucaaggacuuugcugcaggaagaaagagcaucgccuuagaucuugugaccgaaauugggcgcgucccgucacaccucgcccaccgcacccgaaacgcccuagauaacuugguaauguugcacaccagcgagcacggugggaaggccuaccgccacgcgguggaggagcugccagaaacgauggaaacccugcuguuacuaggacucaugauccugcugacuggcggggccaugcuauuccugauuucagguaaagggauaggcaagaccucgauuggauugauuugcgucaucgccagcuccggcaugcucuggauggccgagaucccgcugcaguggaucgccagcgcaaucgugcuggaguucuuuaugaugguguugcugaucccagagccagaaaaacagcggacaccccaggacaaucagcucgccuacgugguaaucgggauuuugacccuugccgccaucaucgccgcuaacgagaugggccuacuagaaacaaccaagcgcgaccugggaaugucuaaggagcccgggguggucagccccacaaguuauuuggacguggaccugcauccagcuagcgccuggacccuguacgcgguggcuaccaccguaaucacgcccaugcugcggcacaccauugagaauaguaccgccaacgugaguuuagcggccauugcuaaucaggcggugguccugaugggccucgacaagggguggccgaucuccaagauggaccucggugugccauuguuggcccucgggugcuacagccaggugaacccauugacacugacggccgccguacuacuccugaucacccacuaugccauuauuggccccggucuacaggcaaaagcgacgcgcgaggcucagaagcggacugcggccgggaucaugaagaauccgacgguagacgguaucaugacgaucgaucuggacccuguuaucuacgauuccaaauucgaaaagcaacuggggcagguuaugcuacugguguuaugcgcggugcagcuucucuugaugcgcaccucaugggcacucugcgaggcucuaacccuggccacgggcccgaucaccacccuuugggagggcuccccgggaaaguucuggaacaccaccaucgcggucucgauggccaacauauuccgaggcucauaccuugccggggccggccucgccuucucgaucaugaaguccgucgggaccggcaagcgcgguacgggcagccagggugagacccucggugaaaaauggaaaaagaagcucaaccagcugagccggaaagaguucgaucuuuacaagaaaucaggcaucacggagguggaucgcacggaagcgaaagaggggcugaagaggggagagauuacccaccacgcugucagcaggggcucggccaaguugcaaugguucgucgagaggaacauggugaucccggaagggaggguaaucgaccucgguugcggucggggaggguggagcuacuauugcgccggucucaagaaagugaccgagguacguggguacaccaaaggugggcccgggcaugaggagccugucccaauguccacguacggcuggaacauugucaaacugaugagcggcaaggacguguuuuacuuaccacccgaaaagugcgacacccugcugugcgacaucggcgaguccucgcccucccccaccgucgaggagagucggaccauccgcgugcuaaaaaugguagagccguggcugaagaauaaucaguucugcauuaagguccuaaacccauacaugcccacggugaucgagcaucuggaaaggcuccagaggaaacacggagggaugcucgugcgcaacccccucuccagaaauuccacucacgaaauguacuggauuucuaacggcacggggaacaucgucgcuaguguuaacauggucucucgccuccuguuaaaucgcuucacaaugacacaccgccgccccacuaucgaaaaggaugucgaucuuggcgcugguaccagacacgugaacgccgagcccgagacgccaaauauggacgugaucggagagcggaucaagcgcauuaaggaggaacauaacagcaccuggcacuacgacgacgagaaccccuacaagaccugggcguaccacggauccuaugaagucaaggccaccgggucggcguccucuaugauuaacggcgucgugaagcugcucaccaagcccugggacguagugccgauggucacgcagauggcgaugacagacaccacccccuucgggcaacagagaguguucaaggagaagguggauacgcggaccccaagaagcaugcccggcaccaggcggguuaugggcaucacugccgaguggcuauggcgcacgcuggggagaaacaagaagccccgccucugcacucgggaggaguuuaccaagaaagugcgcaccaaugccgccaugggcgcggucuucacugaggagaaccagugggauuccgcgaaagcggccgucgaggacgaagacuucuggaaguuaguggaucgcgaacgcgaacugcacaaacuaggcaaaugcgggagcugcgucuacaacaugaugggcaaacgugagaagaaacuuggggaguucggcaaggcaaaggggagccgggccauaugguauauguggcuuggcgcccgcuaccuggaguuugaagcccugggguuuuuaaacgaggaccauugguucagccgggaaaauucguacagcggcgucgagggggagggacugcacaagcucggcuacauccuaagagauaucuccaagauccccgggggcgccauguacgcugacgacaccgcugggugggacacacggaucaccgaggaugaccugcacaacgaggagaagaucacgcagcagauggauccggaacauaggcaacucgccaacgcgaucuucaagcugaccuaucagaacaaaguggugaaaguccagcggccgacccccaccggcacugucauggauaucaucucccgcaaggaccagagaggguccggccaggugggcacguacgggcugaacaccuuuaccaacauggaggcccaacucauucgccagauggagggagaagggguccugagcaaggcggaucuagagaacccccaucucccggagaagaagaucacccaguggcuggaaacgaaggggguugagcggcugaagagaauggcgaucucuggcgacgacugcgugguuaagccuaucgacgaccgguuugccaaugcccuccuggcgcuaaacgacauggggaagguucgcaaggacauuccacaguggcagcccucaaaaggguggcacgacuggcagcagguuccguucugcucgcaccacuuccacgagcuaauuaugaaggacggccggaaguuaguagugcccugccgcccacaggaugaacucaucggucgagcccgcauaagccagggggccggcuggucucuccgggagacagcaugccugggcaaagcauacgcccagauguggagccugauguauuuccacaggcgcgaccuccggcuggcguccaacgccaucugcagcgccgugccuguccacuggguuccgaccuccagaaccacguggucuauccacgcccaccaccaauggaugaccacugaggacaugcugacuguguggaaccgugucuggaucgaggacaaccccuggauggaggacaaaaccccggugaccaccugggaaaaugugccguaccucgggaagcgcgaggaccaguggugcggcagccugaucgggcugaccagccgggcuacaugggcgcagaacaucccgaccgcgauccagcagguacgcagcuuaaucggcaacgaagaguuccuggacuacaugccauccaugaagcgguuccgcaaagaggaggaguccgaaggggcgaucugguaa

SEQ ID NO: 25946 - RNA, 9873 nt, Artificial Sequence
  derived and/or modified CDS sequence (opt11) from DENV-3__EU726772__SS-prME
accagccugugccucaugaugauccuccccgcggcuuuagcguuccaccugaccucucgggauggagagccccggaugauaguggguaaaaaugaacgaggcaagagccugcuguuuaagacggccuccgggaucaacaugugcacucuaaucgcuauggaccugggcgagaugugcgaugacaccgugaccuauaaaugcccgcacaucacggagguggagcccgaggacaucgacugcuggugcaaucugaccucaaccuggguaaccuacggaaccuguaaccaagccggcgagcaccggcgcgauaagcgguccgucgcccucgcgccccacguggguaugggucuggacacccgcacccagaccuggaugagcgccgagggggccuggcgacagguggagaagguagagacgugggcgcugcgccacccgggguucaccauacucgcccuguuccuggcccacuacauuggcaccucccucacccagaagguggugaucuucaucuuauugaugcucgucacgcccagcaugaccaugcgaugcgucggcgugggcaacagagacuucgucgagggccuguccggggccacuuggguggacguuguccucgagcacggaggcugcgugaccacgauggccaagaacaagccgaccuuggacaucgagcugcagaagacggaggccacacagcuggcgacguuacgcaagcucugcaucgagggcaagaucacuaacauaaccaccgacagcagaugccccacgcagggcgaagccgugcugccggaggaacaggaccagaacuaugucuguaagcacaccuacguggaccggggauggggcaaugguugugguuuauucggaaagggcucacugguuaccugcgccaaauuccaaugccuggagcccaucgagggcaaggucgugcaguacgaaaaccucaaguacaccguuauuaucacgguccacacuggcgaccaacaccagguggggaacgagacgcagggggucaccgcggagaucaccccccaggcgagcaccaccgaggcgauccugcccgaguacggcacgcugggacucgagugcuccccgcgcacuggccuggauuucaacgagaugauccuucucacgaugaagaacaaggccuggauggugcaccgacagugguucuucgaccugccccugcccuggaccagcggcgccaccaccgagacucccaccuggaaccgcaaggagcuccuggugaccuucaagaaugcccacgcuaagaagcaggaggucguggugcuggguucccaggagggugcgaugcacaccgcccucacgggagcaaccgagauacagaauagcggcgggaccucgauuuucgccggccaccugaagugccggcucaaaauggacaaacucgagcugaaggguaugagcuacgcuauguguaccaauacguucgucuugaagaaggaggucuccgagacucagcacgggaccauucucaucaaaguggaguacaagggagaggacgucccguguaagauccccuuuaguacagaagauggccagggcaaagcgcacaacgggcgcuugauaacagcgaaccccgucgugaccaaaaaggaggagcccgucaauaucgaggccgagccgcccuucggugagagcaacaucgugaucggcaucggggacaaugcccugaagauuaacugguacaagaaggggucgagcaucggcaaaauguucgaggcgaccgcccggggcgccaggcggauggccauucugggagacaccgcaugggauuucggguccgugggcggaguguugaacagccugggcaaaauggugcaccagaucuucggguccgcguacacugcccuguucagcggcguaucgugggucaugaaaauaggcauuggggugcuccugaccuggauuggacugaacaguaagaacaccucgaugagcuucuccuguaucgccaucgguauaaucacccucuaccugggcgccgugguccaggccgacauggggugugugaucaacuggaagggcaaggagcugaagugcggcagcgggaucuucgugacuaacgagguccacaccuggaccgagcaguacaaguuccaggcggacucccccaagaggcuggccaccgccaucgccggcgccugggagaacggggugugcggcauccgcagcacgacaagaauggagaaucugcuguggaagcagaucgcgaacgaacucaacuauauccugugggagaacaacaucaagcugaccgugguagugggggacaucaucggggugcucgagcaggguaagcgcacccucaccccccagccaauggagcugaaguacuccuggaaaaccugggguaaggcuaagaucgucaccgccgagacgcagaacagcucguuuauaaucgacggcccgaacacgccugaguguccgucugccuccagggcguggaacgugugggagguugaggauuacggcuucggcgucuucaccacgaauaucuggcugaaguugcgcgagguguacacgcagcugugcgaccaccggcucaugagcgccgccgugaaggacgagagagccguccacgccgacaugggcuacuggaucgagagccagaaaaacggauccuggaagcuggaaaaggcgucucugaucgaggugaagaccuguacguggccgaaaucccacacucucuggucaaacggcgugcuggaguccgacaugaucauuccuaagagccuggccgggcccaucucccagcauaacuaccggccuggguaccacacacagaccgccgggccauggcacuugggcaaacuugagcuggacuucaacuacugcgaggggacuacugucgugaucaccgagaacuguggaacccgcggccccagccuccggacgaccacuguguccgggaaguuaauccacgaguggugcugccgcagcugcacccugcccccgcuucgguacaugggggaggacgggugcugguacggcauggagauucgacccauauccgagaaggaggaaaauauggucaagagccugguguccgcaggcucugggaagguggacaacuuuacaaugggcguucugugccucgcgauucuguucgaggaggugaugcgggggaaguuuggcaagaaacacaugaucgcagggguguucuucaccuuuguccuccuccuguccggccagaucaccuggcgcgacauggcacacacccuaaucaugaucggcagcaacgccuccgaccggauggggaugggggucacguaucucgcacugauagccaccuuuaagauucagccuuuccuggcgcuuggguuuuuccugcgcaagcugaccagccgggagaaccuccugcugggggugggccuggccauggcgacgacuuugcagcugcccgaggacaucgagcagauggccaauggcaucgcgcucggccugauggcccugaagcucaucacccaguucgagaccuaccaauuauggaccgcccugauuagccucaccugcucuaauaccaucuucacccugacaguagccuggagaacggccacccugauccucgcaggggucagccugcugccggucugucaguccucguccaugcggaagaccgacuggcuucccaugaccguggccgcgaugggggugccgccccucccucuguucaucuuuagccugaaggacacgcugaagcgccgcuccuggccccugaacgagggggucauggccguaggucuggugagcauccuggccucaagccugcuccggaacgacguccccauggccggcccccugguggcugggggacugcucaucgccugcuacgugauaaccgggaccagcgccgauuugaccgucgagaaagcggcggacguaacgugggaggaggaggccgagcaaaccggcgugagccacaaucuaaugaucaccguagacgaugacgggaccaugcgcauuaaggacgacgagacugaaaacauucucacgguucuacugaagacggcccuccugauaguauccgggaucuuuccguauagcauccccgcgacccugcucgucuggcauacguggcaaaagcaaacgcaacgguccggcgugcugugggacguccccucuccccccgagacccagaaggccgagcuggaggaggggguguaccguaucaagcagcagggcauuuucgggaagacacaagugggaguggggguccagaaggagggcguguuccacaccauguggcacgugacgcggggcgcgguccuuacguacaacgguaagaggcuggaacccaacugggccucugugaagaaggaccugaucagcuacggcgguggguggcgacucuccgcucaguggcaaaaaggggaggaggugcaggucauugccguggagcccggcaagaaccccaagaacuuucagaccaugccaggcacauuccagacgaccaccggggaaaucggagcgaucgccuuggacuuuaaaccagggaccagcggcagcccgaucaucaaccgcgaagguaaaguagucggccuguacggcaacgggguggucacgaaaaacggcggguacgucagcggcauugcccagacgaacgccgagccggacggccccaccccugagcuggaggaggagauguuuaagaagcggaaccucaccauuauggaccugcaucccgggagcgguaagacgcgcaaguaccugccggccaucgugcgggaggcgaucaaaaggcggcuucgcacccugauucuagcgcccacccgcguagucgccgcugagauggaggaagccuuaaaggggcugccgauacgcuaccagacgacggcgaccaaguccgagcacacaggccgggagaucguggaucugaugugccacgccacguucacgaugcgccuccugagccccguccggguaccaaacuacaaccugaucauuauggaugaggcccacuucacggaccccgcuuccaucgccgcgcgcggcuauaucagcacacgggugggcaugggggaggccgccgccauuuucaugaccgcgacgccacccgggaccgccgacgccuucccgcagaguaacgcgcccauccaggacgaagagcgugauauccccgagcgcucuuggaacuccggcaacgaguggaucaccgacuucgcagggaagaccguaugguucgucccaagcauaaaggcuggcaacgauaucgcaaacugccuccgaaagaacgggaaaaaggugauacagcugucccgcaagacguuugacacggaguaccagaagaccaagcugaacgacugggacuucguggucaccacggacauaagcgagaugggcgccaacuucaaggcggaucgggugaucgacccucgccggugccucaagcccgucauccucacagacggcccggagagggucauauuggccgggcccaugccugugaccgcggcaucagccgcccagcggagaggccgggugggccgaaacccccagaaagagaacgaccaguacauauucacgggccagccccucaauaacgacgaagaucacgcacauuggaccgaggcgaagaugcuguuagacaacaucaauacgcccgaggggaucauuccggcucucuucgaacccgagcgggagaaguccgccgccauugacggggaguaccgccugaaaggcgaaucccggaagacauucgucgagcugaugagacguggggaccugccuguguggcuggcccacaagguagccagcgaggguaucaaguacaccgaccgcaaauggugcuucgaugggcagcggaacaaucagauacuggaggagaacauggacguggagaucuggaccaaggaaggcgagaaaaagaagcuccgcccacgcuggcucgacgcccgcacguacuccgacccucuggcccuuaaggaauucaaggacuuugccgcgggccgcaagagcaucgccuuagaucuggugacagagaucgggagggucccaucccaccucgcccaccgcaccagaaacgcgcuggacaaccuggugaugcugcacaccagugagcacgggggcaaggccuaccggcacgcggucgaggagcugccagaaacgauggagaccuugcuucugcugggccucaugauccugcugaccgggggcgccaugcuuuuucuuaucagcggcaaggggaucggcaagaccuccaucggucugaucugcgucaucgccagcuccggcaugcuauggauggcugagaucccgcugcaauggaucgccuccgccaucgugcuggaguucuucaugauggugcuucucaucccggagcccgagaagcagcguacuccccaggacaaccagcuggccuacguggugaucgggauccuuacccucgccgcuauuaucgccgcgaacgaaaugggccugcucgagaccaccaagagagaccuggggauguccaaggaaccugggguggucagccccaccuccuaccuggacguggacuuacaccccgccagcgccuggacacuguacgccguggcgaccaccgucaucacgcccaugcugcggcacaccauugagaacagcaccgccaacgugagucucgcggccauagcaaaccaggcagugguccugaugggcuuggacaagggguggccgaucuccaagauggacuuaggcgugccccuguuagcccucggguguuauagccaagugaacccucugacccugacggccgcagugcuccuccuaauuacucacuacgcuauaauaggcccgggccuccaggcgaaggccacccgugaggcccagaagagaaccgccgcggggauuaugaagaauccgacgguggauggcaucaugaccaucgaccuugaucccgucauuuacgacuccaaguucgagaagcagcugggucagguuaugcuacuagugcugugcgcgguucagcuccugcugaugcgcaccagcugggccuuaugugaggcccugacccuggcuacgggccccaucacgacgcucugggagggcuccccuggaaaguucuggaacaccacgaucgcggugucaauggccaacaucuuccggggcuccuaccuggccggugccggccuggcuuuuagcaucaugaaguccguagggaccggcaagcgcggaaccgggagucagggugagacucuaggggagaaguggaaaaagaagcugaaccagcugucaaggaaagaauucgaccucuacaagaaguccggcaucaccgagguggaccgcacggaggcgaaggaggggcugaaaagaggcgagaucacccaccacgccgucagccgcggaucggccaagcugcagugguuuguugagcggaacauggugaucccagaggggcgcguaaucgaccuuggcugcggucggggcggguggagcuacuacugcgccggcuugaagaagguuaccgaggugcgcggcuacaccaaaggcgggcccggccacgaagagccgguccccaugaguacguacggcuggaacaucgugaagcuaaugagcgggaaggacguuuuuuacuuaccgccagagaagugugacacacugcugugugacaucggugagagcucuccuucacccaccguggaggagagccggacgauccgcgugcucaagaugguugagccguggcugaagaacaaccaauucugcaucaagguucugaaccccuauaugccaaccgugaucgagcaccucgagcgcuuacaacggaaacacggcgggaugcuggugaggaauccccuguccaggaacagcacccaugaaauguauuggaucuccaacgguaccggaaacaucgucgccagcguaaauauggugucccgcuugcuucuuaaccgcuucaccaugacgcaccguaggccgaccauugagaaggacgucgaccuaggcgcuggcacccggcacgugaacgccgagccagagaccccuaacauggacgucauuggcgagcggaucaaaagaaucaaggaggagcauaacucuacguggcacuacgacgacgaaaacccguacaaaaccugggcuuaccacggcuccuacgaggucaaggcaaccgggagcgcauccagcaugaucaacggcguagucaagcugcugaccaagcccugggacguggugcccaugguuacccagauggccaugaccgacacaaccccuuucggccagcagcggguguucaaggagaagguggauacgcgcacuccgcggaguaugcccgguacucgucgggucaugggcaucaccgcagaguggcucuggcgcacauuagggcggaacaagaagccccgacugugcacccgggaggaguuuaccaagaaggugcgcacgaacgccgccaugggcgcgguguucaccgaagagaaccagugggacucggccaaggccgcaguggaggacgaggacuuuuggaagcucguagaccgcgagcgugaacugcacaagcuggggaagugcggaagcugcguguacaacaugauggggaagcgcgagaaaaagcucggugaauuuggaaaagccaaagggucccgagcgauaugguacauguggcugggggcuagguaccuggaguuugaggcacucggcuuccugaacgaggaccacugguucucccgggagaacuccuauagcggcgucgagggggagggcuugcacaagcucgguuacauccugcgggacaucuccaagaucccggggggcgccauguaugcagaugacaccgcggggugggacaccagaaucaccgaggacgaccugcacaacgaggagaagaucacgcaacagauggacccggagcaccgucagcucgccaaugccaucuucaagcugaccuaccagaacaaggugguuaagguccaaaggcccacccccaccggcaccguuauggauaucaucucacgaaaggaccagcgaggcuccgggcaggugggaacguacgggcuaaacaccuuuacuaacauggaggcccagcucauccgccagauggagggcgaaggggucuugagcaaggcggaccuggagaacccccaccucccagagaagaagauuacccaguggcuggagacaaaagguguggagcggcugaaacgcauggcgaucucaggcgacgacugcguggucaaaccuauagaugaucgguucgcgaacgccuugcuggcccugaaugauauggggaagggccgcaaggacauaccccaauggcagcccagcaaggguuggcaugacuggcaacaggugccguucugcucucaccacuuccacgaacucaucaugaaggacggccggaaacuaguuguccccugcaggccccaggacgagcugauaggccgggcccgaaucagccagggggcgggcuggucccugcgggagacugccugccucgggaaggccuacgcccagauguggagcuuaauguacuuccaccgccgcgaccuuaggcuugcguccaaugcgaucuguucagcaguucccgugcacugggugccgaccagucgcaccacguggagcauccacgcccaccaucaguggaugaccacagaggacaugcugaccguguggaaccguguuuggauagaggacaaucccuggauggaggacaaaacgccagucaccaccugggagaacgugccauaccucggcaagcgcgaggaucaauggugcgguagccugaucggccugaccucccgggccacgugggcccagaacauuccgacggccauccaacaggucagaucccucauugggaacgaggaauuucuggacuacaugcccuccaugaagcgauuccgcaaggaggaggaaucggaaggcgcaaucugguga

SEQ ID NO: 25947 - RNA, 9873 nt, Artificial Sequence
  derived and/or modified CDS sequence (opt11) from DENV-3__FJ182013__SS-prME
acuucuuuaugccuuaugaugauccugccugcagccuuggccuuccaucucaccagucgggacggggagccccggaugauuguggggaaaaacgagagaggcaagucacugcuguucaagaccgccuccgggauuaauaugugcacccucauagcaauggaccucggcgaaaugugcgacgacaccgugaccuacaagugcccccacaucaccgagguugagcccgaagacauugacugcugguguaaccuaacuuccaccugggugacauaugguacgugcaaccaggccggcgagcaccggcgcgacaaacgguccgucgcccucgcgccccauguggguauggggcucgauacccgcacccagaccuggaugagcgccgagggcgccuggcgacagguggaaaagguagagacgugggcccugcgacauccgggguucacaauauuggcgcuguucuuagcccacuacgugggcaccucccucacucagaaaguugugauuuucaucuugcugaugcuggugacucccagcaugaccaugcggugcgugggggucggcaaccgcgacuucguggaggggcuguccggggccacauggguagaugucgugcuggagcacggggggugcgugacaacuauggccaaaaauaaacccacccucgacaucgagcugcagaaaaccgaagcaacacagcuagccacgcuccgcaagcugugcauugagggcaagaucaccaacauaacaaccgauucgcggugccccacucagggcgaggccguccugccggaggagcaggaccagaauuacguguguaaacacacguauguagaucggggaugggggaacggguguggccucuucgggaagggcucccuggugacuugcgcuaaguuccaaugccucgagccuaucgagggcaagguggugcaguacgagaaucucaaguauaccgucauaauuacggugcauaccggggaccagcaccaggucggcaacgaaacgcaaggggugaccgccgagaucacgccucaggccaguacuacugaagcgauacugcccgaguacggcacucuagggcuagagugcuccccuagaaccggcuuggauuuuaacgagaugauccuguugacuaugaagaauaaggccuggauggugcaccggcagugguucuucgacuuaccuuuacccuggaccagcggcgcuaccacugagacgccuacauggaaccgcaaagaguuacuagugaccuuuaagaacgcccacgcuaagaaacaggagguaguggugcugggcagucaggagggagccaugcacaccgcccuaacuggggccaccgagauccagaacagcggcggaacguccaucuucgccggccaucugaagugccggcugaagauggauaaacucgaauuaaaggggauguccuaugccaugugcaccaauacguucgugcucaaaaaggagguauccgaaacacagcacgguacgauacuaaucaaggucgaauacaagggcgaggacgugccgugcaagauucccuucagcaccgaggaugggcagggcaaagcccacaauggccggcucauaacagcuaaccccguggucaccaaaaaggaggagccugugaacaucgaagccgagcccccuuucggagagucgaacauugugaucggcauaggcgacaacgcucugaagaucaacugguauaagaaagguagcagcaucgggaagauguucgaagccaccgcucgaggcgccagacggauggccauccugggcgauaccgccugggacuucggguccgugggcggggugcucaacucccugggcaagaugguacaccaaaucuucgggucggcguacacugcccuguucucaggcgucuccugggugaugaagauaggaauaggggugcuccuaacauggaucggccugaauagcaagaacaccuccaugagcuucuccugcaucgccaucggaauaaucacccucuaccugggcgccguagugcaggccgacaugggguguguuauuaauuggaagggcaaggaacucaagugcggcagcgggaucuucgugacuaacgaggugcacaccuggaccgagcaguacaaguuccaagcggauuccccuaaaagacucgccaccgccaucgccggcgccugggaaaacggugugugcgguauccgcagcacgacccggauggagaaccugcuguggaagcagaucgcuaaugagcucaacuauauacuuugggaaaacaacauaaagcugaccgucguggugggugacaucaucggcguacuugagcagggcaagagaacccuuacgccccagccgauggagcugaaguauuccuggaagaccugggggaaggcuaagauagucaccgcggagacccagaacagcuccuucaucaucgacggacccaacacgcccgagugccccagcgccagcagagcguggaauguaugggaaguugaggacuacggguucgggguguucacaacaaacaucugguuaaaguugagggagguauauacccagcugugcgaccaccgucucaugucagcagcgguuaaggacgagagagcaguucacgcugacaugggguacuggauugaaucccaaaagaacggguccuggaaguuggagaaggcgagccuuauugaagucaagaccugcacuuggccuaagucgcacacccucuggagcaacgggguccuggagucugacaugaucaucccgaagagccuggcagggcccaucucccagcacaauuaccguccgggcuaccauacccaaaccgccggccccuggcaccucggcaaacuugaacuggauuuuaauuacugcgaagggacgacugugguaaucaccgagaacugcgggacccgcgggccaagccuccggacaacaacgguuuccgggaagcuaauccacgaguggugcugccggagcugcaccuuacccccacuccgguacaugggcgaggacggcugcugguacggcauggagauucgcccgaucuccgagaaagaggagaauauggucaagagccugguguccgccggcuccgggaaggucgauaacuucacgauggguguguugugccucgcuauccuguucgaggagguaaugcgggggaaguucggcaagaaacauaugaucgcgggggucuucuucacuuucgugcuucuccuaucaggccagaucaccuggcgcgacauggcccacacucugaucaugauuggcagcaacgcauccgaucggauggggaugggcgugacauaucucgcccugauugccaccuucaaaauccagccguuccuagcgcucggcuucuuccugaggaagcugacuaguagagagaauuugcugcugggcguaggccucgccauggccacgacgcugcaacugccggaggacaucgagcaaauggccaacgguaucgcguuaggccucauggcccucaagcucaucacccaguucgaaacuuaucagcuguggaccgcucuaaucucacucacguguagcaacaccauauucacccugaccguggcauggcgcacggccacccugauacucgcgggugucagccugcugcccgugugucaguccagcuccaugcggaagacugauugguugcccauggccguggccgccaugggagugccaccccugccgcuguucauuuucagccucaaggacacccugaagcgccgcuccuggccccugaacgaaggggugauggccgugggccucguaucaauccuggcguccagccuguugcggaacgacgugcccauggccggcccccuuguggccgggggccuacucauagccugcuacgugauaaccggcaccuccgcggacuuaaccguagagaaggcggccgacgugacgugggaggaagaggccgagcagacgggcguuucgcacaaccugaugaucaccguggacgacgacgggaccaugcguauuaaggacgacgagaccgagaacauccucaccgugcuacugaagacggcccuccugaucguauccggcauuuucccguacagcauccccgccacacuguuaguguggcacaccuggcagaagcagacacagcgcuccggagugcugugggauguccccagcccgccggagacgcaaaaggccgagcuggaagagggaguauaccgcauaaagcagcaagggauuuucgggaagacccaggugggcgucgguguucagaaggagggcguguuccacacgauguggcacgucacacguggggcuguguuaacauacaacgggaagcgccuggagcccaacugggccaguguuaagaaggaccuaauaagcuacggcgggggguggcggcucuccgcccaguggcagaaaggugaggagguccaggugaucgcgguggaaccggguaagaacccuaagaacuuucaaaccaugcccggaaccuuccagaccacaaccggggagaucggcgccaucgcucuagacuucaagcccggaacaagcgguagcccaauaaucaacagggagggcaagguaguggggcuuuauggaaacggaguggucaccaagaacggcggguacgugagugggaucgcccaaacgaaugcagagccugacggccccacucccgaauuagaagaagagauguucaaaaagcggaaccucaccaucauggacuuacaccccgggagcggcaagaccagaaaauaccugccggcgauugugcgggaggcaauaaaacgacgucucagaacgcuuauuuuggcccccacccgcguuguggccgcagagauggaggaagcgcucaagggguugcccauacgcuaccagacgaccgccacuaaguccgagcauaccggccgggagaucguggaucuaaugugucacgcaaccuucaccaugcgccucuuaagccccguccggguaccgaacuacaaccugaucaucauggacgaagcccacuucacggaccccgccuccauagcggcccgcggguauaucaguacucgggugggcaugggugaggccgcagcaaucuucaugacagccaccccccccgggacggccgaugccuucccacaguccaaugccccgauccaggacgaggagcgcgacauccccgagagaagcuggaacuccggaaaugaauggauaaccgacuuugcggggaagaccgucugguucguucccucuauuaaggccgggaacgacaucgccaacugucuacguaagaacgggaagaaggugauccaguugucccgcaagaccuucgauacggaguaccagaagaccaagcuaaacgacugggauuuugucguaaccaccgacauaagcgagaugggcgccaacuucaaggcggaccgggugauugacccgcgacgcugccugaagccuguuauccuuacggacggcccugaacgcguaauccuugcugggcccaugcccgugaccgcagccucagcggcccagcggcgcggcaggguggggcgcaacccccagaaggagaacgaccaguacaucuucaccggccagccguugaacaacgacgaagaccacgcccacuggaccgaggccaagaugcugcuugacaacaucaauacccccgagggcauuauacccgcccucuucgagcccgagagagaaaaguccgcugcgaucgacggagaauaccgccugaagggggaaucccggaagacguuuguagagcugaugcgccgaggagaccugccaguuuggcuggcgcacaagguggccagcgaaggcauuaaguacaccgaucggaagugguguuucgaugggcagcggaauaaccagauacuggaggagaauauggauguggagauuuggaccaaggagggcgagaaaaagaagcuccgcccccguuggcuggacgcccgcacguacuccgacccguuagcccucaaggaauucaaagacuucgcggccggccgcaagagcauagcccuggaccuggucacggagauugggcgggugccgucccacuuagcacaccgaacccggaacgcccuggacaaccugguaaugcuccacaccucugagcacggcgggaaggcguaccgucacgccgucgaggaacugcccgagaccauggagacgcuguuacugcugggccucaugauauugcugacagggggcgccaugcuuuuccugaucagcggcaaggggaucggaaagaccucuauuggucugaucugcgugaucgccagcuccgggaugcucuggauggcugagaucccgcugcaguggauugccuccgcaaucgugcuggaguuuuuuaugaugguccuccucauucccgagcccgaaaagcagagaacgccccaggacaaccagcuggccuacguggugauugggauacucacguuggccgccaucaucgccgcuaacgagauggggcugcucgaaacaacuaagcgcgaccugggcauguccaaggaaccgggggucgugagccccaccuccuaccuggacguggaccuacaccccgcaucggccuggaccuuauacgcggucgccacgaccgugaucaccccgauguuacgccacacgaucgaaaacagcaccgccaacgugagccuagcugccaucgcgaaccaagccguuguacugauggggcuagauaagggguggccgaucuccaagauggacuuaggcgugccccugcucgcccucgggugcuacagccaggucaacccgcucacccugacugccgccgugcuccugcucaucacucacuacgcgauaaucggccccggccuccaggccaaggcuacccgcgaggcccagaagcggaccgccgcggggaucaugaagaaccccaccguagacggcaucaugacgaucgaccucgacccggucaucuacgacuccaaguuugagaagcaacucggccaagugaugcuacuagugcugugcgcgguccaacuacuacugaugcgcaccaguugggcccuuugcgaggcgcuaacucuggcgaccgggccuaucacgacccucugggagggcucccccgggaaguucuggaacaccacuaucgccgugucgauggcuaacauauuccggggcuccuaccuggccggagccgggcucgcauucagcaucaugaagagugugggaacgggcaagcgcggcacugggucgcagggcgagacucucggggagaaguggaagaagaagcugaaccagcugagccggaaagaguucgaccucuauaagaaguccggcauuaccgaggucgaccgaaccgaggccaaagaagggcugaagaggggagagaucacacaccacgccguaagccgcggcuccgcuaaguuacagugguucguggaacgcaacaugguuauaccggaggggcgcgugaucgaccucggaugcggacgagguggguggagcuacuacugcgccggucugaagaaggugaccgagguccgcgguuacaccaaaggcgggcccgggcacgaggagcccguacccaugucaaccuauggcuggaacauugugaagcuuaugagcgggaaggacgucuucuaucucccgccugaaaagugcgacacgcugcugugcgauaucggcgagucaucgccuuccccgaccguggaggagagccggacgauccgcgugcugaagauggucgagccguggcucaaaaacaaccaguuuugcaucaaggugcucaaucccuacaugccuaccgugauugagcaccuugagaggcuccagcggaagcauggcgguaugcugguccgcaacccacugagccggaauagcacgcacgagauguacuggaucuccaacggaaccggcaacauaguggcgaguguaaacauggucucuagacuccuucugaacagauucaccaugacgcaucgccgaccuacgaucgagaaggauguggaccucggugccggcacccgucacgugaacgccgagcccgagacacccaacauggaugucaucggggagcggaucaagcgcaucaaggaggaacacaacagcaccuggcacuaugacgacgagaacccuuacaagaccugggccuaccacgggagcuacgagguaaaggccaccgggagcgcguccagcaugauaaacggggucgugaaguuacugaccaaacccugggauguggucccaauggucacccagauggcuaugacggacaccaccccguucggacagcagcggguguucaaggagaagguagacacccgcacgccccggagcaugcccgggacccgccgggugaugggcaucaccgccgagugguuauggcgcacccuggggcggaacaagaagccgcgccugugcacucgggaggaauucaccaagaaggugcgcaccaacgcggcgaugggcgcugucuucaccgaggagaaccagugggacuccgcgaaggccgccguggaagacgaggauuucuggaagcucguggaccgggagcgagagcugcacaagcuggggaaaugcggcagcugcgucuacaauaugauggggaagcgcgagaaaaagcucggcgaguucggcaaggcgaaggggagucgggcuauaugguacauguggcugggcgcccgcuaccuggaguucgaggcucuaggguuccugaaugaggaccacugguucagccgggagaacuccuauucaggcguggagggggaaggccugcacaagcuggguuauauccugcgcgacaucucaaagaucccgggcggggcuauguacgccgaugacacggccgguugggacacccggaucacugaggacgaccugcacaacgaggaaaagaucacccagcaaauggacccagaacaccgacagcuggccaaugccauuuucaagcugacguaccaaaacaagguggucaagguucaacggccaacgcccacaggcaccgugauggauaucauaucgcgcaaagaccagcggggcuccgggcaggucggcacuuacggccugaacacauucaccaacauggaggcgcaauuaauacgccaaauggagggcgagggagugcugagcaaggcggacuuggagaauccccaccucccggagaagaagauaacgcaguggcuggaaaccaagggcguggaaagauuaaagagaauggccauuuccggcgacgauugcgucguuaaacccauugacgaccgguucgccaacgcccuucuggcccugaacgacauggggaaggugagaaaagacauuccgcaguggcagcccucuaagggcuggcacgacuggcaacaggucccguuuugcucccaccauuuccaugagcucaucaugaaagacgggaggaagcuaguggugcccugucggccucaggacgagcugaucggccgagcacgcaucucucagggggccggguggagcuugcgagaaacagccugucucggcaaagccuacgcgcagauguggagccugauguacuuccaccgccgugaccuccggcuagccucuaacgccaucugcagugcggugccaguucacugggugccgaccucccgaacaaccuggagcauccacgcccaccaccaguggaugacgaccgaggacaugcugacggucuggaacaggguguggaucgaggacaaucccuggauggaggacaagacgcccgugacgacgugggaaaacguccccuacuuaggcaagcgcgaggaccaguggugcggcucacugaucgggcugaccucccgggcgacgugggcccagaacaucccuacggccauacaacaggugcgcagccuaaucggcaacgaggaauuucuggacuacaugccauccaugaagcguuuccgcaaggaggaggagagugaaggggcaaucugguag

SEQ ID NO: 25948 - RNA, 9873 nt, Artificial Sequence
  derived and/or modified CDS sequence (opt11) from DENV-3__EU781136__SS-prME
acaucccugugucugaugaugauccugccggccgcccucgcguuccacuugaccucgcgggauggggaaccucguaugaucguugggaaaaacgagcgcggcaagagucuccuguucaagacugccucuggcauaaacaugugcacccucaucgcuauggauuugggcgagaugugugaugauacugugaccuauaaaugcccccacaucacggaaguugagccugaggauauugauugcugguguaaccucaccagcaccugggugaccuacgggaccugcaaccaggccggggaacaccggagggacaaacgguccguggcccucgcgccccacguggggaugggcuuggacacccgcacucagaccuggaugagcgccgaaggugccuggcggcagguagagaaggucgagacgugggcucugcgacacccgggguucacuauucuagcucuguucuuagcucauuacaucggcaccucacuuacccagaaggugguuaucuucauccugcugaugcuaguaacgccuagcaugacgaugcgcugcguggguguuggcaaccgcgacuuugucgagggcuuguccggggcaaccuggguugacgugguccuggagcacgggggcugcgugaccaccauggccaagaacaaacccaccuuggacauagagcugcagaagacugaagcuacccagcuugcgacgcuccggaaacugugcauugagggcaagauuaccaacaucaccaccgacagccgcugcccuacucagggggaggccgugcuuccggaggagcaggaccagaauuacgugugcaagcacaccuacguggacaggggguggggcaacgggugugggcucuuugggaaggggucccuugugaccugugcuaaguuccaguguuuagaacccaucgagggcaaggucgugcaguacgagaaccucaaguacacagucauuaucacuguccauacuggggaccaacaccaggugggcaacgagacccaaggggugaccgcugagaucacgccgcaagcaucgacaaccgaggcgauuuugcccgaauacggcacauuaggguuagaguguucaccgcguaccggccuggacuuuaaugagaugauccugcucaccaugaagaauaaagccuggauggugcacagacagugguucuucgaccugccgcuccccuggacgagcggcgcuacaaccgagacgcccacguggaaccggaaggagcuacuugugacuuucaagaaugcacacgccaagaagcaagaagucgucguauuggggucccaggagggcgcuaugcacacagcgcuuaccggggccaccgagauucaaaauucaggcgggaccuccaucuucgccggccacuuaaagugucgguuaaagauggauaagcucgagcugaaaggcaugagcuaugccaugugcaccaauacuuuuguccugaagaaagagguguccgagacccagcacgguaccauccuaaucaaaguagaguacaagggcgaagacgugccgugcaagauccccuucagcaccgaggacggccagggcaaagcucacaacggacgccugaucacggccaaccccguugucaccaagaaggaggaaccagucaauauagaggcugagccucccuucggagagaguaacaucguuauaggcaucggggacaaugcacugaaaaucaacugguacaagaagggcucgucaaucgggaagauguucgaagcgaccgcgagaggggcaagacggauggcgauccugggcgacacagcaugggauuuuggcuccgucggcgggguccucaauagcuuagggaagauggugcaucagaucuucggguccgcguacacggcccucuuuagcggcguuucaugggucaugaagauuggaaucggggugcuccugaccuggaucggccugaacagcaagaacaccuccaugaguuuuuccuguaucgccauugggaucaucacccucuaccugggcgccgugguccaggccgacauggggugcguaguaaacuggaaaggcaaagaacugaagugcggcagcgggaucuucgucacgaaugagguucacaccuggacagagcaguauaaauuccaggcggacucaccuaagcgccucgccacggccauagcuggcgccugggagaacggggugugcggcauuaggagcacuacucgcauggagaaccugcuguggaaacagaucgcaaacgaguuaaacuacauccugugggaaaacaacaucaaacugaccguugugguaggggacaucauuggcguccucgagcaaggcaaacguacucugacuccccagccgauggaacugaaauacucguggaagaccugggggaaggccaagaucguuaccgccgagacccagaacagcuccuucaucauugauggcccaaacacgcccgaaugcccaagcgccuccagagcguggaacgugugggaggucgaggacuauggguuugguguguucaccaccaacaucuggcugaaacugcgcgaaguauauacgcagcugugcgaccaccgucucaugagcgccgccgugaaggacgagcgcgccgugcacgccgacaugggcuauuggaucgagagccagaagaacggguccuggaagcuggagaaggcgagucugaucgaggucaagacuugcacauggccgaaaagccacacccuguggagcaacggcguuuuggaguccgacaugaucauucccaagucacuggccgggcccaucucccagcacaacuacagaccgggcuaccauacccagacugccggacccuggcaccucgggaaguuggagcuggacuucaacuacugcgagggcacgacugugguuauuacagaaaacugcggaacccgcggacccagcuugcggacgaccaccgucucggggaaacuuauccacgaguggugcugccggagcugcacccugcccccgcuucgguacaugggugaagacggguguugguacggcauggagaucaggccgaucuccgagaaagaggagaacaugguuaagagccucgucuccgccggaagcggaaagguagacaauuucacgaugggcguguuaugcuuagcgauccuguucgaggaagugaugcgagggaaguucggcaaaaagcacaugauugcggggguguucuucacauucgugcugcucuuaucaggccagaucaccuggcgcgacauggcccacacacugaucaugauuggcagcaacgccuccgacaggauggggaugggcgugaccuaccucgcccuuauagccaccuucaagauucagcccuuccuagcgcucggguucuuucugcgcaaguuaaccagccgggagaaccuccuacugggaguuggucuugcuauggccaccacacugcagcugcccgaggacaucgagcagauggccaacggaauugcgcuuggccuaauggcgcuuaagcucaucacccaguucgaaaccuaucagcuguggacggcgcucaucucucucacgugcuccaauaccaucuucacccugaccgucgccuggcguacggccacacuaauccucgcuggggugagccuguugccugugugucagagcucguccaugcggaagaccgacuggcuccccaugaccguugccgccaugggcgugccgccucucccgcuauucaucuucagcuugaaggauacgcugaagaggcgcagcuggccacugaacgagggugugauggcgguggggcucgucagcauccuggcauccagccuucuccggaacgaugugcccauggcgggcccccuuguugccgggggauuacugaucgccugcuacgucauuaccgggacauccgccgaucugaccguugagaaggccgcggacgugacgugggaggaagaggcggaacaaaccggcgucagccacaaccugaugaucaccguggaugacgacgggaccaugcgcaucaaggaugacgagaccgagaacauccugaccguguuacucaagaccgccuugcugaucguguccggcaucuucccguacagcauccccgccacccugcucgucuggcauaccuggcagaagcaaacucaacggaguggcgugcugugggacguccccagcccgcccgagacccaaaaggccgagcuggaagaggggguguaccgcaucaagcagcagggcauuuucggaaagacccaggugggcgucggugugcaaaaggaaggaguguuucacaccauguggcauguuacacgaggcgcggugcucaccuacaacgggaaacgcuuggagcccaauugggccagcgucaagaaggauuuaaucucauacggugggggcuggcgacucuccgcccaguggcagaagggggaagagguacaggugauugcgguugaaccaggcaagaaccccaagaacuuccagacuaugccgggaaccuuccagacgaccaccggugagauaggcgcgaucgcccuagauuucaaacccgguaccuccggcucccccauaaucaaccgcgagggcaaggucgugggacuguacggcaaugggguggucacgaagaauggaggguacguguccggaauugcucagacaaacgccgagccggacggccccacccccgagcuggaggaggagauguuuaagaagaggaaccucaccauaauggaccugcaccccggcagcggaaagacgcgcaaguaccugccggccauugugagggaggcgauaaagcgacggcuccgcacccugauccuggcccccacccgggucguggcugccgagauggaagaggcgcucaagggacugcccauccgcuaucagaccaccgcaaccaagucagagcacaccggccgggaaaucguggaccuuaugugccacgccaccuucacgaugcgccuccugagcccuguccggguaccaaacuauaaucugaucaucauggacgaggcccauuucaccgaccccgccuccaucgccgcccgggguuacaucagcacccgugugggcaugggcgaggccgcggccauauucaugaccgcgacgccacccgggacggccgacgccuucccgcaguccaacgccccgauccaggacgaggagcgcgacauacccgagcguagcuggaacuccggcaacgaguggauaacagauuucgcgggaaagacaguuugguucgugccuuccaucaaggcgggcaacgacaucgccaacugccuccggaagaaugggaagaaagugauccagcucucccggaagacguuugacaccgaauaccagaagaccaaauuaaacgacugggacuuugucguaaccacggacaucagcgagaugggagccaacuucaaggccgaucgugugauugacccucgccggugccucaagccagugauccucaccgacggcccagaacgcgugauacuggcagggccuaugccagugaccgcugccagcgccgcucagcggcguggucgggucgggcgcaacccccagaaggaaaacgaucaguacaucuucacugggcaaccauuaaacaacgacgaggaucacgcucauuggaccgaggcgaagaugcugcuggacaauaucaacacgcccgaggggauaaucccggcccucuucgagcccgagcgggagaaaagcgcagccaucgacggggaauaccgccugaagggcgagucccgcaagaccuucguggaguugaugcgccgcggggaccuccccgucuggcuugcgcacaagguugccagcgagggcaucaaguacacugaccgcaaguggugcuucgacgggcaacggaacaaccagauauuagaggagaacauggacguggagaucuggaccaaagaaggcgagaagaagaagcuccggccccgguggcuggacgcgcgcacguauucggauccgcuggcccucaaggaguucaaggacuuugccgcgggaagaaagagcauugcauuagaccuggucaccgaaaucggacggguccccucacaucuagcccaccggacccggaaugcccuggacaaccuggucaugcuccacacgagcgagcacggagggaaagccuaccggcacgcuguugaggagcuacccgagacaauggaaacccugcuacuguuaggccucaugauccugcugaccgggggcgcuaugcuguuucugaucuccggcaaggguaucgggaagaccuccaucggguuaaucugcgugauagccagcuccggaaugcuguggauggccgagauaccgcugcaguggaucgccucagcgaucgugcuggaguucuucaugauggucuugcugaucccugagccugaaaaacaacggacgccgcaggacaaccaauuagcauacgucgugaucgggauccucacccuggcagccaucauugcagcaaacgaaaugggccuguuagagaccacaaagcgugaccugggcauguccaaggagccgggggucgugucucccacauccuaccuggacgucgaccuccaccccgccagugcuuggacccucuacgccgucgcgaccacggugaucacuccaaugcugcggcacacuaucgagaacagcacggccaauguaagccucgccgccauagcgaaccaagcugucgugcugaugggccuugauaagggguggccgauuuccaagauggaucucggagugccccugcuggcccuaggguguuacagccaggucaacccacugacucugaccgccgccgugcuacugcugaucacgcacuacgccaucaucggucccggccuccaggccaaggccacccgggaggcgcagaagcggaccgccgcagggaucaugaagaacccgacgguggacggcaucaugaccaucgaccucgacccgguuaucuacgacuccaaguucgagaagcagcugggccaggugaugcuccuugugcugugcgcaguccaacuccugcugaugcgcacuucaugggcccucugcgaggcccuaacgcuggccacuggcccgaucaccacccucugggaaggcucccccgggaaguucuggaacaccaccaucgcggugagcauggccaauaucuuuaggggguccuaccuggccggggccggccucgcguuuaguaucaugaaguccguggggaccgggaagcgggguaccggcagccaaggugaaacccucggcgagaaauggaagaagaaauuaaaccaacugagccggaaggaguucgaccucuauaagaagucgggcaucaccgaggucgaccguacggaagcgaaggaagggcugaagcggggugagaucacccaucacgccgugagccgcgguuccgcaaagcuccagugguucgucgagcggaacaugguaauuccggagggacgcgugaucgaccucggaugcgggcggggagguuggaguuacuacugcgcuggccugaagaaagucaccgaggucaggggcuauacaaagggcggucccgggcaugaggagcccgugcccauguccaccuacgguuggaacaucgugaagcugaugagcgggaaggacgucuucuaccucccgcccgagaagugcgacacccugcugugcgacaucggcgaguccagcccuucccccacuguggaggaaagccggaccauccgcguucugaagauggucgagccguggcucaagaacaaccaguuuugcaucaagguacuuaaccccuacaugcccaccguuaucgagcaccuggagcgccuccagcggaagcacggagggaugcuuguccgcaauccgcugagucggaacagcacccacgagauguacuggauuucgaauggcaccgggaacaucguugccucugucaacauggucucccgccuucugcuuaaccgguucacgaugacccacaggcggccgacuauugagaaggacguugaccucggcgcgggcacgcgccaugugaacgcagagccggagacccccaacauggacgucaucggugagcggaucaagcgcauaaaggaggagcacaacucgacuuggcacuacgacgacgagaacccguacaagaccugggccuaccacggcuccuacgaggucaaggccaccgggucggccuccagcaugaucaauggcgucgugaagcuacugaccaagccaugggacgucgucccuaugguaacgcaaauggcgaugacugacaccacacccuucgggcaacaaagaguuuucaaggagaaggucgacacgcgcaccccgcgaagcaugcccggcacacgccggguuaugggaaucaccgccgaaugguuauggcgcacgcuggggcggaacaagaagccccgccugugcacccgggaggaguucaccaagaaggugcgcacgaacgcagccaugggugcggucuuuacggaggagaaccagugggacuccgccaaggcggccguagaagacgaggacuuuuggaagcucguugacagagagcgggaacugcacaagcuggggaagugcggcagcuguguauacaacaugauggggaagcgcgagaaaaagcucggcgaguuuggcaaggccaaggggucucgggcuaucugguauauguggcuaggcgcccgcuaccuagaguucgaggccuugggguuccugaacgaggaccacugguucucgcgggagaacucguacagcgggguugagggggagggccuucacaagcugggcuacauccugagggauaucuccaagauucccgggggcgccauguacgccgaugacaccgcagggugggacacacggaucacggaggacgaccugcacaacgaggagaaaaucacgcagcaaauggacccggaacaccgccagcucgccaacgccauauuuaagcugaccuaccagaacaaaguugucaagguccagcggccuaccccaaccggcacagugauggauaucauuagccgcaaggaucagcggggcagcgggcaagucggaacguauggacugaacaccuucacgaauauggaagcccagcucauccgccagauggaaggggaaggggugcugagcaaggccgaccuggagaacccccaccuccccgagaagaagauaacccaguggcuggagacgaaaggcgucgagcggcuuaagagaauggcaaucuccggcgacgacugcgucguaaaaccgaucgacgaccgguuugccaaugcccucuuagcccuuaacgacauggggaaagugcgcaaggacaucccccaguggcaacccucgaagggguggcacgacuggcagcaagucccguucugcagucaccauuuccacgagcucaucaugaaagacgggcggaagcugguggugccgugucgcccgcaggacgagcugaucggucgggcccgcaucucucaaggggcgggguggucccuacgcgagaccgcauguuugggaaaagccuacgcccagauguggagccuaauguauuuccaucgccgcgaucuccggcucgcgucuaaugccaucuguagcgccguacccguacacugggucccgaccucccgaacaacguggagcauccacgcucaccaucaguggaugacaacugaggauaugcugaccgucuggaaccgcguguggaucgaggacaaccccuggauggaggauaagacucccgugaccaccugggagaacguccccuaccucgggaagcgcgaggaccaguggugcgggucgcugaucggacucaccagccgggcuacgugggcccaaaacauuccgaccgccauccagcagguucgcagccuuaucggaaacgaggaguuccuggacuauaugcccucuaugaagagguuccgcaaagaggaggagagugagggggcaauuugguga

SEQ ID NO: 25949 - RNA, 9873 nt, Artificial Sequence
  derived and/or modified CDS sequence (opt11) from DENV-3__EU781137__SS-prME
accagucucugccucaugaugaucuuacccgcggcccuggcguuucacuugaccucaagagacggagagccucggaugauuguagggaagaacgagcggggcaagucucuacuauucaaaacggccucugggaucaacauguguacccuuaucgcuauggaucugggcgaaaugugcgacgacacggucacuuacaagugcccacacaucaccgagguggagcccgaagacaucgauugcuggugcaacuuaaccagcaccuggguuaccuacggaaccugcaaccaggcuggagagcaccggcgcgauaaacgguccguggcuuuagccccgcacguuggcaugggucuggacacacgaacccagacauggaugagcgccgagggagcguggcgacaaguggagaagguggaaaccugggcgcuaaggcacccggguuucaccauccuugcguuguuccuggcgcacuacaucggcaccucccucacucagaagguggucaucuucacguuacuaaugcucguaacuccgagcaugacuaugcggugcgugggggugggcaaccgcgacuuugucgaggggcuguccggggcuacuuggguggacgugguucuggagcacggcgguugcgugacuaccauggccaaaaacaagccuacccucgacaucgaauugcagaagacugaagccacgcaguuggccacucuccgaaagcuaugcaucgagggcaaaaucaccaauaucaccacggacagccgaugcccaacccagggugaggccgugcugccagaggagcaggaccagaacuauguuugcaagcacaccuacguggaccggggauggggcaacggguguggccucuucgggaaaggcagucuggugacuugugccaaauuucagugucuagagcccaucgaggggaaagucgugcaguacgagaaccucaaguacacgguuaucaucaccguccacaccggggaccagcaucaaguuggaaacgagacccagggggucacugccgaaaucaccccucaggcaaguaccacagaggcgauucugcccgaguacggcacccuaggguuggaguguuccccaagaaccggccucgacuuuaacgagaugauccugcucaccaugaaaaacaaggccuggaugguucauagacaaugguuuuucgaccugccucugccguggacuucgggcgccaccacugagaccccgacauggaacagaaaggagcugcuggugaccuuuaagaacgcgcacgcuaagaagcaggaggucguggugcuagguucccaggagggcgcgaugcacacggcccucacgggugcaacugagauucagaacucaggagggacguccaucuucgcugggcaucugaagugccgccugaagauggacaaguuagagcuuaagggcaugaguuaugcaauguguacgaacaccuucguuuugaaaaaagagguuuccgagacccagcacgggaccauccucaucaagguggaguacaagggcgaggacguucccugcaagauccccuuuagcaccgaggacggacaaggcaaggcccauaacggcagacugaucacggccaaccccgucgugacuaaaaaagaggaacccguuaauaucgaggcugaacccccauucggugaguccaacaucgugaucgguauaggggauaaugccuugaagauaaacugguauaaaaaaggcucuagcaucgggaaaauguuugaggcgaccgcccguggcgcccgccguauggccauacugggcgacaccgccugggacuucggcagcgugggcgguguccucaacagccuaggcaaaaugguccaccagaucuucggcucggcuuacaccgcacuguucagcggugugaguugggugaugaagauaggcaucggcguacuucugaccuggaucgggcugaacagcaaaaauaccuccaugucuuucucaugcaucgcaaucggaauaauuacacucuaucucggcgcagugguccaggcugacauggguugugugaucaacuggaagggcaaggaacugaagugcggcagcgggaucuucgugacaaacgaaguucauacuuggaccgagcaguacaaauuccaggcggacucccccaagcgucuugcaacugcuaucgccggcgcgugggagaacggcgucuguggcauccggagcacaacgcggauggagaaucugcuguggaaacaaauugcgaacgaacucaacuacauucucugggagaacaauaucaaacugaccguggucgugggugauaucauagguguacuggaacaggguaagagaacccugacgccacagccuauggaacugaaguacagcuggaagaccugggggaaggccaagauugucaccgccgaaacgcagaacagcucuuuuauuaucgacggccccaauaccccugaaugccccagugccucccgggccuggaauguaugggagguggaggacuacggcuucgggguuuuuaccaccaauauauggcucaaacugcgcgagguguacacccagcugugcgaccaccggcucaugagugcugcugugaaggaugagcgcgcuguucacgccgacaugggcuacuggaucgagagccagaagaacggguccuggaagcuggaaaaagcuucauuaaucgagguuaagacgugcacguggccgaaaucucauacccuauggagcaacggugugcucgaguccgacaugauaaucccgaagagccuggccggacccaucucgcagcauaacuaccguccaggcuaccacacccaaacggcaggcccuuggcaccucggcaaacuggagcuggauuucaacuacugugagggcacgacugucgugaucacggaaaacugcggcacgcgugggccaucccuccggacaaccacgguguccgguaagcucauccacgaguggugcugccgcucaugcacgcuucccccguugagauacaugggcgaggacgggugcugguaugggauggagauccgccccauauccgaaaaagaggagaacaugguaaagagccucguauccgcagggucggggaaaguagacaacuuuacgaugggcgugcugugccucgccauccucuucgaggaggucaugcgggggaaguucggcaaaaaacauaugaucgcggggguguucuucaccuucguauuacuccucuccggacagauaaccuggcgcgacauggcacacacgcugauuaugaucgggagcaacgccuccgaucggauggggaugggcgugacguacuuggcccugaucgccaccuuuaagauccagcccuuccuggcgcuaggguucuuccuccgcaaacugaccucccgggaaaaucuccugcuuggcgugggacucgcaauggcaacuacacuucaguuacccgaggacaucgaacagauggcgaacgggauugcgcucggacugauggcccugaagcucauaacccaguucgagacguaucaguuguggacggcccugauaucgcugaccuguagcaacaccauauucacccucacgguggccuggcguacggcgaccuugauccucgcgggugugagccuguuaccggucugccagagcagcuccaugaggaaaacagacugguugcccaugacugucgccgcaauggggguaccgccgcucccacuuuucaucuucagcuugaaagauacacugaagaggcgcucauggccccugaacgagggaguuauggccgucggcuuggugagcauccuggcauccucucugcuccggaaugacgucccaauggccggcccacuuguggccgggggccuucuuaucgccugcuaugugaucaccgggaccucagcagaccuaacagucgagaaggccgcggacgugacuugggaggaggaggccgagcaaaccggcguuucgcacaaccuuaugaucaccgucgaugacgauggaaccaugcggauaaaagacgaugagacggaaaacauccuuaccguguuauugaagaccgcccugcucaucguaagcggcaucuucccauauagcauuccugccaccuuacucgucuggcauacguggcagaagcagacacagcgaaguggcgugcugugggacgugccgaguccgccagagacacagaaagccgagcuggaggagggggucuaucgcaucaagcaacagggaaucuucgggaaaacccaggugggcgugggaguccagaaagagggcguguuccauacgauguggcacguaaccagaggcgcggugcugacuuauaacgggaagcggcuggagccgaacugggccagcguaaagaaagaccugaucagcuauggcggggguuggcgacucuccgcacaguggcagaagggggaggagguucaagucaucgccgucgagcccgguaagaacccuaaaaacuuccagaccaugccaggaacguuccagacaaccacaggggaaaucggcgcgaucgcccuggacuucaagcccggcacgagcgguagcccaaucauaaaccgcgagggcaagguagugggucuguauggcaacggaguggugacgaaaaacggcggguacgucuccggcaucgcacaaacgaacgcggagcccgacggaccaacgcccgagcucgaggaggaaauguucaagaagcguaaccuuacaaucauggaccuucaucccgggucugggaagacacgcaaguaccugccggcuaucguucgugaggcaaucaagcgccggcuccguacgcugauauuagcucccacacgugucgucgccgcagagauggaggaggcccucaagggccuaccaauccgcuaccaaacgaccgcgaccaaguccgagcacaccggccgggagaucgucgaccugaugugccaugcaacauucacuaugagacuucuaucccccgugcggguucccaacuauaaccugaucaucauggacgaggcccacuucacagaccccgccuccauugcggcccgcggguacaucagcacccgggugggaaugggcgaagcagcugccauauucaugacggcgacaccgcccgggaccgccgacgccuucccgcagucgaacgcgccuauccaggaugaggagcgcgacaucccugagcgcaguuggaauuccgggaacgaauggaucaccgacuucgcagguaagacggugugguucguccccucuaucaaagcgggcaacgacaucgccaauugucuccggaagaacgggaagaaggugauacaacuguccagaaagacuuucgacacagaguaucaaaaaacgaaguugaacgacugggauuucgugguaacgaccgacaucucggaaaugggcgccaacuucaaggccgauaggguuauagacccuaggcggugccucaaacccgugauucugaccgacggcccugaacgggucauucuugcugggcccaugccaguuacugcggcgucggcagcccagcggcgcggcaggguggggcgaaacccccagaaggagaacgaccaauauaucuucacgggccagccccucaacaacgacgaggaccacgcccacuggacugaggcgaagaugcuacuggacaacaucaauacuccagaggggauaauuccggcccuguucgagccugagcgugagaaguccgcggcuauugacggcgaguaccgccugaagggcgaaucacguaagacuuucguggagcugaugcguaggggagaucuucccguguggcucgcucacaaggucgccagcgagggcaucaaguacacggaccgcaaguggugcuucgacgggcaacgcaacaaccagauacucgaggagaacauggauguggagaucuggacgaaagagggcgaaaagaaaaagcuccgcccccgguggcuagacgcccgcaccuauuccgaccccuuagcccucaaggaauucaaggauuucgccgccggccgcaaaaguauagcccuugaccuggugaccgaaaucgggcgcgugcccucgcaccucgcacaccgcacacggaacgcccucgacaaccugguaauguugcacaccagcgagcauggcggaaaagcuuauaggcacgcuguugaggaacugcccgaaaccauggaaacguuguuacuucugggucucaugauccuucugaccgggggcgcaaugcuguuccugauuucagguaaggggaucgggaagacguccaucggguuaaucugcguaaucgccucuuccgguauguuauggauggcggagauaccccugcaguggauagcgagcgcaauaguucuggaauucuucaugaugguuuugcugauccccgagccugagaagcaacggaccccacaggauaaucaguuggccuacgucgugaucgggauccugacccuggccgcaauuaucgcagccaacgaaaugggccugcuugaaaccacgaagcgcgaccugggaauguccaaggaacccggcgucgucucaccaacaucuuaccuggacguggaccuccaccccgcaagcgcguggaccuuauacgccguagcgacuacugucaucaccccgaugcuucggcacaccaucgagaacaguaccgcaaacgugagcuuagccgcuauagccaaccaagcgguggucuuaaugggccuggacaagggguggccgaucuccaaaauggacuuaggcgugccccuguuagcccuuggguguuacagucaggucaacccccuaacccucaccgccgccguucuccuccuuauuacccacuacgccaucaucggaccagggcuccaggcgaaggccacacgcgaggcccagaagcguacggccgccgggaucaugaagaacccgacgguggacggcauaaugaccaucgaucuggaucccguuaucuacgauagcaaguucgagaaacaguugggacaggugaugcugcugguauuaugcgcggugcaacuccuccuuaugcgcaccagcugggcacuaugcgaggcccugacgcuggccaccggccccaucacgacucuuugggagggcucccccggcaaguucuggaauaccacgaucgcggucagcauggccaacauuuuccguggaaguuaucuggccggugcgggccuggccuucagcaucaugaaaucugugggcacuggcaagcgcgguaccgggucccagggcgaaacccucggggagaaguggaaaaagaagcugaaccaacugucucgcaaggaguuugaccuguacaaaaaauccggcaucacggaaguggaucgcacggaggcuaaggagggucugaagcggggcgagauuacucaucacgcugucagccggggcuccgccaagcugcaaugguucguggaacggaacauggugauaccggaaggccgcgugauagaccucggcugugggcgaggcggcuggagcuauuacugugccggccuuaagaaagugacugaggugcgcggauacacgaaaggggggcccggacacgaagagcccguccccauguccaccuacggauggaacaucgugaagcugaugucagggaaagacguuuucuaccucccucccgagaagugcgacacccuguugugcgacaucggugaguccucgccauccccuacugucgaggaaagucgaacgauccgcgugcugaagaugguagagccauggcuaaagaauaaccaguucugcauuaagguccuaaauccauauaugcccaccguuaucgagcaucuggagcgacugcaacguaagcacggggggaugcugguacgcaacccccugucccggaacagcacccacgagauguacuggauuuccaauggcaccggaaacaucguagcaagcgucaacaugguuagccgccuccuucuuaaucgguucacgaugacccaccgccggccgaccaucgagaaagacgucgaccucggugcgggcacaaggcacgugaacgccgagcccgaaacucccaacauggauguaaucggugagagaaucaagcguauaaaggaggaacacaauaguacuuggcacuacgacgaugagaacccguacaagaccugggccuaccaugguaguuaugagguaaaagcuaccgggagcgccuccuccaugauuaacgguguggucaaacuccuuacgaagccaugggauguagugcccauggucacgcagauggcaaugacggacaccacgcccuucggucaacagcggguauuuaaagagaaggucgacacccgcacaccgcggagcaugccugggacacgucgcgucaugggcaucacggcagaguggcuguggcgaacccuggggcggaauaagaagccccgucuuugcaccagagaagaguucaccaaaaaggugcgcacuaacgccgcuaugggcgccguguucacggaggaaaaccagugggacuccgccaaggcggccgucgaggacgaggauuucuggaaacucguggaucgcgagcgggagcugcauaaguugggcaaguguggaucauguguguacaauaugauggggaagagggagaagaagcugggcgaauucggcaaggccaaagggucccgggccauaugguacauguggcucggggcccguuaucuggaauucgaggcccucggguuccuaaacgaggaccacugguucagccgggagaauuccuacagcggcgucgagggcgaaggacugcauaagcugggcuauauccugcgcgacauuuccaagaucccagggggagccauguacgccgacgauacggcgggcugggacaccagaaucacagaagacgaucuacacaacgaggagaaaauuacucagcagauggacccggagcaccgccagcucgccaacgccauauucaagcugaccuaccagaacaagguugugaagguccaacggcccaccccuaccggcacuguuauggauauaauuagccguaaagaccagcggggaaguggucagguagggaccuauggccugaacacauucaccaacauggaggcgcaguuaauccgccagauggaaggugaggggguccugagcaaggccgacuuagagaacccccaucuccccgagaaaaagauuacccaauggcuggagaccaaggguguugaaagacugaagcgcauggccaucuccggagacgacugcgucguuaaacccauagacgaccgguucgcgaacgcgcuccuggcccugaacgacauggggaaggugcgcaaggauauuccucaguggcagcccucgaaaggcuggcacgacuggcaacaagugcccuucugcucacaccauuuccacgagcucguuaugaaggacgggcgaaagcuggugguccccugucgcccccaggaugagcugauaggacgugcccgcaucagccagggugcuggcuggucucucagagaaaccgccugccugggcaaggccuacgcccagauguggucuuuaauguacuuccaccggcgcgaccuucgguuggccucgaaugccaucuguagcgccguccccgugcacugggugccgacaucccguaccacguggaguauccacgcacaucaucaauggaugacaaccgaggauaugcuaacgguauggaacagagucuggaucgaggacaaucccuggauggaggacaagacccccguaacaaccugggaaaaugugccguauuugggaaaacgcgaggaccaguggugcgggucacugaucggacugacgucgcgcgcaaccugggcucagaacaucccgacugccauccaacagguaaggagccucaucgggaacgaggaguuccuggacuauaugccgucuaugaagcgguuccgcaaagaggaggaaagcgagggggccaucugguga

SEQ ID NO: 25950 - RNA, 9873 nt, Artificial Sequence
  derived and/or modified CDS sequence (opt11) from DENV-3__EU726773__SS-prME
accaguuuaugccucaugaugauucuccccgcggcgcuggcguuucaccucaccagccgcgauggugaaccucggaugaucguugggaaaaaugagcguggcaagagccugcuguucaagacggccuccgggaucaacaugugcacauuaaucgccauggaccucggagagaugugugacgauaccguuaccuacaaguguccccauauaaccgagguggagcccgaagacaucgacugcugguguaaccugacgagcaccuggguaacguacgguacgugcaaccaagccggcgagcacaggcgcgacaagaggaguguggcccucgcuccccaugugggcaugggccuggauacccgcacccagacguggaugagcgccgagggggcguggcggcaggucgaaaaggucgagacgugggcccuccgccauccgggguucacaauccucgcccucuuucuagcccacuacaucgggacuuccuuaacccagaagguggucaucuucauacuucugaugcucgugacacccagcaugaccaugcgaugugugggugucggcaaucgugacuucgucgagggccuauccggggccaccuggguggaugugguccuggagcacggcggcugcguuacaacgauggccaagaacaagcccacccuagauauugagcugcagaagaccgaggccacccagcuggcgacgcuccggaagcuguguauagagggcaaaauuacuaauaucacgacggacucucgcugccccacccagggcgaggccgugcucccggaggaacaggaccagaacuaugugugcaagcacacguacguggaucgaggguggggcaacggaugcggccuauucgggaagggcucucugguuacaugcgcgaaauuccagugccuggagcccaucgagggcaaggucgugcaguacgaaaaccucaaauacaccgugaucaucacgguacacacaggugaucaacaccaggucggaaacgagacccagggggugaccgccgagaucacgccccaggccagcaccacugaagcaauacuccccgaguacggcacccuggguuuggagugcuccccucgcaccgggcuagacuuuaacgaaaugauccugcuuacgaugaagaauaaggcuuggauggugcaccggcagugguuuuucgaccugccccugccguggaccagcggggcaacgacagagacccccacguggaaucguaaggaguuacuugugacuuucaaaaacgcccacgccaagaagcaggaggucguggugcuggggucccaggagggugcuaugcacacugcccugacaggggccacagagauucagaacagcggggggaccuccauauucgccggucaccugaagugcagacugaaaauggacaagcucgagcugaagggcaugagcuaugccaugugcacaaacacuuuuguacugaagaaggaagugagcgagacccagcacgguaccaucuugaucaaaguggaguacaagggcgaggaugucccguguaagauucccuucagcaccgaggacgggcagggcaaggcgcauaacggccgccucauuaccgccaaccccguggugacaaaaaaagaggagcccgucaauaucgaggcagaaccucccuucggggagagcaacaucgugauaggcauuggugacaacgcacugaaaauaaacugguauaagaaaggcucaagcaucgggaagauguuugaggcgaccgcccggggcgcacgccggauggcuaucuugggcgacaccgcuugggacuucgggucuguuggcgggguccucaacucccucggcaaaauggugcaccagaucuucgggagcgcguacaccgcacuuuucagugggguguccuggguuaugaagauagguauaggcgugcuacuuacuuggaucggcuuaaacagcaaaaauaccuccaugucauucuccuguaucgugaucggcaucaucaccuuguaccugggcgccgucgugcaagccgauaugggcugugugaucaacuggaagggcaaggaacugaagugcggcucagggauauucgucacgaacgaggugcacacauggacggagcaguacaaguuccaggcugauagccccaagcgcuuggccaccgcuaucgccggcgccugggagaauggugugugcggcauccgcagcacgacccggauggagaacuuacuguggaaacaaaucgccaacgagcucaacuauauccugugggaaaacaacauuaaacugacgguaguugucggggauaucaucggggugcucgagcaaggcaagcgcacccugacgccccagccgauggagcugaaguacucuuggaagaccugggggaaggccaagaucgugacggccgagacucagaacagcuccuuuaucaucgacggucccaacacgcccgagugcccuucugccagccgagcguggaaugugugggagguagaggauuacggguucggcguauuuaccaccaacauuuggcucaaacuaagagaagucuacacccaacucugugaccaccgacucaugucagcggcugucaaggacgaacgagccgugcacgccgacaugggcuacuggaucgagagccagaaaaauggguccuggaagcuggagaaggccaguuuaaucgagguaaaaaccugcacauggccgaagucccacacucucuggaguaacgggguccuggaguccgacaugaucauucccaagagccuggcggggccuaucucccaacacaacuaccggccgggcuaucacacccagaccgccgggcccuggcaccugggcaagcuggagcuugacuucaacuacugcgagggcacgacuguggugaucacagagaauugcggcacccgcggacccagccuacggacgacuacggucagugggaagcucauucacgaguggugcugcagaucgugcacccucccuccgcuccgguauaugggcgaggacggcuguugguauggcauggagauccgcccaaucucggaaaaggaggagaacauggucaagagccucgugagcgccggcagcgggaaggucgacaauuucacaaugggcgugcugugccuagccauacuguucgaagaagugaugcgggggaaguuugggaaaaaacacaugaucgcggggguguuuuucaccuucgugcuacuccucuccggccagaucaccuggcgcgacauggcgcacacccucauaaugaucggcagcaacgcauccgaucguauggguaugggcguaacguaccuagcccugaucgccacuuuuaaaauccagccguuuuuagcccucggguucuuuuugcgcaaguugacgagccgggagaaccuccugcugggugucggccuugcgauggccacuacgcugcagcugccggaggacaucgaacagauggccaaugggauagccuugggucucauggcgcuaaaguuaauuacccaauucgagaccuaccaguuauggaccgccuuaaucagccucacguguucuaacaccaucuuuacccugaccgucgccuggcgcacugccacccugauccucgccggggucagccuacugccugugugccaguccucuuccaugcggaagaccgacuggcuccccaugaccguggcggcaaugggcguaccgcccuuaccgcuguucaucuucagccuuaaggacacgcugaagcgccgcuccuggccccugaacgagggggucauggccgugggccucgucagcauacuggcuuccucccuacuccggaaugacgugcccauggccggcccucuuguggccggcgggcugcucauugccugcuacgucaucaccggaacuuccgcagaucugaccguggaaaaggcagccgacgugacgugggaggaggaggcggaacagacggggguuucucauaaccugaugaucaccguugacgacgacgggacgaugcgaaucaaggacgacgaaacggagaacauccucacggugcugcugaagaccgcccuccugauagugucaggcauuuucccuuauagcauucccgcaacccugcucguguggcauaccuggcagaaacagacgcaacgguccggggugcugugggacgucccuaguccgcccgaaacgcagaaagcugagcuggaagaggggguguaccguaucaagcagcagggcaucuucgggaagacccagguagggguugggguucaaaaagaaggcgucuuccacaccauguggcaugugacucguggcgccgugcucacguacaacggaaagcgccuggagcccaacugggcguccgugaagaaagauuugaucucuuacggcgggggcuggcggcucuccgcccaguggcagaagggggaggagguccaggugaucgccguugagccgggaaagaacccgaagaacuuccagacuaugccugguaccuuccagaccaccaccggggaaaucggagccaucgcguuggacuuuaaacccggaaccucuggcagccccauaaucaaccgggaaggcaaggucgugggucuguauggcaauggugucguaacgaagaacggcggguacguguccgguaucgcccagacaaacgccgagccggauggucccacaccagagcuggaggaggagauguucaagaaaaggaaccucacgauuauggaccuacaccccgggucagggaagacucggaaguaccugccagcaauaguucgugaggccaucaagcgcaggcuccgcacacugauacuugcucccacgcgggucguggccgcugagauggaagaggcccugaaaggccugccgauacgcuaccagacuaccgcgaccaaguccgagcacaccggccgggagaucguagaccugaugugccacgcuaccuuuacgaugcgucucuuaucgcccguccgggugccuaauuauaaccugauuauuauggacgaggcgcauuucaccgaccccgccucaaucgccgccagaggauacaucagcacccgggucggcaugggcgaggcagccgccaucuuuaugaccgccacgccucccggaacugcugacgccuucccgcaauccaacgcucccauccaagacgaggaaaaagacaucccagaacgcagcuggaauagcggcaacgaguggaucacagacuucgccggaaagacgguuugguuuguaccgagcaucaaggccggcaacgauauugcgaacugccuccgaaagaaugggaaaaaggugauccaacucucccggaagacauucgacaccgaauaucagaagacuaaguuaaacgacugggacuuugucgucaccaccgauaucagcgaaaugggcgcuaacuucaaagccgaucgcgugauugacccgaggcggugccucaagccugucaucuugacggacggacccgaacggguaaucuuagcagggcccaugccggugaccgcggcguccgccgcccagagacggggccgcgucggcagaaacccccaaaaggaaaacgaccaguauaucuucaccggccaaccccucaauaaugacgaggaucaugcucacuggacugaagccaaaaugcugcuggacaauaucaacacacccgagggaaucauccccgcccucuucgaacccgagagggagaagagugccgcaaucgacggugaguacagacuaaagggggaaagucgcaagaccuuuguugaacugaugagaaggggugaccuacccguuugguuggcccacaaggucgcgucagagggcaucaaguacacggaccggaaguggugcuucgacggccaacgcaauaaccagauucuggaggagaacauggauguggagaucuggaccaaggaaggcgagaaaaagaagcuucggccccgcuggcuggacgcccguacguacagcgacccgcuggcgcucaaggaguucaaggauuucgcggccggccgcaagagcauugcgcuagaucuggucacggaaauagguagagucccaucccaccucgcccacaggaccagaaacgcccuggacaaccuggucaugcuccauaccuccgaacaugggggcaaggccuaccggcacgccgucgaagaacugcccgagacuauggagacccugcuauuguugggccucaugauccugcugacugguggcgcaaugcuguuucugaucagcggcaaggggaucggcaagaccucaauugggcucaucugcgucaucgccagcuccggcaugcuauggauggcugaaaucccguugcaguggaucgccagcgcaaucgugcuugaguuuuucaugaugguccuucugauacccgagcccgagaagcaacgcacuccacaagacaaccaacuagcguacguggugauaggaaucuugacccuggccgccaucauagccgccaacgagauggggcugcuggagacuacaaagcgggaccuuggcaugaguaaagaacccggggucguaagccccacgucuuaccucgacguugaccuccaccccgccagcgcauggaccuuguaugcagucgccacgacgguuauuacgccuaugcugcgccacaccaucgagaauucgacugccaacgugagccucgccgccauugccaaccaggccgucguccuaaugggccuagacaagggguggccaaucuccaaaauggaccucggcguaccccugcuggcucucgggugcuacagccaggucaacccccugacacugacggccgcagugcuucuacuaaucacucauuacgccaucaucggacccggguugcaggccaaggcgacccgggaagcccaaaaacgcacugcagcagguaucaugaagaacccgacgguugacggcauaaugacuaucgaucucgaccccgugaucuaugacucaaaguucgagaagcaguuaggccaagucaugcuccucguguugugcgcugugcaacucuugcugaugcggaccucuugggcacucugugaagcccugacccuggcgacuggccccauaaccacucucugggaggggucgcccggaaaguucuggaauaccacaaucgccgugucuauggcaaacaucuuccggggcuccuaccuggcuggggccggccuggccuucuccauaaugaaaucggugggcaccgguaagcgggggaccgggucacagggcgagacccucggggagaaguggaagaagaagcugaaccagcucucacgcaaagaguucgaucucuacaagaaauccgggaucaccgagguagaccggaccgaagcuaaggaggggcuaaagcguggagaaaucacucaccacgcggugucucggggcuccgccaagcugcagugguucguggagcgaaacauggucaucccugagggacgggugaucgaccuugggugcgggcgcggcggguggagcuacuacugugccggccuuaaaaaggucacagagguccguggguacacuaagggcgggcccggucaugaagaaccggugccaaugagcacuuacgguuggaacaucguaaagcuaaugagcgggaaggacguauucuaucucccccccgaaaagugcgauacccuucugugcgacauaggcgaguccucccccucccccacgguggaggagagucgaaccaucagagugcugaaaauggucgaaccguggcucaagaacaaccaguucugcaucaagguuuugaaucccuacaugcccacggugauagagcaccucgagcgccuccaaagaaagcacggcgggaugcugguccggaacccgcugucucgcaauaguacccacgagauguacuggaucucuaacgguacggggaauaucguggcgagcguuaacauggugucccggcuccugcugaaccguuucacuaugacgcaccggcguccgaccaucgagaaggacgucgaccucggcgccggaacacggcacguaaacgccgagcccgagacccccaacauggacgucaucggggagcgcauaaagcguauuaaggaggagcauaacagcaccuggcauuacgacgacgagaauccguacaaaaccugggcauaccacgguuccuaugaggugaaggccaccgggagcgccuccagcaugaucaacggcgucgugaagcuacugaccaaacccugggacguaguccccaugguaacccagauggccaugacugacaccacgccauucggccagcagcggguauucaaggagaaggucgauacgcggaccccgcgcagcaugcccggaacccggcgcguuaugggaaucaccgcggaguggcuuuggcggacucugggacguaacaagaagccgaggcuaugcacgcgagaggaguucaccaagaaggugaggacgaacgccgcuaugggcgccguauucacugaggagaaucagugggacucggcgaaggccgcaguugaagacgaagacuucuggaucuugguggaucgggagagagaacuucacaaauuggggaaguguggaagcugcguuuacaauaugauggggaagcgagaaaagaagcucggcgaguucggcaaggccaaggggagucgcgccaucugguacauguggcugggugcacgcuaccucgaguucgaggcacucggguuccugaacgaggaucacugguucagccgcgagaacuccuauucuggcguagagggggagggccugcauaaacucggcuauauacuacgcgacaucucaaagauuccaggaggcgccauguacgcagaugauacagccgggugggauacccgcauuaccgaggaugaccugcacaacgaagagaagauuacgcagcagauggacccagagcaccggcaacuugcgaaugcuaucuucaagcuuaccuaccaaaacaagguggucaagguucaacgccccacgcccaccggcacggugauggauauaaucagccggaaggaccagcgcggauccggccaggucgguacguacggccuaaacacuuucacaaauauggaggcccagcucauacggcaaauggagggcgagggggugcugagcaaggccgaucuugagaacccacaccucccggagaagaagaucacccaguggcucgaaacaaaaggaguggagcgccugaagcggauggcgaucuccggcgacgacugcguugugaagcccaucgacgaccgcuuugcaaacgcccugcuggcacugaacgauauggggaaggugcggaaagacaucccucaauggcagcccagcaagggcuggcacgacuggcagcagguaccauuuugcucccaccacuuccaugagcucaucaugaaggacgggcgcaagcugguggugcccugcagaccucaggacgaacucauaggccgcgcccggauaagccagggggccggcuggucccugcgcgagaccgcgugcuugggcaaagccuacgcacagauguggaguuuaauguauuuccaccggcgcgaccuccgccucgcauccaaugcgauaugcagcgccguacccgugcacugggugccuaccucucggaccacguggucgauccacgcccaccaucaguggaugacaaccgaggacaugcugacgguuuggaaccgcguguggauagaagacaacccguggauggaggauaagacacccgugaccacaugggagaauguccccuaucucgggaagcgggaggaccagugguguggaucucuaaucggguuaaccucccgggcaacgugggcccagaacaucccgacggcgauccagcaggucaggagccucaucgggaacgaggaguuccuagacuacaugcccucaaugaagcgcuuucggaaagaagaggaguccgagggagcgauuugguga

SEQ ID NO: 25951 - RNA, 9873 nt, Artificial Sequence
  derived and/or modified CDS sequence (opt11) from DENV-3__EU726774__SS-prME
accucccugugccucaugaugaucuuaccagccgcgcuggcguuucaccucacaagccgcgacggcgagccccggaugaucguggggaagaacgagcgcggcaagagccuacuauucaagacggccuccgggaucaacaugugcacccuuauagccauggaccuaggcgagaugugcgaugacacagugacguauaagugcccccacauaacggagguggaaccggaggacaucgacuguugguguaaccugaccucaaccugggugaccuacgggacguguaaucaggcgggcgagcaccggcgagacaagcgguccgucgccuuggcgccccauguggguaugggucuggacacccguacucagacauggaugucagccgagggcgccuggcgccaaguggagaaggucgagacgugggcccuccggcacccgggauucaccauccucgcgcuguuccuugcccacuacaucggcaccucccucacacagaagguggugaucuucauucugcugaugcucgucacgccuagcaugaccaugcggugcgugggggugggcaaucgcgacuuugucgagggccuguccggggccacguggguggacguuguccuggagcacggcgggugcgugaccacgauggccaaaaacaagcccacccucgacaucgagcugcaaaaaaccgaggccacccagcuggcgacgcuccggaaauuaugcauagagggcaagauuaccaacaucaccaccgacagccguuguccaacgcagggcgaggccguccugccugaggagcaagaccagaacuacgucugcaagcacacguauguggaccggggguggggcaauggaugcggacucuucggcaaggguucccuggucacgugugccaaguuccagugucuggagcccauagagggaaagguagugcaguacgaaaaucucaaguacaccgucaucaucacgguccacacgggcgaccaacaucaggugggcaaugaaacucagggggucaccgcggaaaucacuccucaagccagcaccacagaggcgauccuuccggaguacggcacccuggggcucgagugcuccccgcggaccggucuggauuucaaugagaugauccuacucacgaugaagaacaaggcguggauggugcaucggcaaugguucuuugaccugccccuuccguggaccucuggcgccacgaccgaaacgccuaccuggaaccgcaaggagcuacuaguuaccuuuaaaaacgcccacgcgaagaagcaagaggucguggugcuggggucccaagaaggcgcgaugcacaccgcccucacgggggcgaccgagauccagaacagcggcgggaccuccauauucgccggccaccuuaaaugccgguugaaaauggacaaacucgagcugaaggggaugagcuacgccaugugcaccaauacguucguccugaagaaagagguguccgagacccagcacgggacgauccucaucaagguggaauauaagggcgaggacgucccguguaagauccccuucagcaccgaggacgggcagggcaaggcgcacaacggccgccugaucacggcaaauccgguggugaccaagaaagaggagcccgucaauauagaggccgagccgcccuucggggaaucaaacaucgugaucggaaucggggauaaugcccugaaaauaaacugguauaagaagggcuccagcaucggcaagauguucgaagcgacggcacggggcgcgcgccggauggccauucugggugacaccgccugggacuucggauccguuggcgggguccucaacagccugggcaagauggugcaccagaucuucggcuccgcuuacacggcccucuucagcggcguguccugggucaugaaaaucggcauaggaguuuuacugaccuggaucgggcugaacaguaagaacaccagcaugaguuucuccuguaucgccaucgggauaauuacucucuaccugggcgccgucguccaggccgacauggggugcgugaucaacuggaagggcaaggagcugaaaugcggaucgggaaucuucgugaccaacgaaguccacaccuggaccgagcaguacaaguuccaggcggacagccccaagcgccucgccacagccauagccggcgccugggagaauggggucugcggcauccgcucgacgacucggauggagaaccugcuguggaagcagauagcgaacgagcucaacuacaucuugugggagaacaacaucaagcugacaguggucgugggugauaccaucggggugcucgagcagggcaaacgcacacugacgccccaaccgauggagcugaaguacucauggaagaccugggggaaggccaagauugucacagccgagacgcaaaacuccuccuucaucaucgacggccccaacacccccgaaugcccgagcgcgucgcgggcguggaacgugugggaaguggaggacuacggguucggcgucuucaccaccaacauauggcucaaacuucgcgagguguacacccagcugugugaccacagacucauguccgccgccgugaaggacgaaagagccguccacgccgacaugggcuacuggaucgagagccagaaaaacggcuccuggaagcucgaaaaggcgucccugaucgaggugaaaacgugcaccuggccgaagucccacacccuauggagcaacggcgugcuggagagugacaugaucauccccaaaucauuagcagggcccauuucccagcacaauuaccgcccaggcuaccacacccaaacagccgggcccuggcaucucggcaaguuggagcuggacuucaauuacugcgagggcaccaccgucguuauaaccgaaaacugcgggacgcgcggcccgagucuccggaccaccaccguguccgggaagcuaauccacgaguggugcugccgcucaugcacgcugcccccgcugagguacaugggcgaggacggcugcugguacggcauggaaauccgccccaucuccgagaaggaagagaacauggucaagagccugguuucagccgggagcgggaagguggacaacuuuaccaugggcguccugugccucgcaauccuguucgaagaggugaugcgugggaaauucggaaagaagcacaugaucgccgggguguucuucaccuuuguccuccugcugaguggucagaucaccuggcgcgacauggcucacacgcugaucauggugggguccaaugcguccgaccggauggggaugggcgucaccuaccucgcccucaucgcgaccuucaagauucagcccuuccuggcgcucgguuucuuccugcgcaagcugacgagcagggaaaaccuccugcugggcgucggacucgcaauggcaacgacucuucagcugcccgaggacaucgagcagauggccaacggaauagcgcucggucugauggcccugaagcucacuacccaguucgagacguaccagcuuuggaccgccuuaaucagccugacgugcuccaacacaaucuucacguuaaccguagcguggcgcacagccacgcugauacucgcgggggucagccuuuugccgguaugccaaaguagcagcaugcggaagacggacuggcuccccaugacuguggccgccauggguguaccgccccucccgcuguucauauuuagccuuaaagacaccuuaaagcgacgcuccuggccccuaaacgaaggagugauggccgucggccuagucagcauccuggcauccagccugcuccgcaacgaugugcccauggcgggcccccugguagcuggcggcuuacucaucgccugcuacgugaucacugggacgagcgccgaccugaccguggagaaggccgcugacgucaccugggaagaggaggccgaacagaccggcgucagccacaaccuuaugaucaccguggaugacgaugggaccaugcgcaucaaggacgacgagaccgagaacauccucaccgugcugcuaaagaccgcccuccuuaucgucucaggcauuuucccuuacagcauccccgccacacugcucguguggcacaccuggcaaaagcagacccagagauccggggugcugugggacguccccagcccgcccgaaacccagaaggccgagcucgaggaggggguguaccgcauuaaacagcagggcaucuucggaaagacccaggugggcgucggggugcagaaggagggcguguuccacaccauguggcacgucacccggggcgcggugcucaccuacaacgguaaacgacuggagcccaacugggccuccgugaagaaggaccugaucagcuauggcggggguuggcggcucuccgcacaguggcagaagggcgaagaggugcaggugaucgcgguggaaccgggcaagaacccgaagaacuuccagacgaugccuggcaccuuucagacgaccacgggagagaucggcgcgauugcucuggacuucaagccggggaccagcggcaguccaaucauaaauagagagggcaaagucguggggcuguaugggaaugggguggucaccaagaacgguggauacguguccgguaucgcccagacuaacgcagagccggacgggcccacgcccgagcuggaggaggaaauguucaagaagcguaaccucacgauuauggaucugcaccccggaagcggaaagacccgcaaguaccugccggccauagugcgggaggcgaucaagcgccgacuccgcacccucauccuggcgcccacgcggguuguggccgccgaaauggaagaagcccucaaggggcugcccauacgcuaucagaccacggcgaccaaguccgagcacacgggcagagagaucguggaccugaugugccacgcgacauucaccaugcgccuccucagucccguccguguucccaacuacaaucugauaaucauggaugaggcccacuuuaccgaccccgccucaaucgccgccagaggguacaucagcacgcgagugggcaugggcgaggcggccgccaucuucaugaccgcgacgccgcccgggaccgccgacgccuucccacaauccaacgccccgauccaagacgaggagcgcgacauccccgagcgcagcuggaacuccggcaaugaauggauuacggauuuugccgggaagaccguuugguuuguucccucuaucaaggcgggcaacgauaucgcaaacugucucagaaagaacgggaagaaggugauccagcugucccgcaagaccuucgacacggaguaccagaagacgaagcugaacgauugggacuuugucgugacgaccgacaucagcgagaugggggcgaacuuuaaggccgaccgggugauagacccucgccggugcuuaaagcccgucauccuuaccgauggccccgaacguguuauacuggccggucccaugccggugaccgcggccuccgccgcccagcgacggggucgggucgggcguaacccgcagaaagagaacgaccaauacaucuucacgggccaaccccucaacaacgacgaagaccacgcgcacuggaccgaggcgaagaugcugcuggacaacauuaacacccccgagggaaucaucccggcccuuuucgagcccgaacgggagaaguccgcggccaucgacggcgaguacagauugaaaggggagucaagaaaaacguuuguggagcucaugcgccgcggggaccugcccgucugguuagcgcauaagguggccagcgagggcaucaaguacacggaccguaaaugguguuucgacggccagcggaacaaccaaauacucgaggagaauauggacguugagauuuggaccaaagagggcgagaagaagaagcuccgaccccgcuggcuggacgcccgcacuuacuccgacccccucgcacucaaggaguucaaggacuucgccgcaggucgcaagagcaucgcccuggaccuggucaccgagaucgggagagugcccucccaccucgcgcaccgcacccggaacgcucuggacaaccucgugaugcuccacacuagcgagcacggcgggaaggcuuaccgacaugcggucgaggagcugcccgagaccauggagacccuauugcugcugggucucaugauccugcugaccggcggcgccaugcuguucuuaaucagcgggaaggggaucggcaagaccuccauaggccugauaugcgugauugcaagcuccggcaugcucuggauggcugagaucccgcugcaguggaucgccucugcuaucgugcuggaguucuuuaugaugguccuccucauccccgaacccgagaagcagcggacaccccaagacaaccagcuggcguacguagugauugggauccucacccuagccgccaucaucgcagcgaacgaaaugggccugcucgagacgaccaagcgcgaccugggcauguccaaggagccaggggucgugagccccaccuccuaccuggacguggaccuacaccccgccagcgccuggacccuguacgccgucgcgacgaccgugaucacccccaugcuccggcacacgaucgaaaauuccacagccaaugugagccucgccgccaucgccaaucaggcggucgugcugaugggccuggacaaaggguggccgauauccaagauggaccugggcgugccauugcuggcccucggguguuacucucaggucaacccccugacccugaccgccgccgugcuccugcugaucacacauuacgccauuaucggccccggcuuacaagcgaaggcaacgagagaggcccagaagcguacagccgcgggaaucaugaaaaauccgaccguggacggcaucaugacgaucgaccuggaccccgucaucuacgacuccaaauucgaaaagcaguugggccaggugaugcucuugguccugugcgccgugcagcuccugcugaugcguaccucaugggcccucugcgaggcacuaacccuggcgaccggcccgaucaccacgcucugggagggcucccccgggaaguuuuggaauaccacgaucgcggucucaauggcaaacaucuuucggggcuccuaucuggccggagccggccucgccuucagcaucaugaaguccguggggaccggcaagcgcggcaccgggagccagggcgagacgcucggggagaaauggaagaagaagcugaaccagcugagccggaaggaauucgaccucuacaaaaagucaggcaucaccgaagucgaucgcacugaagcgaaagagggacuaaagcggggcgagaucacacaccacgccgugagccgcggcuccgccaaguuacagugguuuguggaacggaacauggucauaccggagggccgagugaucgaccucggcugcgggcggggcggguggucauacuacugcgccggccuuaaaaaggugacggagguccgcggcuacacgaagggcgggccagggcaugaggagcccgucccuauguccaccuacggcuggaauaucgugaagcugaugagugggaaggacgucuucuaucucccgcccgagaagugcgacaccuugcugugcgacauuggcgaauccagcccauccccuacaguggaagagagucguacuauccgagugcuaaagauggucgagccguggcucaagaacaaccaauucugcaucaaaguacugaaccccuacaugcccacgguuauagagcaccuggagcgccuccagcggaagcacggagggaugcuggugcgcaaccccuugucccgcaacagcacccaugagauguauuggauuuccaacgggacagggaacaucguagccaguguaaacauggucucccgccuauuacugaaccguuuuaccaugacccaccgccggccaacgaucgagaaggacguggacuuaggcgcggguacgaggcacgugaaugccgagcccgagacccccaauauggaugucaucggagagcgaauaaagcggauuaaggaggaacacaacaguaccuggcauuacgacgacgagaaccccuacaagaccugggcuuaccacggcuccuacgaggugaaggccacggggagcgccaguagcaugaucaauggcgucgugaagcugcugacuaaaccgugggacgugguccccauggugacccagauggcgaugaccgacacgaccccguucgggcagcagcggguguuuaaggagaaggucgauacccgcaccccacgaagcaugcccggcacgcgacgggucaugggcauaaccgcugaguggcuuuggcgcacccucggcaggaacaaaaagccccgccugugcacucgggaagaguucacgaaaaaggugcgcaccaacgccgcuaugggcgcggucuucaccgaggagaaccagugggacuccgccaaggcagccguggaggacgaggacuuuuggaagcucguggaccgcgagagggagcugcauaagcuggggaaguguggaagcugcgucuacaacaugauggggaagcgcgagaagaagcucggcgaguucggaaaggccaaggggucccgugcgaucugguacauguggcugggcgcccgcuaccuggaguucgaggcccucgguuuccugaaugaagaccacugguuuagccgggagaauaguuacagcggcguggagggggaggggcuccacaagcucggcuacauccugcgcgauauuucuaagaucccugggggagccauguaugcagaugacaccgccgggugggacacgcggauaaccgaggacgaccugcacaacgaggagaagauaacccagcagauggauccggagcacagacaacucgccaacgcgaucuucaagcugaccuaccagaacaagguggucaaggugcagcggccaacccccacgggcaccguuauggacauaauuagccgcaaggaccagcggggcuccggacaggucggcacuuacgggcugaacaccuuuacgaacauggaggcccagcucauccgccagauggaaggcgaaggggugcuuagcaaagcggaccuggagaacccacaccucccggaaaagaagaucacccaguggcuggagaccaagggcguggagcggcugaagcguauggcgauaucaggcgacgauugcguaguuaaacccaucgacgaccgguucgcgaaugcccuacuggcccucaacgacauggguaaaguccgcaaggacauuccccaguggcagcccagcaagggguggcacgacuggcagcaggugccguucugcagucaucacuuccacgaguugauaaugaaggacgggcgaaagcuuguggugcccugucgcccgcaggacgaguugaucggucgagcgcgcauaagucagggggccggauggucccuccgggagaccgccugccugggcaaggccuacgcccaaauguggaguuugauguacuuccaccgacgcgaccuccggcuggcauccaacgcaaucugcagcgccguccccgugcacugggugccaacgucuaggaccaccuggagcauccacgcccaccaccaguggaugaccaccgaggacaugcugaccgucuggaaccggguguggauugaagacaaccccuggauggaggacaagacucccgugaccacgugggagaacguccccuaccucgggaagcgcgaagaccaauggugcggcagccugaucgggcuuaccucccgggccaccugggcgcaaaacauccccaccgccauccagcagguccgcagccucaucggcaacgaggaauuccuggacuacaugcccuccaugaagcgguuccgcaaggaggaggagagcgagggggcgaucugguga

SEQ ID NO: 25952 - RNA, 9873 nt, Artificial Sequence
  derived and/or modified CDS sequence (opt11) from DENV-3__EU687219__SS-prME
accucguugugccucaugaugauuuugcccgcagcccuggcguuccaccucaccagccgggacggggagccccguaugaucguggggaagaacgagagaggcaaaagccugcuguucaagaccgcuuccgggaucaacaugugcacucucaucgccauggacuugggcgagaugugcgacgauaccgugaccuauaaaugcccccacaucgccgagguugagcccgaggacaucgacugcuggugcaaucugaccagcacuugggugaccuaugggaccuguaaccaggccggcgagcaucgccgcgauaagcgguccguugcgcucgcgccccacguggggaugggucucgacacccgcacccaaacuuggaugagcgcagagggugccuggcggcaggucgagaaggucgaaaccugggcgcugcgacacccgggguucaccauacucgcccuuuuccuggcccacuauaucgggaccucccucacccagaagguggugaucuucauccugcugauguuggucacgcccagcaugacgaugcgcugcguggguguggguaaucgcgacuucgucgagggccuguccggggccacguggguggacguuguccuagagcacggcgggugugugaccaccauggccaaaaauaaaccaacucucgacauagagcugcagaagaccgaggcgacacagcuggcaacuuuacguaaacugugcauagaggggaaaaucaccaauaucacgaccgauucacgcugcccuacccagggggaagcuguuuugcccgaggaacaggaucagaacuacgugugcaagcacacguacguggaucgagggugggggaacggguguggccucuucgggaagggguccuugguuaccugcgccaaguuccagugccuggaacccaucgagggaaaggucguccaguacgagaaccucaaguauaccgugaucaucaccguccacacgggggaucagcaccagguggggaacgagacccagggagucacagccgaaaucacgccgcaggcgagcacuaccgaggcaauccugcccgaguacggcacccuaggacuagagugcucaccgcguaccgggcuggacuuuaacgagaugauccugcuuaccaugaagaacaaggccuggaugguucaccgccagugguuuuucgaccugccccugcccuggaccaguggagccaccaccgaaaccccgacguggaaucgcaaggagcuuuuagugaccuucaagaacgcccacgcaaagaagcaagaggucguggugcugggcucccaggagggcgccaugcacacugccuugaccggggcgacggaaauccagaacagcggugggacauccauuuuugccggucaccucaagugccgccugaaaauggacaagcucgaguuaaaaggcaugagcuacgcuauguguaccaacacguucguccuaaagaaggaggugucagagacccagcacgggaccauccucauaaagguagaauacaagggugaagacgucccgugcaagauccccuucuccaccgaagaugggcaaggaaaggcccacaacggccgccuuaucaccgccaacccgguggugacgaaaaaggaggagcccgugaacaucgaggccgagccgcccuucggggagagcaacaucgugaucggcauaggggacaacgcgcuaaaaaucaauugguacaagaaaggcaguucaaucgggaaaauguucgaggccacugcgcguggcgccagaagaauggccauccugggcgacaccgcgugggacuucggguccguagggggcgugcucaacagucugggcaagauggugcaccagauauucggguccgccuacaccgcccuguucagcggcguguccugggucaugaagaucggaauagguguucuccugacguggauaggcuuaaacucaaagaacaccuccaugucuuuuuccuguaucgccaucgggaucaucacauuguaccugggcgccguggugcaggcggacauggggugcguuauuaacuggaagggcaaggaauuaaaguguggcucagggaucuucguuacgaacgaggugcauacguggaccgagcaguacaaguuccaggccgauucccccaagcgccucgccaccgccaucgccggugcaugggaaaacggggucugcggaaucaggagcaccacacggauggagaaucugcucuggaagcagaucgcgaacgagcucaacuacauccugugggagaacaacauaaagcugaccgucgucgugggggacaucaucggggugcucgagcaaggcaagcgcacacugacgccccagccuauggagcugaaauacucguggaagacaugggggaaggcaaagauagucaccgccgaaacccaaaacagcuccuuuauuaucgacggcccgaacaccccggagugccccagcgugucccgggcguggaaugugugggaagucgaagacuacggguucgguguguucacgaccaacauuuggcucaaacugcgcgagguguacacccagcuuugcgaucaccggcugaugagcgccgcggugaaggacgaacgagccgugcaugcugacaugggguacuggaucgaaagccagaagaacggguccuggaaacuggagaaggcgagccuuaucgagguaaagaccuguaccuggccgaagucccacacgcucugguccaacggcguccuggaguccgauaugaucauacccaagagccuggcagggcccauaucacagcacaacuaucggccuggcuaucacacccagaccgccgggccguggcacuuaggcaagcuggaguuagauuucaacuacugugaggggacuacgguagugaucacggaaaacugcgggacgcgcggcccgagcuugcggaccacgaccguguccgggaagcugauccacgaguggugcugccgcagcugcaccuugcccccgcuccgguacaugggagaggacgggugcugguacggcauggagauccgccccaucucugaaaaggaggagaacaugguaaagagccugguguccgcgggaucggggaaggucgacaacuucacaauggggguguuaugucucgccauucuguucgaagaggugaugcgggggaaguucggcaagaagcacaugauagcggggguuuucuucacguucgugcugcuauuaucagggcagauuaccuggcgcgacauggcucacacucugaucaugaucggaucaaacgcgagcgaccggaugggaaugggggugaccuaucucgccuuaaucgccacguuuaagauucagcccuucuuggcgcuaggguucuuccuacgcaagcugacuagccgggaaaaccuccugcuuggagucggccucgccauggccacaaccuuacagcuccccgaggacaucgagcaaauggcgaacgggaucgcgcucggguugauggcccuaaagcucaucacgcaguucgaaaccuaccagcuguggacugcccuaaucagccugacgugcuccaacacgaucuucacccugaccguggccuggcgcaccgccacgcuuauacucgcggggguaucauugcugccggugugucaauccagcucgaugcggaaaaccgacuggcucccaaugaccguggccgccaugggcgugcccccucuuccgcuguuuaucuucagccucaaggacacacugaaacgacguagcuggccccucaacgagggggugauggccgugggccucguauccauccucgccuccagccugcuccggaaugacgugcccauggcaggcccucugguggccggaggccugcuuauagcuugcuaugugaucacugggaccuccgcugacuugaccguggaaaaggcagcggacgugaccugggaggaagaggcggagcagacgggagucagccacaaccugaugauuaccgucgacgaugacggcacaaugaggaucaaagacgacgagacugagaacauccuuacggugcugcucaaaacggcccuccuaauagucuccggcaucuucccguauagcauccccgccacccugcucguguggcauacuuggcagaagcaaacccagcguuccgggguacugugggauguccccagcccgccggagacgcagaaggccgaguuggaagaggggguauaucgcauuaaacagcagggcaucuucgggaagacacaggugggcgugggggugcaaaaggaaggcguguuccauaccauguggcaugucacacgaggcgcgguccucacguacaaugguaaacgccuggaaccuaacugggcaagugugaagaaggauuuaauaagcuacggaggaggguggcggcugagcgcucaguggcagaagggggaggaaguccaagugaucgccguggagcccggaaagaaccccaagaacuuccagaccaugcccggcaccuuccaaaccacgacgggcgagaucggagcgauugcccuagauuucaagccugggacaagugggagccccaucaucaaccgcgagggcaaggucgugggacuguacggcaacggggugaucaccaagaauggaggauacgucuccgguaucgcucagaccaaugcggagcccgacggccccacccccgagcuagaggaggagauguucaagaagcggaaccucaccaucauggaccugcauccagggagcggcaagacccgcaaauaccugccggccaucguccgcgaggcuaucaaacgccgccuacgcacgcugauucuagcccccaccagaguaguugccgccgagauggaggaggcccucaagggauuacccauacgcuaucaaaccacagcgacuaaauccgagcacacuggucgggagaucguggaccugaugugccacgccacauucaccaugcgacuccugagccccgugcggguuccgaacuauaaucugauuauaauggaugaggcucacuucacugaccccgcuucuaucgcugcgagaggguacauaagcacucgggugggcaugggcgaggcagcggccaucuuuaugacggcgacgccgcccgggacggccgacgccuucccgcaguccaacgcacccauacaggacgaggagcgggacauccccgagcggagcuggaacuccggcaacgaauggaucacugauuucgccgggaagaccguaugguuuguacccagcauuaaggcgggcaacgacaucgcuaacugccugcggaagaacgggaagaaggugauucagcuaucccgaaagaccuucgacacggaguaccagaagacuaaguugaacgauugggacuucgugguaaccaccgacaucuccgagaugggcgcgaacuucaaggcggaccgggucauugacccgcgccggugccucaagccgguaaucuugacugauggccccgagcgggucauccuggccgggccuaugccugugacggcggcaagugccgcccagcggaggggucgcgugggacgcaacccccagaaggagaacgaccaauacaucuuuacuggucagccccuaaacaacgacgaggaccaugcccacuggaccgaggcgaagaugcucuuagacaacaucaacaccccagaggggaucauuccggccuuauucgaacccgagcgggagaaaagugccgcuaucgacggcgaguaccgcuuaaagggcgagucccgaaagacguucgucgaacucaugcgccggggcgaucuccccguguggcuggcacacaagguugccagcgagggcaucaaauacacagaccgcaaguggugcuucgacgggcagcggaacaaccagauccuggaagagaacauggacguagagauauggacaaaggagggcgagaagaagaagcuacgcccccgguggcuggacgcccgcaccuacuccgacccgcuagcccucaaagaguuuaaggacuuugccgcuggccgcaagagcaucgccuuggaccugguaacggaaauagggcggguacccucucaccucgcccaccgaacccggaacgcccuagacaaccugguuaugcugcacaccagcgagcauggcgggaaagccuauaggcacgcgguggaagaacugcccgagaccauggagacccucuugcugcugggccucaugauccugcugaccgguggcgcaaugcuauucuugaucagcggaaagggaaucggcaagaccucuaucgggcugaucugcgucaucgccagcagcggaaugcuauggauggcagagaucccgcugcaguggaucgccagcgcgaucgugcuggaguucuucaugauggugcuccugauucccgaaccagagaaacaacggacgccccaggacaaucagcuggccuacgucgugauuggaauccucacgcuagccgccaucaucgcugcuaacgaaaugggccuccucgagaccaccaagcgcgaccugggaaugaguaaggaacccgggguugucucccccaccagcuaccucgauguggaccugcaucccgccagcgccuggacgcuauacgcgguggcgaccaccgucauaacccccaugcugcggcauacgaucgagaacuccacggcaaacgugucccucgcggcgaucgccaaccaggcggucgucuuaaugggccucgauaagggauggcccaucucgaagauggaccucggcguucccuugcuggcuuuagggugcuacagccaagucaacccccugacccugacugccgcaguuuuacuucugauaacgcacuaugccaucaucggccccggcuugcaggcgaaagcuacgcgcgaggcacagaagagaaccgccgcagggaucaugaaaaacccgaccguggacggaaucaugacgaucgaccuggaucccgugaucuacgacuccaaauuugagaagcagcugggacaggugaugcucuuggugcugugugcgguacaacuacugcugaugcguaccagcugggcccucugcgaggcucugacacuggccaccggcccuauaaccacccucugggagggcagucccggcaaauucuggaacaccacuaucgcaguaagcauggccaacaucuuccgagggaguuaccucgccggggcuggcuuagcuuuuagcaucaugaaauccgugggaaccggcaagcgaggcaccgguagucaaggagagaccuugggggagaaauggaagaagaaacugaaucaacugagccggaaggaguuugaccucuacaagaagucgggcaucaccgaaguggaccgcacagaggcuaaggagggguuaaagcguggcgaaaucacgcaccacgcugucagccgcggcuccgccaagcugcaaugguucguggagcggaacauggugauacccgagggacgugucauugaccucggcugcgggagaggcggcuggucguauuacugugcuggccugaagaagguaaccgaggugaggggcuacacaaagggaggacccgggcaugaagaacccguccccauguccaccuacgguuggaacaucguuaagcugaugagugggaaggauguguuuuaccucccgccggagaagugugacacgcuccugugcgauauuggcgagaguagccccucacccaccgucgaggaaagccggacgauccgcgugcugaagaugguggaaccauggcucaaaaacaaccaguucugcaucaagguccuuaauccguacaugcccacuguaauugagcaccuggagcgccuccaaaggaagcacggcgggaugcuggugcgcaacccccugucacggaacagcacacacgagauguacuggauuuccaauggcaccgggaacauuguggccagugugaacaugguaucccgccuccugcugaaucgguucaccaugacccaccgcagaccaacaauagagaaagacguugaucucggcgcgggcacccgccacgugaaugcagagccggagaccccaaacauggacgugauuggagaacggauuaagagaaucaaggaggagcauaacucuacuuggcacuacgacgaugagaacccguacaaaacgugggccuaccacggcucuuaugagguaaaggccaccgggucugcauccucuaugaucaacggcgucguuaagcuccucaccaaaccaugggacgucgugccaauggucacccagauggcaaugacugacaccacccccuucggacagcagcggguguuuaaggagaagguggauacccgcacaccccggagcaugcccggcacccgacgcgucauggguaucaccgccgagugguuguggcggacccuagggcggaacaaaaagccgcgccuguguacccgggaggaguucaccaagaaagugcgcaccaacgccgccaugggcgcgguguuuacugaggagaaccagugggacuccgccaaggccgcugucgaggaugaggacuucuggaaacuuguggaccgcgaacgggagcugcacaagcuggggaagugcggcaguugcguguacaauaugauggggaaacgcgagaagaagcuaggcgaguucggaaaagcgaaaggcagucgggcgaucugguauauguggcugggcgcccgcuaccuggaguucgaggcccucggauuuuugaacgaggaccacugguuuagccgugagaacucuuacagcggaguggagggugagggacugcacaagcucggauacauccugcgcgauaucucuaaaauccccggcggggcuauguaugccgacgacacggcggggugggacacccggaucacagaggaugaccugcacaacgaggaaaagauuacccaacaaauggaccccgaacaucgccaacucgccaaugcgaucuuuaagcugacguaccagaacaaaguggugaagguccaacggcccaccccuaccggcacugugauggacauaauuagccgcaaggaucagcggggcuccgggcagguagguaccuaugggcugaauacguuuaccaacauggaggcccagcucaucaggcaaauggagggcgaaggggugcuuagcaaggcugacuuagagaauccccaccucccggagaagaaaaucacccaguggcuggagacuaagggcguagagagacugaaacgcauggcgauaagcggagacgacugugugguaaagccaaucgacgaccgauucgccaacgcacuguuagcccugaacgacauggggaaggugcggaaggacauuccccaguggcagcccagcaagggcuggcacgacuggcaacaggucccguucugcucccaccacuuccacgagcucauaaugaaggacgggcggaaauuggucguaccuugcagaccccaggacgagcucaucggccgggcccgcaucagccaaggggcgggauggucccuccgagagacagccugucugggcaaggccuaugcccagauguggagccuaauguacuuucacagacgcgaccuccggcuggccuccaacgcgaucugcagcgcgguacccguccacugggugccuaccucccgcacgaccuggagcauccaugcccaucaccaauggaugacgaccgaggacaugcugaccguguggaaccgggucuggauugaagacaauccuuggauggaagacaagacccccgugacgaccugggagaacgugcccuaccugggaaagcgcgaggaccagugguguggcagccugaucggacugacaucccgagcgacuugggcgcagaauaucccgacagccauccagcaaguccgcagccucaucggcaaugaagaguuccuggacuauaugcccucgaugaaaagguuucgcaaggaggaggaguccgagggggccaucugguga

SEQ ID NO: 25953 - RNA, 9873 nt, Artificial Sequence
  derived and/or modified CDS sequence (opt11) from DENV-3__EU726768__SS-prME
accagccugugccucaugaugauccugccagcggcgcuggcguuccaccucaccagccgggacggcgagccgcggaugaucguggggaagaacgagcgcggcaagagccuacuguucaaaacugcguccgggaucaacaugugcacccucaucgcgauggaccugggcgagaugugcgacgacaccgugacguacaagugcccgcacauuacggagguggagcccgaggauaucgacuguuggugcaacuugaccuccaccugggugaccuaugggacguguaaucaagccggcgaacaccggcgcgacaagcggucagucgcucucgcgccccacgugggcauggggcuggacacccgcacccagaccuggaugagcgccgagggggcauggcgccaagucgagaagguggagacgugggcccugcgccacccgggguucaccauccuugcgcuguuccuggcccacuacauaggaacgucucucacccagaagguggugaucuucauccugcucaugcucgucaccccgagcaugacgaugcggugcguggggguggguaaccgcgacuucgucgagggcuugucuggggcuaccuggguggacgugguccuggagcacggcgguugcgucaccacgauggccaagaacaagccgacccucgacaucgagcugcagaagaccgaggccacccagcuagcaacgcuccggaagcugugcauagagggcaagauaacgaacaucaccaccgacaguaggugcccaacgcagggcgaggccgugcugccagaggagcaggaccagaacuacgucugcaaacacaccuacguagaccggggguggggcaacgggugcggcuuauuugggaagggcucacuggugaccugcgccaaguuccagugccuggagcccaucgagggcaagguggugcaguacgagaacuuaaaguacaccguuaucaucacgguccacaccggagaccagcaucaggugggcaaugagacccaaggggucaccgcggagaucacaccucaggcuagcaccaccgaggcgauccugcccgaauacggcacccugggucucgagugcucaccgcgcaccggccuugacuucaacgagaugauccugcuaacgaugaagaacaaggccuggaugguacaccggcagugguucuucgaucuuccccugcccuggaccagcggcgccaccacugagacgcccaccuggaaccgcaaggagcuccuggugacauucaaaaacgcccacgccaagaagcaggagguugugguacugggaucccaggagggcgcgaugcacaccgcccucacuggggcgacggagauccagaacagcggcgggaccagcaucuucgccggccaccugaaaugccggcugaagauggacaagcucgagcugaagggcaugucauacgccaugugcaccaacacguuuguacugaagaaggaggugucggaaacccagcacgggaccauccucauaaagguugaguacaagggcgaggaugucccgugcaagauaccguucagcaccgaggacgggcagggcaaggcgcacaauggccgccuaaucacggccaaccccgugguuaccaagaaggaggagccggucaacaucgaggcggagccgccauucggggaaagcaacaucgugauuggcaucggggacaacgcccuuaagaucaacugguacaagaagggcagcagcaucgggaagauguucgaggcgacugccagaggcgcucgccggauggcaauccugggcgacaccgccugggacuuuggcuccguaggugggguccucaacagucugggcaagauggugcaccagaucuucggguccgcauauacagcccuguucagcggcgugucgugggucaugaaaaucggcauuggggugcuacuaacguggaucggccuuaacagcaagaacacuuccaugagcuuuucguguaucguuaucgggauaauaacccucuaucuaggagccguaguccaagccgacauggggugcgugaucaacuggaagggcaaggaguuaaaguguggcucggggaucuucguuacgaacgaggugcacacguggacagagcaguacaaguuccaggccgacuccccaaagagacuggcgaccgcgaucgcgggcgccugggaaaacgggguuugcggcauccgcucgacaacccgaauggaaaaccugcuguggaagcagaucgccaacgaacucaacuacauccugugggaaaacaauaucaagcucacagucguggugggggauauaaucggaguccuggagcagggcaagcgaacccugacgccccaaccgauggaacugaaguauucauggaagaccugggggaaggcgaagauugugacugccgagacccagaacuccuccuucaucaucgacggccccaacacgcccgagugccccagcgccucccgggccuggaacgugugggagguggaggacuacggguucggcguguucaccacgaacaucuggcucaagcugcgcgagguguacacccagcugugcgaccaccggcucauguccgcggccguaaaggaugagcgcgccgugcaugccgacaugggguacuggaucgagucucaaaagaacggguccuggaaacuggagaaggccucgcugauagaggugaagaccugcacguggccuaagucccacacccucuggagcaacggcguccuggagucagacaugaucauuccaaaaucacuggcgggccccaucucccagcacaacuaccggccugguuaccacacccagaccgccggacccuggcaccucggcaagcuggagcuggacuucaacuacugugagggcacgaccguuguuaucacggaaaacugugggacccgcggccccucucuccggacuacaaccguuucuggaaagcugauacaugaguggugcugcaggagcuguacucugcccccgcuccgauacaugggcgaggacgggugcugguacggcauggagauccgccccaucuccgagaaggaggagaauauggugaagucucugguguccgccggcagcgggaaaguugacaacuucacgaugggcgugcugugccucgccauccuguucgaggaggugaugcgaggcaaguucggaaagaagcacaugaucgccggcgucuucuucacauucgugcuccuccuguccggccaaaucaccuggcgcgacauggcgcacacccugaucaugaucggcagcaacgccuccgaccggaugggcaugggcguuaccuaccucgcucugaucgcgaccuucaagauccagccuuuucuggcccuuggguucuuccugcgcaagcugaccucgagggagaaccuccugcugggugucggucucgcgauggcaaccacucugcagcugccugaggacaucgaacagauggccaaugggaucgcacucggacuaauggcguugaagcucaucacacaguucgagaccuaucagcuguggaccgcccugauaagccucacgugcuccaacaccaucuucacccuaaccguggccuggcgcacggccacccugauccucgcggggguaagccugcugccgguaugccaguccagcuccaugcggaaaacggacuggcuccccaugacaguggcggccaugggcgugccgccccucccgcuguucaucuucagccucaaggacacgcuuaagcgccgcuccuggccccugaaugaggggguuauggccgugggacucgucucgauccuggccuccucccugcuucggaacgacgugcccauggccggcccccugguggccggagggcugcucauugccugcuacgucaucaccggcaccuccgccgaccucacaguggagaaggccgccgaugugacaugggaggaggaggcggagcaaaccggggucucgcacaaccugaugauuacugucgacgaugacgggaccaugcguaucaaggacgacgagacugagaacauccugacggugcugcugaagaccgcgcucuugaucgucucagggauauucccguacagcauccccgccacucugcucguguggcacaccuggcagaaacagacgcagcguucgggcgugcugugggacguccccagcccgccugaaacccagaaagcagagcuggaggagggaguguaccgcaucaagcagcagggcaucuucggcaaaacccaggugggggucggggugcagaaggaggguguguuccacaccauguggcacguaacgcggggcgccgugcucaccuacaacgggaagcgccuggagcccaacugggcuagcgugaagaaggaccugaucucauacggagggggcuggcggcucuccgcccaguggcagaagggagaggagguccaggugauagccguggagcccggcaagaaccccaagaacuuccaaacgaugcccggcaccuuccagacgaccaccggggagaucggcgccaucgcccuggacuucaaacccggcaccagcggcagccccauaaucaaccgcgagggcaaggucgugggguuguacggcaacggggucguuacgaagaacggcggguacguguccggcaucgcccagaccaacgccgagccggacggccccacccccgaguuagaggaggaaauguucaagaagcggaaccucaccaucauggacuugcaccccggcagcgguaagacgcgcaaguaucugccggccaucgugcgggaggccaucaagcgccggcuccgcacccucauuuuggcgcccacccgggucguggccgccgagauggaggaggcccucaaggggcugcccauacgcuaccagaccacagccacuaaguccgagcacacaggcagggagaucguggacuuaaugugucacgcgacuuucacgaugcgccuccugagccccguccgggugcccaacuacaaccugaucauaauggacgaggcccauuucaccgaccccgccuccauagcggcgagaggguauaucagcacaagagucggcaugggcgaggcggccgccaucuucaugaccgccacgccaccggguaccgcggacgccuucccgcaguccaacgcccccauccaagacgaggaacgcgacauccccgagcgcagcuggaacuccggcaacgaauggauaaccgacuuugccgguaagaccgucugguucgugccgucgaucaaagccggcaacgacaucgcuaacugccuccggaagaacgggaagaaggugauccagcugucccgcaagacuuucgacacggaauaccagaagacaaaauuaaacgacugggacuuugucguaaccacggacaucucugagaugggcgccaacuuuaaggcugaccgggugaucgacccgcgcagaugccucaagcccguuauccugaccgacggccccgagcgcgugauccuggccgggcccaugccagugaccgcugcguccgccgcccagcggaggggacgggucgggcgcaauccgcagaaggagaacgaucaauauaucuuuaccggccagccgcucaacaacgacgaggaccacgcccacuggaccgaggccaagauguuacuggauaacauuaacacgcccgaggggaucaucccagcccucuucgagcccgaacgcgagaaauccgcagcaauugauggcgaguaccgccugaagggcgagucccggaagacauucguggagcugaugcgccgcggggaccucccggucugguuagcccacaagguggccagugagggcauaaaguauacggaccgcaaguggugcuucgacgggcaacggaacaaccagauccuggaggagaacauggacguggagaucuggaccaaagagggcgagaagaagaaacuucgcccccgguggcuugacgcccgcacguauagugacccgcuggcacucaaagaguucaaggacuucgcggccggaagaaagagcaucgcgcuugaccuggucacagagauagggagaguccccagccaccucgcccaccgcacccggaacgcccuggacaaucuggugaugcuccacaccagcgagcacggcgggaaggccuaucgccacgccgucgaggaacugcccgagacgauggagacccugcuacuacugggccucaugauacugcugacagggggugcgaugcuguuucugaucagcggcaaagggauaggcaagaccuccaucggccugaucugcgugauagccagcuccgggaugcucuggauggcggagauuccgcugcaauggaucgccagcgcaaucguguuagaguucuucaugaugguccuccugaucccggagcccgagaagcagcggacaccccaggacaaccaacuggcauacguagugaucgggauccucacccucgccgcgaucaucgccgccaacgagaugggccuguuagagacaaccaagagagaccugggcauguccaaggagccgggcguagugagcccuacguccuaccuggauguggaccuccaccccgcgucugccuggacucuguacgccgucgccaccaccgugaucacgccuaugcugcggcacaccauagagaacucaaccgcgaacgugucucucgcugcaaucgcgaaccaggccgucguguugaugggccuagacaaaggguggccgaucagcaagauggaccuaggcguaccccugcuggcgcucgggugcuacucacagguaaacccccuaacccugacggcagccgugcuccugcucaucacccacuacgccaucaucggcccgggccuacaggccaaggcgacgcgcgaggcgcagaagaggacugccgccggaauuaugaagaacccgacgguggacggaauaaugaccaucgaccuggaccccguuaucuacgacuccaaauucgagaagcagcugggccagguuaugcuccuggugcugugcgcgguacagcugcugcugaugcgcacuagcugggcgcucugcgaggcucugacccuggccacgggccccauuaccaccuuaugggagggcucccccgggaaguucuggaacaccacgaucgccgugagcauggcgaacauauuucggggcuccuacuuggcgggggccggccuggccuucagcauuaugaaguccgucgggacgggcaagagaggcaccgggagccaaggcgagacccucggagagaaauggaagaaaaagcugaaccagcugagccggaaggaguucgaccucuacaagaaguccgguaucacugaagucgaccgcacggaggccaaagaggggcugaagagaggugagaucacccaucacgcggugagccgcggcuccgccaagcugcaaugguucguggagcggaacauggugauaccggaagggcgcgugaucgaccugggcuguggaagaggcggguggagcuacuacugcgcgggccugaagaaggugaccgagguccgcggcuacaccaagggcgggcccgggcacgaggagccggugcccauguccacguacggcuggaacaucgucaaacugaugagcgggaaggacguuuucuaucucccgccggagaagugcgacacacugcugugcgauaucggcgagaguagccccucccccaccguagaggagagccguaccauccgcgugcuuaaaaugguagagccuuggcugaagaacaaccaauucugcaucaaggugcugaaccccuauaugcccacggugaucgagcaccuggagcgccuccagcggaagcacggcggaaugcugguccgcaacccccugucccggaacagcacccacgagauguacuggaucuccaacggcaccggaaauauaguggcuagcgugaacaugguuucccgccugcugcugaaccgguucaccaugacgcaccgccggccgaccaucgagaaagacguggaucucggcgccggcacacgucacgugaacgcagagccagagacccccaacauggacgucaucggggagcgaaucaagcgcaucaaggaggagcauaauuccacauggcauuaugacgacgagaacccguacaaaacaugggccuaccacggcucauacgaagugaaagccaccggcucggccuccuccaugaucaacggcgucgugaagcuguugacaaagccaugggacgugguccccauggugacgcaaauggccaugaccgacaccaccccauucggccagcagcgcguguucaaggaaaagguggauacccgcaccccacggagcaugcccggcacccgacggguuaugggcaucaccgcggaguggcucuggcguacacugggucggaacaaaaagccccgccuguguacgcgggaggaguucacaaagaaggugcgcaccaaugcggcuaugggcgcgguauucaccgaggagaaccagugggacuccgcgaaggccgccgucgaggacgaggacuucuggauccuuguggaccgcgagcgggagcugcacaagcuggggaagugcgggagcugcguuuacaacaugauggggaagcgcgagaagaagcucggcgaguucggcaaagccaaggggucccgggccaucugguacauguggcugggcgcgcgcuacuuagaguucgaagcccucggauuccugaacgaggaccacugguucagccgggaaaauuccuacagcggcguggagggggagggccugcacaagcugggcuauauauuaagagacauuuccaagauacccgggggcgccauguacgccgacgacacagccgggugggacacccggaucaccgaagacgaccugcauaacgaggagaaaaucacacagcagauggacccggagcaccgccagcucgccaaugcgaucuucaagcugaccuaccagaacaaaguggucaaagugcagcggccgacccccaccggcacaguuauggacaucaucagcaggaaggaccagcguggcuccggacaggugggcacguacgguuugaacaccuucaccaauauggaggcccagcucauccgccagauggagggcgagggggugcugagcaaagccgaccuggaaaacccccaccucccagaaaagaagauuacccaguggcuggaaacgaagggcgucgagaggcugaagcgcauggccaucuccggcgacgacugcgucgugaagcccauagaugaccgcuucgccaacgccuuguuagcccuuaacgacauggguaaggugcgcaaagacaucccccaguggcagcccagcaaggguuggcacgacuggcagcaggucccguucugcucccaccacuuucacgagcucaucaugaaagacggccggaagcugguggugccgugcagaccucaggacgagcugaucggccgagcccgcaucagucagggggccgguuggucccuccgggagaccgcgugucugggcaaggccuacgcccaaauguggucgcugauguacuuccaccgaagggaccuccggcuggccagcaacgcaauaugcagcgccguccccgugcacuggguaccgaccucccgcaccacguggagcauccacgcccaucaccaguggaugaccacugaggacaugcugacggucuggaaccggguauggaucgaggacaaucccuggauggaggauaagacgcccguuaccacgugggagaacguccccuaccucgggaagagggaggaccaauggugcggcagccugaucgggcugaccucucgggccacgugggcucagaacaucccgaccgcuauccaacagguccgcagcuuaaucgggaacgaagaguucuuagauuacaugcccucgaugaagcgguuucgcaaagaggaggagucugagggggccaucugguga

SEQ ID NO: 25954 - RNA, 9873 nt, Artificial Sequence
  derived and/or modified CDS sequence (opt11) from DENV-3__EU687226__SS-prME
accagccuuugccucaugaugauccugccugccgccuuagcguuccaccucacuagccgggacggcgagcccagaaugauuguggggaagaacgagcgcggcaagagccugcuguucaagacggcuuccgggaucaacaugugcacccucauagcaauggaccugggcgagaugugcgacgacaccgugaccuacaaguguccucacauaacugaaguggagcccgaggacaucgacugcuggugcaaccuaacgagcaccugggugaccuacgggacguguaaccaggcgggcgagcaccggcgcgauaagcggagcguggcccucgccccccaugugggcaugggguuagacacucgcacgcagacguggaugagcgccgagggcgccuggcggcaagucgaaaaggucgagacgugggcgcugcgccacccgggguucaccauacuagcgcuguuccuagcccacuacaucggaacgucccucacccagaaggugguuaucuuuauucugcugaugcucguuacgcccucuaugaccaugcggugcgugggggugggcaaccgcgacuucguugagggccuguccggggccaccuggguggacgugguccuugagcacggcggcugcgugaccacgauggccaagaacaaacccacccuugacauugagcugcagaagacggaggccacccagcuggcgacguugcggaagcugugcaucgagggcaagauuacaaacaucacuaccgauucgcguugccccacgcagggcgaagccgugcugccggaagagcaagaccaaaacuacgucuguaagcacaccuacguggaccggggauggggcaacggaugcggacucuucgggaagggcucccucgugaccugcgccaaguuccagugccuggagcccaucgagggcaaggucguacaguacgagaaccucaaguacaccgugaucaucacaguccauaccggggaccaacaccaagugggcaacgagacacagggggucaccgccgagaucacgccccaggccagcaccaccgaggcgauccugcccgaguacggaaccuuagggcuugaauguuccccgcgcaccggccuggacuucaacgagaugaucuugcucacgaugaagaacaaggccuggaugguacaucggcagugguucuucgaucugccccugcccuggaccagcggcgccaccaccgagacgcccacuuggaaccguaaggaguuacuggugaccuucaagaacgcccacgccaaaaagcaggaaguuguggugcuggggucccaggaaggugcaaugcauaccgcacucaccggggccaccgagauccagaacagcggcgggaccuccaucuucgccggccaccugaagugucggcugaagauggacaagcuugagcuaaagggcaugagcuacgccaugugcacgaacacguucguccucaaaaaggagguguccgagacccagcacgggaccauucucauaaaggucgaguacaagggcgaggacgugccgugcaaaaucccuuuuagcaccgaggacggccaaggcaaagcgcacaacggccgcuugaucacggccaaccccguggugaccaagaaggaggagcccgugaacaucgaggccgagccgcccuucggggagagcaacaucguuaucggcauuggugacaaugcacugaagaucaacugguacaagaagggcuccagcaucgggaagauguucgaggcgaccgcccggggcgcccgccggauggccaucuugggcgacacggccugggacuucggauccgugggcgggguucucaacagccugggaaagaugguccaccaaaucuucggguccgcguacacggcacuguuuagcggaguguccugggucaugaagaucggcauuggugucuugcugaccuggauagggcuaaacagcaagaacacauccaugagcuucagcugcaucgccaucggcaucauaacucuguaccugggcgccgugguccaggccgacauggggugugugaucaacuggaagggcaaggagcugaagugcggcagcgggaucuucgugacgaacgagguucauacuuggaccgaacaguacaaguuccaggcggacucccccaaacgccucgccaccgccaucgcuggcgccugggagaauggggugugcggcaucagaagcacgaccagaauggagaaccugcuguggaagcagaucgcgaacgagcucaacuacauacuuugggagaacaacaucaagcugaccguggucgugggggauaucaucggcguacucgagcagggcaagcgcacccugacgccccagccgauggagcugaaguacuccuggaaaaccugggggaaagccaagauugugacagcggagacccagaacagcucuuucauuaucgacggccccaacacgcccgagugccccagcgccucccgagcguggaaugugugggagguugaggacuacggguucggcguguucacuaccaacaucuggcucaagcugcgcgagguguacacccagcugugcgaccacagauugaugagcgccgccgugaaggacgagcgcgccguucacgcagacaugggauacuggaucgagagucagaagaacggguccuggaagcuggagaaggcgaguuuaaucgaagugaagacuugcacguggccgaagucccacacgcucuggagcaacggggugcuggaguccgauaugaucauccccaaguccuuagccgggcccaucucccagcauaacuaucggccuggcuaccacacccagaccgccgggccguggcaccucggcaagcuggaacuggacuucaacuacugcgagggcacgaccgucgugaucaccgagaacugcgggaccaggggccccagccugcggacgaccaccguguccgggaagcugauccacgaguggugcugcagaagcugcacccugcccccgcuccgguacaugggcgaggauggcuguugguacgggauggagauuaggcccgucuccgagaaggaggagaacauggucaagagcuuggugucggccggcagcggaaagguugacaacuucacgaugggcgugcugugccucgccauccuguucgaggaagugaugagggggaaguucggcaagaagcacaugaucgcagggguguucuucaccuucgugcugcuccuguccggccagauuacguggcgcgacauggcacauacccugaucaugaucggcagcaacgcauccgaccggaugggaaugggcgugacguacuuggcccugaucgccaccuucaagauccagccauuccuggcgcuuggguucuuccuacgcaagcugaccagccgggagaaccuccugcugggcgucggacucgccauggccacaacucugcagcugcccgaggauaucgagcagauggcgaacgggaucgcucucggccugauggcauuaaagcucauuacccaguucgagaccuaccagcuguggaccgcccuuaucagccucacgugcuccaacaccauuuucacccugaccguggccuggcgcacggcuacccuuauccucgcuggggucagcuugcuaccgguaugccaguccagcuccaugcggaagaccgacuggcuccccaugaccguggccgccauggguguuccgccccugccucuauucauuuucagccuaaaggauacccugaaacgaagaaguuggccccugaacgagggcgugauggcugugggccucgucagcauacuggccucaucacuacuccggaaugacgugcccauggcgggcccccugguggcaggaggccuccucauugccugcuacgugaucaccgggaccuccgcggaccuaaccguggagaaggccgcagaugugacgugggaggaggaggccgagcagaccggcgucagccacaaucugaugaucaccguggacgaugacgggaccaugcgcaucaaggaugacgagaccgagaacauacucaccguccugcugaagaccgcccuccugaucgucuccgguaucuucccguacagcauccccgccacccugcucguauggcacaccuggcauaagcagacgcagcggucgggcgugccaugggacguccccagcccuccggagacccagaaggccgaguuagaggaggggguguacagaaucaagcagcagggaaucuucgggaagacccaggugggcgucggagugcagaaagagggcguauuucacuccauguggcacgucacccggggcgcggugcugaccuacaacgggaagcgccucgagccaaacugggccagcguaaagaaggaccugaucuccuacggaggaggcuggcggcuaagcgcccaguggcagaagggggaggagguccaggugaucgccguggagcccggaaagaaccccaagaauuuccagaccaugcccgggaccuuccaaaccacgacuggggagauuggagcgaucgcccucgacuucaagccaggcaccagcggcuccccgaucaucaaccgcgaaggcaagguuguugggcuguacggaaacgggguggucaccaagaauggcggguacgugagcggcaucgcgcagacgaacgccgagcccgacggccccaccccagagcuugaggaggagauguucaaaaagcggaaccugaccaucauggauuugcacccgggguccggcaagacccgcaaguaccugcccgccaucgugcgggaggcgauaaagcgccggcugcgcacgcucauccuggcccccacucgggucguggccgccgagauggaggaggcccugaaggggcucccuauccgcuaccagaccaccgcgaccaagucugagcacaccggccgggagaucguggaccugaugugucacgcgacguuuacgaugcgccugcucuccccgguccgugugcccaauuacaaccugauuauuauggaugaggcacacuucacggacccugccagcaucgccgcgcgcggguacaucuccacccgggugggcaugggcgaggccgcagccaucuuuaugaccgcgacuccacccggcacggcugacgccuucccccaaagcaacgcccccauacaagacgaagagcgcgacauccccgagcgcuccuggaacagcggcaacgaguggauaacggacuucgccgggaagacgguaugguucgugcccuccaucaaggcgggcaacgacaucgccaacugccugcggaagaacgggaaaaaggugauccagcucagcaggaaaaccuucgacacggaguaccaaaagaccaagcugaacgacugggacuucgucgugaccacugauaucuccgagaugggcgccaacuucaaggccgaccgggugauagacccucgccggugccuuaaacccguaauucucacggauggccccgagcgcgugauacuggccgggccgaugcccguuaccgcggccagugccgcccagcggcgcggccgggucgggcguaacccccagaaagagaacgaccaguacaucuucaccggccagccccugaacaacgacgaggaccacgcucacuggaccgaggccaagaugcuccuggacaacaucaacaccccugaggggaucauccccgcucuguucgagcccgagagggagaaguccgccgccauagacggcgaguaccgccucaagggagaaucucggaaaacguucguagagcugaugcgccgcggggaucugcccgucuggcucgcgcauaaaguggccuccgagggcaucaaguacaccgaucgcaaauggugcuucgacggccagcggaacaaccagaucuuggaggagaacauggacguggagaucuggaccaaggagggcgagaagaagaagcugcgcccgcgguggcucgacgcccgcaccuacagcgacccccuggcccuuaaggaguucaaggacuuugccgcgggccgcaaguccauugcccucgaccuggucacugagauagggcgcgugcccucacaccuggcccacaggacccggaacgcccucgacaaccuggugaugcuccacacuagcgaacauggugggaaggccuaucgccacgcggucgaggaacucccggagaccauggagacgcugcugcuccugggccuaaugauccuccugaccggcggcgccaugcuguuccucauauccggcaaggggaucggaaagaccagcaucgggcugaucugcguaaucgccaguagcggcaugcuguggauggccgagaucccccuccaauggauagccuccgcgauuguguuagaguucuucaugaugguccugcucauaccugaacccgagaagcaacggacgccgcaggacaaccagcuugcauacguugugaucgggauccucacgcucgccgccaucaucgcugcgaacgagauggggcugcuugagacaaccaagcgcgaccugggcaugagcaaggagcccggggucgugagucccacuagcuacuuggacguggaccugcaccccgcguccgccuggacgcuauacgccgucgccaccaccguaaucacacccaugcugcgucauacgaucgaaaacagcaccgccaacgugucguuagccgcaaucgccaaccaggccgucgugcuuaugggccuggacaagggguggcccaucagcaagauggaucugggcguucccuuacuggccuuggggugcuacucccaggucaacccccucacccugaccgccgccgugcugcuccugaucacgcacuacgccaucaucggcccgggccugcaggcgaaggccacccgcgaagcccagaagcgaaccgcggccgggaucaugaagaaccccaccguggacggcaucaugacgaucgaccucgaccccgucauuuacgacagcaaguucgagaagcagcugggccaagugaugcugcuggugcugugcgcgguccaacugcuccugaugcgcaccuccugggcucugugcgaagcccucaccuuggccaccggccccaucacgacccugugggaagguagcccagggaaauucuggaacaccaccaucgcgguguccauggcaaacaucuuccggggcucguaccucgccggagccggccuggccuucagcaucaugaaauccguugggacuggcaaacgcggcaccgggagccagggcgagacgcugggggagaaguggaagaaaaagcuaaaccaacugucccgcaaggaguucgaccucuacaagaagucuggcauaaccgaggucgaccgcaccgaggcaaaagaaggguugaagagaggcgagaucacgcaccacgccguguccaggggcagcgccaagcugcagugguucguggagcggaacauggucauccccgaggggcgcgucaucgaccugggcugcgggaggggcgguugguccuacuauugcgccggccucaaaaaggugacggagguccgcggcuauacaaaggggggucccgggcacgaggagcccguuccaaugucuaccuacggcuggaacaucgugaaguuaaugucugggaaggacguauucuaccugccgcccgagaagugcgacacgcuccugugcgacauuggcgagagcucaccaagcccgaccguggaggagucccggacuauccgcgugcugaaaauggucgaacccuggcugaaaaacaaucaguucugcaucaaggugcucaacccguacaugcccaccgugaucgagcaccuggagcgccugcagcggaaacacggugggaugcucgucaggaauccguuaucacggaacucgacgcacgagauguacuggauaucaaauggcaccgggaacaucguggcgucagugaacaugguaagccgccugcuccugaaccgguucaccaugacacaccgcagacccacgaucgagaaggacguagaccugggugcgggcacccgccaugugaacgccgagcccgagacacccaacauggacgucaucggugagaggaucaagcgcaucaaggaggagcacaacaguacuuggcacuacgacgacgagaaccccuacaagacgugggccuaccauggcaguuacgaggucaaagccaccggguccgcgagcaguaugaucaauggagucgugaagcuucugacaaagcccugggauguaguccccauggucacccagauggcgaugacggacaccaccccguucggacagcagaggguguucaaggagaaggucgacacccgcacuccccgcaguaugccuggcaccagacggguuaugggcaucacagcggagugguuguggcgcacccucgggcgaaauaagaaaccccgccugugcacgcgugaggaauucacaaagaaggugcgcacuaacgccgccaugggugcagucuucaccgaggagaaccagugggauagcgccaaggccgcuguggaggacgaagacuuuuggaagcugguugaccgcgagcgggagcuccacaagcuggggaagugcggcuccugcguguacaacaugaugggcaaacgcgagaagaagcugggcgaguuuggcaaagcaaaggguagcagagcgaucugguacauguggcucggcgcucgauaccuggaguucgaggccuuaggguuccucaaugaggaucacugguucucccgggagaacagcuacucaggcguagagggcgagggccugcacaaacugggcuacauccuccgagacaucagcaagaucccaggcggggccauguacgccgaugacacugcggggugggauacccgcaucacggaggacgaccugcacaacgaggagaagaucacccagcagauggaccccgagcaccgccagcuagccaaugcgaucuucaagcucacguaccaaaauaagguggucaagguacagcgccccacccccaccgguaccgucauggacaucaucucccgcaaggaccagcgcgggagcgggcaggucggcaccuacgggcuaaacacguuuaccaacauggaggcccagcugauacgccaaauggagggagagggggugcucuccaaggccgaccuggagaacccccaucuccccgagaagaagaucacccaguggcucgagaccaagggcguggagcggcugaagcgcauggcgaucagcggcgacgacugcgucguaaagcccaucgaugaccgguucgcuaacgccuugcucgccuuaaacgacauggggaaagugcgcaaggacaucccccaguggcagccguccaaggguuggcaugauuggcagcagguaccuuucugcagccaccacuuccaugaacuaaucaugaaggacggccggaaacucguggugcccugucgcccccaagacgaacugaucggccgugcccgcaucucccagggggcuggcuggagccugcgggagacugccugucucggcaaggccuaugcccaaauguggucccugauguacuuccaccgccgcgaccugcggcucgcaucaaacgcuaucugcuccgcggucccggugcacugggugccuacgagccguaccaccuggaguauccacgcccaccaccaguggaugacgaccgaggauaugcugaccguauggaaccggguguggaucgaagauaaccccuggauggaggacaagaccccagugaccaccugggagaacgucccauaccuggggaagcgcgaggaucaguggugcggcucacucauagggcugaccagccgggccaccugggcgcaaaacaucccaacggccauccaacaaguccgcucccugauuggcaacgaagaguuccuugacuauaugccaagcaugaagcgguuccgcaaggaggaggagucugagggggccaucugguga

SEQ ID NO: 25955 - RNA, 9876 nt, Artificial Sequence
  derived and/or modified CDS sequence (opt11) from DENV-3__EU687233__SS-prME
accucgcucugccucaugaugauacugccugcugcccuggccuuccaucucaccagccgggacggggaacccaggaugauuguggggaagaaugagcgcggcaagucucugcuauucaagacggccagcgggaucaauaugugcacccucaucgccauggaccugggcgagaugugcgacgacaccgugaccuauaagugcccacacaucgccgagguggagccugaggacaucgacuguuggugcaaccugaccagcaccugggugaccuacgggacgugcaaccaggccggcgagcaccggcgcgacaagcgaagugucgcgcucgcaccccacguuggcaugggacuagacacucgcacccagaccuggaugagcgccgagggagccuggcgccagguggagaaggucgagaccugggcgcuucgccacccgggguucacgauccucgcccuguucuuagcccacuacaucggcaccucccucacgcagaaggucguuaucuucauauuacucaugcuugucaccccuagcaugaccaugcggugugugggggugggcaaccgcgacuucgucgagggccuguccggcgccaccuggguggacgugguucuggagcacggcgggugcguaaccacgauggccaagaacaagccgacgcucgacaucgaguuacagaagacugaagcgacccaacuggccacccuccggaagcugugcaucgaggguaagauuacgaacauuacaaccgauucgcgcuguccgacccagggcgaagcgguucugccggaggagcaggaccagaacuacgucugcaaacauacguauguggaccggggguggggcaacgggugcggccucuucggcaagggcucccucgugaccugugccaaguuccagugccuggagccaauugagggcaaagucguacaguacgagaaccucaaauacaccgugaucaucaccgugcacacgggggaccagcaccaaguggguaacgaaacgcagggggucaccgcggagaucacgccccaggcaagcacgaccgaggccaucuugcccgaguacggcacccugggucucgagugcuccccgcgcaccggccuggacuucaacgaaaugauccugcucacgaugaagaacaaggccuggauggugcaccggcagugguuuuucgaccugccccucccuuggaccuccggcgccacaaccgagacccccacguggaaccgaaaggagcuccuggugaccuucaagaacgcccacgcgaagaagcaagaagucguggugcugggaucccaggagggcgccaugcacaccgcccucacaggggcgacggagauccagaauagcggcgggaccuccauuuucgccggccaccugaagugccggcucaagauggacaagcucgagcugaaaggcaugagcuacgcgaugugcacgaacacuuucguccucaagaaagagguguccgagacgcagcacgggaccauucucauaaaaguggaguauaaaggcgaggacgugccgugcaagauccccuucagcaccgaggauggacagggcaaggcccacaauggacgccugaucaccgccaaccccguggugacgaagaaggaggagcccgucaacaucgaggccgagccuccuuucggggagagcaauauaguuaucggaauuggggacaacgcgcugaagaucaacugguacaagaagggcuccagcaucgguaaaauguucgaggcaaccgcccggggugcccgccgcauggccauccugggggacaccgcgugggauuucggguccgugggcgggguccucaacagccugggcaagaugguccaccagaucuuuggguccgccuacaccgcucuguucaguggaguuuccugggucaugaagaucggcaucgggguacucuuaacguggauuggcuugaacagcaagaauaccucgaugucauuuucgugcaucgccaucgggaucaucacucuuuaccuuggcgcugugguucaagcggacaccggcugcguuaucaacuggaagggcaaggagcugaagugcggcucagggaucuucgugacuaacgagguccacaccuggacugagcaauacaaguuccaggccgacuccccgaagcgccucgccaccgcaaucgcuggcgcgugggagaacggcgugugcggcauccgcucuaccaccaggauggagaaccugcuguggaagcagaucgcaaacgagcucaacuacauccugugggagaacaacaucaagcugaccguggucgugggggacaucaucggcgugcuagagcagggcaagcgcacccugacgccucagccgauggagcugaaguauagcuggaagaccugggggaaggcaaagaucgucaccgccgagacccagaacagcagcuucauaauagacggccccaacacgcccgaaugccccagcgcgucccgggccuggaacgugugggagguggaggacuacggauucggcgucuucaccaccaacaucuggcucaagcugcgcgagguuuacacgcagcugugcgaccaccggcuuaugagcgcggccgucaaggacgagagggccguucacgcagacaugggcuauuggaucgagagccagaaaaacggauccuggaaguuagagaaggcaucccuaauugaggugaagaccugcacguggcccaagucccacacccucuggagcaacggggugcuggaguccgacaugaucauucccaagagccuugccgggcccaucucccagcacaacuaucgucccggcuaucauacucagaccgccgggcccuggcaccucgggaagcuggagcuggacuucaacuacugcgagggcacgacggucguaaucaccgagaacugcgggacacggggcccaucgcuccggacgaccaccguauccgggaagcugauccacgaguggugcugccgcaguugcacccugccuccgcuccgguacaugggcgaggacgggugcugguauggaauggagauuagacccaucuccgagaaggaggaaaacauggucaaaagccuggugagcgccggcagcgggaagguggacaacuucaccaugggaguccucugccuagcgauccuguucgaggaggugaugcgggggaaguucggcaaaaagcacaugauagcagggguauucuucaccuucguccuguuacuguccggccaaaucaccuggcgggacauggcccacacccugaucaugaucggcuccaacgccucggaccggaugggcaugggugugaccuaccucgcccugaucgcgaccuucaagauccagccuuuccuagcccucggguucuuccugcgcaagcugaccucucgggagaaccucuuacugggagugggcuuggccauggcuaccacccugcagcugcccgaggacauugagcagauggcgaacgggauagcacucggccugauggcccugaagcucaucacgcaguucgagaccuaccagcuguggacagcacugauuagcuugacguguuccaacacuaucuucacccugaccgucgccuggcggacggcgacccugauccucgccggugugagccuccugccggucugccaguccucauccaugcggaaguccgacuggcuccccaugaccguggcugccaugggcgugccgccccucccgcuguucaucuucucccucaaggacacccugaagcgccgcagcuggccccugaacgagggggucauggccguagggcucgugucgauccuggcgagcuccuugcuccggaacgacgugcccauggccggcccccugguggccggaggccugcucaucgcgugcuacgugaucacggggacaagcgccgaccugaccguggagaaggcggccgacgugaccugggaggaggaggccgagcagacgggcgugucccacaaccuuaugauuaccgucgacgaugacgggacaaugcgcauaaaggacgaugagaccgagaacauccucaccgugcugcucaaaacggcccuccucauugugagcggaaucuucccguacuccauccccgccacuuuguuagucuggcacaccuggcagaagcagacccggcgcucgggcgugcugugggacgugccauccccgcccgagacgcagaaggcugagcuggaggagggggucuaccggaucaagcagcagggcaucuucgguaagacccaggugggggucgggguccagaaggagggcguguuccacaccauguggcacguaacucgcggcgccguccuuacguacaaugggaaacgguuggagcccaauugggcgagcgugaagaaagaccucaucaguuacggcgggggcuggcggcucagcgcccaguggcagaagggggaggaaguacaggugaucgcgguggagcccggcaagaaccccaagaacuuccagaccaugcccggcaccuuccagaccacaaccggggagauaggcgcuauugcccuggacuucaagcccggcaccagcggcuccccaaucaucaaccgggagggcaaggugguagggcuguacggcaauggggucguaaccaaaaacggcggguacgucaguggcaucgcccagacgaacgccgagccggauggcccgacccccgaguuggaagaggagauguucaagaagcgcaaccucaccaucauggaccugcaccccgggucaggcaagacccggaaguacuugccggccaucgugcgcgaggcaauaaagcgucgccuucggacgcugauccuggcccccacccgcguagucgccgccgagauggaggaggcgcucaaaggucuuccaauccgguaucagaccacugccaccaagucugagcacaccggccgcgagaucguggaccugaugugccacgccacuuucaccaugcgguugcugucccccgugcgcgucccgaauuacaaccucaucaucauggacgaggcccacuucaccgaccccgcuagcaucgcggcccggggguacaucuccaccagagugggcaugggcgaggccgccgcgaucuucaugacggccacgccacccgggaccgcggaugcguuuccgcagagcaacgcccccauccaggacgaggagcgagacauuccugaaagauccuggaacagcggcaacgaguggauuaccgacuuugcgggaaagaccgugugguucguaccuaguaucaaggccggcaacgacaucgccaacugccuccgcaaaaacgggaagaaggucauccagcugagccgcaagacguucgacacggaguaccaaaagaccaagcugaacgacugggacuucguagucaccaccgacaucuccgagaugggcgccaacuucaaggcugaccgcgucaucgacccgcggcgcugccucaagcccgugauccugaccgacggccccgaacgggucauucuggcgggaccuaugccgguaacagccgccagcgcugcccaacgcaggggccgcguggggcggaacccccagaaggagaacgaccaguacaucuuuaccggccagccccuaaacaacgaugaggaccaugcccacuggaccgaggccaagaugcugcuggacaacaucaacacgcccgagggaauaaucccggcacucuucgaacccgaaagggagaaguccgccgccaucgacggcgaguaccggcugaagggggagagccgcaagacguuugucgagcuaaugcggcgcggggacuugcccguguggcuggcccacaaggucgcgagcgagggcaucaaguacaccgaccggaaguggugcuucgacgggcagcgcaacaaccagauccuggaggagaacauggacguagagaucuggaccaaggagggugagaagaagaaacuccggccccgcuggcuggacgcacgcaccuauuccgacccgcuggccuuaaaggaguuuaaggacuucgcggcgggccggaaguccaucgcccuggaccucgugacggagauagggcgcguaccaagccaucucgcgcaccggacccgcaacgcccuggacaaucugguuaugcuccacaccuccgagcacggcgggaaggcguacagacacgccguggaggagcugcccgagacgauggagacgcugcuccugcugggucucaugauccugcugacagggggcgccaugcuauuccugauuuccgguaaggggaucgggaagacuagcaucgggcugaucugugucaucgccuccuccggcaugcucuggauggccgagaucccguugcaauggauugcguccgccauaguucuggaguuuuucaugaugguucuccugauccccgagcccgagaagcagcgcacgccgcaagauaaccaacuagccuacguugugaucgggauccucacguuagccgccaucaucgcggccaacgagaugggccugcucgagacaaccaagcgggaccuggggaugagcaaggagccggggguggucucccccacgagcuaccuggacguggaccuccaccccgccucugccuggacucuguacgcaguggcgaccacugucaucacccccaugcugcgccacacuaucgagaacagcaccgcgaacgugucccuagccgccauagcgaaccaagccgucguccugaugggccuggacaagggauggccuaucucgaagauggaccucggcgugcccuuacuggcccuugggugcuacagccaggugaacccccuuacccugacagccgccguccuccuacugauaacgcacuacgcgauuauaggccccggccugcaggccaaggccacccgggaagcccagaagagaaccgccgcggggaucaugaaaaacccgacaguggacggcaucaugacgaucgaucuggacccgguaaucuaugacagcaaguuugagaaacagcuggggcagguaaugcucuuagugcugugugccgugcagcuccugcugaugcggaccagcugggcccucugugaggcccugacccuggcgaccggccccaucacgacccucugggagggguccccagggaaguucuggaacaccacgaucgccgucuccauggccaacaucuuccgcggcucauaccuggccggagccggccuggcguuuuccauaaugaaguccgugggcacggguaagcgcggaaccgggagccagggcgagacucucggggagaaguggaagaagaagcugaaccagcugucccgcaaggaguucgaccucuacaaaaaguccgguaucacggagguggauagaacagaggccaaggaggggcugaagcgaggcgagaucacgcaucaugcaguaucccggggcucugccaaacugcagugguucguugagcgaaacauggugaucccagagggccgggucaucgaccucgguugcggacgcggcgggugguccuauuacugcgcgggcuuaaagaaggugaccgaggugcggggcuacaccaagggcgggcccggccacgaagaacccguccccaugaguaccuacggcuggaacauagugaagcugauguccgggaaggacguguucuaccucccgccagagaagugcgacacgcuguuaugcgacaucggcgagagcucacccucgcccaccgucgaggaguccaggaccauccgcguccugaagaugguggagccguggcucaagaacaaccaguucugcauaaagguccugaaucccuauaugcccacugugaucgagcaccuggagcggcuccagcgcaaacacggcggaauguuagugcggaaccccuugagccgcaacuccacgcaugaaauguacuggaucaguaacggcaccgggaacauugucgcguccgugaacauggugucgcggcuccugcugaaccgcuuuaccaugacccaucggcgcccgacgauagagaaggaugucgacuuaggcgcgggcacccggcacgugaacgccgagccugagacccccaacauggacguaauuggggagcgcauuaagcggaucaaggaggaacacaacuccacauggcacuacgacgacgaaaacccguacaagacgugggcauaccacggcagcuaugaggucaaggcaaccggguccgcgagcagcaugaucaauggugucgucaaguuacugacuaaacccugggaugucgugcccauggucacccagauggcgaugacugacaccacccccuucgggcaacaacgaguguucaaggaaaagguggacacccggacaccgcgcuccaugcccggcacccggcgcguaaugggcaucacugcugaguggcucuggcggacccugggacgaaacaagaagccccggcugugcacccgcgaggaguucacgaagaaggugcggaccaacgccgcgaugggcgccguguucacagaggagaaccagugggacagcgcuaaggcagccgucgaggacgaggacuucuggaagcucguggaucgggagcgcgaguuacacaagcuggggaagugcggauccugcguguacaacaugauggggaagcgggagaaaaagcucggcgaguucggcaaagcgaagggaagccgcgccaucugguacauguggcugggcgcacguuaccuggaguucgaggcucucggguuccugaacgaggaccacugguucucccgcgagaacucguauuccggcgucgagggggaaggccugcacaagcucggcuacauccugcgggauauuagcaagauccccgggggcgccauguacgcagacgacacggcggguugggacacgcgcaucaccgaggacgaccugcauaacgaagaaaagaucacccagcagauggacccggagcaccggcagcucgccaacgcuaucuucaaacugacguaccagaacaagguggugaagguccagagacccacgcccaccggcaccgugauggacaucaucuccaggaaggaccagcgcggaagcggacagguggguacuuacggccugaacacgugucacuccaacauggaggcccagcucaucaggcaaauggaaggcgagggcguccuauccaaagcggaccucgagaauccccaccucucugagaagaaaauuacccaguggcuggagacuaagggcguagaacgucugaaacggauggccauuagcggcgacgacugcguggucaagcccauugacgaccgcuucgcgaaugcacucuuggccuuaaacgacaugggaaaaguccggaaggauaucccccaguggcagcccuccaagggauggcacgacuggcagcagguccccuucugcagccaccauuuccaugagcucaucaugaaagacgggcggaagcugguagugccgugccggccccaggacgaauuaaucggccgcgcgcggauuagucagggggccggguggagccuccgcgagaccgccugccugggcaaggccuacgcgcagauguggagucuuauguauuuccaccgccgagaccucaggcuggccagcaacgccauaugcagcgccguucccguccacugggugcccacgucacggaccaccuggagcauccacgcccaccaccaguggaugacgacggaggacaugcugaccgucuggaaccgcgucuggaucgaggacaacccguggauggaggacaagacccccgugacgacgugggagaacgugcccuaccucgggaagcgcgaagaccaauggugcggcucccugaucggccugaccagccgcgcgaccugggcccaaaacaucccaacugccauccaacagguacgguccuugaucggcaacgaggaguuccuggacuacaugccgagcaugaagcgcuuucggaaggaggaggaguccgagggggcuaucugguga

SEQ ID NO: 25956 - RNA, 9873 nt, Artificial Sequence
  derived and/or modified CDS sequence (opt11) from DENV-3__EU687234__SS-prME
accagucugugccucaugaugauucuacccgcggcgcuggcauuccaucucaccagccgagacggggagccccggaugauuguggguaaaaacgaacggggcaagucccuguuguucaagacagccagcggcaucaacaugugcacccucauugcuauggaccugggcgaaaugugugaugacaccgugaccuacaaguguccccacaucacugagguggagccugaggauauagacugcugguguaaccugaccagcacgugggugaccuacgguacgugcaaccaggccggcgagcaccgacgcgauaagcggucagucgccuuagcgccccacgugggaaugggauuagauacccgcacccaaaccuggaugagcgccgagggcgccuggaggcagguggagaagguggagacgugggcccuacgccauccuggcuucaccauacuagcgcuuuuccuggcccacuacaucggcaccucccucacccagaagguggugaucuucauccucuugaugcucgucacgcccagcaugacgaugcguugcguggggguggguaaccgcgacuucguagagggacuguccggggccaccugggucgaugugguccuggaacacggcgggugcgugacaacgauggccaagaacaagccgacccucgacaucgagcuacaaaagaccgaagcuacccagcuagcgacgcuccggaaauuaugcaucgagggcaagaucacuaacaucacaacggacagccgcugcccgacgcagggcgaagccgugcuuccggaggagcaggaccagaacuacgucugcaagcauaccuacguugaccggggguggggcaacgggugcggucuuuucggcaaggggucccuggugaccugcgcuaaguuccaaugccuggagcccauagagggcaaggucgugcaguaugaaaaccucaaauacacggugaucaucacgguccacacaggggaccagcaccaggugggcaacgagacacaggggguaaccgccgagauuacgccccaagccagcaccacagaggcgauuuuaccggaguacgguacccuggggcucgagugcucuccgcgcacgggucuugauuuuaaugagaugauccuguugacgaugaagaauaaggccuggaugguacaccgacagugguucuucgaccugccucugcccuggaccagcggcgccacgacggagacgcccacuuggaaccgcaaggagcuccucgugaccuucaagaacgcccacgccaaaaagcaggaggucgugguucuggggucccaagagggcgcgaugcacaccgcccuaacgggugcaaccgaaauacagaacagcggagggaccuccauauucgccggccauuuaaagugccggcugaaaauggacaagcucgagcuuaagggcaugagcuaugccauguguaccaacaccuucguccuaaagaaggagguauccgagacucagcacgggacaauccucauuaaaguugaguacaaaggggaggacgucccauguaaggugccguucaguaccgaggacgggcaggggaaagcacauagcggccgguugaucacggccaaccccguagucacgaagaaggaggagcccgugaacaucgaggccgagccccccuucggggagaguaacaucgugaucggcauuggagacaacgcccucaagaucaacugguacaagaagggaucuucaaucgggaagauguucgaagcaacggcccggggcgcccgacgcauggcuauccuaggggacacggccugggacuucgggagcgugggcggggugcucaacucccuggggaagauggugcaucaaaucuucgggagcgcguacacggcauuauucagcggggucagcugggugaugaaaaucggcaucggggugcuccugaccuggauaggucugaacuccaagaacaccagcauguccuucagcuguaucgucauugggaucaucacgcuuuaccugggcgccguggugcaggcggauauggggugcgucaucaacuggaagggaaaggagcugaagugcggcuccgggaucuucgugacgaaugagguucacaccuggacugagcaguauaaguuccaggccgacuccccaaaaagacucgccaccgccaucgccggugcuugggaaaacggugucugcggaauacgcuccaccacccggauggagaaccuacuuuggaaacaaaucgccaacgagcucaacuauauccugugggagaacaauaucaagcugacagugguggucggagauaucaucggcguucucgagcaaggcaagcgcaccuugacaccucagccgauggagcugaaguacagcuggaagaccugggggaaggcgaagaucgugaccgcugagacucaaaauuccuccuucaucaucgacgggcccaauacgcccgaaugccccuccgccucucgggccuggaauguaugggagguagaagacuacggguucggcguguucaccaccaacaucuggcucaagcugcgcgagguuuacacccaacugugugaccaccggcucaugagcgcggccguuaaggacgagcgcgccgugcacgccgacaugggguacuggaucgagucccaaaagaauggguccuggaaguuagagaaagccucucucauugaagugaagaccuguacguggcccaaaagucacaccuuaugguccaacggcgugcucgagagcgacaugaucaucccuaagucgcuugcugggcccauuagccagcacaacuaccggccgggcuaccacacacagacggcugggccguggcaucucgguaaauuggagcuggauuuuaauuacugcgagggaacaaccgucgucauaaccgagaacugcgggacccgaggucccucgcuccggacuacuacggucagcgggaagcugauucacgaguggugcugccgcaguugcacauugcccccgcucagguacaugggcgaggaugguugcugguacggcauggagauccgccccaucucugagaaggaggaaaauauggugaaauccuuggucagcgccggcagcgggaagguagauaacuucacgaugggcgugcuaugccucgccauccuguucgaggaggucaugcggggaaaguucggcaagaagcacaugauagccgggguguucuucacuuucgugcuucuccugagcggccagaucaccuggcgcgacauggcacacacccugauuaugaucggcucaaaugccagcgaccgaauggggaugggcguuacguaucucgcccucaucgccaccuuuaagauccagccauuccuagcccucggcuuuuuuuugcgcaagcugaccucacgggagaauuugcugcugggcguaggcuuagcgauggcaaccacgcugcagcugccugaagacaucgagcaaauggccaacggcaucgcccucggccugauggcgcugaagcuaauaacccaguucgagaccuaccagcuguggaccgcccugaucucgcucacgugcagcaacacaaucuucacccuuaccgucgccuggaggacugccaccuuaauccucgccggggucucccuacuuccggucugccaaagcuccagcaugcggaaaaccgacuggcugcccaugaccgucgcugccaugggagugccgccgcucccgcuguuuaucuucuccuugaaagacacgcugaaaagacgcucuuggccccugaacgagggcgugauggccguaggccucguguccauccuggccucgucccugcuccggaacgacgugcccauggcaggcccccuggucgccggcgggcugcucaucgccuguuacgucauuacugggaccagugccgaccugaccguugagaaggcggccgacgucacuugggaggaggaggcggagcagaccgggguaagucauaaccugaugaucaccguggacgacgauggcaccaugcgaaucaaagacgaugagaccgagaacauccucacgguccugcugaagacugcucucuuaaucgugagcggcaucuucccguacuccauccccgccaccuugcucguauggcacaccuggcaaaagcaaacucagcgguccggcgucuuaugggacgugcccagcccacccgaaacccagaaggccgagcuggaggaaggaguauaccguauaaagcaacaaggcauauucgggaagacccaggucggcguugggguccagaaggagggcgucuuucauacuauguggcacgugacgcgaggcgcaguccucacguacaacgggaagagacuggagccgaauugggcgagugucaagaaggaucugaucuccuacggcgggggauggcggcucagcgcccaauggcagaaaggggaagagguccaggucauugcaguagagccaggcaagaaccccaagaacuuucagaccaugcccgggacuuuccaaacgaccacgggggagaucggcgccaucgccuuagauuucaagcccgggacaaguggcuccccaaucaucaaucgagagggaaagguugugggccuguacggcaacggugucgugacgaagaacgggggguauguaagcgguauugcccagacgaacgcugaaccggacgggccgacccccgaguuggaggaggagauguucaaaaaacgaaaccucacgaucauggaccuucaccccgggagcgggaagacgaggaaguaccugccggccaucguccgggaagcuaucaagcgccgccuccgcacccuaaucuuggcacccacccggguuguggccgccgagauggaggaggcgcucaaggggcuaccaauccgcuaccagaccacugcuaccaagagcgaacacaccggccgggaaauuguagaccugaugugccacgcuacuuucacgaugcgccuccuguccccgguacgggugccgaacuacaaccugaucaucauggacgaggcucacuucaccgaccccgcuagcauugccgcccgcggguacaucuccacacgcguuggcaugggcgaggcagcugcuaucuucaugacggcuacgccgcccgggaccgcggacgccuucccgcaguccaaugcacccauccaagacgaagagcgcgacauccccgagaggucguggaauagcggcaaugaauggaucacagacuucgcagggaagaccgugugguucgugcccuccaucaaggccggcaacgacauagcgaacugccugcguaagaacgggaagaaggucauccagcuuagucgaaagacguucgacaccgaguaucagaaaaccaagcugaacgacugggacuucguggugacaaccgacauuucugaaaugggagcaaacuucaaggcagauagagucauagacccgcgcagaugccucaagcccguaauccugacggacggccccgagcgcgugauacuggcggggcccaugccggucaccgccgcgucugcggcccagcggcggggccggguggguaggaacccccagaaggagaacgaucaauacaucuucaccggccagccccucaacaacgacgaggaccacgcccacuggaccgaggcaaaaaugcuucuggauaauaucaacacgccugaggguaucaucccggccuuauucgagcccgagcgggaaaaguccgccgccaucgacggagaguaccgcuugaaaggggagagccggaagacguucguugagcugaugcgcagaggggaccuccccguguggcuggcucauaagguggcauccgagggcauaaaguacaccgaccgcaaguggugcuucgacgggcagagaaauaaccagauccuggaggaaaacauggacguggagaucuggaccaaggagggcgaaaagaaaaagcuccgcccccggugguuggacgcgcgcacguacucggauccgcuggcgcucaaagaguucaaggacuuugcugccggccgaaaguccauagccuuggaucugguuaccgagaucggacgcgugcccagccaucucgcccaucgcacccgaaacgcgcuggauaaccuggucaugcuccacaccagcgagcacggcgggcgcgccuaccggcacgccgucgaggagcugcccgagacgauggagacccuucuacugcucggccucaugauccugcuaaccgggggcgcgaugcuguucuuaauaucugggaaggggaucggcaagaccagcauaggacugauuugugugaucgccuccagcgggaugcucuggauggcagagaucccuuugcaguggaucgcaucggccaucguccucgaauucuucaugaugguguuacugauccccgaacccgagaagcagcguaccccccaggacaaccagcuggcguacguggucauaggaauccucaccuuagcagccaucaucgccgcuaacgagauggggcuacuggagacuaccaagcgggaccugggcaugagcaaggaaccgggcgugguguccccuacgaguuaccuggaugucgaccuucaccccgcgagugccuggacgcuguacgcagucgcgaccaccgugaucacacccaugcugcgccacaccauagaaaacagcaccgccaacguuagccucgccgccauagccaaccaggccguggugcugaugggcuuagacaagggcuggccgauuagcaagauggacuugggcgugccccugcuggcgcuagggugcuacucccagguaaacccccuaacccugacggccgcggugcuccugcuuaucacccacuacgccaucaucggacccggacuccaggcgaaagcgacccgggaggcccagaagagaaccgcagcugggaucaugaagaacccuacagucgacggcaucaugaccaucgaccuagaccccguuauuuacgacucgaaguuugagaagcagcuuggccaggugaugcuccugguucuaugugcagugcagcuccuccugaugcggacaucaugggcacugugcgaggccuuaaccuuagcaacgggccccaucaccacacugugggaaggaagccccgggaaguucuggaauaccacuaucgcaguguccauggcgaacaucuucagggguagcuaccuggcaggcgccggguuagccuucuccauaaugaaguccguuggcacaggcaagcggggcaccggcagccaaggcgagacgcucggggaaaaguggaagaagaagcugaaccagcugucccgcaaggaguucgaccuguauaagaaaucuggcauaacugagguggaccgaacugaagccaaggaggggcugaaaaggggcgagauuacccaccacgcggugucccgugggagcgcgaaguugcagugguucgucgagcgcaacauggugaucccggaaggccgugugaucgaccucggcugugggcgaggcggcugguccuauuacugcgcaggccuaaagaaggucaccgagguucggggcuauaccaagggcggccccggacacgaggagccggugcccaugucuacguacggcuggaacaucgucaaacugauguccgggaaggacguguucuacuugccuccggaaaagugcgacacccugcugugugacauaggggaguccucccccagccccacgguugaggaguccagaaccauccgcguccugaaaauggucgaaccguggcucaagaacaaccaguucugcaucaaggugcuaaaucccuauaugcccacggucauagagcaucuggagcggcuccaacgcaagcacggcggcauguuggugcggaacccccugagcagaaacuccacccacgagauguacuggauaagcaacggaacuggaaauaucguggcuuccgucaacauggugagccggcuccugcuaaacagguucaccaugacgcaucggagaccgacuaucgaaaaggacgucgacuugggcgccggcacucggcacgugaacgcggagcccgagacgcccaacauggacguaaucggcgaacgcaucaagcgcaucaaggaggagcacaacucuacguggcacuacgacgaugagaauccguacaagaccugggccuaccauggcagcuacgaggugaaggcgacggggucugccagcagcaugaucaacggaguggugaagcugcugaccaagccgugggauguaguacccauggugacacagauggcaaugaccgacaccacacccuucgggcagcagcgggucuucaaagagaaggucgauacgcggaccccuagauccaugccgggcacccgacgcgugaugggcaucaccgcagaguggcucuggcggacgcuggggcgcaacaagaaaccgagguugugcacuagagaggaguucaccaagaaaguccgcacaaacgcugccaugggcgcaguguucaccgaggagaaccagugggacagcgcgaaggccgccguugaggacgaggacuucuggauccuugucgauagagaacgcgagcugcacaaacuggggaagugugguuccugcguguacaacaugaugggaaagcgggagaagaagcucggggaguucggcaaggcgaaggguagccgcgcgaucugguauauguggcugggcgcccgguaccuggaguuugaagcccucggguuccugaacgaggaucauugguucucccgcgagaacagcuacuccggaguggagggggagggccugcacaagcucggcuauauauugagggacaucucuaagaucccugggggcgcgauguacgccgacgacaccgcgggcugggauaccagaaucaccgaggacgaccuccacaaugaggagaagaucacccagcagauggacccagagcaccggcagcucgccuccgcuaucuuuaaguuaaccuaccagaauaaagucgugaaggugcagcgccccaccccgaccggcaccguuauggauaucaucucacguaaagaccagcggggguccggccaggugggcacguacggguuaaacaccuucaccaacauggaggcacaacugauccggcaaauggagggggagggggugcugagcaaggcugaucuggaaaacccgcaccucccggagaaaaagaucacucaguggcuggaaacaaagggcgucgagcgacugaagcguauggcuaucaguggugacgacugcguggugaagccaauugaugaucguuucgcgaacgcccuccuggcccugaacgacauggggaagguucggaaagauaucccucaguggcagccgagcaagggcuggcacgauuggcaacaggugccguucugcucccaccacuuccaugaguugaucaugaaggaugggcgaaaacugguuguucccugucggccccaggaugaacugaucggacgggcacggauuagccaaggggcgggcuggucucuucgcgagaccgcgugccugggcaaagcguaugcucagauguggagucucauguacuuccaccgccgggaucucagacuggccaguaaugcgaucuguucagcugugcccgugcacuggguuccuaccagccggaccaccugguccauccacgcucaccaucaguggaugacaaccgaggacaugcucacaguuuggaaccgcguguggaucgaggacaacccauggauggaagacaagacgcccgucacuaccugggagaauguacccuaccucgggaagcgggaagaucaguggugcggcagccugaucgggcugaccucacgcgccacgugggcccagaacaucccgacagcgauccagcaaguccguagccucauagguaaugaggaauuucuggacuacaugccuuccaugaaacgcuucagaaaagaagaggagagcgaaggggcgaucugguga

SEQ ID NO: 25957 - RNA, 9873 nt, Artificial Sequence
  derived and/or modified CDS sequence (opt11) from DENV-3__EU687196__SS-prME
accagccucugccucaugaugauucugcccgccgcccuggcguuccaccucaccagccgggacggcgagccccgaaugauaguggggaaaaacgaacgcggcaaaagucugcuguucaagacggccuccgggaucaacaugugcaccuuaaucgccauggaccuuggggagaugugugacgacaccgugaccuacaagugcccccacauuacagagguggaacccgaagauauugacugcuggugcaacuugaccucgaccuggguuacuuacggaacuugcaaccaggcgggcgagcaccggcgcgacaagcggucgguggcccucgcgccccacgugggcauggggcuggacaccaggacacagaccuggaugucggccgagggcgccuggcggcaggucgagaaaguggagacgugggcccugcgccauccgggcuucaccauacucgcgcuguuucuggcgcacuauaucgggacuuccuugacacagaagguggugaucuucauccugcugaugcucgugacgcccagcaugacuaugcggugcguuggggugggaaaccgggauuucgucgagggccuguccggggccacguggguggacgugguccuggaacauggcgggugcgucaccacgauggccaagaacaagcccacucucgacaucgagcuacagaagaccgaggccacccagcuggcgacccugagaaagcucugcauagagggcaagaucaccaacaucaccaccgacagccgcugccccacacagggcgaggcugugcugccggaagaacaggaccagaacuauguuugcaaacacaccuacguggaccgggguuggggcaacgggugcggacucuucggaaaggggucccuggugacuugugcgaaauuccagugccuggagcccauugagggcaaagucgugcaguacgagaacuugaaguacaccgugaucaucacgguccacacuggggaccagcaccaggugggcaacgagacgcagggggucacggccgagaucacgccgcaggccaguacgaccgaggcgaucuuaccugaguacggcacccucgggcuagaaugcucaccucgaaccggccuggauuucaaugaaaugauccugcucacgaugaaaaacaaggcuuggauggugcaccggcaaugguucuucgaucucccccugcccuggaccagcggagccaccaccgagacgcccaccuggaaucgcaaggagcuccuggugaccuucaagaacgcccacgccaagaagcaggaggucguggugcuggggucccaggagggcgcgaugcacaccgcccucacgggggcaaccgaaauccagaacagcggcgggacgucaaucuuugccggccaccugaagugcagacugaagauggacaagcucgagcugaagggcaugagcuacgcaauguguaccaacacguucguacucaagaaggagguguccgagacccagcacgguacgauccucaucaagguggaauacaagggcgaggacgucccgugcaagauucccuucucaaccgaggaugggcagggaaaagcgcacaacggccggcugaucacggcaaauccuguggugaccaagaaagaagaacccgucaacauagaagccgagccgccguuuggggagucgaauauuguuauaggcauuggggauaacgcccugaaaaucaacugguauaagaagggaucuucuaucgggaagauguucgaggcgaccgcccggggcgcacgcagaauggccauccugggcgauaccgccugggacuucggguccgugggaggggucuugaacucacuggggaaaauggugcaucaaaucuucggguccgcguacacagcccuguucaguggcguguccugggugaugaaaauaggcaucggcguuuugcuuacuuggaucggccuaaauuccaaaaacaccuccaugagcuuuuccuguauagccaucggaaucaucacucucuaccugggagcgguuguacaggcggacauggggugugugaucaacuggaaaggcaaggagcugaagugcggcagcggaaucuucgugacgaaugagguacacaccuggaccgagcaauacaaguuccaggcugacucccccaagcggcucgcgaccgccaucgccggcgccugggagaacggggugugcggcauacggagcacgacccggauggaaaaucugcucuggaagcaaaucgcuaacgagcucaacuauauucugugggagaacaacauaaaguuaaccguggucgugggcgacaccaucggcgugcucgagcagggcaagaggacgcugacgccccagcccauggagcugaaguacuccuggaagaccugggguaaggccaagaucgucaccgccgaaacucagaacucuuccuucaucaucgacggcccuaacacgcccgagugccccagcgccucccgggcguggaaugugugggagguggaagacuacggguucggcgucuucacuaccaacaucuggcucaagcugcgggaggucuauacccagcugugcgaccaucggcucaugagcgccgccgugaaggacgagcgcgccguccacgcagacaugggcuauuggauugagucccagaagaacggguccuggaagcuggagaaggcgagccuaaucgaggugaagacgugcacauggccgaagucccacacccucuggaguaacggcgugcuagaguccgacaugaucauccccaagagccucgccgggcccaucucucaacauaacuaucggccgggcuaccacacgcagacggccggccccuggcaccuugguaaacucgagcuggacuucaacuacugugagggcacgaccgucgucauaaccgagaacugcgguacgcguggucccucacuccggaccaccacggugucgggaaagcugauucacgaguggugcugccgcagcugcacgcugccaccccugcgguacaugggcgaagacggaugcugguacggaauggagauccgccccaucuccgagaaggaggaaaauauggucaaaucgcuggucuccgccggcagugggaagguggacaacuucaccaugggaguccugugccuggccauccuguucgaggagguuaugcgggggaaguucggcaaaaagcacaugaucgcgggggugaucuucacuuucguccugcuccugucaggccagaucaccuggcgcgacguggcucacacguugauuaugaucggcagcaacgccuccgaccggauggggaugggggucaccuaccucgcccugauagcaaccuucaagauccagccuuuccuugcgcucggguucuuccuccgcaagcugaccagccgggagaacuugcuacugggagucgggcucgcuauggcuacgacccugcaacuccccgaggacaucgagcagauggccaacgguaucgcgcucgggcugauggccuugaagcucaccacccaguucgagacguaucagcucuggaccgcccugauaagccugaccugcuccaacaccauuuuuacgcucaccguggccuggcgaaccgcuacgcugaucuuggcgggagucagccugcugcccgugugccaaagcagcucgaugcggaagacggacuggcuucccaugaccguggccgccaugggagugccgccccucccacucuucauauucagccucaaggauacccugaaacgccgguccuggccccugaacgagggagucauggccgugggucucguuagcauccuagccuccagccuguuacguaacgacgugcccauggcgggaccucugguggccgggggcuuacucaucgccuguuacgucaucacgggcacuucagccgaccugaccguugagaaggccgcggacgugacaugggaagaggaggccgagcagacaggcgucagccauaaucugaugauuacuguggacgacgacggcacuaugcgcauuaaggacgacgaaaccgaaaacaucuugacugugcuuuuaaagaccgcccuucuaaucgucuccggcaucuucccuuacagcaucccugcuacgcuacucguguggcacacguggcagaagcagacccagcgguccgggguucugugggauguccccagcccacccgagacgcagaaggccgagcuggaggaggguguuuaccgcaucaagcagcagggcauauucggcaagacgcaagugggcgucgggguucagaaggagggcguguuccacacaauguggcacguuaccagaggggcgguguuaacguacaacggaaagagguuagaacccaacugggccuccgugaagaaggaccuaauuagcuacggugggggcuggcguuuauccgcucaguggcagaagggggaggaaguccaaguuaucgccguggagcccgguaagaacccuaagaacuuccaaacgaugcccggcaucuuccagacaaccacgggggagaucggcgcaaucgcccuggacuucaagcccgggacgagcggcagccccaucauuaacagggagggaaagguagugggguuauauggcaacgggguggucaccaagaauggcggguacguauccgggaucgcccagacaaacgccgaaccggacggccccacccccgagcuugaagaggaaauguucaagaagaggaaccucacuauaauggaccuccacccugguagcggcaaaacccgcaaguaccuccccgccauagugcgggaggcuaucaagcgccggcuccguacccugauccuggcccccacucgggucguggccgcggaaauggaggaagcacucaaggggcugccuauucgcuaccaaaccacagcgaccaaguccgaacacacggggcgggaaaucguggaucugaugugccacgcaacguucaccaugcgccuccugucgcccguccgggugccgaacuacaaccugaucaucauggacgaggcccacuuuaccgaccccgccuccaucgccgcgcgcggauacauuagcacccgggugggcaugggcgaagcggccgcgaucuucaugacggccacgcccccagggaccgccgacgccuucccgcaguccaacgccccuauccaggacgaagaacgcgacauccccgagcgcagcuggaacuccggcaacgaguggauaaccgacuuugccgguaagacgguaugguucgugcccucgaucaaggcgggcaacgacaucgccaacugccuccggaaaaacgggaagaaggugauccagcugucccgcaagaccuuugauacagaguaccagaagaccaagcugaacgacugggacuucguagugacgacggauaucucugagaugggcgcgaauuucaaggcagaccggguaauagacccgcgccggugccucaaacccguuauccugacagacggcccagagcgcgugaucuuagccgggccaaugcccgucacagcggccuccgcagcacaacgacgcggccgaguuggucgcaauccacaaaaggagaaugaccaguacaucuucacaggccagccccucaacaacgacgaagaccacgcacacuggaccgaagcuaagauguugcuggacaacaucaacacccccgaagggaucauucccgcccucuucgagccggaacgggaaaaguccgccgccauugacggagaguaccgcuugaagggcgagucucggaagaccuucguggaacugaugcgccgcggggaccuccccgucuggcuggcgcacaagguggccucggaggguauuaaguacaccgaccgaaaguggugcuucgaugggcagcggaauaaccagauccuggaggagaacauggacguggagaucuggacgaaggagggagagaagaagaaacuccgcccacgguggcuagacgcccgcaccuacucagacccccuggcccucaaagaguucaaggacuucgccgcgggacgcaagagcaucgcucuggacuuagucaccgagaucggacgcguucccucccaccucgcccauagaacccggaacgccuuggacaaucuagugaugcuccacaugagcgagcacggaggcaaggccuaccgccacgcggucgaagaacugcccgaaacgauggagacccugcuccugcuaggccucaugauccucuuaaccgggggcgccaugcuauuccugaucagcggcaaagggauaggcaagaccuccaucgggcugaucugcgugaucgccaguuccggcauguuguggauggccgagaucccgcugcaauggaucgcuagugcgaucgugcuggaguucuucaugaugguccugcugaucccagaacccgagaagcagcggacaccccaggacaaccagcucgcguacguggugauaggcauccucacccuugcagccaucaucgccgcgaacgagaugggccugcucgagaccacaaagcgcgauuugggcauguccaaggaaccgggugucgugagucccaccuccuaccuggacguggaccuccaccccgccagcgccuggacccuguacgcugucgcgacuaccgugaucacccccauguugcggcacacuaucgagaacucaacugccaacgucagcuuagccgccaucgccaaccaagccgucgugcugaugggccuggacaagggguggccgaucuccaaaauggaccucggcgucccacugcuggcccucgguuguuacucacaggucaacccucucaccuuaacggccgccgugcuccugcugaucacccacuacgcgaucaucggccccggauugcaggcgaaagccacccgcgaggcccagaaacgcaccgccgccgggauuaugaagaacccgacgguggacggcauaaugaccaucgaccuggaccccgucaucuaugacucaaaguuugagaagcagcugggccaggugauguugcugguguugugcgcgguccagcuccuccugaugcgcacuagcugggcccucugcgaggccuuaacccuggccaccgggccaaucaccacccucugggagggcucccccgggaaguuuuggaacacgacgaucgcggugucaauggccaacaucuuucggggcuccuaucuggccggggccggccuggcuuucagcaucaugaagucuguggggaccggcaagcgcggcaccggaucccagggcgagacccucggagaaaaguggaaaaagaagcugaaccagcugagccgaaaggaguucgaccucuauaagaagagugguaucacagaagucgaccgcacggaagcgaaagaggggcugaagcgaggcgagaucacgcaccacgccgugagccgcggcuccgccaagcugcagugguucguggagcggaacauggucaucccggagggucgggugaucgaccucggcugcgggaggggcggguggagcuacuacugcgccggcuugaagaaggugacagaagucagagguuacaccaagggcgggcccggucacgaagaacccgugccuauguccacguacggcuggaacauugugaagcugaugagcgguaaggaugucuucuaccucccgcccgagaaaugugacacccuguugugcgacaucggggagucgagcccuuccccgaccguggaggagagucggaccguucgcguccugaagauggucgagccuuggcucaagaacaaccaauucugcaucaagguucugaaccccuacaugcccacggucaucgagcaccuggaaaggcuccaacggaagcacggcggcauguuggugcgcaacccccuaucaaggaacagcacccacgaaauguacuggauuucgaacggcaccgggaacauuguggccagcgugaacauggucucccggcuccugcuaaaucgguuuaccaugacgcacaggcguccgaccaucgaaaaggauguggaccucggcgcgggaacccgccauguaaacgcagagcccgagacacccaacauggacgugaucggggaacggaucaagcgcaucaaagaggaacacaucagcacauggcacuaugacgacgagaauccguacaagaccugggcuuaccaugguuccuacgaggucaaagccaccgggagcgcaagcaguaugaucaacggaguggugaagcugcugaccaagcccugggaugucgugcccauggugacccagauggcgaugaccgauaccacccccuucgggcagcagcgggucuucaaggaaaaaguggauacgcgcacuccacgcagcaugcccggcacgcgacgggugauggguauaacggccgaguggcucuggcgcacgcuggggaggaacaagaagccccgucugugcacccgggaggaguucaccaaaaagguccgcaccaacgccgcuaugggcgcggucuucacggaggagaaccagugggauucggcaaaggccgccguugaggacgaggacuucuggaagcucgucgaccgcgagcgcgagcugcacaaauuagggaaguguggcagcuguguguacaauaugauggguaaacgcgagaaaaagcucggcgaguuugguaaagccaaaggaucccgggcgaucugguacauguggcugggcgccagauaccuggaguucgaggcccucggguuccuuaacgaagaccacugguuuagccgggagaacucauacagcggcguggagggggagggucugcauaagcucgguuacauccugcgcgacaucuccaagauccccgggggcgccauguacgccgacgacaccgcggggugggacacacggaucaccgaggacgaccugcacaaugaggagaagaucacgcagcaaauggauccggagcaccgccaguuggccaacgcaaucuuuaaacugaccuaccaaaacaaggucguaaaggugcagcggccgacccccacaggaaccguaauggauauaaucucccgcaaagaccagaggggcuccggccaaguaggcacguacggguugaacacuuucaccaacauggaggcccagcucauccgccagauggagggcgaggguguccugucgaaggccgaucuugagaacccccacuuaccggagaagaagaucacccaguggcuggagacgaaaggcgucgagcggcugaagaggauggcgaucuccggggacgauugcgucguaaagcccaucgacgaccgguucgcaaacgcccugcuggcccugaacgauauggggaagguucgcaaagacauuccccaguggcagccaagcaagggcuggcacgacuggcagcagguccccuucugcucccaccacuuccacgaacucaucaugaaggacgggagaaagcugguggugccaugcagaccccaggacgagcugaucggccgcgcacgcauuagccagggugcaggcuggaguuuccgagagaccgccugccucggcaaagccuaugcccaaauguggagccugauguacuuccaucgacgggauuuacggcucgcguccaaugccaucugcagcgccgugcccgugcacuggguaccgaccucccguacaacguggaguauacacgcgcaccaccaguggaugaccaccgaggacaugcuaaccguguggaaccggguguggaucgaggacaaccccuggauggaggacaagaccccggucacaaccugggagaacgugcccuacuuagggaagcgagaggaccaaugguguggaagccucaucgggcugacauccagagccacgugggcucaaaacaucccaaccgccauccagcagguccggagccugaucggcaaugaagaguuucuagacuauaugcccuccaugaaacgguuccgcaaagaggaggagagcgagggcgccaucugguga

SEQ ID NO: 25958 - RNA, 9873 nt, Artificial Sequence
  derived and/or modified CDS sequence (opt11) from DENV-3__EU854298__SS-prME
accucgcuaugccuaaugaugauccugcccgccgcacuagcauuccaccucaccagccgggauggagagccgaggaugauuguggggaagaacgaacggggcaagucuuugcuguuuaaaaccgccagcgggaucaacaugugcacccucauugccauggaccugggcgagaugugcgacgacaccgucaccuacaaguguccgcauauaacggaggucgaacccgaagacaucgacuguuggugcaaccugaccagcacauggguuacguaugggacuugcaaccaggcuggcgagcaccgaagagauaaacggagugucgcccucgcgccccacgugggcauggggcuggacacccgcacccaaaccuggaugagugccgaaggcgccuggcgccaaguugagaagguggagacgugggcgcugagacacccgggguuuaccauucucgcucuguuucuggcucacuacaucgggaccucguuaacccagaaggucgugaucuuuauccuacucaugcucgucacgcccagcaugaccaugcggugcguggggguggggaaucgcgacuucgucgaaggccuguccggggcgaccugggucgacgugguccuggagcacggcgggugcgucacuacgauggccaagaacaagccgacccucgauaucgagcuacagaagaccgaggccacccagcuggccacacuccggaaauuauguaucgagggcaagauaaccaacaucaccacggacucacguugccccacccagggcgaggccguccuaccggaagaacaggaccagaacuacgucugcaagcacacguacguggaccggggguggggcaacgguugcggccucuucgggaaagggucccugguaaccugcgccaaguuucagugccuggaacccaucgaggggaaggucgugcaguacgagaaccucaaguacacaguuauuaucacggugcacacgggggaccagcaccaggugggaaaugaaacccaaggagucaccgcugagaucacaccucaagcgagcacuaccgaggcuauacuucccgaguacggcacccuaggguuagagugcagcccccgaaccggccuggauuucaaugagaugauccuccucacaaugaagaauaaagccuggauggugcaccgucagugguucuucgauuuacccuuacccuggacauccggggccaccaccgaaacacccaccuggaaucggaaggagcuccuagugacuuucaaaaacgcucacgcaaagaagcaggaggucguggugcuggggucccaggagggugcgaugcacaccgcccuuaccggggccaccgagauccagaacucgggcgguaccuccauuuucgccggccacuugaagugucgccugaaaauggacaaguuggagcucaaggggaugucuuacgccaugugcaccaacacguucguccugaagaaggagguguccgagacucagcacgggaccauccucauuaaaguggaguauaagggugaggacguaccuugcaagaucccuuucuccacggaggacggacaggggaaggcgcacaacggccgccugaucacagccaaccccguggugaccaagaaagaggaacccgucaacaucgaggcugaaccacccuuuggugagagcaacauugugaucggcaucggcgacaacgcccuuaagaucaacugguacaagaagggcuccaguaucgggaagauguucgaggcgacagcccggggcgcacgccggauggcgauccugggggacacagccugggauuuugggucugugggagggguauugaacucucugggcaagauggugcaucagaucuucggcuccgcguacacggccuuauuuagcgguguuuccugggucaugaagaucgguauagggguccuccuuaccuggauaggauugaacagcaagaacacauccaugagcuucuccugcaucgccauugguaucauaacccuauaccuaggcgcugugguacaagccgauauggggugcguuaucaauuggaaggggaaagagcuuaagugcggcagcgggaucuuugucaccaacgaagugcacaccuggacugagcaguacaaguuucaggcggauuccccuaagcgccuagcuaccgcuauagccggcgccugggagaacggugugugcggcauccgcagcacgacacggauggagaaccugcuuuggaaacaaaucgcgaaugagcucaacuauauucuuugggagaacaauaucaaguuaacggucguagugggugacauaaucggugugcucgaacagggcaaaagaacccugacgccacagccaauggagcugaaguacuccuggaagacaugggggaaggcgaagaucgucaccgccgagacccagaacucgucauuuaucauagacgggccuaacacgccugaaugcccgaacgcaagccgggcguggaacguuugggaggucgaggacuacggguucggcguguucacuacaaacaucuggcucaaauugcgcgaggugcacacccaguugugcgaucaccggcuuauguccgccgccgugaaggacgagcgcgccguccacgccgacaugggcuacuggaucgagagccagaagaacgggagcuggaagcucgagaaggcuucccugaucgaggucaaaaccugcacguggccaaagucccacacccuguggaguaauggcgugcuggaguccgacaugaucauccccaagucucuggcgggucccauaucucagcauaacuaccguccgggcuaccauacccagaccgccgggcccuggcauuugggcaagcuggagcuggauuucaacuauugcgaaggcacgaccgucguaauuaccgagaacugcgggacucgcggcccuuccuuacggacgacaaccgugagcggcaagcugauccaugaguggugcugucgcuccugcacucugccaccccuacgguacaugggcgaggacggcuguugguauggcauggagauaaggccuauaucugagaaggaggagaacauggucaagucccugguaagcgccggcucggggaaaguggacaacuucacgaugggcguccuuugccuugcgauacuguucgaggaggugaugagggggaaguuuggcaagaagcacaugauugcgggaguguucuuuaccuucguccuacucuugagcggccagaucaccuggcgcgacauggcccacacucuaauaaugaucggcuccaacgcuagcgauaggaugggaaugggcgugacguaccuggcccugaucgcaaccuucaagauccagcccuuccuggcgcucggguucuuccugcgcaaacugaccucccgcgagaacuuauugcugggaguaggccucgccauggccaccacccugcagcugcccgaagacaucgaacagauggccaacgggaucgccuuaggccugauggcucuuaagcucaucacccaguucgaaaccuaccagcuguggacggcccugaucucucucacgugcucgaacaccaucuucacucuaaccguagcuuggcgcaccgcuacccuuauacucgcaggggugucccuucucccggucugccagagcaguagcaugcggaagacggacuggcuccccaugaccguugcugcaaugggcgugccuccccucccgcuguucaucuuuuccuuaaaggacacguuaaagcgccgcagcuggccccuuaacgagggcguuauggccguuggccuugucuccauccucgcaucuucuuugcuccggaacgacgucccaauggcuggcccccugguggccgggggccugcuaauugccugcuacgugaucaccgggaccagcgccgaucugaccguggagaaggccgcggaugugacgugggaggaggaggccgagcaaaccgggguaucccacaacuuaaugaucaccgucgacgacgaugggaccaugcgaauaaaggacgacgagaccgagaacauccucacggugcugcugaagacugcccuuuuaaucgugagcggcauuuucccguacuccauuccugccacccugcucgucuggcauaccuggcagaagcaaacacagagaucaggcguguuaugggacgugcccucgccgcccgaaacccagaaggccgaguuggaggaaggggucuaucgcaucaagcaacaagggaucuucgggaagacccaggugggcguggggguccagaaagagggcgucuuccacaccauguggcacgugacgcgaggcgcgguucucgccuacaacgggaagcgacuugagccuaauugggcuuccgugaagaaggaccuuaucuccuacggcggaggguggcggcucagcgcucaauggcagaaaggggaggagguucaggucaucgccguggagccaggaaagaaccccaagaacuuccagaccauaccuggaaccuuucagaccacuaccggggagauaggggccaucgcucuggacuucaagccugggaccuccggcucucccauuaucaaccgcgaggguaagguggucggucuguauggcaaugggguggugaccaagaauggcggguacgucucuggcaucgcacagacgaacgccgagccggacgguccgacccccgaacuggaggaagaaauguuuaaaaagcguaaccuaaccaucauggaccugcaccccggguccggcaagacccgcaaauaccugccggcgaucgugcgggaggcaaucaagcggcggcuccgcacgcugauuuuagcgccaacgcgagucguugcagccgagauggaagaggcucuaaaggggcugccuauccgcuaccagacaaccgccaccaagagcgagcacacuggccgggagaucguugaucugaugugccacgccacauuuacuaugcgcuugcugucccccgugcgaguuccgaacuacaaccuuaucauuauggacgaggcccacuucacggaccccgcgagcaucgccgcccgcggguacauuuccacccgugugggcaugggcgaggccgcggcgauuuucaugaccgccacuccaccuggaacggcggacgccuucccccaauccaacgcucccauccaggacgaggagcgagacauccccgagcgcagcuggaauagcggcaacgaguggaucaccgacuucgcggggaagaccgugugguucgucccuuccaucaaagcaggaaacgacauagcuaacugucuccggaagaacgggaagaaggugauccagcugagucgaaagaccuucgauacggaauaucagaagacgaagcucaacgacugggauuucguggucaccaccgacauaucagagaugggcgccaacuucaaagcagaucgggucaucgacccgcggcguugucucaaaccggugauccugacggacggacccgagcgggucauccuugcggggccuaugccaguaaccgcugccagcgccgcucagcgccgcggcagaguggggcgcaacccacagaaagagaacgaccaguacaucuucaccgggcagccucuaaacaacgacgaggaccaugcucacuggacggaagccaagaugcugcuggauaauaucaacacucccgaagggaucaucccggcacucuucgagcccgagcgggagaaaagcgcggcgaucgacggcgaguaccggcugaagggcgagucacggaaaacguucguagagcugaugcgcagaggggaucuccccguguggcuggcccacaaggucgccuccgaggggaucaaauacaccgaccgcaaguggugcuucgacgggcagcggaacaaccagauccuggaagaaaacauggacgucgagauuuggaccaaggagggggagcgcaagaagcuacgcccccgcugguuggacgcuaggaccuacagcgacccccuggcgcucaaggaguucaaagacuuugcggccggucggaaguccauugcccucgaccuggucacugaaaucgggcgaguacccagccaucucgcgcaccggacccgcaacgcgcuggauaaucuggugaugcuccacaccucggagcacggcgguaaagcguaccggcacgcaguggaggagcucccggagaccauggagacacugcuccucuuaggucucaugauacugcugaccggcggugccauguuauuucucauaagcgggaaggggaucggaaagaccagcaucggguugaucugcgucaucgccuccagcggcaugcucuggauggccgagaucccucugcaauggaucgcguccgcgauuguucuggaguuuuucaugaugguccuacugauccccgagcccgagaaacagcgcacgccccaggacaaccagcuggcauacgucguaauuggaauccucacgcuggccgccaucauugcggcgaacgagaugggauuacucgagaccaccaagcgggaccugggcaugucgaaggagcccggggucgucagucccacgagcuaccuggacguggaccuccaccccgccagcgccuggacgcucuacgcgguggcuacgacgguuauaacacccaugcugagacacacaaucgagaacuccacggccaaugugucccucgccgcuaucgcgaaccaggccgugguccugaugggccuggacaaaggcuggccgauaagcaagauggaccucgggguaccgcugcuggcccucgguugcuacucccaggucaacccuuugacucugaccgcugccguucuuuuacucaucacgcauuacgccaucaucggccccggccuccaagccaaggccacccgcgaagcacaaaagcgcaccgcagcggggauaaugaagaacccgaccguugacgguaucaugacaaucgaucuggaccccgugaucuacgacagcaaguuugagaaacagcugggccaggugaugcucuugguacuuugcgccgugcaacuccuucugaugagaacguccugggcccucugcgaggcccugacccuggcuacaggcccuaucacgacccucugggagggcucucccggcaaguucuggaacacuacuaucgccguauccauggccaacaucuuccgcggcuccuacuuagcaggggccggccuggcauucuccauuaugaaguccguugggaccggcaagcggggcaccgggucccagggugaaacccuuggcgagaaguggaagaagaagcugaaccagcuaagccgcaaggaguucgaucucuacaagaagaguggaaucacagagguugaccggacagaggccaaggaggggcuuaagcgcggcgagaucacgcaucacgcugucucacggggcagcgccaagcuacagugguucguggagcgcaacauggucauaccggaggggcgggucauugacuugggcugcggacgcggcgggugguccuacuacugugcuggccugaagaaggugaccgagguucggggcuacaccaagggagggcccggccaugaggagcccguccccaugucgaccuacgguuggaacauugugaagcugauguccgggaaggacguguucuaccucccgcccgagaagugcgacacgcuucugugcgacaucggcgaaagcucccccucgcccaccgucgaagagagccgaaccauccgcguguugaagaugguggagccguggcucaaaaacaaccaguucugcaucaagguacugaaccccuacaugccgaccgugauagagcaccuggaaaggcuccaaagaaagcauggcgggaugcuuguacggaacccccugucgcggaacucgacgcacgagauguacuggaucagcaacggcaccgggaacaucgucgcuuccgugaauauggugucccggcucuuacugaaucgcuucaccaugacccaccgucgcccgacuauagagaaggacgucgaccucggcgcaggcacccggcauguaaacgccgaacccgagacccccaacauggacgugaucggggagagaaucaagcgaauaaaagaggagcacaacuccacguggcacuacgaugaugagaacccauauaagacuugggccuaucacgggagcuacgaggucaaggccacaggguccgcgucauccaugaucaacggcguggucaaguuacugaccaagccgugggacguggugccaaugguaacccaaauggccaugacggauacuacucccuucgggcagcagcgcguguucaaggagaagguggacacacggaccccgcgcucuaugccgggcacccggcgggugaugggcaucaccgccgaguggcucuggcgaacccuggggcgcaacaagaagccccgcuuguguacacgcgaagaguucaccaagaagguacgcaccaacgccgcgaugggcgccguguucacagaggagaaccaaugggacagugcuaaggccgcagucgaggacgaagacuucuggaaacugguagaccgcgagcgcgagcugcacaagcuggggaagugcggcuccugcguguacaacaugauggggaagcgggagaaaaagcucggcgaguucggcaaagcgaaggggagccgugccaucugguauauguggcugggcgccagguaccuggaguucgaagcccucggcuuccugaaugaggaccacugguucucccgcgagaacuccuacucuggugucgagggcgaaggccugcacaagcuaggcuacauccugagagauaucagcaagauccccgguggagccauguaugcggacgauacggcggggugggacacgagaaucaccgaggacgaccugcauaacgaggagaaaaucacccagcaaauggacccggagcaccggcagcuugccaacgccaucuucaagcugacguaucagaacaagguggugaagguacagcgccccacccccaccgguaccgugauggauaucaucucccggaaagaccagagaggcagcgggcaagugggcacauacggccugaauacuuucaccaacauggaaguccaacucauucgucagauggagggcgagggggugcugucgaaggcugacuuggagaauccccaccucccggagaagaagaucacccagugguuagagaccaagggcguagagcgccugaagcggauggcgaucaguggcgaugacugcguuguaaagccaaucgacgaucgcuuugccaaugcccugcuggcccugaaugacauggggaaggugcggaaagauaucccacaguggcagcccuccaagggauggcacgacuggcaacaggucccauucugcagccaucacuuucacgagcucaucaugaaggacgggcgcaaacuuguugugcccugccggccccaggaugaguuaaucggccgcgcccggauuucccagggcgcuggcuggucauugcgcgagaccgcgugccuaggcaaagccuacgcccagauguggucccugauguacuuccaccgccgugaccuccguuuggcgaguaaugcaauuuguucugcggucccaguccacuggguaccgacaagcaggaccaccugguccauccacgcccaucaccaguggaugaccaccgaagacaugcugacggucuggaaccgcguguggaucgaggacaaucccuggauggaggacaaaacuccugugacaaccugggagaacguccccuaccucgggaaacgggaggaccaauggugcggcagccucauagggcuaaccagucgggccaccugggcgcagaauaucccaacggccauccaccagguccggucguugaucggcaacgaagaguuucuggacuacaugccuaguaugaagcgcuuccggaaggaagaggaacuggagggugccaucugguag

SEQ ID NO: 25959 - RNA, 9873 nt, Artificial Sequence
  derived and/or modified CDS sequence (opt11) from DENV-3__FJ373306__SS-prME
accagccugugccucaugaugauucugcccgcugcgcuggcguuccauuugaccagccgggacggcgagccuaggaugaucguggggaaaaacgagcgcggcaagagccugcuguuuaagacugcuagcgguauaaacauguguacccuaaucgccauggaccugggcgagaugugcgacgacacggugaccuacaagugcccacacaucacggagguggagcccgaggacauugacugcuggugcaaccugaccaguaccugggugacguacgguacuugcaaccaggccggggagcaucggcgcgacaagcggucugucgcucucgcgccgcaugucggcauggggcuggacacccgcacccagacguggaugucggccgagggcgccuggcggcagguugagaaagucgagacgugggcccugaggcauccgggguucacgauucuugcgcuguuccuggcccacuaugugggcaccagucucacccaaaagguggucauuuuuauacugcucaugcucguuacgcccagcaugaccaugcggugcguuggggugggaaacagagacuucguggagggucuguccggcgcgaccugggucgacgucguccuggagcacggcgggugcgugaccacuauggccaagaacaaaccaacccucgacaucgaguugcagaagacagaggcaacccagcuggcuacgcuacgcaaacugugcaucgaaggcaagaucacgaauaucaccaccgacagccgcuguccaacgcagggugaagcgguccugccugaggagcaggaccagaauuacguguguaagcacaccuacguggaccggggguggggcaacgggugcggauuauucgggaagggcucccuggugaccugugccaaguuccaaugccuggagcccaucgagggcaaggugguucaguacgagaaccucaaauacacggucaucaucacggugcacacgggggaucagcaccagguuggcaaugaaacucagggggugacggcagagauuacgccucaggcaucgacuaccgaggccaucuuacccgaguacgggacccuggggcucgagugcaguccccgcaccggccucgacuucaacgagaugauucugcucacgaugaaaaacaaggcauggauggugcaccggcagugguuuuucgaccugccccugcccuggaccagcggcgccacuaccgagacgcccaccuggaaccgcaaggaguuacuggucacauucaagaacgcccacgccaagaagcaggaggugguugugcuagggucucaggagggcgcgaugcacacagcccucacgggugccaccgagauccagaacagcggcgggacuucaauuuucgccggccaccugaagugccggcugaagauggauaaacuugagcugaagggcaugucauaugccaugugcacuaauaccuucgugcugaagaaagagguguccgagacccagcacgguaccauccucaucaaggucgaguauaaaggcgaggacgugccguguaaaguucccuucucaaccgaagacgggcagggcaaggcgcacaacggccgccugaucacagccaacccagucgugaccaagaaggaggagcccgugaacaucgaagccgagccgcccuucggggaaagcaacaucgucaucggaauuggggacaacgcccuuaagaucaacugguacaagaagggcucgagcaucgggaaaauguucgaggccacggcccggggcgcccgccggauggccauucugggugacacagccugggauuucgggucggucggcgggguguuaaacucacucggcaaaaugguccaccagaucuucgggucggcguacacggcccuauucagcggugucuccugggucaugaagaucgggaucgggguccuccugacauggaucggccucaacagcaagaauacauccaugucuuucuccugcaucgugaucgggauaaucacccuuuaccuaggcgcuguggugcaagcugacaugggcugugucauuaauuggaagggcaaggagcugaagugcgguagcgggaucuucgugaccaacgagguucacaccuggacagagcaguacaaguuccaggcggacucgccgaagcgccucgcgaccgccaucgccggagccugggagaaugggguuugcggaauccgcucaacgacucggauggagaacuuacuguggaagcagauagcaaaugagcucaacuacauccugugggagaacaauaucaaguugaccgucgucgugggagacauuaucggcgugcucgagcaaggcaagagaacccugaccccacagccaauggagcuuaaauacagcuggaagacguggggaaaagccaaaaucgucaccgcagagacccagaacucaucauuuaucaucgacggacccaauacucccgagugccccagcgcuucucgggcuuggaacgugugggagguagaagacuacggguucggcgucuucagcacuaacauuuggcucaagcugcgcgaggucuacacccaacugugugaccacagauuaaugucugcggcgguaaaggacgaacgcgccguucacgccgauaugggcuacuggauagagagucagaaaaacgggucauggaaacuggagaaggccucacugaucgaaguaaagaccugcaccuggcccaagucucacacgcucugguccaauggcguucuggagagugacaugaucauacccaaaucccuggcggggccuaucucacaacacaacuaccggccagguuaccacacgcaaaccgccgggccauggcaccucggcaagcucgagcuggacuuuaauuacugugagggcacaacggucgugauuaccgagaacugcgggacccgcggcccuagucuccggacuacgaccgucagcgguaagcugauccacgaguggugcugucgcuccugcacccugcccccgcuccgguacaugggcgaggacggguguugguacggcauggaaauccgccccauaagcgagaaggaggagaacauggucaagucacuggugucggccggguccgggaaaguagacaacuuuaccauggguguccugugccuagccauccuguuugaggaggugaugcgggggaaguuuggcaagaagcauaugaucgccggcguguucuucacauucguccugcuccugagcggccagauaaccuggcgcgacauggcgcacacucugaucaugaucggcuccaacgccagcgaccggauggggaugggagugacuuaucucgcacugauugcaacguucaagauccagcccuuccuggcccucggguucuuccugcgcaaacugacaagccgggagaaccuccuccugggcgucggccucgcgauggccaccacccugcagcugcccgaggauaucgagcaaauggccaacgggaucgcccucggacuaauggcgcuaaagcucaucacgcaguucgagacauaccagcuguggaccgcucugaucucccugacuugcagcaacacgauauucacccugaccguugccuggcgcaccgccacgcugauccucgccggcgugucccuccuaccuguaugccagagcuccagcaugcggaagacggacuggcuccccaugaccguugcggcaaugggcgugccaccccucccacuuuuuaucuucuccuuaaaggacacccucaaacgccgcagcuggccccugaaugagggggucauggccgugggccucguguccaucuuggccucgucccugcuacggaacgaugucccaauggccggcccccuaguggccggagggcugcugauugccuguuacguuaucacggggaccagcgcagaccugaccgucgagaaggccgccgacgugaccugggaggaggaggcagaacagacggggguaagccacaaccugaugaucacuguagaugacgacgggaccaugcgcaucaaggacgacgagaccgagaacauccucaccgugcuguuaaaaacggccuugcugaucgugagcggcaucuuccccuauagcauccccgccacccugcucgucuggcacaccuggcagaagcagacccagcggagcggcgugcugugggacgucccaagcccgcccgagacgcagaaagccgagcuggaggagggggucuaccgaaucaaacagcaaggcaucuucgggaagacccaggucggcguggggguccagaaggagggcguguuccacaccauguggcacgucaccaggggcgccguccuuacguacaacggcaagcggcuggagcccaacugggcgagcgugaagaaggaccugaucuccuacgggggaggguggcgguugagcgcccaguggcagaaaggagaggaggugcaggucaucgccguggagccugguaagaaccccaagaacuuccagaccaugccagggaccuuccaaaccaccaccggugagaucggcgccaucgcgcuggacuucaagcccgguaccagcggcucccccauaauaaaccgcgaagggaaggucgucggucuguacgguaacgggguggugacuaaaaacggcggguacgugagcggcauugcgcagaccaacgcagagccggauggccccacucccgagcucgaggaagaaauguucaagaagcgaaacuuaaccaucauggaccugcaccccggaucgggcaagacgcgcaaauaucugccggccauugugcgggaggcuaucaagcgccggcuccgcacacugauccuggcgcccacccggguggucgccgccgagauggaggaggcccucaaagggcugcccauccgcuaccagacgaccgccaccaagucggagcacacaggccgcgagaucgucgaccugaugugccacgcgaccuucacuaugcgccuccuguccccugugcgagucccgaacuacaaucugaucaucauggaugaggcucacuucacggaccccgcaagcaucgccgcacgcggguacaucuccacccgggugggcaugggugaggcagccgccaucuucaugacugccacgccgcccgggacugcggacgccuucccgcagagcaacgcccccauccaggacgaagaacgcgacauccccgagcgcaguuggaacagcggcaaugaguggauaacggacuucgccgggaagacugugugguucgucccguccaucaaggccggcaacgacaucgcgaacugccuccggaagaacggaaagaaggugauccagcucagccggaagaccuucgacacagaauaccagaagacuaagcugaacgacugggacuucguggucacuaccgacaucuccgagaugggcgccaacuucaaagccgauagggugaucgacccgcgccggugccuaaagccugucauccugacggacggccccgagcgcguuauccuggcaggccccaugccggugacggccgcgagcgcagcccaacggcgcggucggguagggcgcaauccccaaaaggagaacgaccaguacauauucaccggacaaccucucaacaacgacgaggaucacgcacacuggacugaggccaagaugcugcuugauaacaucaacacgcccgaggggaucaucccugcccucuucgagccggagcgggagaaguccgccgccaucgauggcgaguaccgccugaagggcgagagccggaagacguucguggagcugaugcgcaggggagacuugcccgucuggcuggcgcacaaggucgcuucggagggaauuaaguauacagaccgcaaguggugcuuugaugggcagcggaacaaccagauccuggaagagaacauggacguggagaucuggacgaaggagggcgagaagaagaagcuccgcccccgguggcuggacgccaggaccuauucugauccgcuagccuuaaaggaguucaaggauuucgccgcgggccgcaaguccaucgcgcuugaucugguaacugagaucggccggguccccagccaccucgcccaccggacccggaaugccuuagacaaccuggugaugcuccacaccagcgagcacggcgguaaggccuaccgccacgcuguagaggagcugccagaaaccauggagacgcugcuccugcuggggcucaugauccuguuaaccgggggcgcgauguuguuccugauauccggcaaggggaucggcaagaccagcaucgggcugaucugcgucaucgccuccagcggcauguuguggauggccgaaaucccgcuccaguggauagcgagcgcaaucgugcuggaguuuuucaugauggugcuccugauacccgagcccgagaagcagcggacgccccaggacaaccagcuugcguacgucgugaucgggauccucacccuggccgcgaucaucgccgcgaacgagaugggacuacucgagaccaccaagcgcgacuuggggaugagcaaggagccggggguggucucccccaccucguacuuagacgucgaucuccaccccgcguccgccuggacguuauacgccguggccaccaccgucaucacccccaugcugcggcacacgauugagaacagcaccgcgaacgugucccucgccgccauugccaaccaggccgugguacugaugggccuggacaagggguggccgaucagcaaaauggaccugggcgugccccugcuugcguuaggaugcuacucccagguaaacccccugacccuaaccgcagccguccuucuccugaucacgcacuacgccauuaucggucccgggcuccaggccaaggcgaccagggaggcccagaagcggaccgccgccggcaucaugaaaaacccuaccguggacggcaucaugacgaucgacuuagacccugugaucuacgacagcaaguucgagaaacaguugggacaggucaugcuacuugugcugugcgcugugcagcuccuucugaugcgaacuuccugggcgcuuugcgaggccuuaacccuugccaccggacccaucacgacgcucugggagggcagccccgggaaguucuggaacaccaccaucgccgugagcauggccaacaucuucaggggcucguaccuggccggagccggucuggccuucaguaucaugaaguccguggggacgggcaagcgcggcaccgggucccagggcgagacgcucggggaaaaguggaagaagaagcugaaccagcuaucccggaaggaguucgaccucuacaagaaguccggcaucaccgagguggauagaaccgaagcaaaggaggggcugaagcggggcgagaucacgcaccacgcugugucacgcggcagcgccaaacugcagugguucguggaacggaacauggugauucccgaagggcgggugaucgaucucggcugcgggcggggcgggugguccuacuacugcgcaggucugaagaaggucaccgaagugcgcggcuacaccaagggcggccccgggcaugaggagcccguccccaugaguacguacgguuggaauaucgugaaacugauguccgggaaggacguguuuuaccucccgccugagaaaugugacacgcugcuaugcgacaucggcgagagcucccccagcccuaccgucgaggaguccaggaccauccgcgugcugaagauggucgagccguggcucaaaaacaaccaauucuguauaaagguauuaaaucccuacaugcccaccgugaucgagcaccuggagcgccuccaacggaagcacggcgggaugcuggugcggaacccacucagccgcaacuccacgcacgagauguauuggaucagcaacggaacuggaaacaucgucgcauccgugaacauggugagucgccuccugcucaaccgguuuacgaugacacaccgccggccgacgaucgagaaggacguugaccucggggccggcacccgccacgugaacgcggagcccgagacccccaacauggacgucaucggggagcgcauaaagcgaaucaaggaagaacauaauuccaccuggcauuacgacgacgagaacccauacaagaccugggcauaccacgggagcuacgaggugaaggcaaccggguccgcuagcucgaugaucaacgggguggucaagcuacugacuaagcccugggaugugguacccauggugacucaaauggccaugacugacaccaccccguucgggcagcaacggguguucaaggaaaagguggacacgcgcacgccgcgguccaugccgggcacccgccgagugauggggaucaccgcggaguggcuauggcgcacgcugggccggaacaagaaacccaggcugugcacgcgugaagaguucaccaagaaggugcggaccaacgccgccaugggcgccguguucaccgaggagaaccagugggacucugcaaaggcagccgucgaggacgaggacuucuggauccucgucgacagagagcgggaacugcacaagcuggggaaaugcgguuccugcgucuauaacaugauggggaagcgcgagaagaaacuuggcgaguucgggaaggccaaggggagccgagcuauuugguacauguggcugggcgcgcgauaccuggaguucgaagcccucggguuccuaaaugaagaccacugguucuccagagagaacagcuacucaggcguggagggggagggacugcacaagcucggauacauccugagggacaucagcaagaucccagguggcgccauguacgccgacgacacagccgggugggauacucggaucaccgaggacgaccugcacaacgaagagaagaucacccagcagauggauccggagcacagacagcuggcgaacgcaaucuucaaacuuaccuaucaaaauaagguggugaagguccagcggcccacccccaccggcaccgugauggacauaaucucccgcaaagaccagcgggguagcggacaggugggcaccuacgggcugaacacguuuaccaauauggaggcccaacucauccgccagauggagggcgaggggguccuguccaaggccgaccuggagaacccccaccucccggagaagaagauuacccaguggcuagagacgaaggguguggaacgccugaaacggauggccaucagcggcgacgacugcgucgugaagccgaucgaugaccgguucgcaaacgcccuccuggcccugaacgacauggguaaggugcgcaaggacaucccccaguggcaaccgucaaaaggcuggcacgacuggcagcaagucccauucuguagccaccacuuucacgaguugauuaugaaggacgggcggaagcuagucgugcccugccgcccgcaagacgagcugauaggccgggccagaaucucccagggggcgggcuggagccuccgggagacagcgugucugggcaaggcuuacgcccagauguggucccuaauguacuuccaccgccgugaccuccggcuggccagcaacgcgaucugcuccgccgugcccguacacugggugcccaccucccgcaccaccuggagcauccacgcccaccaccaguggaugacgacagaggacaugcugaccguuuggaaccggguauggaucgaagacaaccccuggauggaggacaagaccccugugacgaccugggagaacgugcccuacuuagggaagcgcgaggaccaguggugcggcucucugaucgggcucaccuccagggcuaccugggcucagaacauaccgacggcgauccagcagguccgcucccuuaucggcaacgaagaguuucuggacuacaugcccagcaugaagagauuccgcaaggaggaggaguccgagggggccaucugguga

SEQ ID NO: 25960 - RNA, 9873 nt, Artificial Sequence
  derived and/or modified CDS sequence (opt11) from DENV-3__EU687197__SS-prME
accagccugugucuaaugaugauccugcccgccgcccuggcguuccaccucaccagcagggacggggaaccgcggaugauagucggcaagaacgagcgcgggaagucucugcuguucaagaccgcgucugggauuaacaugugcacccucaucgccauggacuuaggcgagaugugcgacgacaccgugacauacaagugcccccacaucacggagguggagcccgaggacaucgauugcuggugcaaccugaccagcaccugggugaccuacgggacgugcaaucaagccggcgagcaccggcgagacaagcgguccgucgcccucgcuccccacgucggcaugggccuggauacccgcacccagaccuggaugagcgccgagggcgccuggcggcagguugagaaggucgagacuugggcccuacgccauccgggguucacgauacucgcgcuguuccuggcccacuacaucggcaccucccucacccaaaaggucgugaucuucauccugcuaaugcucgucacucccuccaugacgaugcggugcguggggguaggcaaccgcgacuucgucgagggccuguccggggccaccuggguagacgugguauuggagcacggcggaugcgugaccacgauggccaaaaacaaacccacccucgacaucgagcugcagaagaccgaagccacgcagcuggcgacgcucagaaagcugugcaucgagggcaagaucaccaauaucaccaccgacagucgcugccccacgcagggcgaggccgugcugccggaggagcaagaccagaacuacgucugcaagcacaccuacguggaccggggguggggcaacgggugcggccucuucgguaaaggcucccuggugaccugcgcaaaguuucagugccuggagcccauugagggcaaggucgugcaguacgagaaccuaaaguacaccgugauaauaacggugcacaccggggaccagcaccaggugggcaacgagacacagggagucacugccgagaucacgccccaggccagcaccaccgaggcgauccugcccgaguacggcacccuggggcucgagugcuccccuagaaccggccuggacuucaacgagaugauccugcuaacgaugaagaacaaggccuggaugguacaccggcagugguuuuuugaccugccccugcccuggacaagcggagccaccacggagacgcccaccuggaaccgcaaggagcuccuggugacuuucaagaacgcccacgccaagaagcaggaggucguggugcuggggucucaggagggagcgaugcauaccgcccucacgggggccaccgagauccagaacagcggcgggaccaguauuuucgccggccaccugaaaugccggcugaaaauggacaagcucgaguugaaggggaugaguuacgccaugugcaccaacacguucguccugaagaaggagguguccgagacccagcaugggacaauccucaucaagguggaguacaagggcgaggacguaccgugcaaaauccccuucuccaccgaggacggacagggcaaggcgcacaacggccgccugaucacggccaaccccguggugaccaaaaaggaagagcccguaaacaucgaggccgagccuccuuucggggagucgaacaucguuaucggcaucggggacaacgcccugaagaucaacugguauaaaaagggcuccuccauagggaagauguucgaggcgacugcccggggcgcccgcaggauggccauccugggcgacaccgccugggacuucggguccgugggcgggguccucaacagccuuggaaagaugguacaccagaucuucggguccgcguacacagcccuguuuagcggcgugagcugggucaugaagaucggcaucggagugcuccucaccuggauaggacugaacuccaagaacaccucaaugagcuucuccugcaucgccaucgguauaauuacgcucuaccugggagccgugguccaggccgacauggggugugugguaaacuggaagggaaaggagcugaagugcggcagcgggauauucguaacgaacgaggugcacaccuggaccgagcaguacaaguuccaagcggacuccccuaagagacucgccaccgccaucgccggcgccugggagaacggggugugcggcauccggagcacgacccggauggagaaucugcuguggaagcagauugcgaacgagcucaauuacauccugugggagaacaacaucaagcuuaccgucguggucggugacaucaucgguguacucgaacagggcaagcgcacgcugacgccccagccgauggagcugaaguacuccuggaagaccugggggaaagccaagaucgugaccgcagagacacagaacagcuccuuuaucauagacggccccaacacgcccgagugcccuaacgccagccgugcguggaaugugugggagguugaggacuacggguucggaguguucacuaccaauauuugguuaaaacugcgcgaggucuacacccagcugugcgaccaccggcuaauguccgccgccgucaaggacgagcgcgccgugcacgccgacaugggcuacuggaucgagagccagaagaacggcagcuggaaguuagagaaggcgucccugauugaggugaagaccugcacguggcccaaaucccacacucuuuggucuaacggcguccuagagagcgacaugaucauccccaagucccuugcagggcccaucagccagcauaauuaucggccgggcuaccauacccagaccgccggcccauggcaccuggguaagcuagagcuggacuucaacuacugcgagggcacgaccgugguaaucaccgagaacugcgggaccagaggcccuucccuccggacgaccaccgucagcgggaaacugauccacgaguggugcugccgcucauguacccugccgccgcuccgguacaugggcgaggacgggugcugguacggcauggagauacgccccauuagcgagaaggaagagaacauggugaaaucccuggugagugccggcuccggaaaggucgacaacuucacgaugggcguccugugccucgccauucuauucgaggagguaaugcgggggaaguuuggcaagaaacacaugaucgcggggguguucuucaccuucgugcugcuccugaguggccagaucaccuggcgcgacauggcucacacgcugaucaugaucggcaguaacgcuagcgacagaauggggaugggcgugacguaccucgcgcugaucgccacauucaagauacaacccuuccuggcgcucggguucuuccugcgcaagcugaccucccgggagaaccuuuugcugggagucgggcuugccauggccacaacgcuccagcugccagaggacaucgagcagauggccaacgggaucgcgcucggcuugauggcccugaaguugaucacccaguucgagaccuaccagcuguggacugcccugaucagccucacguguagcaacaccaucuucaccuuaaccguggccuggcgcacggccacccugauuuuggcggggguuagucugcugccggugugccagagcucgagcaugcgcaaaaccgauuggcuuccaaugaccguggccgcuaugggcguuccgccguugccacuguucaucuucucccucaaggacacgcugaagcgccgcagcuggccccugaacgagggggugauggcggugggccucgucuccauccuugcauccucccugcuccggaacgacgugcccauggcuggcccccucguggccgggggccugcucaucgccugcuacgucaucaccgggaccagcgccgaccugaccguggagaaggccgcggacgucacgugggaagaggaagccgagcagaccggcgucucccacaaccugaugaucaccguggacgacgacgggaccaugcgcaucaaggacgacgagaccgagaacauccucacggugcugcugaagaccgcauugcugauugucagcggcaucuucccauacucuauccccgccacccugcucguguggcacaccuggcagaagcagacgcagcggagcggcgugcugugggacguccccagcccgcccgagacccagaaggccgaguuggaagagggggucuauaggaucaaacagcaggggaucuucgggaagacacaggugggcgucgggguacagaaggagggcguauuccacaccauguggcaugucacgcggggcgcggugcucgccuacaacggcaagcgccuggagcccaauugggccagcgugaagaaggacuugaucucauacggcgggggcuggaggcucagcgcacaguggcagaagggggaggagguacaagugaucgcggucgagcccggcaagaaccccaagaacuuccagaccaugcccggcacguuucagacaacgacgggugaaauaggcgccauagcccuggacuuuaagccuggcaccuccggaagccccaucaucaaccgcgagggcaaggucguugggcuguacggcaacgggguggucaccaaaaacggaggguacgucagcggcaucgcucagacgaaugccgagccggauggccccacgccggagcuggaagaggagauguucaagaagcggaaccucaccauaauggaucugcaccccggcaguggcaaaacccggaaguaccuaccggcgaucgugcgugaggccaucaagcgccggcugcgcacgcugauccuagcucccacacgggucguagccgccgaaauggaggaggcgcucaaagggcuccccauccgcuaccagaccaccgcaaccaagagcgagcacacggggagggagaucguggacuuaaugugccacgccaccuucaccaugcgccuccugucccccguucgggugccgaacuacaaucuaauaaucauggacgaggcccacuucacugaccccgccagcaucgcggcccgcggguauaucucgacccgggugggcaugggcgaggccgccgcgaucuuuaugacugcgacgccgcccgggacggccgacgccuucccgcagagcaacgcccccauacaggacgaggagcgcgacauccccgagcgcucguggaacagcggcaacgaguggaucaccgacuucgcgggccggaccguaugguucgugccuuccaucaaagcgggcaacgacaucgccaacugccuccgcaagaacgggaaaaaaguuauccagcugagccggaagaccuucgacacggaguaccagaagaccaagcugaacgacugggacuucgucgucacuaccgacaucuccgagaugggcgccaacuucaaggccgaccgcgugaucgacccacgucgcugccucaagcccgucauacuaacggacggccccgagcgggugauccuggcggggcccaugccgguuaccgccgccagugccgcccagcgccgaggccgcguagggcggaacccccagaaggaaaacgaucaguacaucuucaccggccagccccucaacaacgacgaggaccacgcgcacuggaccgaggccaagaugcugcuggacaauaucaacacacccgaggggauuaucccggcccucuuugagcccgagcgcgagaagagugccgcaaucgacggagaguaccggcugaaaggcgagagucgcaagacguucguagagcugaugcggcggggagaccuccccgucuggcuggcacacaagguggccucggagggcaucaaguacaccgaccggaaauggugcuuugacggucagaggaauaaucaaauccuggaggaaaacauggacgucgaaaucuggaccaaggagggcgagcggaagaagcuccgcccuagguggcuagaugcucggaccuauagugacccacuggcccuaaaggaguucaaggacuucgcggccggccgcaaauccauugcccuggaccucgucacagagauugggcggguuccgagccaccucgcccaccgcacccggaacgcucuugauaaucuggugaugcuccacaccuccgagcacggagggaaggcuuacagacacgccgucgaggaguuacccgagaccauggagacgcugcuccugcuuggccucaugauucuucuaaccgggggcgccaugcuguuccugaucagcggcaaagggaucggcaagaccagcaucgggcugaucugcgugauagccuccucagggaugcuuuggauggccgagaucccgcugcaguggaucgcguccgcaaucgugcuggaguuuuucaugaugguccuccugaucccagagcccgagaagcagcggacgccccaggauaaucaacuggcuuauguggugauagggauccucacgcuggccgccauuaucgcggccaacgagaugggcuugcuugagaccaccaagcgcgaccugggcaugagcaaggagccggggguggugucccccaccagcuaccuggauguggaccuccacccggccuccgccuggacgcuguacgcggucgccaccaccguaaucacccccaugcugcggcacacgaucgagaacagcaccgccaacgugucccucgcagccaucgcgaaccaggccgucgugcugaugggccuggacaagggauggccgaucagcaagauggaccuaggagugcccuugcuggcccucggcugcuacucccaagucaacccccugacccugacagccgccgugcuccugcugaucacucacuacgcgaucaucgggcccggccuccaggccaaggccacucgggaggcacaaaaacggacugccgcggggauuaugaagaacccuacuguggacggcaucaugacgaucgaccuggaccccgucaucuacgauaguaaguucgagaagcagcugggccaggugaugcuccuggugcugugcgccguccagcuacugcugaugaggaccuccugggcacucugcgaggcccugacgcuugcgaccggccccauuacgacccucugggagggcagcccugguaaguucuggaacacaacuaucgcugucuccauggccaacaucuucaggggcagcuaccuggccggggccggccuugcguucuccaucaugaaauccguugggacgggaaagcgcggcacugggucccaaggcgagacccucggggagaaguggaagaagaagcugaaccaguuaagccggaaggaguucgaccucuacaagaaguccggaauaaccgaggucgaucgcaccgaagcuaaggagggcuugaagcggggcgagaucacgcaccacgcggucuccagaggcagcgccaagcugcaaugguucguggagcggaauauggucaucccggaggggcgcgugaucgaccucggcugcgggcgcggggggugguccuauuacugcgccggccugaaaaaagucaccgagguccgaggcuacaccaaaggggggccagggcacgaagaaccggugcccaugagcacguacggauggaacaucgugaagcugaugagugggaaggacguguucuaccucccgcccgagaagugcgacacccuacugugugacauaggcgagagcucccccucgcccaccguggaggagucgcgcaccauccgcgugcugaagaugguggaaccuuggcucaagaauaaccaguucugcaucaaggugcugaacccguacaugccgacagugaucgagcaccuggagcgccuccagcgaaagcacggagggaugcuggugcgcaauccccugagccggaauuccacgcacgagauguacuggaucagcaauggcaccgggaauaucguggcguccgugaacauggucucacgccugcugcugaacagguucacuaugacucaccgccguccgacgaucgaaaaagacguggaucucggcgccggcacccgccaugugaacgcugaacccgagacacccaacauggacgucaucggcgaacggaucaagcggaucaaagaggagcacaacaguacuuggcacuacgacgacgagaacccguacaagacuugggccuaucaugggagcuacgaggucaaggccacuggguccgcguccuccaugaucaacggcgucgugaagcugcugaccaagcccugggacguagugcccauggugacccagauggccaugacggacaccacccccuucgggcagcagcgaguguuuaaggagaaggucgacacccggacaccgcggagcaugcccgguacccgccggguuaugggcaucacugccgaguggcucuggcgcacccuggggcggaacaagaagccccgccugugcacgcgcgaggaguucacuaagaaggugcggaccaacgccgcaaugggcgccgucuucacggaggagaaucagugggacagcgcgaaggccgccguggaagacgaggacuucuggaagcucgucgaccgcgagcgcgagcugcacaagcugggaaagugcggcucuugcgucuacaacaugauggggaagcgugagaagaagcucggcgaguucggcaaggcgaaggggucucgggccaucugguacauguggcugggcgcccgcuaccuggaguucgaggcucucggguuccugaacgaggaccacugguucucccgggagaacagcuacuccggcguggagggggagggccugcacaagcucgguuauauucugcgcgacaucagcaagaucccggggggugccauguacgcggacgacacggccgggugggacacccggaucaccgaggacgaucugcacaaugaggagaagaucacacagcagauggacccggagcaccgccaguuagccaacgccaucuucaagcugacguaccagaacaagguugugaaggugcagcggcccacacccacgggcaccgugauggauaucauaucccgaaaggaccagcggggcagcggccaggucggcaccuacgggcuuaacacuuucaccaauauggaggugcagcucauccgccaaauggagggcgagggggugcuguccaaggccgaccucgagaacccccaccucccagaaaagaaaaucacccaguggcuggagaccaagggcgucgagcggcugaagcgcauggcaaucagcggcgacgacugcguggucaagcccaucgaugaucgguuugccaacgcccuccuggcccuaaacgacauggggaagguccgcaaggacaucccccaguggcagccuuccaagggcuggcacgacuggcagcaggucccguucugcucgcaucacuuccacgagcuaaucaugaaggacgggcggaagcugguggugcccugcagaccccaggaugagcugaucggacgggccaggaucucccaaggggcgggguggucgcugcgcgagacggcuugccuggguaaggccuaugcccagauguggucccugauguauuuucacaggcgugaccuccggcucgcguccaacgccaucuguuccgccgugccagugcacugggucccgacgagcagaacgaccugguccauccacgcccaccaccaguggaugacgaccgaggacaugcugaccguguggaaccggguguggaucgaggacaacccuuggauggaggauaagacccccguuacgaccugggagaaugugcccuaccucgggaagcgagaggaccaguggugcggcucgcugaucggccugacaucccgagccaccugggcgcagaacaucccgacggccauccaccagguucgcagucucaucggcaacgaggaguuccuggacuauaugcccagcaugaagcgguuucggaaggaggaggaacuggagggggccauaugguga

SEQ ID NO: 25961 - RNA, 9873 nt, Artificial Sequence
  derived and/or modified CDS sequence (opt11) from DENV-3__EU687198__SS-prME
accucucuuugccugaugaugauccugccggccgcgcucgcguuccaccucacgucccgcgauggugagccacgcaugaucguagggaagaaugaacgcggcaagagccuguuauucaagaccgccaguggcaucaacaugugcacccucaucgccauggacuuaggagagaugugugaugacaccgugaccuauaagugcccucacaucgccgagguggaacccgaggacauugauugcuggugcaaccugaccagcaccugggugaccuacgguacuuguaaccaggcaggcgagcaccggcgagauaagcgauccguggcgcucgcgccacacgugggcaugggcuuggacacucgcacccagaccuggaugucagccgaaggcgccuggcgacaggucgagaagguugagaccugggcucugcgacacccaggguucacgauccucgcccuguucuuagcacauuauauaggcaccucgcucacucaaaagguugugauuuuuauccugcugaugcucgucaccccgagcaugacgaugcggugcgugggggugggcaaucgcgacuucgucgagggucugucaggggccaccuggguugacguggucuuggaacauggagggugcgugaccacuauggcaaagaacaagccuacgcucgacauugaguugcagaaaaccgaggcgacccagcucgccacguugcggaagcuaugcauugagggcaagauaacgaacaucacuacagacagccgcugcccuacucagggggaggcagugcugcccgaggaacaggaucaaaacuauguguguaaacacacguacguggaccgggguugggguaauggaugcggacucuucgggaaggguuccuuagugaccugcgcuaaauuccaguguuuagagccaauagagggcaagguagugcaguacgagaacuugaaguacaccguuauaaucacuguacacacgggggaccagcaccagguggguaacgagacccaggggguuaccgccgagauaacaccccaagccagcacgaccgaagcgaucuugcccgaauacgggacccuggggcucgagugcuccccacgcaccggccuggauuuuaacgaaaugauucugcucacgaugaagaacaaagccuggauggugcacagacagugguucuuugacuuaccucugccauggacuucaggcgcgacaacggagacccccacguggaaccgcaaagagcuccucgugaccuucaagaacgcgcaugcgaagaagcaagaggugguaguguuaggcucucaagaaggcgccaugcacacggcccucacgggcgccaccgagauacagaacagcggcgguacgucuaucuucgccggccaccucaaaugccggcuaaagauggauaaacucgagcuaaaagguauguccuacgcgaugugcaccaauaccuuugucuuaaagaaggagguguccgaaacgcagcacgguaccauccucaucaaaguggaguauaagggcgaggacgucccuugcaagauccccuucagcacagaggacggucagggcaaagcccauaacgggcggcugaucacggccaaccccguggugacgaagaaagaagaacccguuaacaucgaggccgagccgccuuucggggagucgaauaucgugaucggcgucggcgacaacgcacugaaaaucaacugguacaagaaaggcucgucuaucggcaagauguucgaggcgaccgcccggggcgcccgccggauggccauccuuggcgacaccgcgugggacuucggauccguuggcggggugcugaacagccugggcaagauggugcaccagaucuuugguucggcguacacagcacuguuuucuggagucuccuggguaaugaagauagguaucggggugcugcuaacguggauaggccucaacagcaaaaacaccucaaugaguuucuccugcauagccaucgggaucaucacucuuuaccugggcgccguaguacaggccgacaccggcugcgugaucaauuggaaagggaaggagcucaaguguggaagcgggaucuucguaaccaacgaggugcacacguggaccgagcaguauaaguuccaggccgacuccccaaagagguuagccaccgcaauugccggcgcgugggagaacgggguguguggcauccggagcacaacccgaauggaaaaccugcuguggaagcaaaucgccaacgaacucaacuacauccugugggagaacaacauaaagcugaccguugucgugggggacaucaucggcguucucgaacagggcaagcgcacgcugacaccgcaaccuauggagcucaaauacaguuggaagaccugggggaaagccaagauaguaaccgccgaaacccaaaacagcuccuuuaucaucgacggucccaauacucccgagugccccucggcgucccgggccuggaacguuugggagguagaggacuacggguucggcguauucaccacaaacaucuggcuuaagcuccgcgaaguguacacgcagcugugcgaccaccggcugaugagcgcagcugucaaggacgaacgcgccguucaugccgacaugggcuacuggaucgagagccagaagaauggguccuggaagcuggagaaggccucgcugauagaagugaagaccugcacguggccuaagucgcacacccucuggucaaacggggugcuggaauccgauaugauaaucccaaagagccuggcggggcccauuucccagcacaacuaccggccgggguaccacacucagaccgccgggccuuggcaccuaggcaagcuggagcucgauuucaacuacugcgagggcacaacgguggucaucacagaaaauugugggacccgcgguccuucgcuccggaccacgaccguguccgguaagcugauccacgagugguguugcaggagcuguacccugccuccacuccgguauaugggcgaggacgggugcugguacgguauggagauacgccccaucucggagaaggaagaaaacauggucaagagcuugguguccgccggcucaggcaagguggacaacuuuacgaugggcgugcuuugcuuggcgauucuguuugaagaggugaugcgggggaaauucggcaagaagcauaugaucgcaggcguauuuuucaccuuugugcugcuccugaguggccagaucaccuggcgcgacauggcucacacccugaucaugaucggcucuaaugcuuccgauagaauggguaugggcgugaccuaccuggcacuuaucgccaccuuuaaaauacagccuuuccucgcccuuggauuuuuccugcggaagcugacgagccgggagaaucuacuacugggcgucggcuuggccauggccaccacgcugcagcugcccgaggacauugagcaaauggcgaacgggaucgcccucggucugauggcccuaaaguugauaacccaguuugagaccuaccagcuguggaccgcccuuaucagcuugacgugcuccaacacaaucuucacucuuacaguggcguggcguacggcgacccugauccucgccggggucagccuguuaccggucugccaaucuucauccaugagaaaauccgacugguuaccuaugacaguggccgccaugggggugccuccccuccccuuguucaucuucucacucaaggacacccucaagcgucggucauggccacugaaugagggggugauggcggugggccucgucuccaucuuggcgagcagccugcuccggaaugaugugcccauggcgggccccuuaguggccgguggccuccucaucgccugcuacgucaucacgggaaccucggcggaccugaccguagagaaggcugccgauguaaccugggaggaagaggcggaacaaacgggcgucucccauaaucuuaugauuacuguagacgacgaugggaccaugcgcaucaaagacgacgagacagagaacauccucaccguguugcugaagacggcccuccugaucguuagcgggaucuucccguauuccauacccgccacccugcucguguggcacacguggcagaagcagacccgucgcucagggguucugugggacgugcccaguccgccugagacccaaaaggcggagcuugaagaggguguuuacaggauuaagcagcaggguaucuucgggaagacccagguuggcgucggcgugcagaaggagggcguuuuccauaccauguggcacgucacccgcggagccguccucacguacaacgggaagaggcuagaacccaacugggccucagugaagaaagaccuuaucucauauggagggggcuggcgcuugagcgcccaguggcaaaagggggaggagguccaggucaucgcgguagaacccggcaagaauccgaagaacuuucagacaaugcccggcaccuuccagaccacgaccggggagaucggcgcaauagcgcuggauuuuaaacccgguacuagcggcucgccgaucaucaaccgggagggaaaagucgugggucucuacgguaacgggguggucaccaagaacggcggguacgugagcgguaucgcccagacuaacgccgagcccgacggcccgacccccgaacuagaggaggaaauguucaagaagaggaauuugacgaucauggaccuacaccccgggaguggcaagaccaggaaguaccugccggcgaucgugcgcgaagccauuaaacggcgacuccggacacugauacuggcucccacccgcgucguggcugccgagauggaggaggcguuaaagggccugccgaucagguaccagaccacggccaccaagucagagcacaccggacgugagaucguggaucugaugugccaugccaccuucacaaugcgucuccugucccccguacgcguuccgaauuacaacuugaucaucauggacgaagcccacuucacggacccggccagcauagcagcccggggauacaucagcacgcgggugggaaugggcgaagccgcugcgaucuucaugaccgcgacgccgccgggaaccgcugacgcguuuccccagucuaacgcgcccauccaggacgaggaacgggacauccccgagcgguccuggaacagugguaacgaguggaucaccgacuucgcgggcaagaccguuugguuuguucccuccaucaaggcgggaaacgacauagcaaauugccucagaaagaacggaaagaaagugauucaacugucccggaagaccuucgacacggaguaucaaaagacccgccucaacgauugggacuucgucgucaccaccgauaucuccgagaugggcgccaacuucaaggccgaccgggugauugacccgcguaggugccucaagcccgucaucuugacagacggccccgagcgaguaauauuggcggggcccaugccggugacagccgccucggcagcccaacggcgcggccgggucgggcgcaauccacagaaggagaacgaccaauacauuuucaccggccaaccgcuuaacaacgacgaagaccacgcgcacuggaccgaggccaaaauguuacuggacaacauaaacaccccggaggguauaauaccggcccucuucgagcccgagagagagaaguccgccgcgauagacggggaguaccgccuuaagggugagagccggaagacauuuguggagcugaugcgccgcggggaccuuccggucuggcuggcccacaagguggccuccgaaggcaucaaguacaccgaccgaaagugguguuucgacgggcagcggaacaaccagauccuggaggagaacauggacguggagauuuggaccaaagagggcgaaaagaagaaacuucgcccccgguggcuggacgccagaacuuacagcgacccgcuggcccucaaagaguucaaggacuucgcggcaggccggaagaguaucgcccuggaucugguuacugaaaucggacgggucccaucacaucucgcccaccgcaccaggaacgcccuggacaacuuggugauguugcacacuagcgagcacggcgggaaggcguaccggcacgcggucgaggagcucccagagacuauggagacgcugcuccuauuaggccucaugauccuacugacgggaggcgcaaugcuuuuccugaucuccggaaaggggauuggcaaaaccagcaucggucugaucugcgucaucgccuccuccggaauguuguggauggccgaaaucccacugcaguggaucgcuuccgcgaucguccuggaguuuuucaugaugguccuccugauuccggagcccgagaagcagcggacgccccaggacaaccagcuagccuaugucgucaucgggaucuugacucuggccgccauaauugcggccaaugagaugggcuuacucgagaccacuaagcgggaccugggcaugagcaaagagccgggggucguuucgcccacuagcuacuuggacguagaccuccaccccgccuccgcguggacgcuguaugcggucgccaccaccgugaucaccccaaugcugcggcacacgaucgaaaacuccacggccaaugugucguuagccgccaucgcgaaccaggccgucgugcucauggggcucgauaagggguggccgaucagcaagauggaccucggcgugccccuguuagcccucgggugcuacucccaggucaacccccugacccuuacagccgccguguuacugcuuauaacgcauuacgcgauuaucgggcccggccuccaggcuaaggcaacgcgugaggcucagaagcgcaccgcugcaggcaucaugaagaaccccaccguugauggcaucaugacaauugaccuggacccagucaucuacgacagcaaguucgagaagcagcugggacaagucauguuacuugugcucugcgccguccaauugcugcugaugagaaccuccugggcgcuaugcgaagcgcugacgcuggcuaccggcccgaucacgacucuaugggagggaagccccgggaaguuuuggaacacaaccauugccgucuccauggccaauaucuuccggggcagcuaccuggccggggcuggccuggcguucuccauaaugaagucagugggaacgggcaagcgcggcacugggucgcaaggcgagacuuugggggagaaguggaagaagaagcugaaccagcugucccgaaaagaguucgaccucuauaaaaaguccggcauaaccgagguggaucgcaccgaagccaaggaaggccugaagaggggugagaucacccaccacgccgugucgcgcggcagcgccaaacuucagugguucguggagcggaacauggucauacccgaggggcgcgugaucgaccugggcugcggucggggcggaugguccuacuauugcgccggucugaagaaggugacggaggucaggggguacacuaagggcgggcccgggcaugaggaacccguucccaugucgacauacggcuggaauaucgugaagcugauguccgggaaggacguguucuaucucccgcccgagaagugugacacgcuguuaugcgacauaggcgagagcucgccaagucccacaguggaggagucccgcaccauccgggugcugaagauggucgaacccuggcucaagaacaaccaguucugcauaaagguguugaacccauacaugcccacaguuauagaacaccuggaacgccuccagcggaagcacgguggaauguuagugcggaauccccuuagcagaaauucaacgcacgagauguauuggaucagcaauggcacggggaacauuguugcguccgugaacauggucagccgccuccuucugaacagauucaccaugacucaccgccgucccacuauugagaaagacguagaucucggcgcuggcaccagacacgugaaugcggaaccugaaacacccaacauggacguaauuggcgaacggaucaaacgcaucaaggaggagcacaacuccaccuggcacuacgacgaugagaacccguacaagacuugggcuuaucacgguagcuacgaggugaaggccacaggauccgcgagcagcaugaucaacggcgucgugaagcuacuuaccaagcccugggaugugguccccaugguuacccagauggccaugacggacacgaccccguuuggccaacagcgcguuuucaaagagaaggucgacacucgcacgccucgguccaugcccgggacccggcgggugaugggcauuacagccgaguggcuguggcgcacccugggcaggaacaagaagccccgucuguguacgcgcgaagaguucacgaagaagguacguacaaacgccgcgaugggugcugucuucaccgaggagaaccagugggacagcgccaaggcggccguggaggacgaagauuucuggaaacuggucgaccgcgagcgggaacugcacaaacuugguaaguguggaucuugcgucuacaacaugauggguaagcgcgagaaaaaguugggggaguucggcaaggcuaaggggucacgggccauaugguauauguggcugggcgcccgcuaucuggaguuugaagcccucggguuucugaaugaggaccacugguuuagucgagagaacagcuacuccggcguggagggggagggucugcacaaguuaggcuacauauugcgcgacauuucaaagauacccgggggcgcgauguaugcugacgacaccgccgggugggacacacggaucaccgaggacgaccuacacaaugaggagaagaucacucagcaaauggacccugagcaucgccaguuggccaacgccaucuucaaacucaccuaccagaacaagguugucaaagugcagcggccuacccccacaggaacaguuauggauaucauuucccgcaaagaucagcgggggagcgggcaggucgguacauacgggcucaacacguuuaccaauauggaggcgcagcucauccgccagauggaaggcgagggggugcucuccaaagccgaccuggagaacccccaccucagcgagaagaagaucacccaauggcuggagaccaagggcguggaacgccuaaaacgcauggccaucucuggagaugauugcguggugaaaccaaucgacgacagguucgcuaacgcccuccuggcccugaacgacauggggaagguccgcaaagacaucccccaguggcagcccagcaagggcuggcacgacuggcagcagguccccuuuugcagccaccauuuccacgagcucaucaugaaagacggccggaagcugguggugccaugucggccccaggacgaacuaaucggucgugcgcggaucagccagggugcgggcuggagucuccgcgagaccgcaugcuuaggcaaggccuacgcgcagauguggucacugauguacuuccaccggcgcgaucuccgauuggccaguaacgccaucugcagcgcgguccccguccauuggguuccgaccucuagaaccaccuggucgauacacgcccaccaccaguggaugacgaccgaggauaugcugacaguuuggaauaggguuuggaucgaggacaacccguggauggaggacaagacgcccgugacgacuugggagaacguccccuaccuugguaagcgcgaagaccaauggugcggcucccugauuggguugaccagcagggcaaccugggcacagaacauacccacugcaauccaacagguccgcagcuuaauagggaaugaggaguuccuggacuauaugccuuccaugaagcgcuuucgcaaggaggaagaguccgagggggcaauaugguga

SEQ ID NO: 25962 - RNA, 9873 nt, Artificial Sequence
  derived and/or modified CDS sequence (opt11) from DENV-3__EU726769__SS-prME
acaaguuugugccucaugaugaucuuaccggcggcauuagcauuucaccucacaucccgggauggcgagccccggaugaucguaggcaaaaacgagcgagguaaaagucuuuuauucaagacggccucagggaucaauauguguacgcugauugccauggaccucggugagaugugcgacgacaccgugaccuacaagugcccacauauuacggaaguagagcccgaagacaucgauugcuggugcaaccugaccucaacaugggugacuuacgggacgugcaaccaagccggggagcaucggcgggacaagcgguccguugcccucgcaccacaugucggcaugggccuggauacacgaacccaaacguggaugucggccgagggagcuuggcgucagguggagaaggucgagacgugggcccugcgccacccgggguucaccauccucgcgcuguuccucgcccacuacaucggcacuuccuuaacccaaaaaguggugauauuuaucuuacuuaugcucguuacgccaagcaugaccaugcggugcgugggggucggcaaccgcgacuucgucgaggggcuguccggggcgaccugggucgauguggugcuggagcacggagguugcgugaccacgauggccaaaaacaagcccacccucgacaucgagcugcagaaaacagaagccacccagcucgcuacgcuccguaagcuguguaucgaggggaagaucaccaacauaaccacggacagccguugcccgacgcagggagaggcggugcucccggaggaacaagaccagaacuacgucugcaagcauaccuacguggaccggggguggggcaacggguguggccuauucgggaagggaucccuggugaccugcgccaaauuccagugcuuggaacccauagagggcaaggucguucaguacgagaaccuuaaguauaccguuaucaucacgguccauacuggugaccagcaccaagucgggaaugagacccagggagucaccgccgagaucaccccucaagccagcacaaccgaggcgauccugcccgaguauggaacucuagggcucgagugcuccccgcggaccgggcuggacuucaaugagaugauccuccucacgaugaaaaacaaggccuggauggugcaucggcagugguucuucgacuuaccccugccuuggacgagcggcgccaccaccgaaacgccgacuuggaaccgcaaggagcuccucgugaccuucaaaaacgcccacgccaagaagcaggaggucguuguccugggaagucaggagggagcgaugcacaccgccuuaacgggggccacggaaauccagaacagcggcggcaccagcaucuucgcaggccaccugaagugcaggcugaagauggacaagcucgagcugaagggcaugucuuaugcuaugugcaccaacacguucgugcugaagaaagagguuuccgagacccagcacgggaccaucuuaaucaagguggaguacaagggcgaggacguacccugcaaaauaccuuucucaaccgaggacgggcagggcaaggcgcauaacggccgccucaucacggccaaccccgucgugaccaagaaagaggagcccgucaauauugaagcugaaccgcccuuuggggaaagcaacauagugauuggcaucggggacaacgcccucaagaucaauugguacaagaaaggcaguucaaucgggaagauguuugaggccacggccagaggggcccgucggauggcgauccugggagacaccgccugggacuucggguccgugggcggaguccucaauucuuuggguaagaugguacaucagaucuucgguuccgcguacacggcucuguucagcggcgugaguugggugaugaagaucggcaucggcguucuccugaccuggauaggauugaacagcaagaacaccuccaugagcuucuccugcaucguuauugggauaaucaccuuauaccuaggagccgucgugcaggccgauaugggaugcgugaucaauuggaaaggcaaagaacugaagugcgggagcgggauuuucguaaccaacgagguacacacauggaccgaacaguauaaguuucaagcggacucaccuaagagauuagcgacggcuaucgccggcgccugggagaacggagugugcggcauccgcaguacgacccggauggagaaccugcuguggaaacagaucgcuaaugagcucaauuacauacugugggaaaacaacauaaagcugaccguuguggugggggacaucaucggcguccucgagcaaggcaagagaacacugacgccgcaaccaauggagcuuaaguacagcuggaaaacgugggggaaggcgaagaucgucaccgccgaaacccaaaauagcuccuucaucauagacggcccaaauacucccgagugccccagugccuccagggccuggaacgugugggaggucgaagacuauggguucgggguguucaccaccaauaucuggcugaagcugagggagguauauacccaacugugugaucacagacucaugagcgccgcggucaaggacgagcgcgccgugcacgcagauaugggcuacuggaucgagucccagaagaacggguccuggaaacuugagaaggccucccugaucgaggugaagacgugcacguggccaaagucucacacccucuggucgaacggcgucuuagagucagacaugaucauccccaagucccuggcgggucccaucucccaacacaauuaccggccgggauaccacacccaaacggccggucccuggcaccucggaaagcuggaauuagacuucaacuacugcgaaggcacgacggugguaaucaccgaaaacugcgggacacgcgggcccagccuccggaccaccaccguguccggcaagcugauacacgaauggugcugccgcagcugcacccugccgccccugcgguacaugggcgaagacgggugcugguauggcauggaaauucgcccgaucucagagaaggaggagaacaugguuaagagcuugguguccgccggcagcggaaaggucgacaacuucacgaugggagugcugugccucgccauccuguucgaggaggugaugcgggggaaguucggaaagaagcacaugguggccgggguguucuuuacguucgugcugcuucugagcggccagaucaccuggagagacauggcgcacacccuaaucauggucgguagcaacgcgucagaccggauggggaugggaguuacguauuuggcucugaucgccaccuucaagauccagcccuuccuggcccucggguucuuccuucgcaaacugacgucccgggagaaucuccuucugggaguaggguuggccauggccacaacguuacaacugccugaagacaucgagcaaauggccaacggcaucgcacucggccugauggcgcucaaacucaucacccaguucgagacauaucagcuguggaccgccuuaaucagccucacauguucuaacaccaucuucacgcugaccguggccuggcgcacggcaacucuuauccuagccggugugucgcugcugccggucugccagucaucguccaugagaaaaaccgacuggcuccccaugacuguagcggcuauggggguuccgccccugccgcucuuuauuuuuagccuaaaagauacgcuaaagagaagaucguggccccugaacgagggagucauggcugugggacucgugagcauccucgccuccagccuguugcggaacgacguccccauggccgggccccucguggccggcgggcugcuaauagcuugcuaugugaucacgggaacaucggccgaucugaccgucgaaaaagccgcugaugugaccugggaagaagaggcggagcagacuggggugagccacaacuugaugaucacuguggacgacgacggcaccaugcgcauuaaagacgacgagacggagaacauccucaccgugcuacugaaaaccgccuugcugaucgugucaggcaucuucccguacucaauucccgccacgcugcucgucuggcacaccuggcagaagcagacccagcggucuggcgugcugugggacguacccagcccgcccgagacacagaaggcggagcuagaggagggcgucuacaggaucaaacaacaaggaauauuuggcaagacccaggugggcgugggcguccagaaggagggcguguuucacaccauguggcacguuacgcggggagccguccucacuuacaauggcaagcgccuggagcccaacugggcguccguaaagaaggaccugaucucauaugguggaggguggcgauuauccgcacaauggcagaagggggaggaggugcaggucaucgcgguggagcccggcaagaaccccaaaaacuuccagaccaugcccggcaccuuucagacaaccacaggggaaaucggcgccaucgcgcuggacuucaagcccgguaccagcggcagucccaucaucaaccgcgaggggaaaguaguagggcucuacgguaauggugucgucacaaagaacggugguuacguguccggcauagcacagacgaaugccgagccggacggcccgacacccgagcuggaggaggaaauguucaaaaagcgaaaccucaccaucauggaccugcaccccgggagcggcaagacacggaaguaccuuccggcaauagugcgcgaagccauuaagcgucggcucagaacgcugauccucgcccccacgcgggucgucgcagccgaaauggaggaggcccucaagggacugccaauccguuaccaaacaacggccacuaaguccgaacacacuggccgcgagaucguggaccugaugugucacgcaacauucacgaugcggcuccugucacccgugcgggucccgaacuacaaccugaucauuauggacgaggcccacuucaccgauccagccucuauagcugccagaggguacauaagcacccgggugggcaugggcgaggcggccgccaucuucaugacugccacaccucccggcacugcggacgccuuuccucagagcaaugcacccauccaagacgaagaacgcgacauccccgagcgcagcuggaacucgggcaacgaguggaucaccgacuucgcagguaaaacugugugguucguccccaguaucaaggcugguaacgacaucgcuaacugccugaggaaaaacgggaagaagguaauccagcuguccagaaagacuuuugacaccgaguaccaaaagaccaaacugaacgacugggacuucgugguaacaaccgacaucagcgagaugggagcaaacuuuaaagcugaccggguaaucgauccgcgacggugccucaagcccgugauccugaccgacggucccgagcgcguuauucucgccgggccaaugccggugaccgccgcguccgcggcacagcgccgcggcagagucgggcgcaacccacagaaggagaaugaucaguauauauuuacaggccaaccacucaacaaugacgaagaccacgcccacuggaccgaggcuaaaaugcugcuagacaacaucaacacgcccgaggggaucauaccggcauuguucgagcccgaacgggagaaauccgcagccaucgacggcgaguaucgcuuaaaaggagagucccggaaaacauucguggaguuaaugcgccgcggggaccucccgguguggcuagcccacaagguagcaagcgagggcauuaaguacacggaccgcaaguggugcuuugacgggcagcgaaauaaucagauccuggaggagaacauggauguagaaauuuggaccaaggagggagagaagaagaaacugcgcccgcgcuggcuggacgcgcggacauacuccgacccccuagcacuuaaggaguuuaaggauuucgccgccggccggaaaagcaucgcccuggaccuggugaccgagauaggcaggguccccucucacuuagcucaccgcacacggaacgcccuggacaacuuggucaugcuccacacaagcgagcacggagggaaggcauaccgccacgccguggaggaacugcccgagacgauggagacccugcuucugcugggcuugaugauccugcugacugggggugcgauguuauuccuuaucagcgggaaggggaucgguaagaccuccaucggucugaucugcgucaucgccagcuccgggaugcucuggaucgccgagauccccuugcaguggauugcgagcgccauuguccuggaguucuucaugaugguguuacuuaucccagagcccgaaaagcagagaacgccucaagacaaccaacuagcguacgucguaaucgggauccuuacccucgcagccaucaucgccgccaacgagaugggccugcuagaaaccaccaaacgcgaccuggguauguccaaggagccgggggugguaagccccaccuccuaucuugauguugaccuccaccccgcgagcgccuggaccuuauacgccguggccaccaccgucaucacgcccaugcugcggcauaccauagagaacucaaccgcgaacgugucgcucgccgccauagccaaccaagccgugguacugaugggacuggacaagggguggccgauaucuaagauggaucucggcgucccccugcuugcgcucggcugcuacagccagguuaacccccuaacccugacggcggcuguccuccugcugauuacccacuacgcgaucauaggcccgggacuccaagccaaggcgacccgcgaggcccagaagcggaccgccgccgggauaaugaagaacccgacgguggaugggaucaugaccaucgaucuggaccccguaaucuaugacuccaaguucgagaaacaacuggggcagguuaugcuccuagugcugugugccguucagcuccugcugaugcggaccaguugggcacucugcgaggcccugacacuagccacgggcccaauuaccacguuaugggagggaucccccggaaaguucuggaacaccacgaucgccguaucaauggccaauaucuuccggggcuccuaccucgccggugcgggccuugccuucagcaucaugaaauccguggggaccggcaagcgcgggaccggcagccagggcgagacacucggugaaaaguggaagaaaaagcugaaccagcugucacgaaaagaguuugacuuauauaagaaguccggcaucacagagguagaccgcacggaggcaaaagaagggcugaagcggggagagaucacgcaccacgcggucagccguggauccgccaagcugcagugguucgucgagcggaacauggugauacccgagggcagagucauugaccucggcuguggcaggggugguuggagcuauuacugcgcuggccuaaagaagguaaccgaagugcgcggcuacacgaaaggcggcccggggcacgaggaaccggucccgauguccacguauggcuggaacaucgugaaacugaugucagggaaggacguguucuaccuaccacccgaaaaaugugacacgcugcuuugcgauaucggagaguccagcccaucucccacugucgaagagagccggaccauccgggugcugaaaaugguggagccguggcucaaaaacaaccaguucugcaucaagguccugaacccauacaugcccacggugauagagcaccuggagcgucuccaacggaagcacggcgguaugcugguucgcaacccacugagccggaacuccacccacgagauguacuggaucuccaacggcacagggaacauagucgcguccgugaacauggugucucgucuccuacuuaaucgguucaccaugacguaucgacguccuacuaucgagaaagaugucgaucucggcgccggcacgaggcacgugaaugcggagcccgagacgcccaacauggacgucauaggggaacggauaaagcguaucaaggaggagcacaacaguaccuggcacuacgacgacgagaacccauacaagaccugggccuaccacggcuccuacgagguaaaggccaccgggagcgccuccagcaugauuaauggcguggugaagcugcuuacaaagcccugggacguggugccaauggucacacaaauggccaugaccgacacaacccccuuugggcaacaacgggucuucaaggaaaagguggauacgagaaccccgcggagcaugccaggcacccgcagggucaugggcaucaccgcggaaugguuauggcgcacgcugggucggaacaagaagccccgccugugcacacgugaggaguucaccaaaaagguucgcacgaacgcagccaugggugcgguauucacggaagagaaucagugggacagcgcgaaggcagccgucgaggacgaggacuuuuggaucuuaguggaccgggaaagggaguuacacaaggugggaaaaugcgguagcugcguguauaacaugauggggaagcgcgagaaaaaguugggggaguucggcaaggcuaaggggucccgcgccaucugguacauguggcucggagcacguuaccuggaguuugaggcucugggauuuuugaaugaggaccacugguucagccgagagaacagcuacagcgguguggagggggagggacugcacaaacugggauacauccuccgggauaucuccaagaucccuggaggcgccauguacgccgacgacaccgccgggugggacacucggaucaccgaggacgaccugcacaacgaagagaagaucacccagcagauggacccggagcauaggcagcuugcaaacgccaucuuuaaacucaccuaccagaauaagguggucaaggugcaacggcccacgcccaccggaaccguaauggacaucaucagccgcaaggaccagcgggggucuggacaggucggcacguacggccuaaacaccuucacaaauauggaggcccaacuuauccggcaaauggaaggugaggggguacucagcaaggccgaucuugaaaauccccaccucccugagaagaagaucacucaauggcucgagacgaaggguguagaacggcugaaacgcauggcgauuucaggcgaugacugcguaguuaaaccaaucgacgaccgguucgcgaaugcccugcuugcccugaacgacauggggaaggugcgcaaggauaucccccaauggcaacccagcaaggguuggcacgauuggcagcaggucccguucugcucgcaccauuuccaugagcugaucaugaaggacgggagaaagcugguggugccaugccgcccccaggaugaacugaucggucgggccaggauaagccaaggggcgggcuggucccugcgugagaccgcgugccuaggcaaggccuacgcccagauguggagccuaauguacuuccaccgccgcgaccugcgccucgcuagcaacgcaaucugcucggccguacccgugcacugggugccgaccucccgcacgacguggaguauucaugcacaccaccaguggaugaccaccgaagauaugcugaccgucuggaaccggguguggaucgaagacaaccccuggauggaggacaagacgccagugaccaccugggagaacguccccuacuuaggcaaacgcgaggaucaguggugcggcucccugaucgggcugacaucccgcgccacaugggcccagaauaucccuacugcgauucaacagguccggagcuuaaucgggaacgaggaguuccucgauuauaugccuuccaugaagagauuccguaaagaagaggagucggagggggcaaucugguga

SEQ ID NO: 25963 - RNA, 9873 nt, Artificial Sequence
  derived and/or modified CDS sequence (opt11) from DENV-3__EU687239__SS-prME
acuucgcugugccucaugaugauucugccggccgcccucgccuuucaccucaccucuagggacggggaaccucggaugaucgucgggaagaacgagcguggcaagagccugcuguucaagacggcuagcgggaucaacaugugcacccucaucgccauggaccugggggagaugugcgacgacaccgucaccuauaagugcccacauaucgccgagguggaacccgaggacaucgacugcuggugcaaucugaccagcacgugggugaccuaugggaccugcaaccaggcgggagagcaccgucgcgacaagcgguccgucgcgcucgcgccucacguggggauggggcuggacacgcgcacgcagaccuggaugagcgccgagggcgcguggcggcaggucgagaagguggaaaccugggcgcugcgccaccccggguucacgauccuugcccuguucuuggcccacuacaucggcaccucucuaacccagaagguggugaucuuuauucugcugaugcuagucacccccagcaugacgaugcgaugcgugggggugggcaaccgcgauuucgucgagggccuguccggcgccacauggguggacgugguucuggagcacggugggugcgugacgaccauggccaagaacaagccaacgcucgacauugagcugcagaagacugaagcaacccaguuagcaacucuacggaaauuaugcaucgaggggaaaaucacaaacaucacaaccgacucacgcugccccacccagggugaggccguucugcccgaggagcaggaccagaacuacgucugcaagcacacguacguugaccgcggguggggcaacggaugcggccucuucgggaaggggucccuggugaccugugccaaguuccagugccuggagcccaucgagggcaaggucgugcaguacgagaaucucaaguacacaguaaucaucaccguccacacaggggaccagcaccaggugggcaacgaaacucagggggucacggccgagaucacgccccaggcgucaacgaccgaggcuauccugcccgaguauggcacccuggggcucgagugcagcccccgcacggggcuggacuucaacgagaugauccugcuaaccaugaaaaacaaggccuggauggugcaucggcaaugguucuucgaucugccccugcccuggaccaguggcgcaaccaccgagacccccacguggaaccgcaaggagcuccuggucaccuucaagaacgcccacgcuaagaaacaggaggucguggugcuggggagucaggagggcgccaugcauaccgcccucaccggcgcuacggagauccagaacucaggugggaccuccaucuucgcuggccaccugaagugccggcugaagauggacaagcuggagcugaagggcaugucuuacgcuaugugcaccaauaccuuugugcugaaaaaggagguauccgagacgcagcacgggacuauuuuaauuaagguagaguacaagggcgaggacgucccaugcaaaaucccauuuucaaccgaggacgggcagggcaaggcccacaacggccgccugaucacagccaacccuguggugacgaagaaagaggagccagucaacaucgaagcagagccgcccuuuggggagagcaacaucguuaucggcguaggggauaacgcguuaaagaucaacugguauaaaaagggcucgagcaucgggaagauguucgaggccacggcccggggcgcgagacguauggcaauccugggagauaccgcgugggacuuuggguccgugggcggggugcucaauagccugggcaaaaugguucaccagauuuucgggucggcguauacugcccuguucucgggagucuccugggugaugaagaucggcauaggggugcugcugacguggauaggccuaaacagcaagaacaccuccaugagcuucuccugcauagccaucgggaucaucacccucuaccucggcgcugucguccaggcggauacggggugcgugauuaacuggaagggaaaggaacugaagugcgggagcggcaucuucgucacgaaugaggugcacaccuggaccgaacaauauaaguuccaggccgacucccccaagagacucgcuacagccaucgcuggagcgugggagaauggggugugcggcauacgcucgacaacuaggauggagaaucugcuguggaagcaaauagcgaacgaacucaacuauauccucugggaaaacaauaucaagcugaccgucgugguaggggacaucaucggcguccucgagcagggcaaacgcacacuaacgccgcaaccgauggagcugaaguacuccuggaagacauggggaaaggccaagaucguuaccgccgagacacagaacucauccuucaucauagauggcccaaauacgcccgaaugccccucagcgucccgggccuggaacgugugggaggucgaagauuacggguucggcguuuuuacaaccaauauaugguuaaagcugcgugagguguacacacagcugugcgaccaccggcucaugagcgcagccguuaaagaugagcgcgccgugcacgcggacaugggcuacuggauugagagccagaagaacggguccuggaagcuggagaaggcuagccuaaucgaagugaagaccugcaccuggccgaaaucccacacccuauggagcaauggcguccuggaauccgacaugauaauccccaagagccuggccgggccuauuucccagcacaacuaccgucccgguuaccacacccagaccgccgggccguggcaucucgguaagcuggaguuagacuuuaacuacugugaaggcacaaccguggugauaaccgagaacugcgggacccgcggccccagccuccggacgacaaccguguccgggaagcugauacacgaauggugcugucggagcugcaccuuaccgccucuccguuauaugggcgaagacggguguugguacggcauggagauccgaccgaucuccgagaaagaagagaacaugguuaagagccuggugagugccggcucggggaaggucgacaacuucacgaugggcguacugugccucgcuaucuuauuugaagaagugaugagagggaaguucggcaagaagcacaugauugcaggggucuucuucacguucgugcugcuacucuccgggcagaucaccuggagggauauggcccacacccugauuaugauuggcagcaacgcuagugacagaauggggaugggcgugacguaucucgcccuaaucgcgaccuuuaagauccaacccuuccuugcacucggguucuuucugcgcaaacugaccucccgagagaaccuccuccugggcguaggccuugccauggccaccacucugcagcugccggaggacauugagcagauggcuaacgggauugcacucggccugauggcucugaaguuaaucacccaguucgagaccuaccagcucuggacugccuuaauuagccuaaccugcucuaacaccaucuucacccugaccguagccuggcgcacagcgacccuaauucuugccgguguuagccuauugccggugugccaguccuccucgaugcgcaagagcgacuggcuacccaugacaguggccgccauggggguaccgccccucccgcuguucauauucucccucaaggacaccuugaaacgccgcagcuggccacucaacgaaggcgugauggccgugggacucguuucgauccuggcgucuucccugcuccggaacgacguucccauggcgggucccuuaguggcagggggccugcucaucgcaugcuacguaaucacggggaccucugccgauuuaaccguggagaaggcggcggacgugaccugggaggaagaagccgagcagacgggcgucucccauaaccugaugaucacuguggaugacgaugggaccaugcgcauaaaggacgacgaaaccgagaacauccugaccguucugcugaagaccgcccugcuuauugucagcggcaucuuuccauacucaauuccggccacacugcucguuuggcacacuuggcagaagcagacucggcggagcggggugcugugggacgucccaaguccgccagagacucagaaggcggagcuugaggaagggguguaccggaucaaacagcagggcauauucgggaagacccagguagggguuggaguucagaaggagggcguguuucauaccauguggcacguuacccgcggcgccgugcucaccuacaacgggaagcggcuagaacccaauugggccaguguuaagaaggacuugauuuccuauggcggaggcuggcgccucagcgcgcaguggcagaagggggaagagguccaggugaucgcgguagagcccggcaagaacccuaagaacuuccagacuaugcccgguacguuccagaccacgaccggggagaucggcgccgucgcccuggacuucaaacccggcacgagcggaucccccauuaucaaccgggagggaaaaguuguuggguuguauggaaauggggucgugacuaaaaacggcgguuacgugagcggcaucgcacagacgaacgccgagccggacggccccacccccgaauuagaggaggagauguucaagaagcguaaucucaccaucauggacuugcaccccggaucuggcaagacucggaaauaccugccggcgaucguucgggaagccaucaagcgccgccuccggacguuaauccuggcgccaacucgcgugguggccgcugagauggaggaggcguugaaggggcugccaauccgguaccagaccaccgccaccaagagcgagcacaccggucgugaaaucgucgacuuaaugugccacgccaccuucacaaugcggcuccugagucccgugcgagugccgaacuauaaccugaucauuauggaugaggcccacuucacggacccugccagcaucgcggcccguggguacauuuccacccgcgucggcaugggcgaggcggccgcgaucuucaugacugccacgccgcccggcacugccgacgccuucccacagagcaacgcccccauucaggacgaagaacgcgacaucccugaacgguccuggaacagugggaacgaguggaucacggacuucgcaggcaagacggugugguucguacccucaaucaaggccggcaacgauaucgccaacugucuccgcaaaaacggaaagaaagucauccagcugucacggaagaccuucgacacggaauaccagaaaacuaagcucaacgacugggacuucgugguuaccacggacauuuccgaaaugggcgcuaacuuuaaagccgaccgugucaucgacccgcggcggugccucaaacccgugauacugacggacgguccugagcgggugauucucgcaggacccaugccggucaccgccgccagcgccgcccagcgccguggcagaguagggcggaacccccagaaggagaacgaccaguauaucuucaccggccagccccuaaacaaugacgaggaucacgcgcacuggacagaagcgaagaugcugcuggacaacaucaacacgccggaaggcaucaucccggcucucuuugagcccgagagagagaaaagcgccgcgaucgacggcgaguaucggcucaagggagagagccgcaaaacuuucguggagcugaugcggcgcggggaccuacccguguggcuagcacauaagguggccuccgagggcauuaaauacacggaccggaaguggugcuuugacggucagcgcaacaaccagauccuggaggagaacauggacgucgaaaucuggaccaaagagggcgagaagaagaagcuacggccgcgcuggcuggaugcccgcaccuacagugauccgcuugcucucaaggaguucaaagacuucgcagccggccggaagucaaucgccuuagaucuggugaccgagauagggcgcgugcccagccaccuagcccaccggacccgcaacgccuuggauaaccuggucaugcuucacacaucugagcacggugggaaggcguaccggcacgccguggaagaacugccggagacaauggagacgcugcuauuacugggccucaugauccugcugaccgggggcgccaugcuauuccugaucucgggcaagggcaucggcaaaaccagcaucggccugaucugcgugauugccuccucaggcaugcucuggauggccgagauuccgcugcaguggauagcgagcgcaaucgucuuagaauuuuucaugauggugcuccugauacccgagccagagaaacagaggacgccccaggacaaccagcuggccuauguggucaucggaauccucacgcucgcggccaucaucgcggccaacgagaugggacugcucgagaccaccaagcgagacuuggguaugagcaaggagccgggaguuguguccccgacaaguuaccuggacgucgaccuacacccagcaucagcauggacccuguaugcgguggcuacaacuguaaucacgccaaugcugcgccauacaaucgagaacagcaccgccaacgucucacucgccgcgauugcgaaccaggccguggugcugaugggccuugacaagggguggccgaucagcaagauggacuugggcgucccccugcuggcccucgggugcuacucgcaaguaaaccccuuaacucuuacugccgccgugcuccugcugaucacgcacuacgcgaucaucgggcccggacuccaggccaaggccacccgggaagcccagaagaggaccgcugccgggaucaugaagaacccuaccgucgacggcaucaugacgaucgacuuagaccccgugauauacgauagcaaguucgaaaagcaacuuggacaggucaugcugcugguccuuugcgccgugcagcugcuucugaugaggaccuccugggcccuuugcgaggcccugacucuugcgaccggccccauaacgacccucugggaggggagccccgggaaguucuggaacacuaccauagccguuuccauggcuaacaucuuccgcggcuccuaucuggccggggccgggcuggcguucucaaucaugaaaagcgucgggacgggcaagcggggcaccggaucacaaggggagacacuuggggaaaaauggaaaaagaaacugaaccagcuuucccgaaaggaauuugaccuuuacaagaaguccggcauaaccgagguggaccggaccgaggcaaaggaggggcugaagcgcggcgaaauaacgcaccacgcgguaucccggggcagcgcaaaguugcagugguucgucgagcgcaauauggugaucccggagggucgggugaucgacuuaggaugcgggagaggagggugguccuacuacugcgcaggacugaaaaaggucaccgaggugcggggauauaccaagggcgggccggggcacgaggagccagugcccaugagcaccuacggcuggaacauagucaagcuaauguccgggaaggacguguucuaccugccgcccgaaaagugcgacacucuucugugcgacaucggcgagucuagucccagccccacuguagaggagucgcgcaccauccguguccuuaagaugguggagccguggcugaagaacaaccaguucugcauaaaaguguugaacccguacaugcccaccgucauagagcaucuugagcggcuccagcgaaagcacggagggauguuggugcggaacccgcuaagccgcaacuccacgcacgagauguacuggauaucuaacggcaccggaaacaucguugcguccgucaacauggugucccggcuccuccugaaccgcuuuaccaugacgcaccggcgcccgacaaucgagaaggacguggaccucggcgccgguacucggcacgugaacgcugagcccgagacccccaauauggacgugaucggcgagcgcaucaagaggauuaaggaggaacacaacaguaccuggcacuacgacgaugaaaacccguacaagacgugggcuuaccacggcucauacgaggucaaggcgaccggguccgcgucguccaugaucaacggcguggugaagcugcuuaccaagcccugggacgucgugcccauggugacacagauggccaugacggacaccacucccuucggccaacagcgcgucuucaaggagaagguagacacccggacgccgcguagcaugcccggaacaagacgcguuaugggcaucacugccgaguggcuuuggcggacccucggucgcaauaagaaaccccggcugugcacgcgcgaggaguucaccaagaagguccgcaccaacgccgcgaugggcgccguguucacagaagagaaucagugggacucugccaaagcagccguggaggacgaggacuucuggaagcucgucgaccgggaaagagaguugcauaagcuggggaagugcgguuccugcguguauaacaugauggggaagcgggaaaagaaauuaggggaguucgguaaggcgaaaggaucgcgggccaucugguacauguggcugggugcccgguaucuggaguucgaggccuugggguuccuaaacgaggaucacugguuuagucgugagaauagcuacuccgguguagaaggugaaggucugcacaagcucggcuacauccugagggacaucagcaagaucccagguggcgccauguaugcggaugacaccgccggcugggacacccgcaucacggaggacgaccugcacaacgaggaaaagauaacccagcagauggacccggagcaccggcaauuggccaacgcuaucuucaagcugacauaccaaaacaaggucgugaagguucagcgccccacucccacaggcaccgugauggacauuaucucccggaaggaccagcgcggcagcggccagguaggcaccuacgggcugaacacguuuacuaacauggaggcgcagcucauccggcagauggagggagaggggguucuauccaaagcggaccuggagaauccccaucucuccgaaaagaagauaacccagugguuggagaccaagggcgucgagcgccugaaacggauggccaucucuggugaugacugcguggugaagccgaucgacgacagguucgcgaacgcgcuccuggcucugaacgauauggggaaggucagaaaagauaucccacaguggcagccaucaaagggcuggcacgacuggcaacaggugcccuucugcucccaccauuuccaugagcugaucaugaaggaugggcgcaagcugguagucccaugucggccucaagacgagcuaauuggccgagcgcggaucagccaaggggccggcuggucccuccgcgagacggccugucugggcaaggcauacgcacagauguggagccugauguauuuccaccguagagaccuucgcuuagccuccaacgcuauuugcagcgcgguacccguacacuggguccccacgagccggaccaccugguccauccacgcccaccaccaauggaugacgaccgaggacaugcugaccguuuggaaccgaguauggaucgaagauaacccuuggauggaggacaagacccccgucacgaccugggaaaaugugcccuaccucgggaagagggaagaccaauggugcggcagccugauagggcugaccucccgcgcaaccugggcccagaauauaccgacggcuauccaacaggugcggagccucaucggcaacgaggaguuccuggacuacaugccguccaugaagcgguuccggaaggaagaggagucugagggggucauaugguga

SEQ ID NO: 25964 - RNA, 9873 nt, Artificial Sequence
  derived and/or modified CDS sequence (opt11) from DENV-3__FJ182004__SS-prME
acgagccuaugccucaugaugauccugcccgcggcccuagcguuccaccucaccagccgggacggggagccccggaugaucguggggaagaacgaacgcgguaaguccuugcucuuuaagaccgccagcggaauuaacaugugcacccucauagccauggacuuaggugaaaugugugacgacacggugaccuacaagugcccccacaucgccgagguugagccugaagacaucgauugcuggugcaaccugacuagcaccugggugaccuacgguaccugcaaccaagcuggggaacaccggcgagauaagcgcuccgucgcgcuagcgccccaugugggcaugggucuggacacuaggacccagacuuggaugucagccgagggggcguggcgccagguggagaaggucgagacgugggcacugcgccauccgggguuuacuaucuuggcacuguuccuggcacacuacaucggcaccagucucacgcagaagguggucaucuucauccugcugaugcucgucacacccagcaugacgaugcggugcgugggggugggcaaccgugacuucguugagggccuguccggggcgacguggguggacgugguacuggagcacggggguugcgucaccaccauggccaagaauaagccaacccuugacauugagcugcagaagacggaagcgacccagcuggcuacacuccggaagcugugcaucgagggcaagaucacgaauaucaccacugacagccgcugucccacccagggcgaggccguccugccugaggagcaagaccaaaacuacgugugcaagcacacguauguugaccggggauggggcaaugggugcggccuauucgggaagggcucccuagugaccugcgccaaguuccagugccuggagcccaucgagggcaagguagugcaguacgagaaccucaaguacacggugaucaucaccguccacacgggggaccaacaccagguagguaacgagacccaaggggucaccgccgagaucacaccucaggccagcacgaccgaggccaucuuacccgaguacggcacgcuugggcucgaaugcucaccgcggaccggacuggacuucaacgagaugaucuugcucacuaugaagaacaaggccuggaugguacacaggcagugguucuuugacuugccccugcccuggacgagcggggccacuacagaaaccccgacuuggaaccgcaaggagcuccuggugacuuucaaaaacgcccaugcaaagaaacaggaagucgucgugcuggggucccaggagggggcaaugcacaccgcacucaccggggccacggagauccagaacagcggcgggaccuccauauucgccgggcaccuuaagugccgucugaaaauggauaagcucgagcugaaggggaugagcuaugcgaugugcacuaacaccuucguacugaagaaagaggugucggagacgcaacaugggaccaucuuaaucaaaguggaguacaaaggcgaagacgcgcccugcaagaucccauuuagcaccgaggacgggcaaggcaaggcacauaacggccgccugaucaccgcuaaccccgucgugacaaagaaggaagaaccugugaacauugaggcggagccgcccuucggggagucaaauauagucaucgguaucggggacaacgccuuaaagaucaacugguacaagaagggcaguagcauuggaaagauguuugaagccaccgccagaggggcccgccggauggcgauccugggcgauaccgccugggauuucgggaguguuggaggggugcucaauucccugggcaagaugguccaccagaucuucggguccgcguacaccgcccuguuuuccggcguguccugggucaugaagaucggcaucgggguauugcugacguggaucggccuuaauagcaagaacaccuccaugaguuucagcugcauagccaucgggauuauuacccucuaccugggugcuguggugcaggcggauaccgggugugucaucaacuggaaggguaaggagcugaaaugcggcagcggaauauucguaacgaacgaggugcacaccuggaccgagcaguauaaguuccaggccgauucgcccaagcgccucgcgaccgcaaucgcgggcgccugggaaaacggggucugcggaauccgcucaacgacccggauggagaacuuacucuggaagcaggucgccaacgagcucaacuauauccugugggagaacaauauaaagcugacaguagucguaggggacauuaucggcguguuagagcagggcaagcggacacugacgccgcaaccuauggagcugaaguauuccuggaaaaccuggggcaaagccaagaucgucaccgcugagacccagaacagcuccuucauaaucgauggucccaauacucccgagugccccuccgcaucaagggccuggaaugugugggagguggaggacuauggcuuugggguguuuacuaccaacaucuggcugaagcugagggagguguacacccaacugugcgaccaccggcucaugagcgcggcgguuaaggacgagcgcgcgguacacgccgacaugggauacuggaucgagagccagaagaacgggaguuggaaacuugagaaggccagccugaucgaggucaagaccugcacguggccgaagucacacacccucuggagcaauggcguacuggaguccgauaugaucaucccuaaaucucuggccgggcccaucucccagcacaauuaccggccaggcuaccacacccagaccgccggucccuggcacuugggcaaacuggagcuggacuuuaacuacugcgagggcacgaccgucgugaucaccgagaauugcgggacccgcggcccgagccuccggacgaccaccguguccgggaagcugauccacgaguggugcugccgcagcugcacccugcccccguugcgguauaugggcgaagacgggugcugguacggcauggaaauccgccccauauccgaaaaggaggagaacauggucaagagccucgugucggcgggcagcggcaagguggauaacuuuacgaugggcguccugugccuugccauccuguuugaggaggugaugcgcgguaaguucggaaagaagcacaugauugccgguguguuuuucaccuucguccugcuccugaguggccagaucacauggcgcgacauggcccacacccugaucaugauuggcaguaacgccuccgaccggauggggaugggggugacauaccucgcgcuaaucgccaccuuuaaaauccagcccuuccuggcccucggguucuuccuucgaaaacuuaccucgcgggagaaccuccugcugggcgugggacucgccauggcgaccacacugcagcugccugaggacaucgagcagauggccaacgggauagcccucggccugauggccuuaaaacuuaucacccaauucgagacauaccagcuguggaccgcccuaaucagccugacuuguagcaacaccaucuucacccugaccgucgcguggcgcacagccacccuaauccucgccgggguaucgcugcugccagucugccaguccagcaguaugagaaaguccgacuggcucccuaugaccguggccgccaugggcgugccgccgcucccgcuguucaucuucucccucaaagacacgcugaagcgccgcagcuggccccugaacgagggggucauggcggugggucucguguccauucuugccagcucccugcuccggaacgacgucccuauggcgggcccccuaguggcagggggccuucuaaucgccugcuacgugaucacggggacaagcgcugaccugaccgucgaaaaagccgccgacguaacuugggaggaggaagccgagcaaacuggcgugucccauaaccugaugauuaccgucgacgacgacggcacgaugcgcauaaaagacgacgagacugagaacauccugaccguguugcugaaaacggcccuccugauuguuagcggcaucuucccguacuccaucccggccacucugcucgucuggcacaccuggcaaaagcaaaccagacguagcggugugcugugggaugugcccucaccgccugagacgcagaaagccgaguuggaggagggggucuaccgcaucaaacaacagggcaucuucgggaagacucaagugggagugggagugcagaaggaagguguguuccacaccauguggcacguuacccgaggcgccguccucacguacaacgggaagcggcuggagcccaacugggccuccguuaagaaagaccugaucuccuacggagggggcuggcgccucagcgcgcaauggcagaaaggggaggaggugcagguuauugccguggaacccgggaagaaccccaagaacuuucagaccaugccuggcaccuuccagacgacgacuggggagauaggcgcaauugcccuggacuucaagcccgggaccagcggcagccccaucauaaaccgggagggcaagguggucgggcuguacggcaacggggucgugaccaaaaacggcgguuacgucucggggaucgcccagacgaaugcggagccggacggcccuacccccgagcuggaagaagaaauguucaaaaagcgcaaccucaccaucauggaccugcaccccggguccggcaagacccggaaguaucugccggcuaucguacgagaggccaucaagcggaggcuccggacgcugauacuggcacccacccgagucgucgcugcggagauggaggaagcucucaaagggcugccgauaagauaccaaaccaccgccaccaaaagcgaacacacuggccgcgagaucguugaccuuaugugccacgccacuuuuacaaugcggcuccugagccccgugcgugucccgaacuacaaucugaucaucauggaugaggcccacuucacugacccagcgucaaucgccgcccguggguacaucuccacccgcguuggaaugggagaagccgcggccauauucaugaccgccacaccgcccgggacugccgacgccuucccccagagcaaugcgcccauccaggacgaggagcgcgacauucccgagcggaguuggaacuccggaaacgaguggauuaccgauuucgccgggaaaaccguaugguucgucccauccaucaaagccggaaacgacauagccaacugcuugagaaagaacgggaagaaagugauccagcuuucucggaagaccuucgauacggaguaccagaagacaaagcuaaacgauugggacuucguggucaccacugacaucuccgagaugggggcuaacuucaaggcggaccgcgugaucgauccgcggcgcugccugaagccggucauccugacggauggccccgaacgggucauacuagccgggcccaugccggugaccgcugcaagugccgcgcagcgccggggccgcgugggucggaauccucagaaggagaacgaucaguacauuuucaccggccaaccccucaacaaugacgaggaucacgcccacuggaccgaagccaagaugcugcuggacaacaucaacaccccggaggggaucaucccggcccuuuucgagcccgagcgcgagaagucugccgccauagauggcgaguaccggcugaagggagagagccguaagacguucguugagcugaugcggcgcggagaccuccccguguggcucgcccacaaggucgccuccgagggaaucaaguacaccgacagaaaguggugcuuugacgggcaacgcaacaaccagauacuugaagagaauauggacgucgagaucuggacgaaggagggcgagaagaagaagcucaggccccgcuggcuggacgcgcgcacuuacagcgacccgcuggcucucaaggaguucaaagacuucgcagccggaagaaagaguauugcacuggaccuugugacggagaucggacgcguuccgagccaccuagcccaccggaccagaaacgcgcuggacaaccuggugaugcuccacaccagcgaacacggcgggaaggcauaccggcacgccgucgaggagcuaccagagaccauggagacccuauugcugcugggcuugaugauccugcuuaccgggggcgccaugcuguuucugauauccggcaaggggaucggaaaaaccuccaucggccugaucugcgucauugccuccuccgggaugcucuggauggcggaaauuccgcugcaauggaucgccuccgccaucguuuuggaguuuuucaugaugguucuacugauuccggaaccagagaagcagcgaacgccccaggauaaccaauuggccuacguugugaucgggauucucacgcuagcugcgaucaucgcugccaacgagaugggucugcucgaaacaaccaaacgggaccugggcaugucgaaggagccgggggugguauccccuaccagcuaccuggacgucgaccuccaccccgccagcgcuuggacacuguacgccguggccacaaccgucauuacccccaugcuacggcacacaaucgaaaacagcaccgcuaacgucucccucgcggcuauugccaaccaggccgugguacugaugggccuggauaagggguggccgaucagcaaaauggaccucggggugccccugcuugcgcucgggugcuacucucaggugaauccucugacccugacugcugcgguauuguuacucaucacgcacuacgccaucauuggcccuggcuugcaggcuaaggcuacgagggaggcccagaagaggaccgccgccgggaucaugaagaacccgacuguggacgguauaaugacgaucgaccuagauccggugaucuacgacagcaaguucgagaagcaacuggggcagguaaugcuucugguucugugcgcuguccagcugcugcuaaugcgcaccuccugggcccucugcgaagcguugacacuggcgacuggccccauuacuacuuuaugggagggcagccccgggaaguucuggaacacuaccaucgccgucagcauggccaacauauuccgcggaagcuaccuggccggggccggccucgcguucuccaucaugaagucgguagguacggguaagcgcggcacgggaucgcagggugaaacccucggggagaaauggaagaagaaacuuaaccagcugucccgaaaggaguucgacuuguauaagaaguccggcauuaccgaaguugaccggaccgaagcuaaagaaggccuaaagagaggcgaaaucacucaccacgcggucagccgcggcuccgccaagcuacagugguucguugagagaaacauggugaucccggagggcagggucaucgaucucggaugcggucgcggcgggugguccuacuacugcgcgggccugaaaaaggugaccgaaguacggggcuacaccaagggcgggccggggcacgaggaaccagucccaaugaguacuuacgguuggaacauugugaaguugaugagcgggaaggauguguucuaccucccuccagagaagugugacacgcuacugugcgauaucggggaaucauccccuagccccacggucgaggagucccgcaccaucagaguccugaagaugguggaaccguggcucaagaacaaucaguucuguauuaagguguuaaacccauacaugcccaccgucaucgagcaccuggaaaggcuccagagaaagcacggcgggaugcuggugcggaacccucuaagccgaaauuccacacacgagauguacuggaucucaaauggaaccggaaacaucgucgccuccgucaacauggugucucggcuccugcucaaucgcuuuaccaugacacaccgccguccuacgauagagaaggacgucgaccuaggcgcggguacccggcaugucaacgccgagcccgagacccccaacauggacguaaucggugaacgcauaaagcggaucaaggaggagcacaacucuaccuggcacuaugacgaugagaaucccuacaagacgugggccuaucacggcucauacgagguaaaagcgacgggcagugccagcagcaugaucaauggcgugguaaagcugcugaccaagcccugggacgugguaccaaugguaacgcagauggccaugacugacacuacccccuuugggcagcagcgcguguucaaggaaaaaguggauacccggacgccacgcuccaugccuggcacccgucgcgucaugggcaucaccgcugaguggcucuggagaaccuuaggacgcaacaagaaaccccgucugugcacgcgagaagaguuuaccaagaaagugcgaaccaacgcggccaugggcgcaguguuuacggaggagaaccagugggacucagccaaggcugcggucgaggacgaggacuucuggaagcucguugaccgcgagcgcgagcugcacaagcucggaaaaugcggauccuguguguacaacaugauggggaagcgggagaagaagcuaggcgaauuuggcaaggccaaggggagcagggcgauaugguauauguggcuaggcgcccgguacuuggaguucgaggcccucggguuccuuaaugaggaucauugguucucccgcgagaacaguuacaguggggucgaaggagagggguuacacaaacucggcuauaucuugagagauauaagcaagauucccggaggggcgauguacgcggacgacacggcgggcugggacacccgcaucaccgaggacgacuuacacaacgaggaaaagauuacgcaacagauggacccggagcauaggcaguuagccaacgccaucuuuaagcucacguaccagaacaaggucgugaagguucagcgcccgacacccacaggcacagugauggacaucaucucccggaaggaccagcgcggcagcggccaagugggaacguacgggcugaacacguucaccaauauggaagcucagcuuauacggcagauggagggcgaggggguccugaccaaggccgaucuugaaaacccacaccuauccgagaagaagaucacccaguggcuugagacaaaaggcguggagaggcuaaagcggauggccauuagcggcgacgacugcgugguaaagccgaucgacgaccgauucgccaacgcccuccuggcucugaacgauauggggaaagugcggaaggacauaccccaguggcagccuuccaagggcuggcaugauuggcagcagguucccuucugcagccaucacuuccacgagcucaucaugaaggacggcaggaaacuuguggugccgugccggccacaggacgaacugaucggccgggcccggaucucccaaggcgcuggcuggagccuccgagaaaccgccugccugggcaaggcauacgcacagauguggucccugauguacuuccacagaagggaccuccgucuggccagcaaugcaauaugcuccgccgugccagugcacuggguccccaccagccggaccacguggucgauucacgcgcaccaccaguggaugaccacagaagauaugcugaccguguggaaccgcguguggauagaggacaacccguggauggaggacaaaacgccaguuaccaccugggaaaacgugccguacuuagguaaacgggaggaccaauggugcggcucucugauagggcugacaucacgagccaccugggcccaaaacauucccaccgccauccagcagguccggucucugaucggcaaugaggaguuccuggacuauaugccgagcaugaagcguuuccggaaagaggaggagucagagggggcaauuugguga

SEQ ID NO: 25965 - RNA, 9873 nt, Artificial Sequence
  derived and/or modified CDS sequence (opt11) from DENV-3__FJ024465__SS-prME
accagccugugcuuaaugaugauucuccccgcugcccuggccuuucauuugacuagccgggacggcgagccccggaugaucgucgggaagaacgaacgggggaagagccuucuguucaagacggcguccgggauaaacaugugcacccuuaucgcuauggaccugggcgaaaugugugaugacacagugaccuacaagugcccccauauugcggagguagaaccagaggauaucgauugcuggugcaaccugacgagcaccugggugaccuacgguaccugcaaccaggccggggagcacagaagggauaaacggaguguagcucucgcaccccacgugggcauggggcuggacacacgcacacaaacuuggaugagcgccgaaggcgcuuggcgccagguagaaaagguagagaccugggcacuucgccacccggguuucacgauccucgcccuguuccuggcccacuacauaggcaccucccuuacacagaaggugguuauauucauccugcuaauguuagucacccccagcaugacuaugagguguguuggggugggcaaccgcgacuucgucgagggccuguccggggccaccuggguggaugugguccuggagcacggggguugcgugacuaccauggcaaagaacaagccuacucucgacaucgagcuucagaagaccgaggccacccagcuugcgacgcuccggaagcucugcaucgagggcaagaucacuaacauuacgacagacucucgcugcccuacccagggugaggcggugcugccggaggagcaggaccagaauuacgucugcaagcacacguacguggaccgcggguggggcaaugggugcggacucuucgguaaaggcucgcuggucacaugcgccaaguuccaguguuuagagcccaucgagggcaagguaguacaguaugagaaccucaaauauaccgugaucauaacuguccacacuggugaccagcaucaggugggcaacgagacccaaggagucaccgcggaaaucacgccccaggccagcacgacagaagccauacugccugaauacggcacgcugggccucgagugcuccccucgaaccggccuggacuuuaaugagaugaucuugcucaccaugaaaaacaaagcauggaugguucaccggcagugguucuucgaucugccccugcccuggacgagcggagcgaccacugagaccccaacuuggaaccgcaaagaacuccuggucacuuucaagaacgcccacgcgaagaagcaggaggucgugguuuuggguagucaggagggcgccaugcacaccgcucucacuggggccacagagauccagaacagcggcggaaccuccauauucgcgggccaucugaaaugccggcucaagauggacaagcuagagcugaagggcaugagcuacgcgauguguacuaauacguucguuuugaaaaaggaaguguccgagacgcaacacggcaccauauuaaucaagguggaguacaagggcgaggacgucccgugcaagauucccuucucgaccgaggacggacagggaaaggcgcacaacggcagauugaucacagcuaaucccgucguaacgaaaaaggaagaacccgucaacauagaggccgagccaccauucggugaaucgaacaucguuaucggaaucggggacaacgcccugaagaucaacugguacaaaaaaggcagcagcauugggaagauguucgaggccaccgcgcggggcgcccgccggauggcgauccuuggggacacugcgugggauuucgggucgguaggcgggguucucaacaguuuaggcaaaauggugcaucagaucuucggguccgcguacaccgcccuguucucgggaguaucuuggguaaugaagauaggcaucggggugcuccugacguggauuggccugaacuccaagaauaccuccaugagcuucucaugcaucgccauagggaucaucacccucuacuugggcgccgucguccaggcggacacaggcugcguaauuaacuggaaaggaaaggaacugaagugcggcagcggaauauucgugacaaacgaggugcacaccuggacggagcaauacaaauuccaggccgacagccccaagcgacuggccacagccaucgccggcgcgugggagaacgggguaugcggcauccgcaguaccacccgcauggagaaccugcuguggaagcagauugccaaugagcucaacuacaucuuaugggaaaacaacaucaagcugaccgugguaguaggggacaucauaggcgugcucgagcaaggcaagcgcacgcuuaccccccagccuauggaacugaaauacaguuggaaaacuuggggaaaggcaaagaucgucaccgccgaaacccaaaauagcagcuucaucaucgauggacccaauacucccgagugccccagcgccucccgggcuuggaauguuugggagguggaagacuacggguucggugucuucaccaccaauaucuggcucaagcugagggagguauacacucagcugugugaccaccggcucaugagcgcagcagugaaggaugagagggcgguccaugcagacaugggcuacuggaucgagagccagaagaacgggagcuggaagcuggaaaaggccagccugaucgaggucaaaaccugcacguggcccaagucccacacucucuggaguaacggcguccuggagagugauaugaucauacccaaaagccuagcggggcccaucucccagcacaacuaccggccgggcuaucauacucagaccgccgggcccuggcaccuaggaaagcucgagcuggauuucaacuacugcgagggcacuaccgucgugaucaccgagaacugugggacacggggccccagccuccggacgaccaccgugucugguaaacugauccacgaguggugcugccgcagcuguaccuugcccccgcuccgcuacaugggagaggacgggugcugguauggcauggaaauccgccccauauccgagaaggaagaaaacaugguuaagagccugguuuccgccggcagcgggaaggucgacaacuucaccauggggguccugugucucgcgauucuguucgaagaggugaugcgagggaaauucgggaaaaagcacaugauugcggggguguuuuucacguucgugcuguugcugagcggccaaaucacuuggcgcgauauggcgcauacccugaucaugauuggcagcaacgccuccgaucggaugggcaugggcguaacuuauuuagcgcugauugcgaccuucaaaauccagccguuucuggcccucggguucuuccugcgcaagcuuacgagccgagagaaccuacuguuaggcguuggacuugccauggcaacuacgcugcagcuacccgaggacaucgagcagauggcgaacgggaucgcccucggacugauggcgcugaagcucauaacccaguuugagacguaucagcuguggaccgcccugaucagccucacgugcaguaacacaaucuucacccugacagucgcuuggcgcacagccacccuuauucucgccgguguuagccugcugccggucugccagucgucuagcaugagaaagagcgacuggcugcccaugaccguggccgcuauggggguuccgccccugccgcuguucaucuuuuccuugaaagacacccugaagcggcgcucauggccccugaacgagggagucauggccgucggcuuaguuucaauucuggcaagcucccugcuccgaaacgacguacccauggccggcccccugguagccggcggccuccucauugcgugcuacgugauuacgggaaccagugccgaccuggcugucgagaaggccgcagacgugacaugggaagaggaggcggagcagaccggcgugucccacaaccugaugauuacggucgacgacgaugggacuaugcgcaucaaggacgacgagaccgagaacauccucacgguucugcugaaaaccgcucuccuaauugugaguggcaucuucccguacuccauccccgcaacucugcucguauggcacaccuggcagaagcagacccagcggagcggaguguuaugggauguaccuagcccccccgagacccagaaggccgagcuggaggagggaguauaucguauaaaacaacagggcauuuuuggcaagacccagguggggguggggguccagaaagagggcguguuccacaccauguggcacgucaccagaggggccguccucaccuacaacgggaagcgccuggagccuaacugggcaucaguuaaaaaggaccucauuuccuacggcggggguuggcggcucagcgcgcaguggcagaagggggaggaagugcaggucaucgccguggaacccggaaagaaccccaagaacuuccagacgaugcccggcaccuuccagaccacaacgggggaaauuggcgccaucgccuuagacuucaagcccggaacaagcggcucuccuaucaucaaucgcgagggcaagguugucggacuuuacggcaacggcgugguuaccaagaacggcggguaugucagcgggauagcacagacgaacgcggaaccggacggccccacaccagagcucgaggaagaaauguuuaagaaacguaauuuaacuauuauggaucuccacccgggcucaggcaaaacacgcaaauacuugcccgccauuguucgcgaagccaucaaacgccggcuccguacucugaucuuggcucccacgcgcguggucgccgccgagauggaggaggcacugaaaggccugcccauacgcuaccagaccacagccacuaagagcgaacacacgggccgggagauuguggaucugaugugccacgccaccuucacgaugagacucuugagcccggugagagucccgaacuacaaccugauaaucauggacgaagcacauuucaccgacccggcgucuauagccgcccgcggguacaucuccacacgugugggaaugggcgaggcagcugccauauuuaugaccgccacgccgcccggcaccgccgacgcauucccgcaaucaaacgcgccgauucaggacgaggagcgagacauacccgagcggucguggaacucgggcaacgaguggaucacggacuuugccgggaagacggugugguucguccccuccaucaaggccggcaacgacauagccaacugucuccggaagaacgggaagaaggugauccaacugucacgaaagaccuucgacacagaauaucagaagacaaagcugaaugauugggacuucguugucaccaccgacaucuccgagaugggcgccaacuucaaggcggaccgggugauugacccucgccggugccucaagccuguuauccuaacggacggccccgagcgcguaauccuugcuggccccaugcccgugacugccgccucagccgcgcaacggcgagggaggguugggcgcaacccccaaaaggagaacgaccaauauaucuuuacgggccagccgcuuaacaacgacgaagaccacgcccacuggaccgaagccaagaugcugcuggauaacauuaacacccccgaggggaucauaccggccuuguucgaaccggagcgggagaaauccgcggccaucgacggcgaguacaggcugaagggcgaguccagaaagaccuucgucgaacugaugaggcgcggagaccucccaguauggcuggcccauaaggucgccuccgagggcaucaaauacacggaccgcaagugguguuucgacgggcagcggaacaaccagauccuugaggagaacauggaugucgaaaucuggaccaaggagggggagaagaagaagcuucgcccucgguggcuggacgcuaggaccuacagcgauccacuggcucucaaggaguuuaaggacuucgccgccgggcgcaaauccaucgcccuggaccuggugacagagauuggccggguaccaagccaccuagcacaccgcacucguaaugcgcuggacaaucuggugaugcuccacaccagcgaacauggcgggaaggcguaccgccacgcgguggaggaacuacccgaaacuauggagacucuguuauugcuggggcucaugauuuuacuaaccggcggggccaugcuguuccugaucuccgguaaggggaucggcaagaccagcauaggccugaucugcgucauugccuccuccggaaugcucuggauggcugaaauuccucuucaguggauugccuccgccaucguacuggaauucuucaugaugguucuccugauccccgaacccgaaaagcaacguaccccccaggacaaccaacuggcuuaugucgugaucggaauccucacccuugccgccauaauagccgcgaacgagaugggccucuuggagacgacgaagcgcgaucugggcaugagcaaggagccaggaguggucuccccuacuagcuacuuagacguagaucuccacccggcguccgccuggacucuguacgccguggccacgacggugaucacccccauguuacggcacaccauugagaacucuacggccaacguguccuuggccgcgauugcaaaccaggcugugguacugaugggcuuagacaagggauggccgaucucgaagauggaccucggcgugcccuugcucgccuuaggguguuacucccaggugaacccccugacuuuaacugcugccguccuccugcugaucacgcacuacgccaucaucggccccggccuucaagccaaagccacgagggaggcccaaaagcggaccgcagccgggauaaugaagaacccgaccguggacgguauuaugacaaucgaucuggaucccgucaucuacgacagcaaguuugagaaacagcugggucaggugaugcugcuggugcugugcgccgugcagcuccugcucaugcgcacguccugggcccuaugugaggcacugacccuggcgaccgggccuaucaccacgcuuugggagggaagccccggaaaguuuuggaacaccaccaucgccgucuccauggccaacaucuuucggggcaguuaccuggccggggcuggcuuagccuucuccauuaugaaauccguggggaccggcaaacgcgguacugguagccagggcgagacgcucggggagaaguggaagaagaagcugaaccagcucucacggaaggaguucgaucucuacaagaagucuggcaucacagaggucgaccgcaccgaggccaaggagggguugaagcgaggcgaaaucacccaccacgccgucuccagagguucugcaaagcugcaaugguucguagaacggaacauggugaucccugaggggcgcgucauagacuuagguugcgggaggggcgguuggucauacuauugcgcgggccuaaagaagguaacggaggugcgcggauacaccaagggcggucccgggcacgaagaacccguucccaugagcaccuauggcuggaacaucgugaagcugauguccggaaaagacguguucuaccucccacccgagaaaugcgauacccugcugugugacauaggugagucguccccaucacccacaguggaggaaucccgaacuauccgcguacugaagaugguggaaccguggcucaagaacaaccaauuuugcaucaaaguucugaacccguacaugcccacggugaucgaacaccucgaaaggcuccagcggaagcacggcgggaugcuagugcgcaacccccugagccggaacuccacccaugaaauguacuggaucucgaacggcaccgggaauauuguagccuccgugaacauggugagcaggcuccuguuaaauagguucaccaugacucaccgccggcccaccaucgagaaggacgucgaccucggggcuggcacgcgccaugugaacgccgagcccgagaccccaaauauggacgugaucggggagcgaauaaagcgcaucaaagaggagcacaacucuaccuggcacuaugacgacgaaaauccguauaagaccugggcauaccauggcucguacgaggugaaagcgacuggguccgcaagcagcaugauaaauggcguggucaaacugcugaccaagccgugggacgucgugcccaccgugacacagauggccaugacggauaccacccccuucgggcagcagcggguuuucaaggagaagguugauacccgcacgccgagauccaugcccgguacacgccgggucaugggcaucacagccgaguggcucuggcgcacccuggggcggaacaagaagccacgacuuugcacgcgggaggaguucacaaagaaagugcggaccaacgcggcaaugggggccguguucaccgaggagaaccagugggacagcgcaaaagccgcggucgaggacgaagacuuuuggaagcucgucgacagagagcgcgaguuacacaagcuggggaagugugguaguugcguguauaauaugauggggaagcgggagaagaaauuaggcgaguucggaaaggccaaggggagccgggcaaucugguauauguggcuaggggcacgcuaucuggaguucgaagcgcuuggcuuccucaacgaggaucacugguucucacgggagaauuccuacucuggggucgagggggagggccuacacaagcugggguacauccuucgagacaucagcaagaucccggguggugcaauguacgcggaugacacggccgguugggacacccgcaucaccgaggaugauuugcacaacgaggagaagauuacccagcaaauggacccggagcaccgccagcuugccaaugcaaucuucaagcuaacauaccagaacaagguuguuaagguccaacggcccaccccgaccgggacugugauggacaucaucucgcguaaagaccagcggggcagcggccagguuggcaccuacgggcugaacacguucacgaauauggaggcgcagcucaucaggcaaauggagggcgaagggguccuguccaaggccgaccuggagaauagccaccucucugagaagaagaucacccaguggcuugaaaccaaggggguggaaagacugaagcgcauggccaucagcggcgacgacugcgugguaaagccaaucgacgaccgguucgcaaaugcccuucuggcgcugaacgacauggggaaggugcgcaaagacauaccgcaauggcagcccuccaaaggcuggcacgacuggcagcagguccccuuuugcucccaccacuuccacgagcucaucaugaaggacgggagaaagcuggucguacccugccgcccgcaggacgaacucauaggccgugcccguaucucacagggagccggcuggagccuccgggaaacugccugucuggguaaagcguacgcccaaauguggucgcugauguacuuccaccgcagggacuugcgucuggccagcaacgccaucuguucggcgguacccguccacuggguccccaccagucggaccacuuggagcauccacgcgcaccaccaguggaugacgaccgaagacaugcugaccguguggaaucggguauggaucgaagacaaccccuggauggaagacaagaccccgguaacgacgugggagaacgugccuuaucuggggaagcgcgaggaucaguggugcggcucccugauuggacugaccagccgggcgaccugggcccagaacauccccacggccauccagcaaguacgcuccuugauugggaaugaggaguuccucgacuacaugcccagcaugaagcgguuuagaaaggaagaggaguccgagggggcaauuugguga

SEQ ID NO: 25966 - RNA, 9873 nt, Artificial Sequence
  derived and/or modified CDS sequence (opt11) from DENV-3__FJ024466__SS-prME
accagccuaugccucaugaugaucuuacccgcagccuuggccuuucaucucaccagccgggacggcgagccucggaugauuguagggaagaacgagcggggcaaaucccugcuguucaagaccgccuccgggaucaacaugugcacucucaucgccauggaucugggggagaugugcgacgacacugugaccuauaagugcccccacaucgcggagguggagcccgaggauauagauuguuggugcaaucuaaccagcaccugggugaccuaugggaccugcaaccaggcgggcgagcacaggcgcgacaagagguccguggcguuggcuccccacguggggauggggcuggacacgcgcacccaaaccuggaugucugccgagggcgcauggcgccagguggagaagguggagaccugggcacugcgccacccgggguucaccauccucgcccuguuccuagcccacuauaucgggaccagccucacccagaagguugugaucuuuauccugcugaugcuuguuacccccucuaugacgaugagauguguuggggucggcaaucgcgauuucguugaaggccugucgggggccaccuggguggacguuguacuggaacacggcgggugcgugaccaccauggccaagaacaagcccacgcucgacaucgagcugcaaaaaaccgaggcgacucagcuggccacccuacggaagcugugcaucgaaggaaaaaucacgaauaucacgacagauagcaggugucccacucagggcgaggcggugcugccggaagagcaggaccaaaacuaugucugcaagcacacguacguggaccggggguggggcaauggguguggcuuguucggcaaggguucccuggugacgugcgccaaguuccaaugccucgagcccaucgagggcaaggucguccaguacgagaaucucaaguacaccgugaucaucaccguucauacgggggaucagcaccaggugggcaacgagacucagggcgugaccgccgaaaucacuccccaagcauccacgaccgaggcgauauugcccgaauacggcacccucggguuggaaugcuccccgcgcaccggccuggacuuuaacgagaugauccuccucaccaugaagaacaaggcguggaugguucaccgacagugguucuucgaccugccgcugcccuggaccagcggcgccaccacagaaacccccacguggaaccggaaggaauuacuggugaccuucaagaacgcccacgcgaaaaagcaggagguuguggugcuggggucccaggagggcgcuaugcacaccgcccucacgggggcaacggaaauccagaacucgggagggaccagcauauuugccggucaccugaaaugccggcugaagauggauaagcuugagcugaaagggaugagcuacgcgaugugcaccaauaccuuuguccugaagaaggagguuuccgaaacgcagcaugggacaauacucauaaagguggaguacaagggggaagacgcaccaugcaagauacccuuuagcacugaagacgggcagggcaaggcccauaacggccgucugauuaccgcuaaccccgucgugacgaagaaagaggaacccgugaacaucgaggcggagccgccauucggcgaaucgaacaucguuauuggcaucggagacaacgccuuaaaaauaaacugguacaagaagggcucgagcauagggaagauguucgaggccaccgcccguggagcgcgcagaauggcaauccugggcgacaccgcuugggacuucggcuccgugggcggggugcuuaacagcuuggggaagauggugcaccaaaucuucggaagugccuacaccgcucuguuuagcggcgugucaugggugaugaagaucggcauaggggugcuccuuacguggaucggccucaacagcaaaaacaccuccaugucauucuccuguaucgccaucgggaucaucacucucuaccugggcgcuguugugcaagcggacaccgggugcgucaucaacuggaagggcaaggagcugaaaugcggcagcgggaucuuugugacgaacgaagugcacaccuggaccgagcaguauagauuccaagccgauagucccaaacgacucgccacugcaaucgcgggcgcaugggagaacggugucugcggcauacggagcacgacccgcauggagaacuuacuguggaagcagaucgcaaacgagcucaacuacauccugugggagaacaacauaaaacuuaccguggucgucggagacaucauaggcgugcucgagcagggcaagcggacccucacaccccagccgauggaacucaaauacuccuggaagaccuggggcaaggccaagaucgugacugcggagacccagaacucguccuuuaucaucgaugggcccaacacgcccgagugccccagcgccucccgcgcauggaauguuugggagguggaagacuauggauucgggguguucaccacgaacauuuggcucaaacugcgcgagguuuauacccagcugugcgaccaucgucuaauguccgcggccgucaaggacgagcgcgcggugcacgccgacaugggcuacuggaucgagucccagaagaacggguccuggaaguuagagaaggccagccugaucgaaguuaagacaugcacauggccgaagucccacacccuauggaguaauggcguccuggagagugacaugaucauccccaagagccuggcagggccaaucucccagcacaauuaccgcccgggcuaccauacccagacagccgggcccuggcaccucggcaagcuggagcuggauuucaacuacugcgaaggaacgacgguggucaucaccgacaauugcggcacccgaggccccucccuacgcacgaccaccguuuccggaaagcucauccacgaguggugcugccggucaugcacccugcccccucuccgcuacaugggagaagacgggugcugguacggcauggagauacggcccauauccgagaaggaagagaacauggucaagagccucgucuccgcgggcucugggaagguggacaacuucacgaugggggugcugugcuuggccauccuuuucgaggaggucaugcgcgggaaguucggcaagaagcacaugaucgcggggguguucuucaccuucgugcugcucuuguccggccagauuaccuggcgggacauggcccacacucugaucaugauagguaguaacgccuccgaccggauggggaugggcgucacguacuuagcgcugaucgccaccuucaagauccagcccuuucuagcccucggguuuuuccuucguaaguuaacgagccgcgagaaccuccuccugggcgugggccucgccauggcgaccacgcugcaguugccugaggacaucgagcagauggccaacgggauugcccucggccugauggcccugaagcucaucacccaauucgagaccuaccagcuguggaccgcccugaucagccuuacgugcaguaacaccaucuucaccuuaaccguugcguggcggacggcgacccuaauccucgccggggucagccugcugccuguaugccaguccuccuccaugcgcaagagcgacuggcuccccaugacgguugccgcgaugggaguaccgccccucccgcuguucaucuucucccucaaggacacccugaagcgacguagcuggccccuaaacgagggggugauggccgugggccuaguguccauccuggcaagcagucugcuucgcaacgacgucccaauggcgggaccccuggucgcuggaggccuguuaauagccugcuaugucaucacagggacgagcgcggaccugaccguggagaaggcggccgacgucacaugggaggaggaggccgagcagacgggcgugagucacaaccugaugauuaccguggaugacgacggcaccaugcguaucaaggacgaugagaccgaaaacauucucaccgucuugcugaagacggcucuccugauagugagcgggaucuuuccguacuccauucccgcgacacugcucguguggcauaccuggcaaaagcagacccgccggagcggcguccugugggacgugcccucacccccggagacacaaaaggccgagcuagaggaagggguauaccgcaucaagcaacaggggaucuuugguaagacccaaguaggcguaggggugcaaaaggagggcgucuuccacaccauguggcacgugacccggggcgcagugcucacguacaacgggaagcgccuggagccuaacugggccagcgugaagaaggaucugauuuccuacggcggaggcuggaggcucagcgcucaauggcagaagggagaggagguccaggucauugccguggaacccggcaagaauccuaagaauuuccagacaaugcccggcacuuuccaaacaacuaccggggaaaucggcgccauugcccuggacuucaagcccgggacuagcggcaguccuauuaucaaccgagagggcaagguagugggguuauacggaaacggggucgugacgaagaacgguggguauguauccggcauugcacaaacgaacgcugagccagauggucccacccccgagcucgaggaggagauguucaagaagcggaaucuaaccaucauggaucugcaccccggguccggcaaaacccgcaaguaccuuccggcaauuguccgggaggccauaaaacgccggcuccgcacucugauauuggcuccaacgagaguggucgccgcggagauggaggaggcccucaagggccuccccauccgcuaccagacaaccgccacuaaguccgaacacaccggccgggagauaguagaccugaugugccacgccaccuucacuaugcgucucuuguccccgguucggguaccgaauuacaaccugaucaucauggacgaggcccacuuuacggaccccgcgagcauagcggcccgcggauauaucagcacccgagucggcaugggcgaggcagcggcuauauucaugaccgccacgccgcccggaacugcugacgcauucccgcagagcaacgcgcccauccaagaugaagagcgggacaucccugagcgcucauggaacagcggcaaugaauggaucacugacuucgccgggaagaccgugugguucgugcccucgaucaaggccggaaacgacaucgcuaacugccuccggaagaaugggaagaaggucauccaguugagccgaaagacuuucgauacggaauaucagaagacaaagcugaacgacugggacuucguggugaccacagacaucuccgagaugggcgcuaacuuuaaggcggaucgggucaucgacccgcgccggugcuuaaagcccgugauccucacggauggccccgaaagagugauauuggccgggccgaugccggucaccgccgccagcgccgcgcagcggcgcggccggguggggcggaacccccagaaggagaacgaccaguacaucuucaccggccagccccucaacaaugaugaggaccacgcccacuggaccgaggccaagauguuacuggauaacauuaacacgccggaggggaucauaccggcacucuucgagcccgagcgggagaaguccgcagccauagacggcgaguaccgccugaagggcgagucccggaagacguuuguggaguugaugcgacggggggaucuccccgucuggcuggcccacaagguggccucagaaggcaucaaguacacagaccgcaaguggugcuucgacgggcagcggaacaaucagaucuuggaggagaacauggaugucgagaucuggacgaaggagggcgagaagaagaagcuccgcccccgcugguuagaugcucggaccuacucugacccgcuugcgcucaaggaguuuaaggacuucgccgccggccgcaaguccaucgcccuggaccuuguaacggagaucgggcgcgugcccagccaucucgcgcaccgcacccggaacgcgcuggacaaccuugucaugcuccacaccagugagcacgguggcaaggccuaccgccacgcuguagaggaacugcccgaaaccauggagacgcuucuccugcugggccuaaugauccugcugaccgggggcgccaugcuguuccugaucucgggcaagggaauuggcaagaccucgauuggucugauaugcgugaucgccuccagcggcaugcuguggauggcggaaaucccccuucaguggauagcauccgccaucguccuggaguucuuuaugauggugcuauugauccccgaacccgaaaagcagcggacgccacaggacaaccagcuggcguacguggucaucgggauccucacgcuggcagcgaucaucgcugcaaaugagaugggccuccuggagaccaccaagcgcgaccugggaaugucuaaggaaccggggguagugucccccaccagcuaccuggacgucgaccuccaucccgccuccgcauggacgcuguacgcaguugccaccacagugauuaccccgaugcugcggcauacgaucgagaacagcaccgcuaacgucucccucgccgcgaucgcuaaccaggccguagugcucauggggcuggacaagggguggccgaucucuaaaauggaccucggcgucccacuccuggcccucgggugcuacucgcaggucaacccucuaacgcugaccgccgccguguugcuauugaucacgcacuacgccaucauuggccccggccuacaggcgaaggcaacgcgggaggcccagaagcguaccgcggccggcaucaugaagaacccgaccgucgauggcaucaugacgauugaccuggaccccgugaucuacgacagcaaguuugagaagcaguugggccaggugaugcucuuaguauugugcgccgugcaacuccugcugaugcgcaccuccugggcccucugcgaggcgcugacucuggccacaggacccauuacgacucucugggagggcagccccgggaaguucuggaauaccacaauagcaguguccauggccaacauauucagaggcagcuaucuggcaggggccggccuggccuucuccaucaugaaguccgucgggacgggcaaacgcggcaccgggagccagggcgagacccucggcgagaaguggaaaaagaagcugaaucaacuaucacggaaggaguuugaucuauauaagaaguccgguaucaccgaggucgaccgcaccgaggccaaggaggggcugaagcggggcgagauaacgcaucacgcagugucccgcggcagcgccaagcugcagugguucgucgagagaaacauggugauaccggagggccgcgugaucgaccuagggugcgggcggggagggugguccuacuacugcgccgggcugaagaaggucaccgaggugcggggcuacaccaaaggcgggcccgggcacgaggagccugugcccauguccacuuauggcuggaacaucgucaaacugauguccgggaaggacguguucuaccucccgcccgagaagugcgacacguuacugugcgacaucggcgagagcucuccuucaccaaccguggaggagucccggacgauacgggugcugaaaaugguggagccguggcuuaagaacaaccaguucugcaucaaggugcucaaccccuauaugcccacagugaucgagcaccuggagcgccuccaacgaaagcacggcgggaugcucgugcgcaacccccuuagccggaacuccacgcaugagauguacuggauaagcaacggcaccggcaacauuguggcuagugugaacauggugagccgcuugcugcugaaccgauucacgaugacccaccguagaccgacgaucgagaaagacgucgaccucggcgcgggcacccgccacgucaacgccgagcccgaaacuccuaacauggacguaaucggggagcgcaucaagcgcaucaaagaggagcacaacuccaccuggcacuacgaugacgagaaccccuacaagacgugggccuaccauggcagcuacgagguaaaggcgacuggguccgccagcagcaugaucaacggcgucguaaaacuacugaccaagcccugggacgucgugcccauggugacccaaauggcaaugacagauacaacacccuucgggcagcagcgggucuucaaagagaaaguggacacccgcacaccucggaguaugcccggcacccgccgggugaugggcaucaccgcugaguggcucuggagaacccucgggcggaacaagaagccccgucucugcacacgggaagaguucacuaagaagguccggacgaacgcggcaaugggcgcaguguuuaccgaggagaaccagugggacagcgccaaagccgcgguggaggacgaggacuucuggaagcucgucgacagagaacgggagcugcacaagcuggggaaguguggcuccugcguguacaauaugauggggaagcgggagaagaagcuuggugaguucgggaaagccaaggggucgcgggccauuugguacauguggcugggcgcucgcuauuuagaguuugaagcucucgguuuccucaacgaagaccacugguucucccgagaaaauagcuacuccggggucgagggggagggccugcacaagcucggcuacauccugcgggacaucucaaagaucccaggcggcgcgauguacgccgacgacacggcggguugggacaccaggauaacugaggacgaucugcacaacgaggagaaaaucacccaccagauggauccggagcaccgccagcuugccaacgcuauuuucaagcugacguaccaaaacaaggucgugaagguucagcggcccacacccaccgguaccguuauggacaucaucucccgcaaggaccagcggggcagcggccaggugggcaccuaugggcugaacacguucaccaacauggaggcgcagcucauccgccagauggagggagagggggugcucuccaaggccgaccuggaaaacccccaccucuccgagaagaagaucacccaguggcuggagaccaagggcguggagcggcugaagcgcauggccaucuccggcgacgauugcgugguuaaaccgaucgacgaccgcuucgccaacgcccuccuggcacugaacgacauggggaagguccguaaggacaucccccaguggcaaccgagcaagggcuggcaugacuggcagcagguccccuucugcucgcaccacuuccacgagcucaucaugaaggacgggcggaaauugguugucccgugucgcccccaggacgagcugaucggcagagcgcgcaucucacagggggccggauggucgcuccgagaaacggcgugccugggcaaggcguacgcccagauguggucccugauguacuuucaucggcgggacuugcgucuggccuccaacgccaucugcuccgccgugcccguacauuggguacccacuucccgcaccaccugguccauucacgcgcaccaccaguggaugacgaccgaggacauguuaaccguauggaaccggguguggaucgaggacaaccccuggauggaagacaaaacucccgucacuacaugggagaaugugcccuaucuuggcaagcgcgaggaccagugguguggcagccugaucgggcugacgucacgggccaccugggcccagaauauccccacagcuauacaacagguccgcagccucauuggcaacgaggaguuccucgacuacaugccguccaugaagcgguuccgcaaggaggaggagagcgagggagcuaucugguga

SEQ ID NO: 25967 - RNA, 9873 nt, Artificial Sequence
  derived and/or modified CDS sequence (opt11) from DENV-3__FJ024467__SS-prME
accagcuuauguuugaugauggugcugcccgcggcgcucgcguuccaccucaccagccgcgacggcgagccccggaugauuguagggaagaacgagcgcggcaagagccugcuguucaagacggccuccgggaucaauauguguacccuaauugccauggaccucggcgagaugugugacgauaccguaaccuacaagugcccacacauuaccgagguugagcccgaagacauugacugcuggugcaaccugaccagcacuugggugaccuacgggacgugcaaccaggccggcgagcaccggcgcgauaagcgguccguggcgcuggccccccaugucgggaugggguuggacacccggacccaaaccuggaugucugccgagggcgcuuggcggcaggucgagaagguggagacgugggcccugcgccacccgggguucacaauccucgcgcuguucuuggcccacuacaucgguacgucccucacccagaaagucgucaucuucauccugcugaugcuggugacgcccucuaugaccaugcggugcgugggggugggcaaccgcgacuucguggaaggccuguccggggccaccuggguggauguuguccuggagcacggugggugugugaccaccauggccaagaauaagccaacccuagacaucgagcuacagaaaaccgaggccacccagcuggcgacgcuccggaagcuuugcaucgagggcaagaucaccaauauaaccacggauagccggugccccacccagggugaggccguccuaccagaagagcaagaucagaacuacgugugcaagcacaccuacguggaccggggguggggcaacggcugcggguuauucgggaaaggcucccuugugaccugcgcuaaguuccagugccuggagcccaucgaagguaaggugguacaguaugagaaccugaaauacaccgucaucaucacgguccauacuggggaucagcaccagguagguaacgaaacccagggggugacggcggagauuacgccccaagccagcaccaccgaggcgauccuccccgaauacggcacccugggguuggaguguuccccgaggacgggccuggacuucaacgagaugaucuuacucacgaugaagaacaaggccuggauggugcaccggcagugguucuuugaccugccccuacccuggacgagcggagccaccaccgagacgccgacguggaaccgcaaagagcugcuggucaccuucaagaaugcccaugccaagaagcaggagguggugguacuggggagccaggagggcgcgaugcacaccgcccucacgggggccaccgagauccagaacaguggggggaccucaauuuuugccgggcaccugaagugccggcugaaaauggacaagcucgagcugaagggcaugagcuacgcuaugugcaccaacacguuugugcugaagaaggagguguccgagacccaacaugggaccauucugaucaagguagaguacaagggcgaggacgccccgugcaaaaucccguucagcaccgaggacggccagggcaaggcccacaacgggcgccugauuacugccaacccgguggucaccaagaaagaagagcccgugaacaucgaggcagagccgccguucggggagagcaacaucgugaucggcaucggggacaacgcccugaagaucaacugguacaagaagggcuccagcauagggaagauguucgaggccacugcccggggcgcacgccggauggccauccugggggacaccgcgugggacuucggauccgugggggggguacucaacucgcugggaaagauggugcaccaaaucuuugguuccgcguauacggcccuguucagcggugugucgugggucaugaagauaggcaucgggguacuuuuaaccuggauuggccugaacucaaagaacaccuccaugucguucuccugcaucgccauaggggugaucacccucuaucugggcgcaguaguacaggcggauauggggugcguaaucaacuggaaaggcaaggagcuaaaauguggcagcggcaucuucgucacgaacgaggugcacaccuggaccgagcaguacaaguuccaagccgacucccccaagagacucgccaccgcgaucgcaggcgcgugggagaauggggugugcggcauucgcaguacuaccaggauggagaaccugcuguggaagcagaucgccaaugagcucaacuacauccuaugggagaacaacaucaagcugaccgucguggugggggacaucaucggaguacucgagcaaggcaaacgcaccuugacgccccagccgauggaacugaaguauuccuggaaaaccugggggaaggccaagaucguaaccgccgagacgcagaauagcuccuucaucaucgacggacccaacacaccugagugcccaagcgcuucacgggccuggaacgugugggagguugaggauuacggguucggcguguucacgacaaauauauggcugaagcugagggagguguacacccaacugugcgaccaccggcucaugagcgcggccgucaaagacgagcgcgcagugcaugcggacaugggcuacuggaucgagagccaaaagaacggguccuggaagcuggagaaggccagccugauagagguaaagaccugcacguggccgaagucccacacccucugguccaacggcgucuuggaguccgacaugauaauucccaagucccuggcagggcccauaucucagcacaaccaucggccggguuaucagacccagaccgccgggcccuggcaccugggcaagcuggaauuagauuucaacuacugcgagggcacgaccguuguaaucaccgagaacugcgggaccaggggccccagccuccggacgaccaccgucuccgggaagcuaauucacgaauggugcugccgcagcugcacacugcccccgcuccgguauaugggcgaggacggaugcugguacggcauggagauccgcccuaucuccgagaaggaggaaaacauggucaagagccuuguguccgccggcagcggcaaggucgacaacuucacgaugggugugcugugccucgcgauccuguuugaggaaaugaugcgggguaaauucgguaagaagcacaugaucgccgggguauucuucaccuucguguuacuccugagcggucagaucaccuggcgggacauggcccacacacuaaucaugauuggcagcaacgccuccgaccgaauggguaugggagugacuuaccucgcccugauagcagccuuuaagauccagccguuucuggcacucgguuucuuccugcgcaagcugaccagccgggagaaucuacugcugggcguuggccuugccauggcaaccacucugcagcucccugaggacaucgagcagauggccaacgggaucgcccucggucuuauggcccugaaacucaucacgcaguuugagacauaccagcucuggaccgcccugauaagcuuaaccugcuccaauacaauguucacuuuaaccgucgcguggaggaccgccacgcuaaucuuagccggggugagccugcugccggugugccaaucaagcuccaugcggaagacagauuggcuccccauggccguggccgcgaugggggucccgccgcucccucuguuuaucuucagccucaaggacacccugaagcgccgcuccuggccccugaaugagggggucauggccguggggcucgugaguaucuuagccuccagccugcuccggaacgacguccccauggcagguccucuuguggccgggggauugcuaaucgcaugcuaugugaucaccgggacuuccgccgaccugaccgucgaaaaggcugccgacaucaccugggaggaggaggccgagcagaccggcgugucacacaaccugaugaucacgguggaugaugacgggaccaugcgcauaaaggaugacgagacugagaacauccucaccguccugcugaagaccgcgcuccugaucguguccggcguuuuccccuacagcauucccgccacgcugcucgucuggcacaccuggcagaagcaaacccagcgguccggcgugcugugggacgugccaagcccgcccgagacccagaaggcagagcuggaggagggggucuaccguaucaagcagcaagguaucuucgguaaaacccaagugggcguggggguccaaaaggaaggcguauuccauacuauguggcacguaacccgaggcgccguccuuaccuacaacgggaagcgccuggagcccaacugggcgagugugaaaaaagaccugaucagcuacggcgggggcuggcggcucuccgcccaguggcaaaagggggaggaagugcaggucaucgccguugagccgggcaagaacccuaagaacuuccagacgaugcccggcaccuuccagaccacaacgggugaaaucggcgccaucgcccuggacuucaagcccggcacgagcgguagcccuaucaucaaucgagagggcaagguggucgggcuguauggaaacggugugguuaccaagaacggcggguacgucagcggcaucgcacagaccaacgccgagccggacggacccacgcccgagcuggaggaagagauguucaagaagcggaaccucaccaucauggauuuacaccccggaagcggcaagacccgcaaguaucugccggccaucgugcgggaggccaucaaacgccggcuccgcacgcugauccuggcccccacucggguggucgcggcugaaauggaagaggcccuaaagggucugccuaucagguaccagaccacggcaaccaagagugaacacacgggcagagaaaucguugaccugaugugccacgccaccuucaccaugcgccuccugagcccagugcgagucccuaacuacaaccugauuauaauggacgaagcccacuucacagaccccgccaguaucgcugcccgcggguacaucagcacgcgugugggaaugggcgaggcggccgccauuuucaugacugccacaccgccaggaaccgccgaugccuucccacaguccaacgcuccaauccaggacgaggaaaaggacauccccgaacgaagcuggaacuccggaaaugaguggaucacggauuucgccggaaagaccgugugguucguccccagcauuaaagccggcaaugacaucgcaaacugccuccgcaagaacgggaagaaagugauccagcucagccggaagaccuucgacaccgaauaccagaagacgaagcuaaaugacugggauuucgugguuaccaccgacaucagugagaugggcgcgaacuucaaagccgaccgcgugaucgaccccagacgcugccuaaagcccgucauacugaccgacggcccggagcgcguuauauuagccgggcccaugccgguaacagcugcauccgcggcccagagacggggccgcgugggucggaacccccagaaggagaacgaccaauauauuuucaccggccagccgcucaacaaugacgaggaucacgcccauuggaccgaggcaaagaugcugcuggacaacaucaauaccccagaaggaaucaucccggcacucuucgagccagagagggagaaguccgcugcaaucgacggugaguaucggcuaaagggcgagucccggaagacauuugucgagcucaugcggcggggggaccuaccaguguggcuggcccacaaggucgccagcgagggcaucaaguacaccgaccggaaguggugcuucgacgggcagaggaacaaccagaucuuggaggagaacauggacguggagauauggacgaaagagggcgagaagaagaaguugcggccccgcugguuagacgcuagaacuuauuccgacccucuggcccucaaggaguucaaggauuuugccgcaggccgcaaguccaucgcucuggaccuggugacggaaaucgggcgcgucccgucccaccucgcgcacaggacucggaacgcgcuggacaaccuggugaugcuccacacuucugagcauggagggcgggccuaccgccacgcaguagaggaguugcccgagacgauggagacccugcuccugcugggccucaugauccugcugaccggcggggccaugcuguuccugauaagcgggaaggggaucggaaaaacaaguauagggcugaucugugucauugcgagcagcggcaugcuguggauggccgagaucccacuacaauggaucgccucagccaucguccucgaauucuucaugaugguacucuuaaucccagaacccgagaagcagaggacgccccaagacaaccaguuagccuacguggugaucgggaucuugacccuugcugccaucaucgccgccaacgagauggguuuacucgagacgacgaagcgcgaucugggcauguccaaggagccggggguggucagcccaaccuccuaucuggacguggaccuccaucccgcguccgcuuggacgcuguaugcgguggccacgaccgucaucacaccuaugcugcggcacaccaucgagaacucuacggccaacguaagccucgcagccauugcgaaccaagcggugguccugaugggcuuggauaagggcuggccgaucucaaagauggaccucggcgugccccugcuugcccucgggugcuacagucaggugaauccucugacccugaccgcggcgguucuccuacugaucacccauuacgccaucauugguccgggccuccaggccaaggccacgcgugaggcgcagaagcggaccgcggccgggaucaugaagaacccgacaguggacggcaucaugaccaucgaucuggaccccgugaucuacgacuccaaguuugagaagcaguuagggcaggucaugcuccugguguuaugcgccgugcagcuccugcuaaugcgaacuagcugggcgcugugcgaggcccucacccuugccaccggacccauaacgacguugugggaaggcuccccggggaaguucuggaacaccacaaucgccgucagcauggcaaacaucuuccgggguuccuaccuggcgggugccggccuggcuuucagcaucaugaaguccguagguaccggcaagcgcggcacggggagucagggagagacccucggggagaaguggaagaaaaagcugaaccagcugucgcggaaggaguucgaucucuacaagaaguccgggaucacugagguggaccgcaccgaagccaaggaggggcugaaaagaggcgagaccacgcaccacgcugucagccgcggcaccgcgaaacugcaaugguucguggagcggaacaugguuaucccggagggccgcgucaucgaucucgguugcggucggggugguugguccuacuacugcgccggcuugaaaaaggugaccgaggugcgcggcuauaccaagggugggcccgggcacgaggagccuguccccaugagcacuuacggcuggaacauugugaaacugauguccgggaaagauguguucuaccucccacccgagaagugcgauacccuucugugcgacaucggagagaguucccccucccccaccgucgaggagucccgaaccauccgcgugcuaaaaaugguggagccguggcucaagaacaaucaguucugcaucaaggucuuaaacccauacaugcccacggucaucgagcaccuggagcgcuuacagagaaagcacggcggaaugcuggugcgcaacccccugagccguaacuccacccacgagauguacuggaucuccaacggcaccgggaacauagucgccuccgugaacauggugagccgccuccuccugaaucgguucaccaugacgcaccgccggccgaccaucgaaaaagauguugaucugggcgccggcacccgccacgucaacgcagaacccgaaacccccaacauggacgucaucggggaaaggauaaaacgaauuaaggaggaacacaacagcacguggcacuaugaugaugagaacccguacaaaacaugggcguaccacgggagcuaugaggucaaggccaccggaucugccagcuccaugaucaacggcguggucaagcuguuaacaaagcccugggacguugugcccauggucacgcagauggcaaugacugauaccacccccuucgggcagcagcggguauucaaggagaagguggacacgcgcacgccgcggagcaugcccggcacucgccgggcgaugggcaucaccgccgaguggcucuggcgcacgcuggggcggaacaaaaaaccccgccugugcacgcgggaggaauucaccaagaagguccgcacaaacgccgccaugggcgcuguguucacggaggagaaccagugggauagcgccaaggccgccguggaggacgagaacuucuggaagcuaguagaccgcgagcgagaacugcacaaacuggggaagugcggcucuuguguguacaacaugaugggcaagcgcgaaaagaaguuaggcgaguucggcaaggccaaggggucccgugccaucugguauaugugguuaggugcccgcuaccuggaauucgaggccuugggguuccugaacgaggaccacugguucucacgggagaacagcuacuccggcguggagggggaaggccugcacaagcucggguacauccuccgcgauaucagcaaaauccccgggggugccauguacgccgacgacaccgccgggugggacacacggaucaccgaagacgaucugcacaacgaggagaagaucacgcagcagauggacccggaacaccgccagcucgcgaacgccaucuucaaacugacuuaccagaacaaggucgugaaggugcaacggcccacccccaccggcaccgucauggacaucaucucccgcaaggaccagcgagggagcggccaaguggguacguacggucugaacaccuucacuaauauggaggcccagcuuauccgacagauggagggcgaggggguucugucuaaggccgaccuggaaaacccacaccugccggagaagaaaaucacccaguggcuggagaccaagggugucgagcggcugcgucggauggcaauaucgggcgaugacugcguggugaagccgaucgacgacagauucgcgaaugcccucuuagcccugaacgauauggggaagguccggaaggacaucccacaguggcaaccguccaagggcuggcacgacuggcagcaggucccguucugcagccaucacuuccacgaguuaaucaugaaggacgggcgcaaacuggucguccccugccggccccaggacgagcugauugggcgcgcacggaucucccagggagcgggcuggagccucagggagaccgccugccuaggaaaggccuacgcccaaauguggagcuuaauguacuuccaccgcagggaucuccguuuggccagcaacgcgaucugcuccgcugugcccgugcacuggguuccgacgagccggaccacgugguccauccacgcccaucaccaguggaugacaaccgaggacaugcucaccguguggaaccgaguguggaucgaggacaaccccuggauggaagacaagacgccaguuaccacuugggagaacguuccuuaucucgggaagcgggaggaccaguggugcggaagccuaaucgggcugaccagccgcgccacgugggcccagaacauaccgaccgcgauucagcaaguccgcucccucaucggcaaugaggaguuccuagacuacaugccaagcaugaagcgcuuccguaaggaggaggaguccgaaggggccaucugguga

SEQ ID NO: 25968 - RNA, 9873 nt, Artificial Sequence
  derived and/or modified CDS sequence (opt11) from DENV-3__FJ024468__SS-prME
accucgcugugucuaaugaugauccugccggccgcucuggcuuuucaccucaccagccgggacggggaaccccggaugaucguggggaagaacgagcgcggcaagucucugcuguucaagaccgcgucggguaucaacaugugcacccucaucgcgauggaucugggcgagaugugugacgacaccguaacguacaagugcccucacaucaccgagguggaacccgaggacauagacuguuggugcaaccugaccagcaccugggugacguacgggacgugcaaucaggccggcgagcaucggcgugacaagcggucagucgcccucgcgccccacgugggcaugggacuggacacccgaacccaaaccuggaugagcgccgagggcgccuggcgccagguggagaaggucgagacuugggcccuacgucacccgggguucaccauacucgcguuauuccuugcacacuauauugguacuagccuuacccagaaggugguaauuuucauccuccugaugcuggucacgcccucgaugaccaugcggugugugggggugggaaaccgggacuucgucgaaggccuguccggggccaccuggguggacgugguccuggagcacggcgggugcgugaccacgauggcgaagaauaaacccacccucgauauagagcugcagaagaccgaagccacccagcuggcgacgcuccggaaacuuugcaucgaaggcaagauuaccaacauuaccaccgauucccgcugccccacgcagggcgaggccgugcugccggaggagcaagaccagaacuacgucugcaagcacacauauguggaccggggguggggcaauggauguggccuguucgggaagggcucccuggugaccugugcaaaguuccagugccuggagcccaucgagggcaaggucgugcaguaugagaaccugaaguacacagugaucaucacgguccauaccggggaccagcaucagguggggaacgagacccagggagucacagccgagaucacaccgcaggccagcacgaccgaggccauccugcccgaguacggcaccuuaggacucgagugcuccccgcgcaccggccuggacuucaaugagaugauccuacucacuaugaagaacaaagcauggaugguacaccggcaaugguucuucgaucugccccugcccuggacgagcggcgcaacuaccgagacgcccaccuggaaccgcaaggagcuccuggugaccuucaagaacgcccacgcgaagaagcaggagguugugguccuggguagucaggagggagcgaugcacaccgcccucacgggggcuaccgagauccagaacagcggcggcaccucuaucuucgccggccaccugaagugccggcugaagauggauaagcucgagcuaaagggcaugagcuacgccaugugcacuaacacguucguccucaagaaggagguaucagagacccagcacgggaccauccucaucaaaguggaguacaagggcgaggacgcgccuugcaagauccccuuuucaacagaggaugggcaggggaaagcccacaacggccgccugaucacggccaaccccguugugaccaagaaggaggaacccgugaauaucgaggccgagccgccguucggggaaagcaacaucgucaucgguaucggggacaaugcucugaagauuaacugguauaagaagggcuccagcaucgggaagauguucgaggccaccgcccggggcgcccgccggauggccauccugggcgacacagcaugggacuucgggucuguuggcggggugcucaacagccuaggcaagaugguccaccaaaucuucggcuccgccuacaccgcccuguuuagcggcguguccugggucaugaagaucggcaucggggugcugcugaccuggaucggacugaacaguaagaauaccucaaugucuuucuccugcauugcgaucgggguaaucacccucuacuuaggugcggugguccaggcggacaugggcugcgugaucaacuggaagggcaaggagcugaaaugcggcucagggaucuucgugacgaacgagguccacacauggaccgaacaguacaaauuccaggccgacuccccaaaacgauuagccacugcaauugccggcgcgugggagaacggggugugcggcauccgcagcaccaccagaauggagaaccugcuuuggaaacagaucgccaacgaacugaacuacauccuuugggagaauaauaucaagcugaccgucgucgugggggacaucaucggcgugcuggagcaagguaagcgcaccuuaacgccccaaccgauggaacugaaguacuccuggaagaccuggggcaaagccaagaucguuacggcugagacccagaacagcuccuucaucaucgacgggccuaauacgcccgagugucccucugcgucgcgggccuggaacgugugggagguggaggauuacggguucggcguauucacuacuaacauaugguuaaagcugcgcgagguuuacacgcaacuaugcgaccaccgacucaugagcgcagccgugaaagacgaacgcgccguccaugcggauaugggcuauuggaucgagucgcagaagaacgggucguggaaguuggagaaggcaagccugaucgaggugaagaccuguacguggccgaaaucacacacccucuggagcaauggcguguuagaguccgauaugaucauccccaagagccucgcugggcccauuucccaacacaacuaccggccggguuaucacacgcagacagcaggacccuggcacuugggaaagcuggagcuggacuucaacuacugugaggguacgaccgucgugauaacggagaacugcggcacccgcggcccgagucuccggacaaccacuguguccggcaaacugauccacgaauggugcugccgcagcuguacgcugcccccgcuacgguacaugggcgaggacggguguugguacggaauggagauccgccccauaucugaaaaggaggagaauaugguaaagagucucguauccgcaggcagcgguaaggucgauaacuucacgaugggcgucuuaugcuuggcgauccuguucgaggaaguuaugcgggguaaguucggcaaaaagcacaugaucgccgggguauucuucaccuuuguccuccugcuuuccggccagaucacauggcgcgauauggcccacacccugaucaugaucggaucuaacgcuuccgacaaaaugggaaugggcgugacuuaccucgcccugaucgcuacauucaagauccaacccuuccucgcccucggguucuuucugcggaagcugaccagcagagagaaccuccugcugggcguggggcucgccauggccaccacgcugcaguugcccgaggacauugagcagauggcgaacgggaucgcccucggauugauggcccugaagcucaucacccaguucgagacuuaccagcuguggacagcccugaucagccucacgugcuccaauaccauguucacccugaccgucgcuuggcggacugcgacgcugauccucgcagggguaagccuucugccagucugccaguccucauccaugcgcaagacggauuggcucccgauggcgguggcugccaugggcguuccaccccucccguuguucaucuucagccucaaggacacauuaaagcgucgcaguuggccucugaacgagggggucauggcggugggccucgucucaauccuggcauccucccuccuccgcaacgacgucccgauggccggcccgcuaguggccgggggccugcucauagccugcuacgugaucacaggaaccuccgcggaccugacugucgagaaggccgccgacaucacaugggaggaggaagcugagcagacgggcguuagccacaaccugaugauuaccguggacgacgacgggaccaugcggaucaaggaugacgagaccgagaacauccuuacaguccugcugaagacggcccuccugaucguguccggcguguucccguacagcauccccgccaccuuacuuguuuggcacaccuggcagaaacaaacccagcgcuccggagugcugugggacgugccaaguccacccgagacgcaaaaggccgagcuggaggagggggucuaccggaucaaacaacagggcaucuucgggaagacacagguggggguggggguccagaaggagggaguguuccauaccauguggcacguaacuagaggcgcugucuugacguauaaugggaagcggcuggagcccaacugggccucagugaagaaagaccucaucagcuacggcggaggcuggcgcuugagugcgcaguggcaaaagggggaggagguccaagucaucgccguugagcccgguaagaacccuaagaacuuccagacgaugccgggcacguuccagaccacgaccggggagaucggcgccaucgcccuggacuucaaaccugggaccagcggcagucccaucaucaaccgggagggcaaggucgugggguuguacggcaaugggguggugaccaaaaacgguggguacguguccgguaucgcccagacgaacgcggaaccggacggcccuacgcccgagcucgaagaggagauguucaagaagcgcaacuuaaccauaauggacuugcacccuggcagcggcaagacucggaaguaccugccggccaucguccgcgaagcuaucaagcgacgccuccggacacugauccuggcccccacccgcguagucgcagcggagauggaggaagcccucaaagggcuccccauccgguaccagaccaccgccaccaaguccgaacacaccggccgugagaucguggaucuuaugugucacgccacuuucaccaugcggcuccugucccccgugcgcgucccuaacuauaaccugauaaucauggacgaggcccauuucacggacccagcaaguaucgccgcgaggggguacaucagcacccgcgugggaaugggcgaagcugccgccauauucaugaccgcuacgccgcccgggacggccgacgccuucccgcaguccaacgcgccgauacaggacgaggaaagagacauccccgagcgcucuuggaacuccggaaaugaguggauaaccgacuucgcggggaagaccgucugguucguucccagcaucaaggcagguaacgacaucgccaauugccuccgcaagaacggcaaaaaggugauacaacugucccgaaagacauuugacacggaauaccagaagaccaagcugaacgacugggauuuuguggucacaacggacaucagugagaugggcgccaacuucaaggcggaccgcgugaucgacccccggcgcugcuugaaacccgugauccugacggacgguccggaacgggucauccucgccggacccaugccgguuaccgccgcauccgccgcucagcggagaggaaggguggggcgcaacccacaaaaagagaaugaccaguacaucuucaccggccagccccucaacaacgacgaggaccaugcacacuggaccgaagccaagaugcugcuggacaacauaaacacgcccgaggggaucaucccggcccucuucgaacccgagcgcgaaaaauccgcggccaucgacggugaguaccgucugaagggcgagucgcgcaagacauucgucgaacuuaugcggcguggugaccuucccguauggcuggcccacaaggucgccucugagggcauuaaauacaccgaccggaaguggugcuucgaugggcagcgcaacaaucagauacuggaggagaauauggacguggagaucuggacaaaggaaggcgagaagaagaagcuccggccccgcuggcuagacgcacggacauacuccgacccgcuggcgcugaaggaguucaaggacuucgccgcgggucgcaagagcauagcacucgaccuggugacggaaaucgggagaguccccucccaucucgcccaccggacccggaacgcgcuggacaauuugguuaugcuccacaccagugagcauggcgggagggccuaucgacaugccguagaggaguuacccgagaccauggagacgcuguugcuguugggccucaugauccugcugacagggggugccauguuauuccuaaucagcggcaaggggaucggcaagaccucuauaggguuaaucugcgucauugccucuaguggcaugcuauggauggcggagaucccucugcaauggauagccagcgcuauuguucuggaguucuucaugauggugcugcugauacccgagcccgagaagcagaggacaccacaagacaaucagcucgcauacgucguuaucgguauccucacgcuggccgcaaucaucgcagccaaugagaugggacuguuggagacuaccaagcgcgacuugggcauguccaaggagcccgggguggucucacccaccuccuaucuggacguggaccuccacccggcaucagcguggacgcuguaugccgucgccaccacugucaucacaccuaugcuaagacacacgaucgagaacuccaccgcaaacgucagucuggccgcgaucgccaaccaggccguagugcugaugggccuggacaaggguuggccgaucuccaagauggaccucggcgugccucugcuggcacucgggugcuacagccaggugaaccccuugacccugaccgccgcgguccucuugcugaucacgcacuacgccaucauaggccccggccuccaggccaaggccacccgcgaggcccagaagcggacugcggccggcauuaugaagaacccgaccguugauggcauaaugacuaucgaccuggaccccgugaucuacgauuccaaguuugagaagcaacuggggcagguaauguugcuggugcugugcgccgugcaacuacuccuaaugcggacaagcugggcccucugcgaggcgcugacccuggccaccggccccaucacgaccuugugggaaggcucucccgggaaguucuggaacaccacaaucgcugucagcauggcgaacaucuuucgggguaguuaccuggccggcgcgggccucgcuuucagcaucaugaaguccguggggacgggcaaacgcggcaccgguucacagggcgagacccucggcgagaaguggaagaagaaacugaaccagcugucgcggaaggaguucgaucucuacaagaaguccggcaucacagagguggaucgcaccgaagcuaaagaggggcugaagcggggagagacgacgcaccaugccguaagccgcggaacggccaagcuacaaugguucguggaacggaacauggugauuccggaggggcgcgucauugaccuaggcugcgggcgaggcgggugguccuauuauugcgcgggccugaaaaaggugaccgagguccgcggcuacacuaagggcgggcccgggcaugaggaacccguccccaugagcacuuacggcuggaauaucguuaagcugauguccgggaaggacgucuucuaccucccgccggagaagugcgacacccugcugugugauauaggagagaguucccccagccccaccgucgaggaaucccggacgauacgcgugcuaaagaugguggaaccguggcucaagaacaaucaguucugcaucaagguccugaauccauauaugcccacugugaucgagcaccuagagcgccuccagcggaaacacggcgggaugcuggugcgcaaccccuuaagccggaacuccacccacgagauguacuggaucagcaacggcaccgggaacaucguggcguccgugaauauggugagcagguuacuccugaaccgguuuacgaugacccaccgccguccaaccauugagaaggaugucgaccucggcgccggcacccgccacgugaacgccgagcccgagacgccgaacauggacgugaucggggaaagaaucaagcgcauaaaggaggaacacaauaguaccuggcacuacgacgacgagaacccguacaagaccugggcauaccacggcucguacgaggucaaggccaccgggucggccagcuccaugaucaauggagugguaaagcugcugacgaagcccugggacguggugcccaugguuacccagauggccaugacugacaccacgccguucgggcagcagcggguguucaaggaaaaggucgacacccgcacaccccggagcaugccggguacccgcagagugaugggcaucacugcugaguggcucuggcgcacucuggggcggaacaagaagccacggcugugcacccgggaagaguucaccaagaaggugcgcacgaaugcggcaaugggugccguguucaccgaggagaaccagugggacagcgccaaggcggcugucgaggacgaggacuucuggaaacuuguggaccgcgagcgggagcugcauaagcugggcaagugcgguucaugcguguacaacaugaugggaaaacgcgagaaaaagcucggcgaguuuggcaaagccaaggggagccgggccaucugguacauguggcugggagccagguaccuggaguucgaggcccucggguuccugaacgaggaucacugguucucccgggaaaauagcuacuccggcgucgaaggggagggucugcacaagcucggcuauauccugcgcgacaucucaaagaucccagggggcgcaauguaugcugacgacaccgcugggugggacacccggaucacagaggacgaccugcauaacgaggagaagauuacgcagcagauggaccccgaacaccgccaacucgccaacgccaucuucaagcugaccuaucagaacaagguggucaagguacaacgacccacccccacaggcacgguuauggacauuaucagccgcaaagaccaacggggcucuggacagguggguaccuacggguugaacacauuuaccaauauggaagcgcagcucauccgccagauggaaggcgaggggguacuaucgaaggcagacuuagaaaauccccaucuuccggagaagaagauuacccaguggcuggagaccaagggcgucgagaggcugcgacggauggccaucuccggggaugacugcgucgugaagcccaucgacgaccgcuucgcaaaugcccuccuggcgcuaaacgauaugggaaaggugaggaaggacaucccccaguggcagcccagcaaaggcuggcacgacuggcagcaggucccguucugcagccaccauuuucaugaauuaaucaugaaggacgggcguaagcucgucguucccugccggccccaagaugagcugaucggccgcgccagaauuucccagggggccggguggagccuucgcgagaccgccugccugggcaaggcguacgcccagauguggucccugauguacuuccaccgacgggaccucaggcuugccagcaacgccaucugcuccgcgguucccguccacuggguacccaccucgcggacgaccugguccauccacgcgcaccaccaguggaugaccaccgaggacaugcugaccguguggaaccgagucuggaucgaggacaaccccuggauggaggacaaaacccccguaacaaccugggagaacgugcccuaccucgggaagcgggaggaccaguggugcggaagucugaucgggcugacaagccgcgccaccugggcccagaacaucccaaccgccauccagcagguccggucccuaaucgggaaugaagaguuccuugauuacaugcccucgaugaagcgcuuccgcaaggaggaggaguccgagggggccaucugguag

SEQ ID NO: 25969 - RNA, 9873 nt, Artificial Sequence
  derived and/or modified CDS sequence (opt11) from DENV-3__FJ024470__SS-prME
accucucugugcuuaaugaugauacugcccgccgcccuggcguuccaccucaccagucgagauggggagccccggaugauaguggggaagaacgaacggggaaagucauuacuguucaagacagccuccgguaucaacaugugcaccuugaucgcgauggaccugggcgagaugugcgaugacacugucacuuacaaguguccccacauuacugagguggagcccgaggacaucgauugcuggugcaacuuaacaucuaccugggugaccuacgggacaugcaaucaggccggcgaacaccggcgcgacaagcgguccguggcccuggcgccacaugugggcaugggccuggacacgcgcacucagaccuggaugagcgcagagggcgccuggcgacagguggagaaggucgagacgugggcccugcggcacccgggauucacuauccuugcccuuuuccuugcccacuacaucggcacuucuuuaacccagaagguggugaucuucauccuguuaaugcuaguaacccccagcaugacuaugcggugcguggggguggguaaccgcgacuucgucgagggacugucuggggccaccuggguagacgugguccuggagcauggcggaugugugaccacgauggccaagaacaagcccacucucgauaucgaacugcagaagaccgaggccacccaguuagcgacgcuccggaaacugugcauagaaggcaagaucaccaauaucaccacagacagccgcugccccacccagggcgaggccgcccugccggaggagcaggaucaaaacuacgugugcaaacauaccuacguggaccggggcuggggcaaugguugcggccuuuucgggaaaggcucccuggugacaugcgcuaaauuccagugccuggagccuauagagggcaagguuguccaguacgaaaacuugaaauauacuguaaucaucaccgugcacaccggugaccagcaccaaguaggcaacgagacgcaggggguuaccgccgagaucacuccccaggcgagcaccaccgaagccauccugcccgaauacggcaccuuagguuuggagugcucuccgcgcaccggccuggacuucaacgagaugauccuuuugacgaugaagaacaaagcguggauggugcaucggcagugguuuuucgaccugcccuuacccuggaccucgggcgcaacuaccgagacacccaccuggaaccgcaaggaauugcugguuaccuucaagaacgcccacgcgaagaagcaggagguuguugugcucgggucccaggagggcgcaaugcacacagcccucacaggggccaccgagauccagaacucuggcggcaccucuauuuucgcgggccaucuaaagugccggcuuaagauggacaagcuggagcuuaaggggaugagcuacgcgaugugcacuaacacauucgugcugaagaaggaggucucagaaacccagcacgggaccaucuugaucaaaguggaguauaagggugaggacgugccuuguaaaauucccuucagcaccgaggacgggcaaggcaaggcgcacaacggucgccugauaacagccaacccagucguuaccaagaaagaggagcccgugaacaucgaagccgaaccgccguuuggggagucgaauaucguuauugggaucggagacaacgcucucaagauaaacugguacaaaaagggcuccagcaucggcaagauguucgaagcgaccgcccggggcgcccgucgaauggccauccuaggcgauacagcgugggacuucgggaguguaggcggggugcuaaacagccuaggcaagaugguucaccagaucuucgggagugcauacacggcgcuguucagcgggguguccuggguaaugaagauaggcaucggggucuugcugaccuggaucggccugaacagcaagaacaccucaaugagcuucagcugcaucgccaucgggauuaucacccuguaccugggcgcggugguucaagcggacauggguugugugaucaacuggaagggcaaagagcugaagugcggcagcgggaucuucguaacuaacgaggugcauaccuggaccgagcaguacaaguuucaggccgacuccccaaagcgccucgccacagccaucgccggcgcgugggagaacgggguuugcggcauccgcagcacuacccggauggagaaccuguuauggaagcagauagccaacgagcucaacuacauuuuaugggagaauaacaucaagcugaccguaguggucggugacaucaucggcguguuggagcaggguaaacgaacccugacgccccagcccauggagcucaaauacucuuggaagacuugggguaaggcaaagauagugaccgcagagacccagaacagcagcuucaucaucgacgggccaaacacucccgagugucccagcgcaucccgcgcauggaacgucugggaggucgaagauuauggguucggggucuucaccacaaauaucuggcuaaaacugcgggagguauacacgcagcugugcgaccaucgucuuaugucggccgcagucaaggacgaacgugcagugcacgcagauaugggcuacuggaucgagagccaaaagaacggguccuggaaguuagaaaaggccagccugauagaagucaagaccugcacuuggccgaagucccauacccucuggagcaacggcgugcuggaaucugacaugaucaucccaaaaagccuggccgggccgaucucccagcacaaccaccggccgggcuaccacacucagaccgcugggcccuggcaucucggcaagcuggagcucgacuucaacuauugcgagggcacaaccguagucauuacugagaacugcgggacccgcggccccagccuucggacgacgaccguuuccgggaagcuuauccaugaguggugcugccgcagcugcaccuuacccccacuccgguacaugggcgaagaugggugcugguacgggauggagaucaggcccaucuccgagaaagaggagaacauggucaaaagccuggucucugcaggcuccggaaaaguggacaacuuuacgauggggguucugugccucgcgauauuguucgaggaggucaugcgggguaaauucggcaagaagcacaugaucgccgggguguucuucacuuucgugcugcuccucuccggccagaucacauggcgcgauauggcccacacacugaucaugaucgggucuaacgccuccgacaggauggggaugggugucaccuaccuggccuuaaucgcgaccuucaagauccagcccuuucuggcgcuaggguucuucuugcgcaagcuuaccagcagagagaaucuccugcugggugugggccuagccauggccaccacauugcaacugccggaggacaucgagcagauggcgaacgggauagcucucggccugauggcccugaagcucauaacccaauucgagacguaccagcuguggaccgcccugauuagccuaacgugcucaaacaccaucuucacccucaccguggccuggagaacggcaacccugauacucgcuggggucagccugcugccgguuugccagucaagcuccaugcggaagacggacugguugcccauggccguagccgccaugggugugccgcccuugccguuguucaucuucaguuugaaggacacccugaagcgccgcuccuggccccuuaacgaaggggugauggcgguaggucucguaucuauccuggccuccucccugcuccggaacgacgugcccauggccggcccgcuugucgccggcggcuugcucaucgcaugcuacgugaucacggggaccuccgcggaccugacggucgagaaggccgcugacaucaccugggaggaggaggccgaacagacgggcgucagccacaacuugaugaucacuguggacgacgacgggacuaugcgcaucaaagacgacgagaccgaaaacauccucacagugcugcugaagacggcguuacugauaguaucaggcaucuuccccuacucgauccccgcgacccugcucguguggcacaccuggcagaagcagacgcagcgauccggcguccugugggacgucccuaguccgccugagacgcagaaagccgaguuggaggagggggucuaccgcaucaagcagcagggaaucuucgggaaaacccaggugggaguuggggugcagaaagaaggcguguuucacacaauguggcacgucacccggggugccguacucacguacaacgggaagcgccuggaacccaacugggccucugugaagaaggaucugaucagcuacggcgggggguggcgucucuccgcgcaguggcagaagggcgaagagguucaggugauugcuguggagcccggaaaaaaccccaagaacuuccagaccaugcccggcacguuucaaaccacgaccggcgagaucggggccauugcuuuagacuucaaacccgggaccagcggcagcccaaucaucaaccgcgagggcaagguggugggucuguacggcaacgggguggucaccaagaacgggggguaugucagcggcaucgcccagacgaacgcagagccggacggacccacccccgagcuggaagaggagauguucaaaaagcggaaccucaccauaauggaccugcaccccggcucuggaaagacgaggaaguaccugccggccaucgugcgggaggccaucaagcgccggcugcgcacgcugauccuagcacccacccgggucguggccgcggaaauggaggaggcgcugaagggucugcccaucagguaccagaccaccgcuacgaaaucugagcacaccggccgggagauuguggaucugaugugccacgccaccuuuaccaugcgccuccugagccccguccgggugccgaacuacaacuuaauaaucauggacgaggcccacuucacggaccccgcaaguaucgccgccaggggguauaucaguacacgggugggcaugggcgaggcggcggccauuuucaugaccgccacuccgccagggacggccgacgccuucccgcaguccaacgcgcccauccaggacgaggagagagacauacccgagcgcagcuggaauucggggaacgaguggaucaccgacuucgccgggaagaccgucugguucgugcccucaaucaaggcuggcaacgacaucgccaacugccuccggaagaacggaaagaaggugauccaacugucuaggaaaaccuucgauacggaguaccagaagacaaaacugaacgacugggacuucgucgugacaaccgacaucuccgaaaugggcgccaacuucaaggcggaccgggugaucgauccgcgcagaugccucaagcccguuauacugacggauggcccagagcgcguaauccuggcuggacccaugccggugacggccgcaagcgccgcgcagcggcgcggccgggucggacgcaacccccagaaggagaacgaccaauacaucuuuaccgggcagccccucaacaacgacgaagaccaugcccacuggaccgaggccaagaugcuccuggacaauaucaacaccccggaagggauuaucccggcccucuuugaaccugagcgggaaaaguccgcagcuauagauggggaguaccgccugaagggcgagucccgcaagacguucguagagcugaugagacgcggugaccuccccguguggcucgcccacaaggucgcuagcgaagguaucaaguacaccgaccguaaguggugcuucgacgggcaaaggaacaaccagauccuggaagagaacauggacguugaaauauggacuaaggaaggcgagaagaagaagcucaggcccaggugguuggacgcaaggacuuacuccgacccgcuggcacucaaggaguucaaagacuucgccgccggccgcaagagcauugcccucgaccuggucacggagaucgggcgcguucccucgcaucuagcacauagaacccggaacgcgcuggauaaucugguaaugcuacauaccagcgagcauggcgggcgugccuaucggcacgcggucgaagagcugccagagacgauggagacgcugcugcugcuuggcuugaugauccugcugaccgggggggccaugcuguuccugauaagcgguaaggggauaggcaagaccuccaucgggcugauuugcgugaucgccucaucaggcaugcuuuggauggcggagauuccgcugcaguggaucgccucugccaucguguuagaguucuuuaugauggucuuacugauccccgaacccgagaagcagcgcaccccccaggacaaccagcuggcguauguggugaucgggauccucacucuggccgcgauaaucgccgcgaaugagaugggccuguuggagaccaccaagcgggaccucggcauguccaaggagccgggggucgugagccccaccucauaucucgacguagaccuccaucccgcgagcgcguggacgcuauaugcugucgcuacaacggugaucacucccaugcugcgccacacgaucgagaacuccaccgccaacguuagcuuggccgcgaucgcgaaccaggccguagugcugaugggacuggacaagggguggccgaucucuaaaauggaccucggcgugccccugcuggcgcucggaugcuacucgcaggucaauccccugacucugacggcagcaguuuuguugcugaucacgcauuaugccaucaucggaccgggccuccaggccaaggcgacccgggaggcacagaagcgcaccgcugcagggauuaugaagaacccgaccgucgacggaaucaugacgaucgacuuagacccagugaucuacgacuccaaguuugagaaacagcuggggcagguuauguugcuggugcugugugccguccagcuccuccugaugcggaccuccugggcccucugugaagcgcugacguuggccacaggccccauaaccaccuuaugggaggggagcccagguaaguucuggaacaccacaauugccgugagcauggccaacaucuuucgcggaucguaccucgccggggcggggcuagccuucaguaucaugaagucuguggguacgggcaagcggggcacggggagccagggcgagacccucggggagaaguggaagaagaagcugaaccagcugagcagaaaggaauucgaucuuuacaagaagucuggcaucacggagguggacaggaccgaagcuaaggaggggcuuaaaagaggagagaucacucaccacgccgugagccggggcuccgcaaagcugcagugguucguggagcgaaauauggucaucccggaggggcgggugaucgaucuugggugugggagaggggguuggucauauuacugugcgggccuuaagaaggugacggagguacgaggcuauaccaagggcgggccugggcacgaggaacccgugccaaugagcaccuauggcuggaauaucgugaagcugaugucagggaaggacgucuucuaccuccccccggagaagugcgacacccugcugugugacaucggagaguccagcccgucccccacuguggaggagagccgcaccauacgagugcugaaaauggucgagccuuggcucaagaacaaccaguucugcauaaaggugcugaacccguacaugcccaccgugaucgagcaucuggaacguuuacagcguaagcacggcgggaugcugguccggaacccccuaucacgcaacagcacgcacgagauguauuggaucuccaacggcaccgggaacaucguggccuccgugaacaugguaucccgucucuuacucaaccgcuucaccaugacccaccggcgcccgacgauugaaaaggaugucgaucucggcgccggcacucggcacgugaacgccgagcccgagacccccaacauggacgucaucggugagaggauuaaacggauuaaggaggagcauaacagcacguggcacuacgacgacgaaaacccguauaaaaccugggcuuaccacggcaguuaugaggugaaggccacugguuccgccuccagcaugauaaacggcguggucaaacugcugaccaagccuugggacguggugccaauggugacgcagauggccaugacugacacuacgccuuucgggcagcagcgcgucuucaaggagaaggucgacaccaggacgccgcgcucaaugccgggcaccagacgcgugaugggcauuaccgccgaauggcucuggcggacccuugggcgcaacaaaaagccccggcuaugcacacgcgaggaguucaccaagaaagugcgcaccaaugccgcaaugggugccguuuuuaccgaggagaaucaaugggacuccgccaaggcggcgguggaggacgaggacuucuggaagcugguggaccgagagcgagagcuacacaagcucgggaaguguggcagcugcgucuacaacaugauggggaagcgggagaagaaauuaggagaauucggcaaggccaaggggucucgagcaaucugguacaugugguuaggcgcccgguaucuggaguuugaggcccucggauuucuaaaugaggaccacugguucagccgcgagaacuccuacagcggcguggagggggagggacugcacaagcucggcuacauucugcgggauaucucuaaaaucccuggaggcgcgauguacgccgacgacacggccgggugggacacuagaaucaccgaagacgaccugcacaacgaagaaaagaucacccagcagauggacccggagcaccggcagcucgccaacgccaucuucaagcugaccuaccaaaauaaggugguaaagguacagcgccccaccccgaccggcaccgugauggauaucauaucucggaaggaccaacgcggauccgggcaaguaggaaccuacgggcugaacacuuucaccaacauggaggcgcaguuaauccggcagauggaaggugaggggguacugagcaaggccgaccuggagucccaucaccugcccgagaagaagaucacgcaguggcuugaaacgaagggcguggagcgccuaaagaggauggccaucagcggugacgacugcgucgugaagccgaucgaugaccgguucgcgaacgcgcuacuggcgcugaaugacauggggaaggugcgcaaggacauuccccaauggcagcccuccaaaggcuggcacgauuggcagcaggucccuuucugcucccaccacuuccacgagcucaucaugaaggacggcagaaaacuaguggugccgugccggccccaggaugagcugaucggccgcgcucggaucagccagggugccggcuggagccuucgcgagacggccugccuggggaaggcauacgcccagauguggucccucauguacuuccauaggagggaccuccgucuggccagcaaugccauauguuccgccguacccgugcacugggugcccacaucucggacuaccuggucaauccacgcgcaccaucaguggaugacgaccgaggacaugcugacuguauggaaucgcgucuggaucgaagacaacccguggauggaggauaagacgcccgugacgaccugggagaacgucccauaccucgggaagcgggaagaccaauggugcgggagccucauagggcuaaccagccgagcuaccugggcccagaacaucccgacggcuauacagcagguccggucccucauaggcaacgaggaguucuuagacuacaugccaucaaugaagcguuuucguaaggaggaggaauccgagggagcaauuugguga

SEQ ID NO: 25970 - RNA, 9873 nt, Artificial Sequence
  derived and/or modified CDS sequence (opt11) from DENV-3__FJ024471__SS-prME
accagccuaugucucaugaugauccugcccgccgcccuggcguuccaucucaccagccgggacggggagccgaggaugaucguggggaagaaugagcgggguaaaagccugcuuuucaaaaccgccucggggaucaauauguguaccuuaaucgccauggaccugggcgagaugugcgaugacacuguaacguacaagugcccgcacaucaccgagguggagcccgaggacauugacugcuggugcaaccucaccagcaccugggugaccuacgguacgugcaaucaagccggugagcacaggcgagauaagcggagcguggcccucgcaccccauguuggcaugggucuggacacacgcacgcagacauggaugucagccgaaggggcguggcgccaaguggagaaggucgaaacgugggccuuacgccaucccggcuucacaauccucgcacucuucuuagcccacuauauaggcacaucccucacccagaaggucgugaucuuuaucuugcugaugcucguaacccccagcaugaccaugcgcugcguggggguuggcaaccgggacuucguagagggccuguccggggcuaccuggguggacguuguccuggagcacggcgggugcgucaccacgauggcgaaaaauaaaccuacacucgauaucgagcuacagaagaccgaagccacccagcuggcgacgcuccgaaagcugugcaucgagggcaagaucaccaacaucaccaccgacagccgcugcccgacgcaaggcgaggccgcucugccagaggagcaggaucagaauuacgucugcaagcauaccuacgucgaccggggguggggcaacggcuguggcuuauuuggcaaaggcucccuagugacuugugccaaguuucagugucuggaacccaucgaggggaaggugguccaguacgaaaaccucaaguacacagugaucaucacggugcacacaggugaccagcaucaggugggaaacgagacccagggggugacggccgagauaacgccccaggcgagcaccaccgaggccauucuuccggaauacgguacccugggguuggagugcuccccgcgcacagggcuggacuucaaugagaugauauugcuaacuaugaagaacaaagccuggaugguucaccggcagugguucuucgaccugccccugcccuggacgagcggggcgaccaccgagacucccaccuggaaccggaaggagcuccuggugacauucaagaacgcccacgcgaagaaacaggagguggucguacuggggagucaggagggcgcaaugcauacagcacucacgggggcaacagagauccaaaacagcggagggaccagcaucuucgcagggcaccugaagugccguuuaaagauggauaagcuggagcugaagggaaugagcuaugccaugugcaccaacacauucgugcugaaaaaggaggucuccgagacucagcacgggaccauacucaucaaaguggaguauaagggugaggacgugccgugcaagauccccuucagcacugaggaugggcagggcaaagcccauaacggccgacugaucacggcuaaccccguggugacgaagaaagaggagccggugaacauugaagccgagcccccauucggggaguccaacaucgucaucggcauuggugacaacgcgcugaaaaucaauugguacaagaagggcagcagcauaggcaagauguucgaggcgaccgcgagaggggcucgccggauggcaauacugggcgacaccgcaugggacuucggguccgucggcggugugcucaauagccuggggaagaugguccaccaaauuuucggguccgccuacacggcccuauucuccggcgucuccugggugaugaaaauuggcauaggggugcugcugacguggaucggccugaacaguaagaacaccucuaugagcuucuccugcaucgccaucgggauaaucacccuguaucugggcgcuguugugcaggcggacauggggugcgugauuaacuggaagggcaaggagcugaagugcggcagcgggaucuucguaacgaacgagguccauacguggacagagcaauacaaguuccaggccgacagccccaagcgacucgcuaccgccaucgcuggcgcuugggagaacggggugugcggcauccgaagcacgacucggauggagaauuuacuguggaagcagaucgcgaacgagcucaacuacauccugugggaaaacaacaucaaguugaccgucguugucggggauaucaucgggguucucgaacagggcaagcgcacccugacgccccagcccauggagcucaaguacagcuggaagaccugggguaaggcuaaaauagugaccgcggagacccagaacucguccuucauaauagacggcccgaacacgcccgagugccccucagcgucccgagcguggaacgucugggagguggaggauuacggguuuggaguguucaccacuaacauaugguuaaagcuacgcgaggucuacacgcaguuaugcgaccaccggcuaaugagcgcagcgguaaaagacgagagggcagugcacgccgacaugggcuacuggaucgagagccagaaaaacgggucguggaaguuagagaaggccucacucaucgaggucaagacaugcacauggccgaagucucacacccuuuggagcaacggcgugcuggagagugacaugaucauccccaagagccuggccgggccaaucagucagcacaaccaucggccgggcuaccacacacagacggcggggcccuggcaucugggcaaguuagaacucgacuucaacuacugugaaggcacaaccguggucaucacggaaaacugugggacccguggucccucgcuccggacgaccacagugucgggaaagcucauucacgaauggugcugucgcuccugcacguuacccccgcuccgguacaugggcgaggauggguguugguacgggauggagauacgcccaauauccgaaaaagaggagaacaugguuaaaagccuggucuccgccggaagcgggaagguggacaacuuuaccauggguguguuaugccucgcgauacuauucgaggagguuaugcgcggaaaguucggcaagaagcauaugauugccgggguauuuuucacauuuguacuacuccuguccggucagaucacauggcgagacauggcacauacccucaucaugauaggaagcaaugccucggaucggauggggaugggcgugacguaccuugcccucaucgcuaccuucaagauccagcccuuccuggcgcucggauuuuuccuucgaaaguugaccagccgggagaacuuguugcuaggcgugggucucgccauggccaccacgcugcagcuucccgaggacaucgaacagauggcgaacgggauugcccuagggcugauggcccuuaagcucaucacccaguucgaaaccuaccagcuuuggaccgcccugauuaguuuaacgugcuccaacaccaucuucacccugaccguggccuggcgcacagcuacccugauccucgcgggggucucccuccuaccggugugucaguccagcuccaugcggaagacugacugguuaccuauggccgucgccgccaugggugugccgccccuaccgcuguucaucuucagccucaaggacacccugaagcgccgcuccuggccccugaacgaggggguuauggcggugggucucguuuccauccuggccucgagccugcuccggaacgacgugccuauggcaggcccguuaguggccgggggccuguugaucgccuguuacguuaucacugggacguccgcggaccugaccguggagaaggcugcggacauuacuugggaggaggaggccgaacaaacgggcgucucgcauaaccucaugaucacuguggacgacgacgggacgaugcgcaucaaggacgaugagaccgagaauauucucaccguucugcugaagacggcacuccugaucguauccggcauauucccguacagcaucccugccacgcugcuuguguggcacacauggcagaagcagacccagcguuccggcguucugugggacgugcccagcccgccugagacgcagaaagcggagcuggaggaggggguuuaccggaucaaacagcagggcaucuucgggaagacccaggugggugucgggguccaaaaggagggcguuuuccacaccauguggcaugucacccggggagccgugcucacguacaaugguaagcggcuggagcccaacugggccucggugaagaaagauuuaaucucauacggagggggcuggaggcucuccgcgcaauggcagaaaggggaggagguccaagugauugccguggagcccggcaagaaccccaagaacuuccaaaccaugcccgggaccuuccaaaccacaacuggggagaucggagcgaucgccuuggacuuuaagcccgggacaagugggucgcccauuauaaaccgggaagggaaggucguagggcuguacggcaacggaguggucaccaagaacggaggauacguaucaggaauagcacagacaaacgcugaaccggacggcccgaccccugagcuugaggaagagauguucaagaagcggaaccugaccaucauggaccugcaccccgggagcggaaaaacgaggaaguaucuuccggcgaucgugcgugaagccaucaagcgacggcuucgcacgcugauacuggcccccacgcgggucgucgccgccgagauggaggaggcgcucaaggggcugcccauccguuaucagacuaccgcuacaaaguccgagcauaccggucgagagaucguagaccucaugugccaugccacauuuacaaugcgccuccucagccccguucgggugccgaacuauaaccucaucauaauggacgaggcccacuucacugauccugcgucaaucgcagcacguggcuacaucagcacgcgcguggguaugggcgaggccgccgccaucuucaugacggccacgccgcccggaacggccgaugccuuuccacaauccaacgcgcccauccaggacgaggaacgcgacauccccgagcgauccuggaacuccggcaacgaguggauaaccgacuuugccgguaagacgguaugguucgugcccucuauaaaggccggcaacgauauugccaacugucuccgcaagaauggaaagaaagugauccagcuauccagaaaaaccuucaacacugaguaccaaaagaccaagcugaaugacugggacuuugucgugacaaccgacaucagcgagaugggugcaaacuucaaggcagaccgggugaucgacccucgcagaugccucaagcccgucauucugacagauggccccgagcgcguuauacucgcagggcccaugccagugaccgcugccuccgcggcgcagaggcgcggccggguuggacgcaacccucaaaaggaaaacgaucaguacauuuucaccgggcagccucucaauaacgacgaggaccacgcgcacuggaccgaggccaagaugcugcuggauaauaucaacaccccugaaggaaucauaccggcccucuucgaacccgagcgggagaaauccgcggccaucgacggcgaguaccgccuuaagggcgagucccguaaaacguucguggagcugaugcgccgcggggaccuccccgucuggcuggcgcacaagguggcuagcgaaggcauaaaguauaccgacaggaagugguguuuugacgggcagaggaacaaccaaauucuggaggagaacauggacguggagauauggacaaaggagggcgagaagaagaagcugcgcccccgauggcuagaugcucgcaccuacuccgacccccucgcucuuaaggaguuuaaggacuucgccgcuggccguaaaaguaucgcccuggaccuggucacggagaucggucgggugccuagucacuuggcacaccgcacccggaacgcgcuggacaaccuggugaugcugcacacgucggagcauggagggcgcgccuacagacacgcuguggaggaguuacccgaaacuauggagacgcugcuccugcugggucucaugauccugcugaccgggggcgcuaugcuguucuugaucucaggcaaggguaucgggaagaccuccaucgggcugaucugcgucauagcuucaucuggaaugcucuggauggccgagauuccgcugcaguggaucgccagcgccauugucuuagaguucuucaugaugguccuccuaauccccgagccagagaagcaaagaacgccccaagacaaccagcucgcguacguagugaucgggauucuaacgcuggcagcgauaauugccgcaaaugaaaugggccuauuagagacgaccaagagagaccugggcauguccaaggagcccgggguugugagccccaccuccuaccuggauguggacuugcacccggcaagcgcguggacgcuguacgcagucgccacaaccgucaucacgcccaugcuccgccacacgaucgaaaauuccacggccaacgugagccucgccgcuaucgccaaucaggccgucgugcuaaugggacuggacaaagguuggccaaucuccaagauggaucucgguguaccccugcucgcccuagggugcuauagccagguaaacccccuaacuuugaccgccgcugugcuccuacugaucacgcacuacgccaucaucgguccgggcuugcaggcgaaggccacacgggaggcccagaagcgcaccgcggccgggaucaugaagaacccaaccguggaugguauaaugacgauagaccuggaccccgucaucuacgauagcaaguucgaaaagcaacugggccaggugaugcuccuugugcugugugccguccagcuucugcuuaugcggaccagcugggcccucugcgaggcgcugacccuggccacaggacccauaacgacuuuaugggagggcucccccgggaaguuuuggaacacaaccauugccgugagcauggccaacauuuuucgcggguccuaccuggcgggggcgggucuugccuuuagcaucaugaagucuguggggacgggcaagcgcggcacggggucgcaaggcgagacccucggggaaaaguggaagaagaaacugaaucagcugagcagaaaagaguuugaccucuauaaaaaguccggcaucaccgaaguugaccguaccgaagccaaggaggggcugaagcgcggcgagauuacccaccaugccguaagucguggcucagccaagcugcagugguucguggagcggaacaugguuauccccgaggggcgggugaucgaccucgggugcggccgcggcgggugguccuacuacugcgcgggccugaagaaagucacggagguaagaggcuauaccaagggcgggcccggccaugaggagcccguacccauguccacguacggcuggaacaucgugaagcuaaugagcggcaaagacgucuuuuaucucccgcccgaaaagugcgacacucugcuuugugacaucggggagucaagcccaucccccaccguggaggagagccggaccauucggguccugaagaugguggaaccguggcucaagaacaaucaguucugcaucaaagugcugaaccccuacaugcccacagugauugaacaucuugagcggcuccagcgcaagcacggcgggauguuaguccggaauccccugucccguaauagcacgcacgagauguauuggaucuccaacgggacaggcaacaucgucgccagcgugaacauggucuccaggcuccuucugaaccgauucaccaugacccaccggcgcccgacgaucgagaaagacguugaccuuggagccgggacccgucacgugaacgcagagccagagacuccaaauauggacgucaucggugaacgcaucaagagaauaaaagaggaacacaauagcaccuggcauuaugacgacgagaacccguauaagacuugggcauaucauggauccuacgaggugaaagcgacgggcagcgcguccagcaugaucaacggcguuguaaagcuacuuaccaagccaugggaugugguacccaugguaacccagauggcaaugaccgauaccacucccuucgggcagcagcgaguguucaaggagaaagucgauaccagaacgccgcgcucaaugcccgggacccggcgagucaugggcauaacugccgaguggcucuggcggacacuggggagaaacaaaaagcccagguuaugcacacgcgaggaguucacuaagaaagugcgcaccaacgcggccaugggcgcugucuuuacugaagagaaucaaugggacagugcuaaggccgccgucgaggacgaggacuuuuggaagcucguggaccgggagcgcgagcugcauaaacuugggaaguguggcagcugcguguacaacaugaugggaaagcgggagaagaagcucggugaguucgguaaggcaaaagggucaagagcuauaugguacaugugguugggcgcccgguaucuggaguucgaggcccuaggauuccugaacgaggaccacugguucagccgagaaaauuccuacuccggcguggagggggagggccugcacaaacucggcuacauucugcgagacaucuccaagaucccaggaggggcgauguacgcggacgacacugccgggugggauacccgcaucacagaggaugaccugcacaaugaggagaagaucacccaacagauggacccagaacacagacagcuggccaaugcaauuuuuaagcuaacguaccagaacaagguggugaaggugcagcgcccaacgccaaccgggaccgugauggacaucauuucccggaaggaccagcgaggauccggacaggugggcacauaugggcugaacaccuucaccaacauggaagcacaacuaauccggcagauggaaggagaagggguccugagcaaggccgaccuggagucccaucaucucucugagaagaaaauaacucaguggcuggagaccaaaggcguagagcgcuuaaagcggauggccaucagcggggaugacugcgucgugaaacccaucgacgaccgcuuugcaaacgcccuauuggcguuaaacgacauggguaagguucggaaggacaucccacaguggcagccgagcaaaggcuggcacgacuggcagcagguccccuucugcucccaccacuuccacgaacucaucaugaaagacgggcggaaguuggugguucccugucgaccucaggaugagcugauaggccgcgcccggauaagccaaggggcaggcuggucauugcgcgagacugcaugccugggcaaggcguacgcccagauguggucguuaauguauuuccaccgccgggaccuucgcuuggccaguaacgcaaucugcagcgccgucccagugcacuggguacccaccagcaggaccaccugguccauccaugcccaccaccaguggaugacgaccgaggacauguuaacuguguggaaucgcguuuggauugaagacaaccccuggauggaggacaaaaccccgguaacgacaugggagaacguccccuaucuggggaaacgggaggaccaauggugcggcucacuuaucgggcugaccucccgagcuacaugggcgcaaaauaucccaacggcuauccagcaaguccggagucucauuggcaacgaagaguuccuugacuauaugcccucgaugaagcgcuuccggaaggaggaggagagcgagggugcgauaugguga

SEQ ID NO: 25971 - RNA, 9873 nt, Artificial Sequence
  derived and/or modified CDS sequence (opt11) from DENV-3__FJ182005__SS-prME
accagccucugcuuaaugaugauccucccagccgcccuggcguuccaccucacgagccgggauggggagccgcgaaugaucguggggaaaaacgagcgcggaaaaagccugcuguucaagaccgccagcgggaucaacaugugcacccugauagccauggaccugggcgagaugugcgacgacaccgugaccuacaagugcccccacauaacggaaguggagcccgaggacaucgauugcuggugcaaccugacgagcacuugggugaccuacggcacgugcaaccaggccggcgagcaucggcgcgacaagcgauccgucgcccucgcgccacacguggguauggggcuggacacccgcacccagaccuggaugagcgccgagggcgccuggagacagguggaaaaggucgagacgugggcccugcggcacccagguuucaccauccucgcacuguuccuagcgcacuacaucggcaccucccucacccagaaagucgugaucuucauccugcugaugcucgucacgcccagcaugaccaugcggugcgugggcgugggcaaccgcgacuucgucgagggccuguccggggccacguggguggacgugguccuggagcacggcgggugcgugacgacgauggccaaaaacaagcccacccucgacauugagcugcagaagaccgaggcuacccagcuggcgacgcuccggaaacuuuguauagagggcaaaaucaccaacaucaccaccgacucgcgcugucccacgcagggcgaggccgugcugccggaagaacaggaccagaacuacgucugcaagcacaccuacguggaccgggggugggguaacggguguggccucuucgggaagggaucccuggugaccugcgccaaauuccagugccuggagccuaucgagggaaaggucguucaguacgagaaccuaaaguauacggugaucaucacaguccacaccggggaccagcaccaggugggcaacgagacccaaggggucaccgccgaaaucacgccccaggccagcaccaccgaggcgauccugccggaguacggcacccuggggcucgagugcuccccgcgaaccggcuuggacuucaacgagaugauccugcuaacgaugaagaacaaggccuggauggugcacaggcagugguucuuugacuuaccccugccuuggaccagcggcgcaaccaccgagacgcccaccuggaaccgcaaggagcuccucgugacguuuaagaacgcccaugccaagaagcaggaggucguggugcuggggucucaggaaggcgcgaugcacaccgcccucacgggggccacugaaauccagaacagcggcgguaccuccaucuucgcuggacaucugaagugucggcugaagauggacaagcucgaguugaagggcauguccuacgcuaugugcaccaacacguucguccugaagaaagaaguauccgaaacccagcacgggaccauccugauuaagguggaguacaagggcgaggacgucccgugcaaagugcccuucagcacagaggacgggcaggguaaggcgcacagcgggcgcuuaaucacggccaaccccguggucaccaagaaagaggagcccgugaauaucgaggccgaaccgcccuuuggagaauccaauaucguuaucgguaucggggacaacgcccugaagaucaacugguauaagaagggcagcuccaucgggaagauguucgaggcgaccgcccggggcgcccgccguauggccauccugggagacaccgccugggacuucgggagcgugggcgguguguugaacucccugggcaagauggugcaccagaucuucggaagcgcguacacggccuuauucagcggagucagcugggugaugaagaucggaauugggauccuccugaccuggaucggccugaacuccaagaauacaagcauguccuucagcugcaucgucaucgggauuaucacccuauaccucggcgccgucgugcaggccgacauggggugcgugaucaacuggaagggcaaggagcugaaguguggcagcgggaucuuugucacgaacgaggugcacacuuggaccgagcaguacaaguuccaggccgacagccccaagcgccucgcgaccgccaucgccggcgccugggagaacggggugugcggaauacgcuccacgacgcggauggaaaaccugcuguggaagcagaucgcaaacgagcucaacuacauccugugggagaacaacaucaagcugacugucgucgugggggacauuaucggcguccucgaacagggcaagcgaacccugacgccccagccuauggagcugaaguacaguuggaaggcaugggguaaggccaagaucguuacggccgaaacccagaacuccagcuucaucauugacggccccaacacucccgagugcccuuccgccagccgggcguggaacguaugggagguagaggacuacggguucggcguguucaccaccaacaucuggcucaagcugagggagguuuacacccagcugugcgaccaccgauugaugagcgccgccgucaaggacgagcgcgcugugcaugccgacaugggcuacuggaucgagucccagaagaacgguagcuggaagcuggaaaaggcgagucugauugagguuaagaccuguaccuggccgaagucccauacgcucugguccaacggcguccuggaaagcgauaugaucauccccaagucccuggccgggcccaucagccagcacaauuaccggccgggcuaccacacccagaccgccgggcccuggcaccucggaaaacuggagcuggacuucaacuacugcgagggcacuacgguggugaucacggagaacugcgggacccgcggaccuucccuccggaccacgacugugagcgggaagcugauacaugaguggugcugccgcuccugcacgcugccgccgcuccgguacaugggcgaggacggguguugguacggcauggagaucagacccaucagcgagaaggaagagaacauggugaaguccuuggugagcgccggcuccgggaaagucgacaacuucaccaugggcgugcugugcuuagccauccuguucgaagaggugaugcgggggaaguucggcaagaagcacaugauagcgggggucuucuucacguuugugcuguuacugagcggacagaucaccuggcgcgacauggcccacacgcuuaucaugaucggcuccaacgccagcgaccggauggggaugggcgugacguaucucgcucugaucgccacguucaagauccagcccuuccuggcgcucggguucuuccugcgcaaacugacaagccgggagaaccuccugcugggcgucggccucgcaauggccaccacccugcagcuccccgaggacaucgagcagauggccaacgggaucgcgcuuggcuuaauggcccugaagcucaucacgcaauuugagaccuaccagcuguggaccgccuuaaucucccugaccugcucuaacacgaucuucaccuuaaccguugccuggcgcacagccacgcuaauccucgccggggucucccugcugccggugugccagagcaguagcaugcggaagaccgacuggcuaccgaugacaguggccgcgaugggcguaccgccacucccgcuuuucaucuucagccucaaggacacccugaagaggcgcagcuggccucugaacgagggggugauggcagugggucucgucucaauccuggccagcucccugcuccgcaaugacgugccuauggcgggaccccucguggccgguggcuuacucauugccugcuacgucaucacggggaccagcgccgaccugaccguggagaaggccgcagacgugaccugggaggaggaggcugagcagacgggcgucucccacaaccugaugaucaccguugacgacgacgguaccaugagaauaaaggacgacgagacggagaacauccucaccgugcugcugaagacggcccuccugaucgugagcggcaucuuucccuauuccauccccgccacccugcucguuuggcacaccuggcagaagcagacccagcggagcggaguacugugggacguccccagucccccggagacgcagaaagccgagcuggaggaggggguguaucgcaucaagcaacagggcaucuucgggaaaacucaggugggcguaggggugcagaaggagggcguguuccacaccauguggcaugucacccggggcgcggucuuaacguacaacgggaagaggcuggaaccuaacugggccagcgugaagaaggaucuaaucuccuaugggggcggguggcggcuuagcgcccaauggcagaagggggaggaaguacaggugaucgccguggaacccggcaagaaucccaagaacuuccaaaccaugccuggcaccuuccagaccacgacaggggagaucggcgcgauugcccuggacuucaagcccgguaccagcggcucccccaucaucaacagggagggcaaggucgugggucuguacggcaacgggguugucaccaagaacggcggguacgugaguggcauagcccagacaaaugccgagccagacggccccaccccggaguuggaggaggagauguucaaaaagagaaaccucaccauuauggaucuacaccccggguccgggaagacgcgcaaguacuugccggccauagugcgggaggcgaucaagcgccggcucagaacgcugauccuggcccccacccggguuguggccgccgaaauggaggaggcccucaaggggcugccaauacgcuaccagaccacagcgaccaagagcgagcacaccggccgggagauuguggaccugaugugccacgccaccuucaccaugcgccuccugucccccguccgggugccgaauuacaaccugaucaucauggacgaggcucacuucacggaccccgccagcaucgccgcgcgcggguauaucuccacccgugugggcaugggugaggcagccgccaucuuuaugaccgcgaccccgcccgggacggccgacgccuucccgcaaagcaacgcccccauccaggacgaggagcgcgauaucccagagcgcuccuggaacaguggcaacgaguggaucaccgacuucgcgggaaagaccgucugguucgugcccuccaucaaggcgggcaacgacaucgccaacugcuugcggaagaacgggaagaaggugauccagcugagccgcaagaccuucgacacggaguaccagaagaccaagcugaacgacugggauuucgucguaaccaccgacaucuccgagaugggcgccaacuucaaagccgaccgggugauagacccgcgucggugccucaagcccguaauccuaacggacggccccgagcgcguuauccuggccgggcccaugccagugaccgcggccagcgcagcccagcggcgcgggcgggucggccggaacccccagaaggagaacgaucaguacaucuucaccggccagccccucaauaacgacgaagaccacgcccacuggaccgaggcgaaaaugcugcuggacaacauaaacacccccgaggggaucaucccggcccucuucgagcccgaacgggagaagucagccgccaucgacggcgaguaccgccugaagggcgagagcagaaagacguucguggagcugaugcgccgcggggaccugcccgucuggcuggcgcacaagguggccagcgaaggcaucaaguacacagaccgcaaguggugcuucgacgggcagcggaacaaccagauccuggaggaaaacauggacguggagauuuggaccaaggagggagagaagaaaaagcuccguccccgguggcuggacgcccgcaccuacagcgacccgcuggcccucaaggaguucaaggacuucgccgcgggucgaaaguccauugcccuggaccuagucacggagaucgggcgggugccuagccaucucgcccaccgcacccggaacgcguuagacaaucuggugaugcuccacacuagcgagcacggcgggagagcguaccggcacgcugucgaggaacuucccgagaccauggagacgcugcuccugcugggccucaugauucugcugacagggggcgccaugcuguuccugaucuccgggaaggggaucggcaaaaccagcaucggacugaucugcguuaucgccuccagcgggaugcucuggauggccgagaucccacugcaguggaucgccuccgcgaucgugcuggaguucuuuaugaugguacuccugauccccgaacccgagaagcagagaacgccccaggacaaucagcuggccuacguggugaucggaauccucacccuggcugcuaucauagccgcgaacgagaugggacugcucgagaccaccaagcgggaccugggcaugagcaaggagccgggggucgugucccccaccucuuaucuggacguggaccuccaccccgcuucugccuggacgcuuuacgccgucgccaccaccguuaucacccccaugcuacgccacacaaucgagaacagcaccgccaacgugucccucgccgccaucgccaaccaggcgguaguacugaugggccuggauaagggguggccgaucagcaaaauggaucucggcgugccccugcuggcccucggcugcuacucccaggugaacccccugacccugaccgccgcugugcuccuacucaucacccacuacgccaucaucggccccggccuccaggcgaaggcgacccgggaggcccagaagcguaccgcugccgggaucaugaagaaccccaccguggauggcaucaugaccaucgaccuggaccccgucaucuacgauagcaaguucgagaagcagcugggccaggugaugcuccugguccugugcgcgguccaacuccugcugaugcggacguccugggcccucugcgaagcccugacccuagccaccggccccaucacgaccuugugggagggcagcccagggaaguucuggaacaccaccaucgcgguguccauggccaauauuuuucgcggcagcuaccuggccggggccggccuggcauucuccaucaugaaguccguggggacggguaagcggggcaccgggagccagggcgagacccucggggagaaguggaagaagaaguuaaaccagcugucccgcaaggaguucgaccucuacaagaaaucgggaaucaccgaggucgaccggaccgaggccaaggaggggcugaaacgcggcgagauuacgcaccacgccgugucccggggcagcgccaagcugcagugguucguggagcguaauaugguaaucccggaggggcgggugaucgaccucggcugcgggcgcggcgggugguccuauuacugcgccggccugaagaaggugaccgagguccggggauacaccaaaggcggacccgggcacgaggaacccgugcccaugucgaccuacggcuggaacaucgugaagcugauguccgggaaggacgucuucuaccucccgcccgagaagugcgacacgcugcugugugacaucggggagagcuccccuagccccaccguggaggagucccgcaccaucagggugcugaagauggucgagccguggcucaagaacaaccaguucugcaucaaaguccugaaccccuauaugccgaccgugaucgagcaccuggagcggcuccagcgcaagcacggcgggaugcugguccggaauccucugucccgcaacuccacgcacgagauguacuggaucagcaacggcacagggaacaucguggcuuccgucaacauggucagccggcuccugcuuaaccgcuucaccaugacccacagacggccgaccauugagaaggacguggaccuuggcgcgggcacccggcaugugaacgccgagcccgagacccccaacauggacgucauaggggaacgcauaaagcggaucaaggaggaacauaacuccaccuggcacuacgacgacgaaaacccguacaagacgugggccuaucacggcagcuacgaggugaaggccacgggguccgccagcagcaugaucaacggagucgugaaacugcugaccaagcccugggacguaguccccauggugacccagauggcgaugacggacaccacgcccuucgggcagcagcgcguguucaaggagaaggucgauacacggacgccgagauccaugcccggcacccggcgcguaaugggcaucaccgccgaguggcucuggcggacccuggggcgcaacaagaagccaaggcugugcacgcgcgaagaguucaccaagaaggugcgcaccaacgccgccaugggcgcggucuucaccgaggagaaccagugggauagcgcuaaagccgccgucgaggaugaggacuucuggauccucguggaucgggagagagagcugcacaagcuggggaaguguggcuccugcgucuauaacaugauggggaagcgggagaagaagcucggcgaguucgggaaggcgaaggggagccgcgcgaucugguacauguggcugggugcccgguaccuggaguucgaagcccuugguuuccugaacgaggaccacugguucucccgcgagaacagcuacuccggcguggagggggagggacugcacaagcucggcuacauccugcgcgacaucagcaagauccccgggggcgccauguacgccgacgacacggcggggugggacacccgcaucacugaagacgaccugcacaacgaagagaagaucacccagcagauggacccggagcaucggcagcuagccuccgccaucuucaagcugacguaccagaacaagguggucaaggugcagcgccccacccccaccggcaccgugauggacauaauaagccggaaggaccaacgcggcuccgggcaggucggcaccuacgggcugaacacguucaccaacauggaggcucagcucaucagacaaauggagggcgaggggguucuuagcaaggccgaucuggagaacccccaucucccggagaagaagaucacccaguggcuggaaaccaagggcguggagcgccugaagcggauggcgaucuccggugacgacugcgucgugaaacccaucgacgaccgcuucgccaacgcccuccuugcccugaacgacaugggaaaggugcguaaggacaucccccaguggcagcccagcaagggcuggcacgacuggcagcaggucccguucugcucccaccacuuccaugagcucauuaugaaggacgggcgcaaguuagugguuccgugccggccccaggacgaguugaucggccgcgcccggaucagccagggggcgggcuggucccuccgcgagacggccugccuaggcaaggcuuacgcccagauguggagccugauguacuuccaccgccgggacuugcgccuggcguccaacgccauauguagcgccguccccguucacuggguucccaccucgcggaccacgugguccauccacgcccaccaccaguggaugacgaccgaggacaugcugacggucuggaaccgcguguggauugaggacaaccccuggauggaggacaagacccccgugacgacuugggagaacguccccuacuuggggaagcgggaggaccagugguguggcagccucaucgggcugaccucccgggccaccugggcgcagaacaucccgacggccauccagcagguccgcagccucaucggcaacgaggaguuccuggacuacaugcccuccaugaagcgcuuccggaaggaggaagaguccgagggggccauaugguga

SEQ ID NO: 25972 - RNA, 9873 nt, Artificial Sequence
  derived and/or modified CDS sequence (opt11) from DENV-3__FJ373302__SS-prME
accagccugugccucaugaugauccugcccgccgcgcuugcguuccaccucaccagccgcgacggcgaaccccggaugaucguggggaaaaacgagcgcgggaaaagccuucuguucaaaacagccaguggaaucaacaugugcacuuuaaucgccauggaccugggcgagaugugcgacgauacugugacguacaagugcccccacauugccgagguggagcccgaggacaucgacuguuggugcaaccugaccagcaccugggugaccuaugggaccugcaaucaagcuggcgagcaccggcgcgacaagcgcuccguggccuuagcaccccacgugggcaugggguuggacacgcgcacccaaacguggaugagugccgagggcgccuggcggcagguagaaaagguagagaccugggcguugagacacccuggguucacgauccucgcccuguuucuggcacacuacaucgggaccucgcucacccagaaggugguaaucuucauccugcucaugcucgucacucccagcaugacgaugcguugcgugggggugggcaaccgcgauuucgucgagggacuuaguggagccaccuggguggacgugguccuggagcacggcggaugcgugacuacuauggccaagaacaagcccacuuuagacaucgagcugcagaagacugaagcgacccagcuggccaccuuacggaagcuguguaucgagggcaaaauuaccaacaucaccaccgacagccgcugccccacccagggugaggccgugcugccggaggagcaggaccagaacuaugucugcaaacauaccuacguggaccgcggguggggcaacgggugugggcuauucgggaaaggcucccucguaaccugugccaaguuccagugccuggagccuaucgaaggcaaggucgugcaguacgagaaccucaaguacacugugaucaucaccguccacacuggggaccagcaucaagugggcaacgagacccagggugucacagccgagaucacgccccaggcgagcacgaccgaggccauucuccccgaguacggcacccuugggcuggagugcucuccgcgcaccggccuggacuuuaacgagaugauccuucugaccaugaagaauaaggccuggauggugcaccggcagugguucuucgaccugccccuccccuggacgagcggcgcaacuaccgagacucccaccuggaaucgcaaggagcugcucgugaccuucaagaacgcgcaugcgaagaagcaagaggucguggugcuggggucgcaggagggggccaugcacacagcccucacgggggccacggagauccagaauagcggcgggacguccaucuucgcaggucaccucaagugucggcugaagauggacaaacuggagcugaaaggaaugagcuacgcgaugugcaccaacaccuucguacugaagaaggaggucuccgagacgcagcacgggacuauccucaucaagguggaguauaagggcgaggacgccccguguaagaucccauuuuccaccgaggacgggcagggcaaggcacacaacggccgcuugaucaccgccaaccccgucgugacgaagaaggaggagcccgugaauaucgaggcagagccgcccuucggggaaagcaacaucgucaucggcaucggggacaacgcccugaagaucaacugguacaagaagggauccucgauagggaagauguucgaggccaccgcccggggcgcucgccguauggcaauccugggagacacggccugggacuucggguccgugggcggggugcucaacagccugggcaagaugguccaccagaucuuuggguccgccuacaccgcccuauucuccggcguauccuggguuaugaagaucggcaucgggguacucuuaaccuggaucggacugaacagcaaaaacaccagcaugagcuuuucuugcauagcuaucgggaucaucacccucuaccuaggcgcgguggugcaagccgacaccggcugugugaucaacuggaagggcaaagagcuaaagugcggcuccgggaucuuuguaacgaacgagguacacaccuggaccgagcaguacaaguuccaagcugacucccccaagaggcucgccaccgccaucgcgggcgcgugggagaacggggucuguggcauccgcucaacaacccggauggagaaccugcuguggaagcagaucgccaacgagcucaacuacauccugugggaaaacaauaucaagcugacagugguggucggcgacaucaucggcguacucgagcagggcaagcgcacgcugacgccucagccaauggagcuaaaguacuccuggaagaccugggggaaggccaagaucgugaccgcggagacucagaacucguccuucaucaucgacggccccaauacgcccgaaugccccagcgccucccgggccuggaaugucugggagguggaagacuacggguuuggcguguucaccacaaacaucuggcucaagcugagagaagccuacacacaacugugcgaccaccggcucaugagcgccgccgucaaggacgagcgagccguccacgccgauaugggcuacuggaucgagagccagaagaaggguuccuggaaacuugagaaggcuagcuuaaucgagguaaaaacuugcacuuggcccaagucacauacacucugguccaacggcguacucgaauccgauaugaucauccccaaaagccuugccgggcccaucucccagcacaacuaccguccagguuaccacacccagaccgcggggcccuggcaccucggcaagcuggagcuggacuucaacuacugcgaaggcacgacaguggugaucacggagaacugcgggacucgcggcccuucauuacggaccacuacagucuccgggaagcugauccacgaguggugcugccgcucgugcacccugcccccguuacgguauaugggcgaggaugggugcugguacggcauggagauccgccccaucuccgagaaggaagagaauauggucaagagccugguguccgccggcagcggaaaggucgacaauuucacgaugggcguguuaugccucgccauacuguucgaggaggucaugagggguaaguucggaaagaagcacaugaucgccgggguguucuuuaccuucgucuugcucuugucgggccagaucaccuggcgcgacauggcacacaccuuaauaaugauaggcagcaacgccucggaccggauggggaugggagugacguaccuggcccuuaucgccaccuucaaaauccaacccuucuuagcucucggguucuuccugcgcaagcuaacaagccgcgagaaccuacucuugggcguaggccucgcgauggccaccacacugcagcugccggaggacauagagcagauggcgaaugguauugcccucggccugauggcccuaaagcuaaucacccaguucgagaccuaucagcuguggaccgcgcugauuagccuaacgugcucgaacaccauuuucacccugacaguagcguggcguacggccacccugauucucgccgggguuagccugcugccggucugccaguccucgaguaugcgcaaguccgacuggcuccccaugaccguggccgcgaugggcgugccgcccuuaccucuguuuaucuucagccugaaggacacccugaagcgacgcagcuggccccugaaugagggagugauggccgugggccucgucaguauccuggccuccucccugcuccggaacgacgugccaauggccggcccccuaguugcaggcggccuacucaucgccugcuacgucauaacggguaccucugccgaccugacaguggagaaagccgcugacgugacuugggaggaggaggccgagcagacgggcguuucccacaaccucaugaucaccguugacgacgacggaacaaugcgaauaaaggacgacgagaccgagaacauccucacgguccugcuuaagacggcguugcugauugugagcggaauauucccauacucgauccccgccacccuuuugguguggcacaccuggcaaaagcaaacccgccgcagcggcgugcuaugggacgucccuagcccgccggagacgcagaaggccgagcucgaggaggguguuuaucggauuaagcagcagggcauauucgguaagacccagguuggcgucggggugcagaaggagggcguguuccauaccauguggcacguuaccaggggcgccguuuugaccuacaacgggaagcggcuggagcccaacugggcgagcgucaagaaagaccugauuuccuacggcggggguuggcgccucagugcccaguggcagaaaggggaggagguacaagugaucgcgguggagccgggcaagaaucccaagaauuuccagacaaugcccggcaccuuccaaaccacaacgggggagauaggcgccaucgcccuggauuucaagcccggcaccagcggcagccccaucaucaaccgggaggggaaggucguggggcuguauggcaacggcguggucaccaagaacggcggguacgugagcggaauagcccagacuaaugccgagccggauggcccaacucccgagcuggaggaggaaauguucaagaagcgcaaccucacaaucauggacuuacaccccgggucaggcaaaacucggaaguacuuaccggccaucguacgcgaggccaucaagcgccgcuugagaacgcugauacuggcgcccacgcgcguaguagcggccgagauggaggaagcguuaaaggggcugcccauucgguaccagacaaccgccaccaagagcgaacacaccggccgcgagaucguggaucugaugugccacgcaaccuucaccaugcggcuucugucccccguccgaguccccaauuacaacuuaaucaucauggacgaggcccacuucacagaccccgccagcaucgcagcacgaggguauaucuccacccgcguggggaugggcgaggccgcugccaucuuuaugaccgccacgccacccgggacggcggacgcguucccgcagagcaacgcacccauccaggacgaggaacgcgauauucccgagcgguccuggaacagcgguaacgaauggaucacagacuuugccggaaaaaccgucugguucguuccuuccaucaaggccggaaacgacaucgccaacugccuccgcaagaaugggaagaagguuauacagcuuagccggaagaccuucgacacggaguaccagaagaccaagcugaacgacugggacuucgucgucaccaccgacaucagugagaugggagcgaacuucaaggcagaccgggugaucgacccucggcgcugucuuaagcccgucauccugacggacggacccgagcgggugauccuggcuggacccaugccggugacugccgccuccgcugcgcagaggcggggccguguugggcggaacccacagaaagagaacgaccaguacauuuucaccggccagccacucaacaaugacgaggaccacgcacacuggacagaggcaaagaugcugcuggacaacaucaacacccccgaggguauuaucccggcccuguucgaacccgagcgcgagaaguccgcagccaucgacggugaguaccgguugaagggugagucucgcaagacuuucguggagcuaaugcggcguggggaccucccgguuuggcuggcccacaaggucgccuccgaaggcauaaaguacaccgacagaaagugguguuucgacgggcagcgaaacaaccagauuuuggaggagaacauggacguggagaucuggaccaaggagggcgagaagaaaaagcuccggccccgcuggcuggacgcccgcaccuacucagauccgcuggcccucaaggaguucaaggauuucgccgcgggucggaaguccaucgcacuggaccuggugacggagauagguagagugcccagccaccucgcgcaccggaccagaaacgcccuggacaaccuggucaugcuccacaccagcgagcacggcgggaaagccuaccggcacgccgucgaggaacucccagagaccauggagacgcugcuccugcugggccucaugaucuugcuaaccggaggggcgaugcuguuccugaucuccgggaaggggaucggcaagaccuccaucgggcugaucugcgugaucgcgucaagcggcaugcucuggauggcugagaucccccugcaguggaucgccuccgccaucgugcuagaauuuuucaugaugguccuccugaucccagagcccgaaaagcagcgcacgccccaggacaaucagcuagccuacguaguaaucgggaucuuaacgcuggcggcuaucaucgccgcuaacgaaaugggccugcucgagaccaccaagcgggaccugggcaugucuaaggagccgggggucguaucaccaaccagcuaccuggauguggaccuccaccccgcaucggcguggacgcuauacgcaguagcgaccaccgugaucacucccaugcugcgccacacgaucgagaacagcaccgcaaacgugucccucgcggccauugccaaccaggccguggugcugaugggucuggacaagggguggccgaucagcaaaauggaccuagguguuccgcuacuggcacucgggugcuacucccaagucaauccccugacccugaccgcggccgugcuacugcugaucacgcacuaugccaucaucggacccggccuccaggcaaaggcgacucgcgaagcgcagaagaggaccgccgccgggaucaugaagaacccgaccguagauggaaucaugacaauugaccuggaccccgucaucuaugacucaaaguuugaaaagcagcugggccaggugaugcucuuggugcugugcgccguccagcuccuauugaugcgaaccuccugggcgcucugcgaggccuuaacccucgcgacggggcccaucacgacccucugggaagguagcccugguaaguucuggaacaccaccaucgcugucuccauggccaacauauuccgcggcagcuaccuggcgggggccgggcucgcauucuccaucaugaaaucugugggcaccggaaagcggggcaccggcagcaagggcgagacccuaggggagaaguggaagaagaaacugaaccagcugucccguaaagaauuugaccucuacaagaaaaguggcauuaccgaggucgaccggacggaggccaaggaggggcugaagcgcggugagaucacgcaccacgcggugucccggggcagcgcgaagcugcagugguucguggagcgcaacaugguaaucccggaggggcgggugaucgacuuaggcugugguagaggcggcugguccuacuauugcgccggucugaagaaagugaccgagguccggggcuacacgaagggcgggcccggacacgaggagcccguccccaugagcacauacggcuggaacauuguaaaauuaauguccgggaaggaugucuucuaccucccgcccgagaagugcgacacgcugcugugcgacauaggcgaaagcucccccagcccuacuguagaggagucccgcaccauccgcgugcugaaaauggucgagccguggcuuaaaaacaaucaguucuguaucaagguacuaaaccccuacaugcccacugugaucgaacaccuggagcgccuccagcgcaagcacggcggaaugcugguccggaacccccugagccggaacucgacgcacgagauguacuggauuagcaacggcaccgggaacauuguagccuccgugaacauggucucucggcuccuacuaaacagguucacuaugacucaccggcgcccuacgaucgagaaggacguggacuuaggggcuggcacgcgacacgugaacgcggagcccgaaacccccaauauggaugucaucggcgagcgcaucaagcguaucaaggaggagcauaacucaaccuggcacuaugacgaugagaauccguacaagacgugggcguaccauggcagcuacgaagugaaggcaaccggaucugccagcagcaugaucaacggcguugugaagcugcugaccaagcccugggacgugguccccauggugacccagauggccaugacggacaccacccccuucgggcagcagaggguauucaaagagaaggucgacacccggacaccaagguccaugcccggcacccggcgcgugaugggcaucaccgcugaguggcucuggcggacccuggggcgcaacaagaagccccggcugugcacacgcgaggaauuuaccaagaaggugaggaccaacgccgccaugggcgcgguauucaccgaggagaaccagugggacagcgccaaagcggccguggaggacgaggacuucuggaaguuaguagaccgugagcgugagcugcacaagcugggaaaaugcgguuccugcgucuauaacaugauggggaagcgugagaagaagcucggcgaguucggcaaagccaaggggucgcgcgccaucugguauauguggcucggcgcucgguaccuggaguuugaggcacucggguucuugaacgaggaccacugguucucccgcgagaacuccuauucgggcguagagggcgagggcuugcacaagcucggcuacaucuugcgggacaucagcaagauacccgggggugcaauguacgccgacgacacggccggcugggacacccgcauaaccgaggaugaccuacacaaugaggagaagaucacccaacagauggacccggagcaccggcagcucgcuaacgcuaucuuuaaacuaacguaucagaacaagguggucaaggugcagagaccuacacccaccggcaccgugauggacaucaucucccggaaagaucagagagguagcgggcaggucggcaccuacggucuaaauacguucacuaacauggaggcccaguugauccggcagauggagggugagggggugcuguccaaggcagacuuggagaacccccacuuaagcgagaagaagauuacccaguggcuggagaccaaagggguggagcgccugaagcggauggccaucucuggcgaugacugcgucgugaagccuaucgacgaucgcuucgccaacgcgcucuuggcccugaacgacauggguaagguacggaaggacaucccccaguggcaaccuagcaagggcuggcacgauuggcagcaggucccauucuguucacaccacuuccacgaacucauaaugaaggaugggcgcaagcuggucgugccgugcaggccacaggacgagcugauuggccgcgcccggauaagccagggggccggguggucucucagagagacggcuugucuggggaaggccuacgcucagauguggagccugauguacuuucaccgccgggaccuccgccuggcguccaacgccauuuguagcgcgguuccugugcacugggugccaaccagcagaaccaccuggucaauccacgcccaccaccaguggaugacgaccgaggacaugcugaccgucuggaaccgagucuggaucgaggacaacccguggauggaggacaagacacccgugacuaccugggagaacgucccauaccucgggaagcgggaggaccaauggugcgggagccugaucgggcugaccucccgugcgaccugggcccagaacauaccuaccgccauccagcagguccggagcuuaaucgggaacgaggaguuccuggacuacaugccguccaugaaacgcuucaggaaggaggaggagagugaaggggcgaucugguga

SEQ ID NO: 25973 - RNA, 9873 nt, Artificial Sequence
  derived and/or modified CDS sequence (opt11) from DENV-3__FJ182007__SS-prME
accaguuugugucucaugaugauccugccggcagcacuggcauuccaccuaacaagcagggacggggagcccaggaugaucguggggaagaacgagcgcgguaagucccugcuguucaagacggccagcgggaucaacaugugcacgcucauagccauggaccugggggagaugugcgaugacaccguaacuuacaagugcccgcacaucgccgagguggagcccgaggacaucgacugcuggugcaaccucacaagcaccugggugaccuacgggaccugcaaccaggccggcgaacaccgccgcgacaaacggucaguagcguuagcgccccacgugggcaugggguuggauacgcgcacccagaccuggaugagcgccgaaggagccuggcgucagguagagaagguggaaaccugggcucugcgccacccuggguucacgauccucgcgcuguuccuggcccacuauaucggcaccucccucacccagaagguggugaucuucauccugcugaugcuaguuacccccucuaugacgaugcggugcguaggggugggcaaccgugacuucgucgagggucuguccggggccaccuggguggaugugguucuggagcacggcgggugcgugaccaccauggcaaagaacaagcccacccucgacauugaguugcagaaaaccgaggcgacacaacuagcgaccuuacggaagcuguguaucgaaggcaagaucacgaacaucaccaccgacucucgcugucccacccagggcgaggccgugcugccggaggagcaggaccagaacuacgucugcaagcacacauacguggacagggggugggguaauggcugcggccuauucggcaaggguucccuggucaccugcgcgaaguuucagugccuggaacccaucgagggcaaagucguucaguaugagaaccucaaguacaccgugauuauuaccguccacacgggagaucagcaccagguggggaacgagacccagggggugaccgccgagaucacgccacaggccagcacgaccgaagccauccugccagaguacgguacacuaggacucgaguguuccccgcgcaccggccuggauuucaacgagaugauccugcucaccaugaagaacaaggccuggaugguucaccggcaaugguucuucgaccugccccugccguggacgagcggggccaccaccgagacccccacuuggaaucguaaagaacuucuggugacauuuaagaacgcccacgcgaagaaacaggagguggugguguuagggucacaggagggcgcgaugcauacggcccuaacuggcgccaccgagauucagaacagcggcgggaccucgaucuucgcuggccaccugaagugccggcugaagauggauaagcuugagcugaaggggaugagcuacgcgaugugcaccaacaccuucguacugaagaaggagguauccgagacgcagcacgggaccauauuaaucaagguggaguacaagggagaggacgccccgugcaaaauacccuucaguaccgaggacggucagggcaaggcccacaacggccgcuugaucacggccaacccuguugugacgaagaaagaagagccugucaacaucgaagcagagccgcccuucggggagagcaacaucgucauuggcacaggggacaacgcucugaagaucaacugguauaagaaaggcagcagcaucggcaagauguucgaggccaccgcccggggagcucgcaggauggcaauccugggcgacaccgccugggauuucggguccgucggcggagugcuuaacagccugggcaagaugguccaccagaucuuuggauccgccuacacggcccuguucagcggcgucuccugggugaugaagauuggcaucgggguccuccugacuuggaucggccugaacagcaagaacaccuccaugucuuucuccugcaucgccaucgguaucaucacccucuaccugggagcgguaguucaggccgacacggggugcgucaucaacuggaagggcaaggagcucaaguguggcucaggcaucuucgugacgaacgaggugcacaccuggacugagcaguacaaauuccaggcagacucccccaagcgccucgccacggccauagcgggugcaugggagaacggugucugcgggauccguagcaccacacggauggagaaucugcuguggaaacagauugcuaacgagcucaacuacauccugugggagaacaauaucaagcugaccgugguggugggggauaucauuggcguguuagagcaggguaagaggacacugacgccccagccgauggagcugaaguauuccuggaagaccugggguaaggccaagaucgugaccgcggagacgcagaacagcucguucaucauugaugggcccaacacccccgagugccccagcgccucccgagccuggaacgucugggagguggaggacuacggguucggcgucuucaccaccaacaucuggcucaaauuacgcgaggucuacacccagcugugcgaccaccggcuaaugucggccgccgugaaggaugagcgcgcggugcacgcugacaugggcuacuggaucgagagccagaagaacggguccuggaaguuagagaaggccagucugaucgaggucaaaacgugcacuuggccgaagagccacacccucuggagcaacggcgugcuggaaagcgacaugaucauacccaagagccuggccgggcccauaagucagcacaacuaccggccggguuaccauacccagacggcagggcccuggcaccuugggaaguuggaacuggacuucaacuacugugagggcaccacuguggucauuacagaggacugcgggacgcgaggcccgagccuacgaaccaccacuguguccgggaaguuaauacacgaguggugcugccgcuccugcacgcugccaccgcucagguacaugggcgaggacgguugcugguacgguauggagauacgccccaucagugagaaggaggaaaacaugguuaagagccuggucuccgcgggcagcgggaaaguggacaacuuuaccauggggguguugugccuggccauccuguucgaggaagucaugcgggggaaguucggcaagaagcacaugaucgccgggguguucuucaccuucguacugcuccuguccggccaaauaaccuggcgcgacauggcccacacgcugaucaugaucgguuccaacgccucugaucggauggggaugggcgucaccuaccucgcccuuaucgccacuuucaaaauccagcccuuccuagcccucggguucuuccugcguaagcugaccucccgggaaaaccuccuguugggcgucggcuuagccauggcgacgacccugcaguuaccugaggauaucgagcagauggcuaaugggaucgcauugggccuaauggcccugaagcucaucacacaguucgagaccuaccaguuauggacggcccugaucagccugaccugcuccaacaccaucuucacccugacgguggcauggcgcaccgccacccuuauccucgccgguguaagucugcugccggugugucaguccagcuccaugcggaaguccgauuggcuacccaugaccgucgccgccaugggggugccgccccucccgcuuuucaucuuuucacucaaggacacacugaagcgccgcagcuggccccugaacgagggggugauggcugucggucucguguccauuuuagccagcucccugcuccggaaugacguaccgauggcgggaccacuagucgcgggaggacuccucauagccugcuacgugaucaccgggaccagcgccgaccugaccguggagaaggcugccgauguuacgugggaggaggaggcagagcagaccggcgugucccacaaccuaaugauaaccguugacgaugacgguacgaugcgcaucaaggacgacgagaccgagaacauccucacgguccuacugaagaccgcccuccugaucgugaguggcaucuucccuuacuccaucccagcgacccugcugguguggcacaccuggcaaaaacagacgcgccgcagcggcguucugugggacgugccuagcccgcccgagacccagaaagccgagcuggaggaggggguguaucggauaaagcagcagggcaucuucgggaagacccaggucggcguggggguucagaaagagggcgucuuccacacgauguggcacgugacccgcggagcggugcuuacguacaacgggaagcggcuggagcccaauugggcaagcguuaagaaggaccuaaucuccuacggcggggguuggagacucagcgcgcaguggcagaagggggaggagguccaggugaucgccgucgagcccggcaaaaaccccaagaacuuccagacgaugcccgggaccuuucagacgaccaccggggagaucggcgccaucgccuuggacuucaaacccgggaccagcgggucccccauaaucaaccgggagggcaagguggucgggcucuacggcaacggagucgugacgaaaaacgguggguacgugagcggcaucgcccagaccaacgcggaaccggacggccccacacccgagcuggaggaggagauguucaagaagcgcaaccucaccauuauggaucugcaccccggguccggcaaaacgcggaaguaccugccggccaucguccgcgaggcaaucaagcggagguuacggacccuuauccucgcccccacccgcgugguagccgcggaaauggaggaggcccuaaaagggcugcccauccgcuaccagaccacggccaccaagucggaacacaccggccgcgagaucgucgaccugaugugccacgccaccuucaccaugcggcuccugagucccgugcgcgugccgaacuacaaccugaucaucauggacgaggcccacuucaccgaccccgcgagcaucgccgcccggggguacaucuccacccgcgucggcaugggcgaagccgcggccaucuucaugaccgccacgccgcccgggaccgccgaugccuucccgcagagcaacgcgcccauccaggacgaggaacgcgacauccccgagcguucuuggaacucaggcaacgaguggaucacagauuucgcugggaagaccgugugguucgugcccuccaucaaggccggcaacgacauagccaacugccuccgcaagaacgggaagaaagucauccagcugagccggaaaacguuugacaccgaguaccagaagaccaaguugaacgacugggacuucguggugacaacggauaucuccgagaugggcgcgaacuucaaagcggaccgcgucaucgacccgcggcgaugccucaagcccgugauucucaccgacggcccggaacgggugauccuggccgggcccaugccggucaccgcagccagcgccgcgcagcgccggggccgcgucggucggaacccucagaaggagaaugaccaguacaucuucaccggccagccucucaacaacgacgaggaccaugcccacuggaccgaagccaagaugcuguuggacaacaucaacacgcccgaagguauuaucccggcccucuuugagcccgagagagagaaguccgccgcuaucgacggcgaauaccggcugaagggcgagagccgcaaaaccuuuguggaacugaugcggcgcggagaccuccccguguggcuugcccacaagguggccuccgaaggcaucaaguacaccgaucggaaauggugcuucgacgggcagcgcaacaaccaaauccucgaggagaacauggacgucgagaucuggaccaaggagggagaaaaaaagaagcuucguccccgcuggcuggacgcccgcacguacucugacccgcuggcgcucaaggaguucaaggacuucgccgccggccggaagucuaucgccuuggaccuggugacugagaucgggcgcgugcccagccaccucgcccaucggacccgcaaugcgcuggacaaccuggucaugcuccacaccagcgagcacggggggaaggccuaccggcacgccguggaggagcugcccgagacaauggaaacccugcugcugcugggccucaugauccugcucacugggggcgccaugcuguuccugaucuccggcaaggggaucggcaaaaccagcaucgggcugaucugcgugauugccuccagcggcaugcucuggauugcggagauuccgcugcaguggaucgccuccgccauaguccuggaguucuuuaugauggugcuccugauccccgagcccgagaagcagcgcacgccccaagacaaccagcuugccuacguggucaucgggauacucacccuggcggcaaucauugccgccaacgagaugggccugcucgagaccaccaagcgggaccuagggaugagcaaggagccggggguggugucccccacaucuuaccuggacguggaccuccacccagccucagcguggacucuguaugccguggccaccacggugaucacgccuaugcugcgucacaccauagaaaacagcaccgcgaacgucucccucgcagcuauagcgaaccaagcagucguucugauggggcuggauaagggguggccgaucagcaagauggaccugggcgucccacuguuagcacucgggugcuauucccaggugaacccccugacccugacggccgccguucuccuguuaaucacgcacuacgccaucaucgguccaggucuccaggccaaggccacccgagaggcgcagaaacgcaccgccgccgggaucaugaaaaacccgacggucgacggcauaaugacaaucgaccuagaccccgugaucuacgacagcaaauuugagaagcaacugggccaggugaugcuccugguccugugugccguacaguugcuguuaaugcggaccucgugggcccucugcgaggcgcugacccuggccacaggucccauaacgacccugugggagggcucgcccggaaaguuuuggaacacaacgaucgccguguccauggccaacaucuuccgcggcucguaccuggccggggcgggcuuggcauucuccauaaugaaguccgucgggaccggcaagcggggcaccgggagccagggcgagacccuaggggagaaguggaagagaaagcugaaccagcugucccggaaggaguucgaccucuacaaaaagucggggaucaccgagguggaccguacggaggccaaggagggucuaaagcgcggcgagauuacccaucacgccguaucccgcggcagcgccaagcuacagugguucguagagcggaacaugguaaucccggaggggcgagugaucgaccucggcugcggccggggcgggugguccuacuacugcgcuggcuuaaagaaggucaccgaagugcgcggcuauaccaagggcgggccagggcaugaagagcccgugcccaugagcacguacggcuggaacauugucaaacugauguccgggaaggacguuuuuuaccucccgcccgagaaaugcgacacccugcugugcgacaucggcgagagcucccccagccccacuguggaggaaucccgcaccauucggguccugaagaugguggagcccuggcucaagaacaaccaguucugcaucaaggugcugaaccccuacaugcccacagucaucgagcaccuugagcgccuacagcggaagcacggcgggaugcuggugcgcaaucccuugagccggaacuccacccacgagauguacuggauaagcaacggcaccgguaacaucgucgccucagucaacaugguuagccggcuccugcugaaccgguucaccaugacccaucgccggcccaccaucgagaaggacguggaucucggagccggcacccgccacgucaacgccgagcccgagacccccaacauggacguuaucggggagcggaucaagcgcauaaaggaggagcacaacuccaccuggcauuacgacgacgagaacccuuacaagacaugggccuaucauggcagcuaugaggugaaggcgaccgguuccgcuagcuccaugaucaacggcguagugaagcuacugaccaagcccugggacguggugcccauggugacgcagauggcaaugacagacaccacccccuucgggcagcagcggguguuuaaggagaagguggacacgcgcaccccgagguccaugcccgguacacgccgggugaugggcaucaccgccgaguggcucuggcgcacgcuggggcguaacaagaagccccgccugugcacccgcgaggaauucaccaagaagguucgaaccaacgccgccaugggcgccguauucacggaggagaaccagugggacagcgccaaggccgcgguggaagacgaggacuucuggaagcucgucgacagagagcgggaacugcacaaacuggggaaguguggcuccugcgucuacaacaugaugggaaagcgcgagaagaagcucggcgaguucggcaaggccaagggaagccgggcuauaugguacauguggcugggcgccagauaccuggaguucgaggcccucggguucuuaaaugaagaccacugguuuuccagagaaaacagcuacuccggcguggagggggagggccuacacaagcucggcuauauccuacgcgacauuucaaagauccccgggggcgcgauguacgccgacgacaccgccgggugggacacccggaucaccgaggacgaccugcauaacgaagagaagaucacucagcagauggacccggagcaccgccagcucgccaaugccauuuucaaauuaacauaccagaacaaagucgugaaggugcagcggccuacccccaccggcaccguaauggacaucaucucacgcaaggaucagcgagggaguggccagguggggacguacgggcugaacaccuuuaccaacauggaggcacagcucauccgccagauggagggcgaagggguacuguccaaagccgacuuggagaacccucaccucagcgagaaaaagaucacccaguggcuugagacuaagggcgucgagcgguuaaagcgcauggccaucuccggcgacgacugcguggugaaaccgaucgaugaccgguucgccaacgccuugcuggcuuuaaaugacauggggaagguccgcaaggacauuccccaguggcagccaagcaaaggcuggcacgacuggcagcagguccccuuuuguucccaccacuuccacgagcucauaaugaaggacgggcggaagcugguagucccgugccgcccccaagacgagcuaaucggccgggcccgcaucagccagggggcuggcuggagucuccgagagaccgccugccugggcaaggcguacgcccagauguggagccucauguacuuccaccgucgcgaucuucggcuggccuccaacgccauuuguagcgccgugcccgugcauuggguaccaaccagccgcaccacguggaguauccacgcgcaccaccaguggaugacgaccgaagacaugcugaccguguggaaccggguguggaucgaggacaacccauggauggaggacaagacacccgugacgaccugggagaacgugcccuacuuagggaagcgcgaggaccaaugguguggaucccugaucgggcugacaucccgggccacgugggcgcagaacauucccaccgccauucagcagguccgcagccucaucggcaacgaagaguuucuagacuauaugccgagcaugaagcgguucagaaaggaggaggagagcgagggggcaaucugguaa

SEQ ID NO: 25974 - RNA, 9873 nt, Artificial Sequence
  derived and/or modified CDS sequence (opt11) from DENV-3__FJ182008__SS-prME
accagccugugcaucaugaugauccuaccugcggcccuggcguuccaccugaccucgcgcgauggcgagccgcggaugaucguggggaaaaacgaacgcggcaagucacuccuguuuaaaaccgccuccgggaucaauaugugcacccugaucgccauggaccucggugagaugugcgacgauacagugaccuacaagugcccccacauaaccgagguggagcccgaggacauagacugcuggugcaaccugaccucuaccugggugacuuacgggacuugcaaccaggccggcgagcaccggagagacaagcgauccguggcacuagcgccccacgugggcaugggccuugacaccaggacccagaccuggaugagcgccgaaggagcauggcgccagguggagaaaguggagacgugggcccugcgccacccgggguucaccauccucgcccuuuuucuggcccacuacaucggcaccucccugacgcagaagguggugaucuucauccuccugaugcuggucacgcccagcaugaccaugcggugcgugggcgugggaaaccgcgacuucgucgagggccucuccggugccaccuggguggacgugguccuugagcacggcgggugcgugacaacgauggcaaagaacaagccuacccuggacaucgagcuccagaagaccgaggcuacccagcuggcgacucugcggaagcuuugcauagagggcaagauaaccaacaucaccaccgacucgcgcugucccacgcagggcgaggcagucuuacccgaggagcaggaccaaaacuacguaugcaagcacaccuacguagaccgaggguggggcaacggcugcggccuguuugggaagggcucccucguuaccugcgccaaguuccagugccuugagcccaucgagggcaaagucgugcaguacgagaaccugaaguacaccgugaucaucacgguccacacuggggaucagcaucaggugggcaacgagacccaggggguuaccgccgaaaucacgccccaggcaucuacgaccgaggcuauccuccccgaguacggcacccuggggcuggagugcuccccucgcaccggccucgacuucaacgagaugauccuccugaccaugaagaacaaggcauggauggugcacaggcagugguucuuugaccucccccugcccuggaccagcggugccaccaccgagacccccaccuggaaucgcaaggaacugcucgugaccuucaagaacgcccacgccaagaaacaggaggugguggugcuggggucccaggaaggcgcgaugcauaccgcccucacuggagcuaccgaaauucagaacagcggggggaccuccaucuucgccggccaccucaagugucggcugaagauggacaagcuggagcucaaggguaugagcuacgccaugugcacuaauacauucguccugaagaaagagguguccgagacccagcacgggaccauccuaaucaagguggaauauaagggcgaggacgcgccuugcaagauccccuuuaguaccgaagacgggcagggaaaggcacacaacggcaggcucaucacggccaacccagucgugacuaagaaggaggaacccgucaacaucgaggcggagccgcccuucggugagagcaacaucgucaucggcaucggggacaacgcgcugaagaucaauugguauaagaagggcuccagcauaggcaagauguuugaggcaacagcucggggcgcucgccggauggcuauccugggcgacaccgcgugggacuuuggcuccgugggcggggugcugaacagccucggcaagaugguucaccaaaucuucgggucagccuacacggcccuguucagcgggguguccugggugaugaagaucggcaucggaguacugcucacauggaucggccugaacagcaagaacacgucgaugagcuucuccugcaucgccaucggcgucauaacgcuguacuuaggcgccgugguccaagccgacauggggugcguaaucaacuggaagggcaaggaacugaagugcggcagcgguaucuucgugacgaacgagguccacaccuggaccgagcaguauaaguuccaggccgacucccccaagcgccuugccaccgcuaucgccggcgcgugggagaacggggugugcggcauccgcagcaccacccgcauggagaaccuccuguggaagcaaaucgccaacgagcugaacuacauccucugggagaacaacauaaagcugaccgugguuguuggagacaucaucggggugcucgagcagggcaagcgcaccuugacuccccagccgauggagcugaaguacucguggaagaccuggggcaaagccaagaucguuacggccgagacccaaaauagcuccuucauaauagacggccccaacacgcccgagugcccuagcgccucccgggccuggaacgugugggagguggaagacuacggguuuggcgucuuuacaaccaauauauggcugaagcucagagagguauauacccaauugugcgaucacaggcugaugagcgccgccgugaaagacgagcgcgccgugcacgcagacauggguuacuggaucgagagccagaagaacggguccuggaaacucgagaaggccagccugaucgaggugaagaccugcacguggccgaagucccacacucuguggagcaacggcgugcucgagucagacaugaucauucccaagagccuggccgggcccaucucccagcacaacuaccggcccgguuaccauacccagaccgccgggcccuggcacuuaggcaagcucgaauuagacuuuaacuacugcgaaggcacgaccgucgugaucaccgagaacugugggacccgcggacccagccugcggacgacuaccguguccgggaagcucauucacgaguggugcugccgcucgugcacucuacccccgcugagguauaugggagaggacgggugcugguacggcauggagauucgacccaucuccgagaaggaggagaacauggucaaaagccuugugagcgccggcagcgggaagguggacaacuucacgaugggcguacugugccuggcuauccucuucgaggaggugaugcgagggaaguucggcaaaaagcacaugauugccgggguguucuuuaccuucguccugcuguugucuggccagaucacguggcgcgacauggcccacacccugaucaugaucggcagcaacgccuccgacaagauggggaugggcgugacguaccuggcccuaaucgcgacuuucaagauccaacccuuccuagcccugggguucuuucuccggaagcucacuagccgcgaaaaccugcuacugggcgugggccuggccauggccacuacgcuccagcugcccgaggacaucgagcaaauggcgaacgggaucgcccugggccucauggcucugaagcugaucacccaguucgagaccuaccagcucuggaccgcccuuaucagccuaacgugcaguaacaccauguucacccucaccgucgccuggcggacggcaacgcugaucuuggccggcgugagccuccugccggucugccagucaagcuccaugcgcaagaccgauugguuacccauggccgucgccgccaugggcguccccccauugccgcuguuuaucuucagccugaaggacacccucaaacggcgcuccuggccccugaacgagggggucauggccgugggccuggugagcauacucgccuccucacugcugcgcaacgacguacccauggccggcccccucguggccgguggccugcuuauugcuuguuacgugauuacggggaccuccgcggaccucacuguggagaaggcagccgacaucaccugggaggaggaggccgagcagacgggcgugagccacaauuuaaugauaacuguggacgacgacgggaccaugcggauuaaggacgacgaaacggagaacauccugaccguccuccugaagacggcccuucucaucaucuccggcguguuuccguacagcauacccgcgacccugcugguguggcacacguggcagaagcaaacccagcgcucgggcguccucugggacgugcccagcccgcccgagacgcaaaaggccgagcuagaagaggggguguaccggaucaagcagcagggcauauucgggaagacccaggucgggguaggggugcagaaagagggcgucuuccacaccauguggcacgugaccagaggcgccgugcugaccuacaacgggaagcggcucgagcccaacugggccuccgucaagaaggaccugaucagcuacggcgggggcuggcgcuuauccgcgcaguggcagaagggggaggagguccaggugauugcggucgagcccggcaagaacccaaagaacuuccagaccaugccgggcaccuuccaaaccacuaccggugaaaucggcgccauagcccucgacuucaagcccgggaccucaggcagccccaucaucaaucgggaagggaaagugguggggcuguacggcaacggggucgugaccaaaaacggcgguuacguuuccgguaucgcgcagacgaacgcagagccggacggccccacacccgagcuggaggaggagauguucaagaagcgcaauuugaccaucauggaccuccaccccgggagcggcaagacccggaaguaccugccggccaucguccgagaggccaucaaaaggcgccugcgcacgcugauccuggccccuacccgcgugguggccgcggagauggaggaagcgcugaaggggcuccccauucgguaccagaccaccgccacgaaguccgagcacacuggccgcgagaucguugaccugaugugccacgccaccuuuaccaugcggcugcucagccccguacgcgugccaaacuacaaccugaucauaauggaugaggcccacuucacggaccccgccuccaucgccgcgcggggguacauaagcacccgcgucgggaugggcgaggccgcggccaucuuuaugaccgccacgccgcccgggacggccgacgccuucccgcaguccaacgcaccaauccaggacgaggagcgggacauaccugaaagaagcuggaacucggguaacgaguggaucacggacuucgcuggaaagacggugugguucguccccagcaucaaggcgggcaacgacaucgcaaacugccugcgcaagaacgguaagaaggucauccagcucuccagaaagaccuucgauacggaauaccagaagacuaagcugaacgacugggauuuuguggugaccacugacaucagcgagaugggcgcgaacuucaaggcggaccgcgucaucgacccacggcgcugccugaagcccgugauacucacggacggccccgagcgcgugauccuggccgggccuaugccggucaccgccgccuccgccgcgcaacgccggggucgggugggacggaacccccagaaggaaaacgaccaguacaucuucaccggucagccccugaacaaugacgaggaccacgcccacuggacugaggccaaaaugcuccuggauaacauaaacacccccgaggggaucaucccggcccuguucgagcccgagagggagaagagcgcggccaucgacggugaguaccggcucaagggcgagucccgcaagacguucgucgagcugaugaggcgcggggaucugcccguuuggcuagcccacaagguggcgagcgagggcaucaaguacaccgaccgaaaguggugcuucgacgggcagcgcaauaaccaaauucuggaggagaacauggacgucgagaucuggaccaaggagggcgagaagaagaagcugcggccccgcuggcucgacgcaagaaccuacuccgacccgcuggcgcuaaaagaguucaaggacuuugccgcaggccgcaagaguaucgcccucgaccuggugacggagauaggacgcgugcccucccaccuggcacacaggacacgcaacgcguuagacaaccuaguaaugcugcauaccucagagcacggcgggagggccuaccgccaugccgucgaagagcuccccgagaccauggagacuuugcugcuucugggcuugaugauccuccugaccgggggcgccauguuguuccucaucagcggcaaagggauuggcaagaccuccaucggccuaaucugcgugaucgccucuuccggcaugcuguggauggcggagaucccgcuacaguggaucgccagcgccaucguccuggaguucuucaugauggugcugcucauucccgagcccgagaagcagcggacgccacaggacaaucagcuggccuacguggucaucgggauacugacacucgccgcgaucaucgcugccaacgaaaugggccugcuggaaaccaccaagcgagaucucggcauguccaaagagccggggguagugagccccaccuccuaccuugacgucgaccugcacccugccagcgcuuggacgcucuacgccguggccaccaccgugaucacccccaugcugcggcacacgaucgagaacuccaccgcaaacgucagccuggcugcgauugccaaccaagccguugugcuuaugggccuggacaagggcuggccaaucuccaaaauggaccuuggcguuccccuccuggcucuuggaugcuacagccaagugaacccgcucacccugaccgccgcggugcuacuccugaucacgcacuacgccaucaucggccccgguuugcaggcgaaggcuacccgcgaggcgcagaaacggaccgcggccgggaucaugaagaacccgaccgucgacgggauaaugaccaucgaccucgacccugugaucuacgacuccaaguucgagaagcagcucggucaaguaaugcugcuagucuuaugugcagugcagcugcugcugaugcgaaccagcugggccuuaugcgaggcgcucacccuggcuaccggccccaucacgacacugugggaaggcaguccggguaaguucuggaacaccacuaucgccgugagcauggcaaacaucuuccggggcuccuaccuugccggugcgggccuggcauucagcauuaugaaaagugucggaacaggcaagcgcggcaccgggucgcagggcgagacccugggggagaaguggaagaagaagcuaaaucagcugucgcggaaagaauuugaucuguacaaaaaguccggcaucaccgaaguggaucggaccgaggccaaggaggggcucaagcgcggggagacgacccaccacgccgugagcaggggcaccgccaagcugcagugguucgucgaacggaacauggugaucccugagggccgcgugaucgaccuaggaugcgggcgcggcgguuggaguuacuauugugcuggccucaagaagguuaccgaggugcgcggguauacuaagggcgggcccgggcacgaggagcccgugcccaugagcaccuacggcuggaacaucgucaagcugauguccgggaaggacguguuuuaccuuccgcccgagaagugcgacacccuccugugcgacaucggcgagagcucucccagccccaccgucgaagaaucccggacuauacgcguccuaaagaugguggagccuuggcugaagaacaaccaguucugcauuaaggugcucaaccccuauaugcccacugucauagagcaccuggagcgcuuacagcguaagcacggcggaaugcucgugcgcaacccucugucacggaacuccacccacgagauguacuggaucagcaacggcaccgggaacauaguugcuagugucaacauggugucucgccuguugcucaaccgguucaccaugacccaccgccggccgaccaucgagaaagacguugacuuaggcgccggcacccgccacgugaaugccgaacccgaaacgcccaacauggaugugauuggagagcggauuaagcgcaucaaggaggaacauaacucuacuuggcacuacgacgacgagaacccguacaagaccugggccuaucacgguagcuacgaggugaaggcgaccggguccgccucguccaugauuaacggcgucgugaaacuccugacgaagcccugggacgucgugcccauggugacccagauggccaugaccgacaccacgccuuuugggcagcagcggguuuuuaaggagaaagucgacacccgcaccccucggagcaugcccgguacccgccgggugaugggcaucacggccgaauggcuguggcgcacccucgggcggaacaagaagccccgccuguguacccgggaagaauucaccaagaagguccgcacgaacgcggccaugggcgccguuuucaccgaggagaaucagugggauagcgccaaggccgcgguugaagacgaagacuucuggaaacuggucgaccgagagagggagcuccacaagcuugggaaguguggcuccuguguguacaacaugauggggaagcgagagaagaagcugggagaauucggcaaagcaaaggggagccgggcgaucugguacauguggcucggggcgcgcuaccuugaguucgaggcccugggguuccucaacgaggaccacugguucucccgggagaacucuuacucgggcguggagggggagggccugcacaagcugggcuacaucuugcgcgauauaagcaagauccccgggggcgcgauguaugccgacgauaccgccgggugggauacgcggaucacggaggacgaucugcauaacgaggagaagauaacccagcagauggacccggagcaccgccagcuggcgaacgccaucuucaaacuaaccuaccagaacaaggucgugaaagugcaacggcccacccccaccggcacggucauggauaucauuucccgcaaagaccagcggggcucaggccaggucggcaccuacgggcugaacaccuucacaaacauggaggcccaacugauccgccagauggagggcgagggggugcucucuaaggccgaccuggaaaacccccaccuccccgagaagaagauaacgcagugguuagagaccaagggcguugagcgguuacgccggauggccaucagcggggacgacuguguggugaagcccauugaugaucgguucgcaaacgcccugcucgcgcugaacgacauggggaagguccggaaggacaucccccaguggcagcccucaaagggcuggcacgacuggcagcaggugccguucugcagccaccacuuccacgagcugaucaugaaagacgggcgcaagcucguggugccgugccggccccaagaugagcugauaggucgggcccggaucucccagggagccggcuggagccugcgugagaccgccugccucggcaaggcguacgcccagauguggagcuugauguauuuccaucggcgggaccugcgccucgccagcaacgccauaugcuccgccguucccgugcauugggucccgaccagccgcacgaccugguccauccacgcacaccaccaguggaugacaaccgaggacauguuaacgguauggaaccgcguguggaucgaggacaacccauggauggaggacaagacgccggucaccaccugggagaacgugccguaccuugggaagcgggaggaccagugguguggcagucucaucgggcugacgagccgugccaccugggcgcagaauaucccaaccgccauccagcaaguacggucccugauuggcaacgaggaguuccucgauuacaugccuuccaugaagcgcuuccgcaaggaggaggagagugagggugccaucugguag

SEQ ID NO: 25975 - RNA, 9873 nt, Artificial Sequence
  derived and/or modified CDS sequence (opt11) from DENV-3__FJ182010__SS-prME
accagcuuaugccuuaugaugauccugcccgcugccuuggccuuccaccucaccagccgcgacggggagccucggaugaucguggggaaaaaugagcgcggcaagagccuuuuauucaagaccgccagcgggaucaacaugugcacucucauugccauggaccuaggggaaaugugcgacgacaccguuaccuacaagugcccccauaucgccgagguggaacccgaagacaucgacuguuggugcaaccugacaucuacgugggugaccuacggcaccuguaaccaggcaggcgagcaccggcgcgauaagcgguccguggcguuggcgccacacgucggcaugggacuggacacccgaacucagacguggaugagcgccgaaggcgcuuggcggcaggucgagaaggucgagaccugggcuuugcgccaccccgguuucacuauccucgcccuguucuuggcccacuacaucggaaccagccugacccagaaagugguaaucuucguacuccugaugcucguuaccccaagcaugacaaugcggugcgucggggucggcaaccgcgacuucguggagggccuauccggggccaccuggguggacgucgugcuggagcauggugggugugugacuaccauggccaaaaacaagccuacgcucgacaucgagcugcagaagaccgaggcgacccaacuggccacccuccgaaagcuguguauagagggaaaaaucaccaacaucaccacggacucacgcuguccuacccagggagaggcgguccugccggaggagcaggaccagaacuacgucugcaaacauacguacguagaccggggauggggcaacggcugcggucucuucgggaagggcucccuggugacgugugccaaguuccagugccucgagcccaucgagggcaaaguuguucaguacgagaaccucaaguacacggucaucaucaccgugcacaccggggaccagcaccaggucgggaacgagacccagggggugaccgccgagaucacuccccaagcaucgacaaccgaggcuauucugccugaauacggcacccugggccucgagugcuccccgaggaccggccuggacuucaaugagaugauauuacucaccaugaagaacaaggcauggaugguucaccgacagugguucuuugaccugccacuucccuggacgagcggcgccacgaccgagacccccacguggaaccgcaaggagcuccuggugacuuucaagaaugcccacgcgaagaagcaggagguggugguccugggcucgcaggagggcgcuaugcacacugcccucacaggggccacggagauccagaacagcggcggaaccucgaucuucgccggucaccugaagugccggcugaagauggacaagcucgagcugaaaggcaugagcuaugcuauguguaccaacacauucgugcugaagaaggaggugucggagacgcagcaugggaccauucucaucaagguagaguauaagggcgaggaugcgccgugcaagauucccuuuagcacugaggacgggcagggcaaggcccauaacggccgccugaucaccgccaaccccguggugacgaagaaggaggagcccgucaacauagaggcggagccgcccuucggugaaagcaauaucgucaucggcaucggugacaacgcccucaagaucaacugguauaagaaggguucuagcauagggaagauguucgaagcgaccgcccggggggcccgccgaauggcgauacugggcgauaccgccugggauuuuggauccgugggcggggugcucaacagccugggcaaaauggugcaccagaucuucggguccgccuacaccgccuuauucagcggcguguccugggucaugaagauaggcaucggggugcuucugacuuggauaggccugaacaguaagaacaccuccaugagcuuuuccugcaucgccauugggaucaucaccuuguaccuuggcgcgguuguccaggcugacaccgggugugugaucaacuggaagggaaaagagcugaaaugugggagcgguaucuucguuacuaacgagguacacacguggaccgagcaguacaaauuccaggccgacucccccaagcgccuugcgaccgccauagcuggcgccugggaaaacggagucugcgggauccggagcacgacccggauggagaauuugcuguggaagcaggucgcaaacgaacucaacuacauccugugggagaacaacaucaaacugacugucguggucggggacauaaucggcguccucgagcagggcaagcgcacucugacgccucaaccgauggaguuaaaauacuccuggaagaccuggggcaaagccaagaucgugaccgcugagacccagaauucuuccuuuaucaucgauggcccuaacacgccggagugucccagcgccagccgcgccuggaacgugugggaggucgaagacuacggguucggcguguucaccaccaacauauggcucaagcugcgcgagguguacacccagcugugcgaccaccgacucaugagcgccgcggucaaggacgagcgcgcggugcacgcggacaugggcuauuggaucgaaucgcagaaaaacggguccuggaaauuagagaaagcuagccugaucgaggugaagaccugcaccuggccaaagucccacacccucuggagcaacggugugcuggagagcgacaugauuauuccuaaaucccuugcgggucccauaucccagcacaacuaucggccgggauaccacacccaaaccgccgggcccuggcaccucggcaagcuggaacuggacuucaacuauugcgagggcacgacugugguaauuaccgaaaacugcgguaccagggggcccagccuccggacgaccaccgugaguggcaaguuaauccacgaauggugcugccgcagcuguacccugccuccauuacgauacaugggcgaagacgggugcugguacggcauggaaauccgcccuaucuccgagaaggaggagaauauggugaagucccugguguccgcggguaguggcaaggucgacaacuucacaaugggcguccucugccucgccauccuguuugaggaggugaugcgggggaaguucggcaagaagcacaugauagccggugucuucuucaccuucgugcugcuccuguccggacagauaacuuggcgcgacauggcccacacccugauuaugauugggaguaaugcguccgaccggauggggaugggagucacauaccucgcgcugaucgccaccuucaagauccaaccauuccuggcccugggguucuuucugcgcaagcugacuucacgggaaaaccuccuucuaggcgucggccuggccauggccaccacgcuacaacugcccgaggacaucgagcagauggcuaaugggaucgcucuugggcuuauggcccugaagcuuauaacccaguuugagaccuaccagcuguggaccgcccugaucucgcugacguguaguaacaccauuuucacccugacaguggcauggcgcacggccacuuugaucuuggccggggucucccugcugccugugugucagucaucgucuaugcgcaaguccgacuggcuccccaugaccguggccgcgaugggcguacccccccugccgcuguucaucuucucccucaaggauacccugaaacgccgcucguggccgcuuaacgaggggguaauggccgugggccucgucagcauucuggccagcucacugcuacggaacgacgugccaauggccggcccccuuguagccgguggccugcucaucgcaugcuacguuauuacugggaccagcgcggaccuaacaguggagaaggccgcugacgugaccugggaggaggaggccgagcaaacgggcguuucccacaaccugaugaucaccguggaugacgacgggaccaugcggaucaaagacgacgaaaccgagaacauccucaccguucugcugaagacggcgcuucugaucgucucuggcaucuucccguacuccauccccgcgacccugcucguuuggcacaccuggcagaagcagacuagacgcagcggcgugcugugggaugugcccucgccucccgagacgcaaaaggccgagcuggaggagggaguguaccggaucaagcaacaagggaucuucggaaaaacucaggugggcgugggggugcagaaggaggguguuuuccauaccauguggcacgucacccggggugccgugcucacguacaacgggaagcgccuugaaccaaacugggcgucuguaaagaaggaccugaucucuuacgguggagguuggcgacucagugcucaauggcagaagggggaggagguccaggugaucgcgguugagccaggcaagaaucccaaaaacuuccagaccaugcccggaaccuuucaaaccacgaccggggagauuggcgcaaucgcccuagacuucaagcccgggaccagcggcucccccaucaucaaccgggagggcaagguaguggggcuguacgguaacggugucguaacuaagaauggcggauacguguccggcaucgcccagacgaacgcggagccggacgggccaacgcccgaguuggaggaggagauguucaaaaagcgcaaccucaccaucauggaccugcacccagggagugguaagacccggaaguaccugccggccauuguuagagaggccaucaagcgucgucugcggacgcuaauucuggcccccacccgcgucgucgccgcggagauggaggaggcacucaaaggccugcccauacguuaccagaccaccgccacaaagucugagcauaccgggcgggagauuguggaccugaugugucacgcaaccuuuaccaugcggcuccugucccccguacgcgugccgaacuacaaccugaucaucauggacgaggcacauuuuacugaccccgcgagcauugccgcccggggguacaucaguacgcgcgugggcaugggcgaggccgccgccaucuuuaugaccgccaccccgcccgggacggccgaugcauucccgcaaagcaacgcucccauucaggacgaggagcgcgacauccccgagcggucuuggaacagcggcaacgaguggaucacagacuucgcugggaagaccgucugguucgugcccuccaucaaggccggaaacgacaucgccaacugucugcgcaagaacgggaagaagguuauccagcugagccggaagaccuucgacaccgaguaccaaaagacuaagcugaacgacugggauuuugucgucaccaccgacaucuccgagaugggcgccaacuuuaaggcggaccgcgugauagacccgcggcgcugccucaaacccgucauccugacggauggcccugaacgagucauccuggcagggcccaugccugugacggcugccagcgcggcucagaggcggggccgcguggggcggaacccgcagaaggagaacgaucaguacaucuucaccggccaaccccucaacaacgacgaggaccaugcccauuggaccgaggcuaagaugcugcuggacaacauaaauacccccgaggguaucaucccggccuuauucgagccggagcgugaaaaguccgcggcaaucgacggcgaguacagacugaaaggugagagccggaagacguucguggagcuuaugcggcggggggaccuccccguuuggcuggcccacaagguggccagugaggguaucaaguacacagaccggaaguggugcuuugacgggcagcgcaacaaccagauccuggaggagaacauggacguggagaucuggaccaaggagggcgaaaaaaagaagcuccggccccgauggcuggacgcacgaaccuauagcgacccccuggcguugaaagaguuuaaagacuucgccgccgggcggaagucaauagcccuggaccugguuacggagaucggcagagugcccucccacuuagcccaucggacucggaacgcgcuagacaacuuggugaugcuacacaccagcgagcacggcgggaaggccuaccggcacgccgucgaggagcugcccgagacuauggagacucuucugcugcucggccuuaugaucuugcugaccggcggcgccaugcuguuucugaucuccggcaagggcaucggcaagaccagcauaggacugaucugcguaauugccagcagcggcaugcucuggauggcggagaucccgcugcaguggaucgcauccgccaucguguuggaguucuucaugaugguacuucugauccccgaacccgagaagcaaagaacgccacaggacaaccagcuggccuacguagucauagggauccuaacccuggccgcgaucauagccgccaacgagaugggccugcucgaaaccacgaagcgggaccuagggaugagcaaagagccgggggucgucucccccaccagcuaucuggacguggacuuacaccccgcuuccgcguggacucuguacgccgucgccacaaccgugaucacccccaugcugcgucauacuauagagaauaguacagcgaacguaucgcucgcagcgauagccaaccaggcggucgugcuaaugggccucgacaaaggguggccgaucagcaaaauggaucucggcgugccguugcuggcguuggggugcuacucccagguaaauccgcugacccugacagccgccgugcuucuauugauaacgcacuacgccaucaucggccccggccuccaggccaaagcgacccgcgaggcccagaaacgcacagcggccgggauaaugaagaacccgaccguggauggcauuaugacgaucgaucuggaccccgucaucuacgacucuaaguucgagaagcagcugggccaagugaugcuccugguucugugugccguacaauuacuacucaugcggacuuccugggcgcugugugaggcgcugacgcuggccacaggccccauuacgacucucugggagggcagcccagggaaguucuggaacaccacaaucgccgugagcauggccaacauuuuccgcggaagcuaccuggcgggugccgggcuggcauucucuauuaugaagucaguggggacugguaagcggggcaccgguucccagggcgagacacucggggagaaguggaagaagaagcuaaaccaacugagucggaaggaguuugaccucuacaagaagucagguauaacggaggucgaccggacagaggccaaagaggggcugaagcgcggagaaaucacccaccacgccgugucccgggguucagccaaguuacaaugguucguggagcgcaacaugguaaucccagaggggagagucauugaccucgguugcggccgcggcggguggucguacuacugugcuggccucaagaaggugacggagguccggggguauaccaaaggagggcccgggcaugaagagccgguacccaugagcacguacggguggaauaucgugaaacugauguccgggaaggaugucuucuaccuaccgccugaaaagugcgacacguuacugugugacaucggcgagagcucuccuucacccaccguggaggagagccgcaccauacgcgugcugaagauggucgagccuuggcucaagaacaaccaguucugcaucaaggugcuuaaccccuauaugccgaccguaaucgagcaccuggagcggcuccagaggaagcauggcgguaugcuuguccguaacccucugagccgaaauucgacgcacgaaauguacuggaucucaaacgggaccggaaacaucguggccagugugaacaugguuagcagacugcuguugaaccgcuuuaccaugacccaucggcgcccgacgauagagaaggacguagaccuuggcgcuggcacccgacacgugaaugccgaacccgagacccccaauauggacgucaucggggagcgcauuaagcgaauuaaggaggagcacaacucaacauggcacuacgacgaugagaacccguacaagaccugggcguaccacgguagcuacgaagugaaggcgaccgggagcgccucaaguaugauaaauggagucgucaagcuccugaccaaaccgugggacgucguacccauggugacucagauggccaugacggacacaaccccuuucggucagcagaggguuuucaaggaaaagguggauacccggacgccacgcuccaugcccggaacccggcgcgucauggggaucacagcggaauggcuguggagaacccuggggcgcaauaagaagccccggcuuuguacgcgcgaagaguucacaaagaaggugaggaccaaugcagccaugggcgccguguucaccgaggagaaccagugggacagcgccaaggccgcgguggaagacgaggacuucuggaagcucguggaccgggagcgcgagcugcacaaacugggcaagugcggcuccugcgucuacaauaugauggggaagcgggagaagaaacucggagaguucggcaaggcaaaggggagccgcgccaucugguacauguggcugggcgcucgguaucuggaauucgaggcccucggauuucugaacgaagaccacugguuuucccgcgaaaacagcuacucaggaguagagggagagggccugcacaagcuuggguacauucugcgggacaucucuaagauccccggaggggccauguacgcugacgacacggccggcugggacacgcgcaucaccgaggaugaccugcacaacgaggaaaagaucacucagcagauggacccggagcaucggcagcucgcagacgccaucuucaagcugacguaccaaaacaaaguaguuaaagugcagaggccuaccccuaccgguacuguaauggacaucauaagccguaaggaccagcgcgggagcgggcaggugggcaccuacggccugaacacguuuaccaacauggaggcgcagcucauccggcagauggagggcgaggggguacuuaccaaggccgaucucgagaacccccaccucucggaaaagaagaucacucaguggcuggagacuaagggcguggagcgucugaagcggauggccauuagcggcgacgacugcguugugaagcccaucgacgaccgcuucgcaaaugcccuccuggcgcugaacgacauggguaaagugcggaaggacaucccccaauggcagcccuccaagggcuggcacgacuggcagcaaguuccuuucugcagccaccauuuucaugagcucaucaugaaagaugggcgcaagcugguggucccgugccggccucaggaugagcucaucggccgcgcgaggaucucacagggggccggcuggagccuucgagaaaccgcuugccuuggcaaggccuacgcgcaaauguggagcuugauguacuuccaccgucgagacuugcgccuggccagcaaugccaucugcuccgccgucccagugcacugggugcccacaucgcgaaccacguggagcauccacgcgcaccaucaguggaugacgaccgaggacaugcugaccgucuggaaccgcgucuggaucgaggacaacccguggauggaggacaagacaccaguuacaaccugggagaauguccccuaccucggcaaacgggaggaccaguggugcggaucccugaucggguuaaccucacgcgccacgugggcccagaacaucccaaccgccauucagcagguccggucccucaucgggaacgaggaguuccuugacuacaugccgagcaugaaacgcuuccgcaaggaggaggagagugagggggcaaucugguga

SEQ ID NO: 25976 - RNA, 9873 nt, Artificial Sequence
  derived and/or modified CDS sequence (opt11) from DENV-3__FJ182011__SS-prME
accucucugugccuaaugaugauccuacccgcugcgcucgcguuccaucucacuucccgggacggggaacccaggaugaucgucggcaaaaaugaacgcgggaagucgcuauuauucaagaccgcaucagguaucaauaugugcacgcuaaucgccauggacuuaggagaaaugugcgacgacacugugacguacaagugcccccauaucgcagaaguggaaccagaagacaucgacugcuggugcaaccuaacaaguacguggguaaccuacggcacaugcaaucaagcaggagaacacagacgagauaaaagaagcgucgcccuggccccacacgugggaaugggacuggauacaaggacgcaaaccuggaugagugcagaaggcgcauggaggcaagucgaaaaaguggaaacaugggcuuugcgacauccgggauucacuauacucgcccuauucuuagcucacuacaucggcacaucacuuacucaaaaaguagugauauucauacugcucaugcucgucaccccuagcaugaccaugcggugcguaggcguagggaaccgggacuucguagaaggacucagcggcgccacuuggguugacguaguguuagaacauggagggugcguaaccacaauggccaaaaauaaacccaccuuggauauugaacuucagaaaaccgaagcaacacaauuggcgacacugagaaaacucugcaucgaagggaagaucaccaacauaacaaccgacagccgcugucccacccagggcgaggccgugcugccagaggaacaagaucaaaacuaugucugcaaacacacauacgucgaucgagggugggggaacggcugcggguuguucggaaaaggaucacucguuacuugcgccaaguuccagugccuggaaccgauagagggaaaagugguacaguaugaaaaucugaaauacaccguaaucauaacugugcacaccggagaccaacaccaggugggaaaugaaacccaaggagucaccgcggagauaacaccacaggcgucaacaaccgaggccauucugccggaguacgguacauuaggccucgagugcucuccgaggacuggauuagauuucaacgagaugauacucuuaacaaugaaaaacaaggcguggaugguucaccgacagugguucuucgaccuaccccucccauggacaucuggugcaacaaccgaaacgccaaccuggaaucguaaagaauuacucgugaccuucaaaaacgcacacgcgaaaaagcaagaagucgucguucuaggaagccaggagggagccaugcacacagcucugacgggagcaacagaaauccagaacagugguggaaccucaauauucgccggccaccugaaaugucgacugaagauggauaaacuagagcuuaaagguauguccuacgccaugugcacaaacacauuuguacuaaagaaagagguaagugagacacagcacggaacgauccuaaucaagguggaauacaagggggaggaugcuccaugcaaaauucccuuuagcacagaagacgggcagggcaaggcacacaacggucgccuaauaaccgcaaacccggucgugaccaagaaagaggagccugucaacaucgaggccgaacccccuuucggcgaaagcaacauaguaauuggcauaggcgacaacgcucuaaagauaaacugguacaagaaaggcagcagcauagggaaaauguucgaagcgacagcgcgaggagcgcgacguauggccauacuaggcgacaccgcgugggacuucggauccguaggcggugugcuuaacucacuugggaaaaugguccaccaaaucuuuggaucugcguacacagcccucuucuccggaguuaguugggugaugaaaaucggaaucggaguccuacuaaccuggaucggucuaaacagcaaaaacacuagcauguccuucuccugcaucgccauaggaauaauaacacuauaccucggcgcggucguacaagcagauacagggugcguaauaaauuggaaaggaaaggagcucaaaugcggcuccggcauauucgucaccaacgaaguccauacuuggacagaacaguacaaauuucaggcagacagcccuaagcgguuagccacugcgaucgcgggugcgugggaaaacgggguaugugguaucagauccacgacccgcauggaaaacuugcuauggaaacagauagccaacgaacuaaauuacauacuaugggagaauaacaucaagcucacagugguaguaggugacauaauaggcguguuggagcaggggaaacgcacccugaccccgcaaccaauggaauugaaauauucauggaagacauggggcaaagcgaagauaguaaccgccgagacgcagaacucgucguucauaaucgaugguccaaauacccccgaaugcccaagcgccagccgcgccuggaacgucugggaaguggaagacuauggguucggcgucuuuaccacgaauauauggcugaaacuccgggagguguacacacaacugugcgaccauaggcuuaugucagcggcgguaaaagacgaaagagccguacacgcggacaugggcuacuggauagaaagccagaaaaacgggaguuggaagcucgagaaagcgucacucaucgaggugaagacaugcacauggccaaaaagccauacacuauggucaaacgggguccuugagagcgauaugaucaucccgaagaguuuagcgggcccuaucagccaacacaacuaccgcccaggcuaucacacgcagacagccggaccauggcaccuagggaaacuugagcucgauuucaacuacugcgaaggaacaaccguggucaucacggauaacuguggaacacgaggaccgucacuaaggacgacaacggucaguggcaaacugauccaugaauggugcugcagaagcugcacccucccaccccugagguacaugggcgaggacggcugcugguacggaauggaaauacgcccaauaagugaaaaagaggaaaauauggugaaaucgcuaguaagcgcaggcuccggaaaaguagauaacuuuacgaugggaguacucugccucgcgauucuguucgaagaaguaaugaggggcaaauuugggaaaaagcacaugauagcgggcguuuucuucacguucguccuuuuguugucaggacagauaaccuggcgagauauggcacacacucucaucaugauaggcagcaaugccagcgacagaauggguaugggugugaccuaccuagcccuaauagcgacuuucaaaauccaaccauuccuugcauuaggcuucuuucuaagaaaacucacaucgcgagaaaaucuccuccuuggagucggacuggcgauggcgacaacccuccagcucccggaagacauagaacagauggcuaacggcaucgcgcuagggcucauggcccuuaagcugauaacacaauucgaaaccuaucaacuauggaccgcgcugauaagccuaacaugcagcaauacaauauucacgcugacaguggcauggcgcacagcuacccuaauacuggccggagugucccuacuaccagucugccaaucaucaucaaugcgaaagucugauuggcuaccgaugaccguagccgccaugggggugccgccgcugccauuguucauauucucauuaaaagauacccucaagcgcagauccuggccgcuuaacgaaggcguuauggcaguaggguuggugucaauucucgcaagcucacuccuacggaacgacguaccaauggcggggccucucgucgccggcggauugcuaauagccugcuacguaauuacgggaacaagcgcagaccucacgguggaaaaagcagccgacguuacgugggaggaggaagccgagcaaacaggugugagccacaaccucaugauuacagucgacgacgacgguacaaugcgcaucaaggacgacgagaccgagaacauucucaccguccuucuaaagaccgcccuccucaucgugucggguaucuuucccuacagcauaccggccacgcuucuaguguggcacacauggcagaaacaaacccggagaucgggaguacugugggacguccccagcccacccgagacacagaaggccgagcuagaagaagguguauacaggauuaagcagcagggaauauuuggcaagacacaagucggaguagggguucagaaagaaggcgucuuccacacaauguggcacguaacgcggggugcgguauugacauacaauggcaaacgacucgaaccuaacugggcaucggugaagaaggaccuuaucaguuacggcgggggcuggcgauuaucagcccaauggcagaaaggcgaggaaguccaaguaaucgcgguggagccggguaagaaccccaaaaacuuccaaaccaugcccggcacauuucaaacaaccacgggcgagauaggcgcgauugcccuugauuucaaaccgggaaccucggggucgcccaucauaaaccgugagggaaaaguggugggauuauacggcaacggugugguaacgaaaaauggaggguacgugagugguaucgcacagacaaacgcagagccggacgggccuacucccgaacuagaggaagagauguuuaaaaagcgaaaucugaccauaauggaccuacacccggggucuggaaagacuagaaaauaucucccagcgaucguccgagaagcuauaaaaagacgccuccgaacccuaauccucgcccccacccgcguaguagccgccgaaauggaagaggcccugaaggggcucccgauucgcuaccagacuacggcaacuaaaucggagcacacaggacgagagaucgucgaccuaaugugucacgcaaccuucaccaugcgacugcuauccccugucaggguaccgaacuacaacuugauaauaauggaugaggcccauuucacagauccugcgagcauagccgcaaggggauacauaagcacccgaguggggaugggagaagcagcugcgauuuucaugacagcaacacccccaggaacagcggacgcauuuccgcaaucuaacgcacccauccaggacgaagagagggauaucccagaacguucauggaacagcggcaacgaauggauaaccgacuuugcaggcaaaacagugugguucgucccaagcauuaaagccggcaaugacaucgccaacuguuuacgcaaaaacggcaaaaagguaauacagcucuccagaaaaaccuucgauaccgaguaccagaaaaccaaacugaacgacugggacuucgucguaacgacugacauuagcgagaugggggcgaauuuuaaggcagacagaguaaucgauccgcgccgaugccucaaacccgucauccuaacagauggcccugagcgaguaauacuggcaggacccaugccggugacugcagcauccgcagcccaaagacggggccgagucggccguaauccgcaaaaggagaacgaccaauacauauucacaggccaaccccugaacaacgacgaggaccacgcgcacuggacugaagcuaaaaugcuccuagacaauauaaacacaccagagggcauaauaccagcauuauuugagccugaaagagagaaaagcgcggcaauagacggagaauaucgccugaagggagaaaguaggaagaccuucguggaacucaugagacgaggggaucuaccggucuggcucgcccacaaagucgcuagcgagggcaucaaauauacugaccggaaguggugcuucgacggacaaagaaacaaccaaauccuagaagaaaacauggaugucgaaauauggacgaaagaaggcgagaaaaagaaauuacgcccgcguugguuagacgcaaggaccuacucagacccccucgcauuaaaagaguuuaaagacuuugcagcgggaagaaagagcauagcacuggaucucguaacagaaauagggcgaguucccagucaucuagcccaccgaacacgcaacgcucuagacaaucuagucaugcugcauacgagcgagcacggagguaaggcguaccgucacgccgucgaagaacuaccagaaaccauggaaacucugcugcugcucgggcucaugauucugcuaacagggggugccaugcuauuccuaaucagugggaaagggauaggaaaaacgagcauaggacugauaugcgucauugcaucaucggggaugcuauggauggcggaaauaccccugcaauggauagccuccgcgauuguccucgaguucuucaugauggucuuacuaauaccagaacccgagaagcaaaggaccccacaagacaaccagcucgcauacgugguaauaggcaucuuaacguuagcagcuauaauugccgcgaacgaaauggguuuacuagagaccacgaaacgcgaccuugguaugaguaaggaacccggcguaguaaguccuacgucguaccuagacguagaccuacauccugcuagugccuggacacuguaugcaguugcgacgacggugaucaccccgaugcuacgccacaccauagaaaacucuaccgcaaacguuagccuugccgcaauagcaaaucaggcggucguacucaugggacuagacaaaggcuggccaaucaguaaaauggaucuuggcgucccguuacucgcucuaggcugcuacagccaagugaacccccucacuuugacggcagccgugcuacuacucauaacccacuacgccauaauaggaccuggucuacaggcgaaagcaacacgggaagcccaaaagcggaccgcugccggcaucaugaagaauccuacaguugacgguaucaugacgaucgaccuagacccgguaaucuacgacaguaaguuugaaaagcaacuaggacagguaauguuauuggucuuaugcgccguacaacuccuacucaugcgaaccagcugggcgcugugcgaagcgcuuacauuagcgacugguccaauaaccacuuuaugggaaggcagcccaggaaaguucuggaacacgacgaucgcagucucaauggccaacauauuccgcgggagcuaucuagccggagccggccuggccuuuucaauuaugaaaucaguagggaccgggaaaagagggacugggucgcaaggggagacucugggagagaaauggaagaagaaauuaaaccaauugucgagaaaagaguuugaccuauacaagaaaagcggcauaacagaagucgaccgcaccgaggccaaagaaggcuugaaacguggcgaaaucacccaucacgcgguuagccguggcagugcaaaacuccaaugguucguagagaggaacauggucaucccugaagggcgaguaaucgaccucgggugcggacgggguggguggagcuauuacugcgcaggccuaaagaaagucacggaaguaaggggguauacaaaaggcgggcccggacacgaagaaccaguaccuaugucaaccuacggcuggaauaucgucaaacuaauguccggcaaagacguguucuaucugccucccgagaagugcgauacgcugcucugugacauaggcgaauccucgccgucgcccacggucgaagagucccgaacgauuagaguccugaagaugguugaacccuggcugaaaaacaaccaauuuuguauaaagguacucaacccauauaugccuaccgucauagaacaccuggagaggcuccaacgcaaacacgguggcaugcucguacguaacccguuaagcagaaacuccacccacgaaauguauuggaucucuaacggaacaggaaauauaguugcgagcgugaauauggucucgagguuacuucugaauagguuuacuaugacgcaccgccgcccaaccaucgaaaaggauguggaccucggagcggguacacgccacguuaacgccgagccagaaacaccaaauauggacgugauaggggagagaauuaaaagaauaaaagaagaacacaauucaacuuggcauuaugacgaugaaaaccccuauaaaaccugggccuaccaugguucguaugaaguaaaggccaccggcagcgccucguccaugaucaacggaguggucaaguugcuuaccaaaccaugggaugugguaccgaugguaacccagauggcaaugacagauaccacaccguuuggucagcaacgcgucuucaaagaaaagguagacacccgaaccccgagaucgaugccaggcacccgacgaguuaugggaaucacggcggaaugguuauggcgcacgcugggccgcaacaagaaaccgcgacucuguacacgugaagaguucaccaaaaagguccgaaccaacgccgcgaugggagcgguauuuaccgaggagaaccaaugggacuccgcaaaggcagccgucgaagacgaagacuucuggaagcucgucgaccgcgaaagagagcugcacaaacucggaaagugcggcucuugcguuuacaacaugaugggcaaaagggagaagaaacuaggcgaguucggaaaagcgaaaggaagcagagccauaugguacauguggcuaggcgcgagguaccucgaguucgaagcacuaggauuccugaacgaggaccauugguuuagcagggagaacagcuauagcgguguagaaggagaaggccuacauaaacuuggcuacauacuacgagacaucagcaagauacccgggggagccauguacgcagacgacaccgcuggaugggacaccaggaucacagaagacgaucugcacaacgaagagaaaauaacucaccagauggauccggaacacaggcaauuggcaaacgccaucuuuaaacuaacauaucagaacaagguaguaaagguacaacggcccacgccaacaggcacggugauggacaucaucuccagaaaggaucagcgcgggucaggccaaguaggcaccuauggacugaauacguuuaccaacauggaggcacagcucauccgccaaauggagggugaagguguacuaucgaaagcugaccucgaaaauccccaccuaucggagaaaaagaucacacaguggcucgaaacgaaaggggucgaaagauugaaaagaauggccaucagcggugacgacugcgugguaaagccaauagacgacagguuugcgaaugcguuacuggcccucaacgauaugggaaaaguacgaaaggacauaccacaauggcaaccaucgaagggauggcacgacuggcaacagguaccauuuuguagucaccacuuccacgaacugauaaugaaggacggccggaagcuaguaguaccgugcagaccccaggaugaauuaauaggccgagcgcgaauaagucagggagcggguuggucacuacgagaaaccgcgugccucggcaaagcauaugcgcaaauguggagccugauguacuuccacaggagagacuugcgucuagcaagcaacgcaauauguucagccgugccaguacauuggguccccacgagccgaacgaccuggucuauacacgcacaucaucaauggaugaccacugaagacaugcuaacaguguggaaccgcguauggaucgaggacaaccccuggauggaagauaagacccccgugacgaccugggaaaaugucccauacuugggcaaacgugaggaccaauggugcgggaguuugaucgggcuaacaucccgcgcaacgugggcacagaacaucccuacagcuauccagcaaguacgcagccuuaucggaaaugaagaguuccuagacuacaugcccagcaugaagcgguuccgaaaggaggaggagucggaaggggcaauaugguaa

SEQ ID NO: 25977 - RNA, 9873 nt, Artificial Sequence
  derived and/or modified CDS sequence (opt11) from DENV-3__FJ182038__SS-prME
acgagcuugugccucaugaugauccuacccgcagcucuggcuuuccaccucaccagccgggauggcgaaccccggaugaucgugggcaagaacgaaagaggcaagucgcugcuguucaagaccgcguccgggaucaacaugugcaccuuaaucgccauggaccugggagagaugugcgacgacaccguaaccuacaaguguccccacaucacugagguggagcccgaggacauugacugcuggugcaaccugacgagcaccugggucaccuacgggacauguaaccaggcaggcgagcacaggcgcgacaagcggucugucgcccucgcaccccacguaggcauggggcuggauacccgcacacagaccuggaugagcgccgagggcgccuggcgccagguggagaagguagagacgugggcccugcgccacccgggauucacaauucucgcccuguuccuggcacacuacaucggcaccucccucacccagaaggucgugaucuucauccugcugaugcuggucacgcccagcaugaccaugagaugcgugggggugggcaaucgcgacuuuguggagggccuuucgggcgcgacguggguugacgucguccuggaacacggcgggugcgucacuacgauggccaagaacaagcccacgcuagacauagagcuccagaaaacggaggcaacccagcuggcaacgcuccggaagcugugcauugagggcaagauaacuaacaucaccacggauagcaggugccccacacaaggagaggccguucuaccggaggaacaggaccaaaacuacgucugcaaacacaccuacgucgaccgggguuggggcaacgggugcggccucuucgggaaaggcucccuagugaccugcgccaaguuccagugccuggaacccauagaggguaaaguaguccaguacgagaaccucaaauacaccgugaucaucacgguucauacgggggaccagcaccaagucgguaacgagacccaagguguaacugcagagaucacgccgcaagcuagcaccacugaggcuauucugcccgaguacggcaccuuggggcucgaaugcagccccaggacgggacuggacuucaacgaaaugauccugcucacgaugaagaacaaagcguggauggugcaccggcagugguucuucgacuuaccacugcccuggaccucgggcgccacgaccgaaacgcccaccuggaaccgcaaggagcuccucgugaccuuuaagaacgcccacgccaagaagcaggaagucgugguguuagggucgcaagaaggugcgaugcacaccgcccucacgggcgccaccgaaauccagaacucuggcggcaccuccaucuucgccggccauuuaaagugccgccugaaaauggacaaacucgaguugaaaggcaugucuuaugccaugugcaccaacacuuucgucuugaagaaggagguguccgagacccaacacgggacaauccucaucaagguggaguauaagggagaggacgcccccugcaagauucccuucagcaccgaggacgggcaggguaaggcucacaacggccgccugaucacagccaaccccguggugaccaagaaggaagaacccgucaauaucgaggccgaaccgcccuucggcgagagcaacauugucaucggcauaggggacaacgcucucaagauuaacugguacaagaagggcuccagcaucgguaaaauguucgaggcuaccgcccgcggcgcccgccggauggccauccugggcgacacggcgugggacuucggcaguguggguggugugcucaauucccuugggaagaugguucaccaaauauucggguccgccuacacgacucuauucaguggaguguccugggugaugaagaucggcauaggcguccuacuuaccuggaucggacuuaauucuaagaacacuuccaugucauucuccuguauugccauaggagucaucacgcucuaccuaggagcggugguccaggccgacauggggugcguaaucaacuggaaaggcaaggaguuaaaaugcggaagcgggaucuucgugaccaaugagguccauaccuggacugaacaguauaaauuccaggcggacagucccaagcgccucgccacggccaucgcgggugccugggagaacggggugugugggauccggagcaccacccgaauggagaaccuucuguggaagcagaucgccaacgagcucaacuacauccuaugggagaacaacaucaaacugacuguggugguaggagacaucauuggaguccucgagcagggcaagcgcacgcuuacgccccagccuauggagcugaaguacuccuggaagaccuggggcaaggccaagauagugacugccgagacgcagaacucuaguuucaucaucgacggcccaaauacccccgagugcccgagcgccucacgggcguggaaugugugggagguggaggacuacggcuuuggggucuucaccaccaacauuuggcucaagcugcgcgagguguacacccagcugugcgaccaccggcucaugucggccgccgugaaagacgagcgcgccguccaugccgacaugggcuacuggaucgagagccagaaaaacggguccuggaagcuggagaaggcgagcuugaucgaagugaagaccugcaccuggcccaagucccacaccuuguggucuaacggggugcuggagucggauaugaucauuccaaagagccuugcugggcccaucucccagcacaacuaccggccggguuaccacacgcaaacggccgggccuuggcaccucggcaaguuggaacuggauuuuaauuacugcgaaggcaccaccguagugauaaccgagaacugcggaacgcgcggaccaagccuccggaccaccaccguguccgggaagcugauccacgaguggugcugccgcagcugcacgcugcccccucuccgguacaugggcgaggacgggugcugguacgggauggagauucgccccauaagugagaaagaggagaauaugguuaagagucugguuuccgcaggcagcggcaagguggacaacuucacaaugggcguccugugccucgccauccuguucgaggagguaaugcgggguaaguucgggaagaagcauaugaucgcggggguguucuucacuuucguccuacuccugaguggucagauaaccuggcgggacauggcgcacacgcugaucaugaucggcuccaacgcauccgacaagauggggaugggcgugaccuacuuagcacugaucgcaaccuucaagauccagccguuccuggcgcucggguuuuuccugcggaaacuuaccagccgcgagaaccuccugcugggcguuggccucgcaauggccacaacccuucagcugccggaggacauagagcagauggccaacgggaucgcgcucggccugauggcccugaagcucaucacucaguucgagacguaccagcuguggacggcccugaucagcuugaccuguucuaacaccauguucacccugacggucgccuggagaaccgccacccuuauccucgccggggugagccugcugccggucugccagucaagcagcaugcgcaagaccgacuggcucccuauggccguggcagccaugggcguuccgccgcucccucuguucaucuuuagccucaaggacacgcugaagcggcguuccuggccgcugaacgaagggguuauggccgugggucucguguccauccuggcguccucgcugcucagaaaugacguccccauggccggaccucugguggcugguggccuucucauagccuguuacguaaucaccgggaccucugcugaccucacuguugaaaaggcggccgacauuacgugggaggaggaggccgagcaaaccggagugagccacaaucugaugaucaccguggacgaugacgggacuaugcggauuaaggaugacgagacggagaauauacuuacaguacuguugaagaccgcacuccuaaucguaucaggaguuuucccguacaguauaccggcgacacugcucgucuggcacaccuggcagaagcagacucaacgcuccggcguacugugggacgugcccagcccgcccgagacgcagaaagcugagcuggaggagggggucuaccguaucaagcagcagggcaucuucgggaagacccaaguaggcgucgggguucagaaggaaggcgucuuucacacaauguggcacgugacgcgcggcgccguccuaaccuacaacgggaaaaggcuugagccaaacugggccagugucaagaaggaccugaucagcuauggcgggggcuggcgccucucagcucaauggcagaagggggaagaggugcaggucaucgccguagagcccgggaaaaauccgaagaacuuccagacgaugccaggcaccuuccaaacgaccacgggugaaaucggcgccaucgcccuggacuucaaacccgguacgagcggcagccccaucaucaaccgggaaggcaagguggucgggcuauacggaaacgguguuguuacuaagaacggaggauacgucucuggcaucgcacaaacgaacgccgagccugacgggcccaccccggaguuagaggaggagauguucaaaaagcgcaaccuuacgaucauggaccugcaccccgggagcggcaagacgagaaaguaccuaccggcuaucguucgcgaagccaucaaacggaggcuccggacucugauacuggccccaacccgcgugguggccgcagaaauggaagaagcgcucaagggcuuacccaucagauaucagacaacggccaccaaaucggagcauaccggacgcgagaucguggaucucaugugccaugccaccuucaccaugcggcuccugagccccguacgggucccgaacuacaaccugaucauaauggacgaagcccauuucaccgacccggccuccauagcugcccguggguacaucagcacgagaguggggaugggcgaagccgccgcgaucuuuaugaccgcuacgccgcccgggaccgccgaugccuuuccgcagaguaaugcccccauccaagacgaggagcgggacauccccgaacgcucauggaacuccggcaaugaauggaucaccgauuuugcggggaagacggugugguucguccccucuaucaaggccggcaacgauaucgccaauugccuacgcaagaacgggaagaaggugauucaguuaucccggaagacguucgacacagaguaccagaaaacgaaguuaaacgacugggacuuuguggucaccacugacaucucggagaugggcgccaacuucaaggccgacagagugaucgacccucggaggugccucaagcccgugauccugaccgacggccccgagcgagucauacuggcggggccuaugccgguuaccgccgccuccgccgcccaacgcagaggccgggugggucggaacccccagaaggagaacgaccaguacauauucaugggccagccucucaauaacgacgaggaccacgcgcacuggacugaggcaaaaaugcugcuggacaacaucaacaccccugaaggcauuauuccagcccucuucgagcccgagcgcgagaaguccgccgcaaucgacggcgaguaccgguuaaagggcgagagccgcaagacguucgucgagcucaugagaaggggggaccugcccguguggcuggcccacaaaguagccucggagggcauaaaguacaccgaccgaaaauggugcuucgacgggcaaaggaauaaccagauccuggaggagaacauggacguggagauuuggaccaaggagggcgagaagaaaaagcuccggccccgcuggcuagacgcccgaacguacagugauccguuagcccucaaggaguucaaggauuucgccgccggccgcaagagcaucgccuuggaccuggugacggagaucgggcgcguccccucgcaccucgcucacagaacaagaaaugcacuggauaaccuaguaaugcuccauaccucagaacacgggggccgggcuuaccgccacgcagucgaagaacugcccgagaccauggagacgcugcuacugcugggucucaugaucuuacuuaccgggggcgcuaugcuguuccugaucaguggcaaggggaucggaaaaacaagcaucgggcugaucugcgugaucgcuagcuccggcauguuauggauggccgagaucccgcugcaguggaucgcgagcgccaucgugcucgaguucuucaugauggugcuucugauccccgaacccgagaagcagcggaccccacaggacaaucagcuugcuuacgugguaaucgggauccucacucuggccgcuaccaucgccgccaacgaaaugggacugcucgagaccaccaaacgcgaccugggcaugucgaaagagccggguguagucucucccacgucauacuuagacguugacuuacaccccgccagcgcauggacccuguacgcgguggcuaccaccgucauaacgcccaugcugcggcauaccaucgagaauaguaccgcaaacgugagccucgccgccauugccaaccaggcaguggucuugaugggccuggacaaaggguggccuauauccaagauggacuugggggugccccugcuugcgcucggaugcuacagccaagugaaucccuugacguugaccgccgccguccuuuuacugauuacccauuaugcuauuaucggcccgggcuuacaggccaaggcaaccagagaggcgcagaagcgcacagcagcgggaaucaugaagaaucccacgguagacggcaucaugaccaucgaucuggacccugugaucuacgacuccaaauucgagaagcagcugggacaggucaugcuucugguguuaugcgccguccagcuccuacucaugcgcaccucgugggcacucugugaggcgcuaacccuugcgacgggcccgaucaccacgcuuugggagggcagucccgggaaguucuggaacaccacgaucgcugucaguauggccaauauuuuccggggcuccuaucuagccggugccggccuggcguucagcauaaugaagagcguggggaccggcaaacgcgggacuggcagccaaggugagacccucggggagaaguggaagaagaagcugaaucagcugucuagaaaggaguuugaccucuacaaaaaauccggcaucaccgaggucgaccgcacggaggccaaggaagggcugaagcggggcgaaacgacccaccacgccguuagccgcggcacagcgaagcugcaaugguucguagagcggaacaugguuauccccgaggggcgcgucaucgaccucggcugcgggcgggggggcugguccuacuacugugccggccugaaaaaagugacggagguacgcggcuacacuaagggcggaccugggcacgaagagcccguccccaugagcaccuacggcuggaauaucgugaagcuuaugucagggaaggacgucuucuaccucccuccggagaagugcgacacccugcugugcgacauuggcgaauccuccccaagccccacagucgaagaauccagaaccauccgcguccugaagauggucgaaccguggcucaagaauaaccaauuuuguauaaagguccuuaaccccuacaugcccaccgugauagagcaccuggagcgccuccagcggaagcacgguggcaugcuggugcgcaacccgcugagccgaaacuccacccaugaaauguacuggauaagcaaugguacgggcaacaucgucgccagcgugaacauggugagucggcuccugcuuaacagguucaccaugacccaccgccggccgaccauagagaaggacguugaucucggcgccggcacucgccaugugaacgccgaacccgaaacccccaacauggacgugauuggagagagaaucaagcgcaucaaggaggagcauaacuccacguggcauuacgacgaugagaacccauacaagacaugggcguaccacggcagcuacgagguaaaggccaccggguccgcauccuccaugauuaacggcguagucaaauuacucacuaagcccugggacguggugccaaugguuacacagauggccaugaccgacacgacccccuuugggcaacagcggguguucaaggagaagguggacacccgcaccccgcggagcaugcccggaacgcgccgggucaugggcaucacagcagaauggcucuggcgcacccuggggcggaacaagaaaccccgccugugcacccgggaggaguucacaaagaaagugcgcaccaacgccgcgaugggcgccguguucacggaggaaaaccagugggacagcgccaaggcugccguagaagacgaggacuuuuggaagcucguugacagggagcgcgaguugcacaaacuggggaagugcggcuccugcguguacaacaugauggguaaacgcgaaaaaaaguugggugaauucggcaaggcgaaggggagccgagcuaucugguacaugugguuaggcgcucgcuacuuggaguucgaagcgcucggguuccuaaacgaagaccacugguucucccgggagaauagcuauucaggcguagagggggaaggccuacacaaacucggcuacauccuccgcgacauaagcaaaauacccgggggugccauguacgcggacgacaccgccgggugggauacgcggauaacagaggacgaccugcacaacgaggagaagauuacucaacagauggauccggaacaucggcagcucgcgaacgcuauauucaagcugacguaccaaaacaaaguggugaagguccagcggccgaccccgaccggaaccguuauggacauaauuucccgcaaggaccagaggggcucgggccaggucggcacuuacggcuugaauacuuucacgaauauggaggcccagcuuauccgccagauggagggcgaaggggucuuauccaaggcggaucuugagaacccccaucucccggaaaagaagaucacccaguggcuggagaccaagggcguggagcggcuacgccggauggcaaucucgggagacgacuguguggugaagcccauagaugaccgcuucgcuaaugcccuccuggcccugaacgacauggggaaggugcggaaggauaucccccaguggcagcccaguaagggcuggcaugacuggcagcaggucccguucugcagccaccacuuccacgaguuaaucaugaaggaugggcggaagcucgucgugcccugucggccccaggacgagcugaucggcagggcgcggaucucccagggggcaggauggagccuucgagagaccgccugucugggaaaggccuacgcgcagauguggucccugauguacuuucaccguagggaucuccgccucgcgagcaacgccaucugcuccgccgucccuguccacugggugccgacgucccgaacgaccugguccauccacgcacaccaccaguggaugacgacugaggacaugcuaaccguuuggaaccgcgucuggaucgaggacaaucccuggauggaggauaagacgccaguuacgaccugggagaacgugcccuaccucgggaagagggaggaccaguggugcggcagccugaucggacugacuucacgcgcgaccugggcgcaaaauauaccaacagccauucagcagguccggucgcuaauuggaaacgaggaguuccuugacuacaugcccagcaugaagcgauuucggaaggaggaagaaucugaaggagcaaucugguga

SEQ ID NO: 25978 - RNA, 9873 nt, Artificial Sequence
  derived and/or modified CDS sequence (opt11) from DENV-3__FJ182041__SS-prME
accagccugugccucaugaugauucugccagcggcucuagcguuucaccucacgagccgugacggggagccccguaugauuguggggaaaaaugagagggguaagagccugcuguucaaaacugcuuccgggauaaauaugugcacccucaucgccauggaccugggcgagaugugcgacgacaccgugaccuauaagugcccccauauugcugaaguugagcccgaggacaucgacugcugguguaaccuaacaagcacaugggugaccuaugguaccugcaaccaagcaggcgagcacaggagggacaagcggagcgucgcacuagcaccccaugucggcauggggcuggacacgcguacccaaacguggaugagcgcggagggcgccuggcgccagguugagaagguugagacuugggccuugcggcacccggguuucacgauccuagcccuuuuccucgcgcacuacauugggaccucccuuacccaaaaggugguaaucuuuauccugcugaugcuugucacgccgagcaugacgaugcggugcgucggcguaggcaaccgagacuuugucgaaggccugucaggggccaccuggguggacguggugcuggaacacggagggugugugaccaccauggccaaaaacaagcccacgcucgacaucgaauugcagaaaaccgaggccacucagcuggcaacacuccggaagcugugcaucgagggaaagaucacaaacauaacaacagacagucggugccccacacaaggggaggcuguacugccagaggagcaagaccagaauuaugugugcaagcauacguacguggacagggggugggggaauggcugcggacuguucgguaagggaagccugguaacaugugcaaaauuccaaugccuggagccuauugaagggaagguaguacaguaugagaaucucaaauacacggugauaaucaccguccacacuggagaucagcaccaaguaggcaaugagacucaaggggugacggcagagauaacaccccaggcgucgacgacagaggccauccugcccgaguacgggacgcuggggcuugaguguaguccccgaaccggccuugacuucaaugagaugauucugcuuaccaugaaaaacaaggcuuggauggugcacagacagugguucuucgaucugccccugcccuggaccucaggcgcaaccaccgaaacacccacauggaaccgcaaagagcucuuaguuaccuucaaaaacgcacacgccaagaaacaggaaguuguggugcuugggucccaggaaggugccaugcauaccgcucucaccggcgccacggaaauucaaaacucaggagggacguccaucuucgccggccaccugaaaugccggcucaaaauggacaaacuugaacuuaagggcaugucauacgcgaugugcaccaacacguucguccugaagaaggaaguguccgagacgcagcaugggaccauccucauaaagguagaauacaagggggaagacguuccguguaaaauucccuucagcacggaggaugggcagggcaaggcccacaauggucgguugaucaccgccaaucccguggucacgaagaaggaagaacccgucaacaucgaggcagagccacccuucggggagagcaauaucgugaucgguaucggggacaaugcgcuuaagauuaacugguacaagaagggcaguucaaucgguaagauguuugaggccaccgccagaggcgcaagacggauggccaucuuaggggacaccgcgugggacuucggcagcguaggcgggguccucaacagccuggggaagaugguccaccaaauuuucggguccgcauacaccgcccuauucaguggagugagcugggucaugaaaauuggaauagggguguuacugacguggaucggccugaauagcaagaacaccucuaugucguuuucuugcauagcuauaggaauaauuacgcucuacuugggagccgucguacaagcugacacagggugcgucauuaacuggaaggguaaggaacugaaaugcggcucggggaucuucgugacgaaugaaguucacacguggacugaacaauacaaguuucaggcagauucccccaaacgauuggcgacugccaucgccggcgcgugggagaaugguguaugcggcauacguucaacgacccggauggagaaccugcucuggaaacagaucgccaaugagcucaacuacauucucugggagaacaacauuaagcuaacaguggucgucggggauaucaucgguguacucgagcagggcaagcggacucugaccccgcagccuauggagcugaaauacagcuggaagacaugggggaaggcgaagauaguaaccgccgagacccagaacucgucuuuuaucaucgacgggcccaacacuccugagugccccagcgcgucccgugcguggaaugucugggaaguggaggacuauggguuuggcgucuucacuaccaauaucuggcucaaacugcgggagguguacacacagcugugcgaccaucgucucaugagugccgcggugaaggacgagcgcgccguccacgcggacaugggcuacuggaucgaaagccagaaaaauggaaguuggaaacuggagaaggccucccuaaucgaagugaagaccugcacuuggccaaaaucgcauacccuuuggucgaauggggugcucgaaagcgauaugaucauucccaagagcuuggccgggcccaucucgcagcacaacuaccgcccgggcuaccacacacaaacugccgggccguggcaucucggaaagcuggaauuggacuuuaacuauugcgagggcaccaccgucgugauaaccgagaacugugggacccgcgggccaagccugcggacaaccaccgugucgggaaagcugauccacgaguggugcugucgcucgugcaccuuaccgccgcuucgguacaugggcgaagacgggugcugguaugguauggagauucgcccuaucucugagaaggaggagaacauggucaagagccucguuuccgccgguagcgggaagguggacaacuucaccaugggcgugcuaugucucgcuauccuguucgaagaggugaugcgggggaaguucgguaagaaacacaugaucgccgggguguucuucaccuucguccugcucuuauccggccagaucacguggcgcgacauggcgcacacccugaucaugauuggcaguaaugcauccgaccggauggggaugggcgucacguaccucgcccugaucgccacguuuaaaauucagcccuuccuggcccucggauucuuuuuacggaaacugacaucucgcgaaaaccuucugcuuggagugggauuggccauggcaacaacgcuacaacugccagaggacauugagcaaauggcuaacggcaucgcccucggccuaauggcacugaaacuuauaacgcaguucgagaccuaccaguuauggaccgcacucauaagccucaccuguucaaauacuaucuucacccugaccgucgccuggcgcacggcgacuuugauccuugccgggguuagccuguugcccgucugccaguccaguuccaugagaaaguccgauuggcuacccaugacgguggccgcaaugggagugccgccucucccucuguucaucuucagccucaaagacacccuaaagcgccgcucuuggccccugaaugagggcguuauggcaguaggccucguaucuauccuggcgaguucccuccuacgcaacgacgucccuauggcuggcccccugguggccggcggacuacucauagccugcuacguaauaaccgggaccagugcggacuuaacugucgagaaagcggcagacgugaccugggaggaagaggccgaacagacgggagugucccacaacuuaaugaucaccgucgaugacgacgguaccaugcgaaucaaggacgacgagacugaaaacauccuaaccguccuucuaaagacugcgcuguuaauuguuagcggaauauucccguacuccauaccggcgacccuucucguauggcauaccuggcagaagcagacucagcggucgggugugcugugggacgugccuaguccgccugagacucagaaagcggagcuggaagaggggguauaucguaucaaacagcaagguauauucgggaaaacccaagugggcguaggcguacaaaaagagggcguguuccauacgauguggcacgugacgcggggcgccguccucacguacaaugggaagcgucuggagccuaacugggcuucuguuaagaaggaccuaauaucguacggcggaggauggcgacucucggcacaguggcagaagggggaagaaguccaggucauugcuguggaacccgguaagaaucccaagaauuuucaaacgaugcccggcacauuccagaccaccacgggggagauaggggcgauugcccucgacuuuaaacccgguaccagcgggucgccaauaaucaaucgagaaggcaaaguaguugggcuguacgggaacgggguggugacgaaaaacggcggauacguauccgggaucgcccagacaaaugccgagccggaugggcccaccccagaacuagaggaagagauguucaagaagcggaaccucacgaucauggaccuacaccccgggagugguaagacacguaaauaccugccugcgaucgugcgggaggccaucaaacgaagacucaggacucugauccucgcaccaacgcggguggucgccgccgagauggaggaggcgcugaaggggcugccuauucgcuaucagacuacugcuacgaaaagcgagcacacgggacgggaaaucguugaucuuaugugccacgcgaccuucaccaugcgucucuuaucgcccguacgggucccgaauuacaaucugauaaucauggaugaagcccacuuuacggacccagcuuccaucgcggcgcgcggguacaucuccacccggguuggcaugggggaggccgccgcgaucuucaugacugcuacgccgcccggaaccgcagaugccuucccgcagucgaacgcccccauccaggaugaggaacgcgauauacccgaaagaaguuggaauagcggcaacgaauggaucacagauuucgcaggcaaaacggugugguuuguccccucaauuaaagcuggcaaugacaucgcuaacugucugcgcaaaaacgggaagaagguaauacaguuaucaagaaagacauucgacacggaguaccagaaaacgaaacucaacgacugggacuucguggucaccaccgacaucuccgaaaugggcgccaacuucaaggcugaccgggugaucgauccaagacggugccucaagccugucauccugaccgacgguccggagcgcguuaucuuagcggggccaaugccgguaacggcggcaagcgcagcccaacgcagaggccgggugggccgcaauccccaaaaagagaacgaccaguacaucuucaccggccagccacucaacaacgaugaggaucacgcgcauuggacggaggccaaaaugcugcuugacaauaucaacacgcccgagggaauuaucccugcccucuucgagccugagcgggagaaaucugccgcuauagauggagaguaccgccugaagggagaaagccguaagacauuugucgaacuuaugcggcgcggcgauuugcccguguggcuggcccacaaggucgcauccgaggggaucaaguacacugauagaaaaugguguuucgacgggcagagaaauaaucagauacucgaagagaacauggaugucgagauauggacuaaggaaggcgagaagaagaagcucaggccccgguggcuugaugcacgcacauacucugacccguuggccuuaaaggaauuuaaggacuucgcagcaggcaggaaguccaucgcccuugaucuggugacagaaaucggucggguucccucacaccucgcccacaggacucggaacgcgcuggacaaccucgugaugcuucacaccagcgaacacggcgggaaagccuaucgccacgccguggaggaacugccugagaccauggagacgcugcuacuucugggcuuaaugauccuguugaccgguggagccaugcuguuccuaaucucuggcaaggggaucgggaagaccagcaucgggcugaucugugucauagcguccagcggcaugcucuggauggccgagauaccgcuacaguggauagccucagcaaucguacuggaguucuuuaugauggucuuacugauuccugaacccgagaaacagcgcacgccccaggacaaccaauuagccuaugucguuauaggaauccugacguuggccgcgaucauugccgcaaacgagaugggucuucucgaaacgaccaagagagaccugggcaugagcaaggaaccaggcgugguaucccccaccucuuaccuggacguggaccuccaccccgccuccgccuggacccucuacgcggucgccacgaccguuauaaccccgaugcugagacauaccaucgagaacucaacagcuaaugugagucucgccgccaucgcaaaucaggccgucguucugaugggccuugauaagggcuggccuaucucgaagauggacuugggaguuccccuacuggcccucgggugcuacagucaaguaaauccgcucacccugacugcagcggugcucuugcugauuacacacuaugccaucaucggccccggccugcaggccaaggccacccgggaggcucagaagcguacugcagcagguaucaugaaaaacccgaccgucgacggcauaaugacaauugaccuggaccccgugaucuaugacagcaaguucgaaaagcaacuggggcaagucaugcuacugguuuuaugcgccguccagcuccuccuaaugcgaaccuccugggcuuuaugcgaggcccucacucuggccacuggucccaucacuacccuuugggaaggcaguccagggaaguuuuggaacaccacuaucgcugucucaauggcuaacaucuuccggggcagcuaucuggccggggcgggccucgcuuucucuaucaugaaguccgugggaaccggcaaacgugguaccgguacccagggcgagacccucggcgagaaguggaaaaagaagcucaaccagcuuagccggaaagaguucgaucuguacaagaaguccggaauaacagaagucgaccgaacggaggccaaggagggccugaagcgcggagaaauaacccaucaugcaguaucucgcggcucugccaaguuacaaugguuuguggagcgaaacauggucaucccugaaggccgcgugaucgaccucgguugcgggagaggaggguggucuuacuacugugccggccuuaagaaggucacagagguucgcggcuacaccaaaggagggccagggcacgaggagccugugcccaugagcacauauggcuggaauaucguuaaacuuaugagcgggaaagacguauucuauuuaccacccgaaaagugcgacacccuacuaugcgacauuggggaguccucgccguccccuacgguagaggaaagcagaacuauccgugugcugaaaaugguugaacccuggcucaaaaacaaccaauucugcauuaagguccuaaacccauacaugccaacagugaucgagcaccucgagcguuuacagcggaaacacggcgggaugcugguacgcaacccccugucacgcaauaguacccacgaaauguauuggaucuccaauggcaccgguaauauugucgcuucggugaacauggugucaaggcugcugcugaacagguucacuaugacgcaccgccguccaacaauugaaaaggacgucgaccugggagcuggaaccaggcauguaaaugccgaacccgagacccccaacauggacguuaucggcgagcggaucaaacgcauaaaggaggaacacaacucuacuuggcacuaugacgacgagaacccguacaaaacgugggcguaucauggcuccuacgaggucaaggccaccgggagcgcuucgagcaugaucaauggcguggugaaauuacugaccaaacccugggaugucguccccauggucacgcaaauggcgaugacagacaccacaccuuucggccaacaacgcguguucaaggaaaagguugacacuaggaccccgcggagcaugccuggcacccgccgggucaugggaaucacugccgaauggcuuuggaggacacuggggcggaacaaaaagccacgccuaugcacccgggaggaguucacgaagaaggugcguacuaacgcagccaugggcgcgguauuuacagaagagaaccagugggacucggcaaaggcggccguagaggacgaggacuucuggaaguuaguagaccgcgaacgagagcugcauaaguuagggaagugcggcaguuguguguauaacaugauggggaagcgcgagaagaaacucggcgaguucgggaaggcuaaggggucccgggcaaucugguacaugugguugggugcacgcuaccuggaauuugaggcccucgguuuccucaacgaggaccauugguucagccgggagaacucguacaguggaguggagggggagggccugcauaaauuggguuauauccuucgcgacaucucaaaaauccccggcggcgccauguaugcggacgacacggccggcugggauacccggaucaccgaggaugaccuccauaacgaggagaaaauuacgcagcagauggacccggagcacagacaguuagcuaaugcaaucuucaaacuaacguaccaaaacaagguggucaagguccagaggcccacucccacuggcacggugauggacaucauuucgagaaaggaccaacggggguccggccaggucgggacguauggguugaacacguucaccaacauggaggcccaauuaaucagacagauggagggagagggugucuugagcaaggcggaccuagagaauccccaccuuagcgagaagaaaaucacacagugguuggagacgaaaggcguggaaagguuaaagcgcauggccaucagcggugacgauugcguggucaaaccuauagacgaccgauucgccaacgcccuccuggcauugaacgacauggggaaggugcggaaggauaucccccaguggcagccuuccaagggcuggcacgacuggcaacagguccccuucugcagucaccauuuccacgaauuaauuaugaaggacgggcggaaacucguugugccuugcaggccccaagaugaauuaaucggccgggcccgcaucagccagggggcuggguggagccuccgugagacagccugcuuaggcaaagccuacgcgcagauguggucccugauguacuuucaccgcagggaccugcgguuagccucgaacgccaucugcuccgccgugcccguucacugggugccuaccagccggaccacguggucuauccaugcgcaucaccaguggaugacgacagaggauaugcugacgguguggaacagagucuggauugaggauaauccauggauggaggacaaaaccccagucacuacuugggagaacguucccuaccucgggaagcgcgaggaccaauggugcgguucucuaaucggacucacuagccgugcgacgugggcgcaaaauaucccaaccgccauacaacagguccggucucucaucgguaacgaggaauuucuggacuauaugccauccaugaagcgguuucgcaaggaggaagaguccgaaggggcgaucugguga

SEQ ID NO: 25979 - RNA, 9873 nt, Artificial Sequence
  derived and/or modified CDS sequence (opt11) from DENV-3__FJ390371__SS-prME
acgucucugugccugaugaugaucuugcccgccgccuuagcuuuucaucucaccagccgggacggcgagccccggaugauaguugguaagaacgagaggggcaaaucccugcuuuucaagacugcuucggggauaaacaugugcacucucaucgccauggaccugggggagaugugcgacgacacggugaccuacaagugcccgcacauagccgagguugaaccugaggacauagacugcuggugcaaucugaccuccacgugggugaccuacgggaccuguaaccaggccggcgagcaccggcgggauaagcgguccguggcgcucgcgccacaugugggaauggggcuugauacgcggacucaaacauggaugagcgccgagggcgccuggcgacaggucgagaagguggagacaugggcgcugcgccauccuggguucacaauccucgcccuguuccuggcccacuauauagguaccucccuaacccaaaaggucgucaucuuuauccugcugaugcucguuacccccagcaugacgaugcguugcguggggguuggcaaucgcgacuucgucgaggggcuguccggggcuaccuggguggacguuguccuggagcauggugggugcgugacaacaauggccaagaacaagccaacgcucgacaucgagcugcagaagaccgaggcgacccaguuggcaacacuccggaaauuaugcauagagggcaagauaaccaacaucacuaccgacagccgcugcccgacccagggggaagccgucuuaccggaggagcaggaccagaacuacgucugcaagcacaccuacguggaccguggguggggcaacgggugcggccucuuugggaagggcucccugguaaccugcgccaaauuccagugucuggagcccaucgagggcaaggucguccaguaugagaaccucaaauacaccguuaucaucaccguccacacgggggaccagcaucaggugggcaacgagacgcagggagucaccgccgagaucacgccccaggcgucuacgaccgaggccauucugccggaauauggaacacuugggcucgaguguucgccgcgcaccggcuuagacuucaacgagaugauucugcucacuaugaagaacaaggccuggaugguacacaggcaaugguucuucgauuugccccuacccuggacgagcggcgccaccaccgaaacccccacuuggaaucggaaggaacuccuggugaccuucaagaaugcgcacgcuaagaagcaggagguagucguacuagggucucaggagggugcaaugcauaccgcucucaccggggcgacggagauccaaaacagcggagggaccuccauauuugccggccaccugaagugucggcugaagauggacaagcucgaacugaagggcaugagcuaugccaugugcaccaacaccuuuguccugaagaaggagguguccgagacacagcaugggaccauccucaucaagguggaguacaagggggaggacgccccgugcaagaucccuuucagcaccgaagacggacagggaaaagcccacaacgggcggcugaucaccgccaaccccgucgugacgaagaaggaagaaccugucaauaucgaggcggagccgcccuucggggagagcaacaucguuauaggcaucggggacaacgccuuaaagauuaauugguacaagaaaggcuccagcaucgggaagauguuugaagccacagccagaggggcgcgcagaauggcgauacugggcgauaccgccugggacuucggauccguuggcgggguucucaauucucugggcaagaugguccaccagaucuuuggguccgcguacaccgcccuguucaguggcgucucuugggucaugaaaaucggcauaggcguccugcucacuuggaucggccugaauagcaagaacaccagcauguccuucuccugcaucgccaucgggaucaucacccuuuaccuaggcgcggugguucaagccgacacggggugugucaucaacuggaaggggaaggagcugaagugcggcagcgggaucuuugugaccaacgaaguucacacuuggacggagcaguacaaguuccaggccgacucccccaaacgccucgccacggccaucgcuggcgccugggagaauggagucugcgguauuagauccacgaccaggauggagaaccuucuguggaagcaaaucgccaacgagcugaacuacauccugugggaaaacaacaucaagcugacugugguggugggggacaucauaggcguccucgagcagggcaagcgcaccuuaacgccccagccgauggagcugaaguacaguuggaagacgugggguaaggcaaagauagugaccgcggagacucagaacucauccuucaucaucgacggacccaacacgccugagugccccagcgcaucccgggccuggaacgucugggagguagaagacuacggauuuggcguguucaccaccaacaucuggcucaaguugcgcgaggucuauacccagcugugugaccaccggcucaugucggccgcugucaaggacgagcgcgcggugcacgccgacaugggcuacuggaucgagagccagaaaaaugguuccuggaagcuggagaaggccagcuugaucgaggucaaaacuuguacguggccgaaaucccacacccucuggaguaacggcguacuagaguccgacaugaucauucccaagucgcuggccggccccaucagucaacacaacuaccggccgggcuaccacacccaaaccgcggggcccuggcaccugggcaaguuagagcuggacuucaacuacugugagggcacgacuguaguuaucaccgagaauugcgggacccgcggcccaagccucagaacgacgaccgugucagggaagcugauacacgaguggugcugccgauccuguacccugccgccgcuucgguacaugggcgaggacgguugcugguacgguauggagauacgccccauuuccgaaaaagaagagaacauggucaagagccucgucuccgcuggcagcggcaagguggauaacuuuacgaugggcguucugugccucgcgauucuuuucgaggaggucaugcgcgggaaguucgguaagaagcacaugaucgccgggguauucuucaccuuugugcugcuccuguccgggcaaaucacguggagggacauggcccacaccuuaauaaugauuggcagcaacgccuccgaccggauggggaugggugucacguaccucgcgcugaucgccaccuucaaaauccagcccuuccuggcccucggguucuuucuacgcaaacuuaccagccgcgagaaucuccuucuggguguuggccucgccauggcuacuacucugcaguuacccgaggauaucgagcagauggccaacgggauagcucucggccugauggcccugaagcucaucacgcaguucgaaacguaccagcuguggacggccuugaucagcuugacgugcuccaacacaaucuucacgcuaaccguggcguggaggacggccacgcugauccuugccggggucagccugcugccgguaugccaguccagcuccaugcggaaguccgauuggcuccccaugaccguagcggccaugggcguuccaccucucccgcuguuuauauucucccucaaggacacccugaagcgccgcagcuggccccuaaacgaaggugugauggcgguugggcuuguguccauauuagccagcucgcuacucagaaacgacguccccauggccgggccucugguugccgggggucugcucaucgccugcuacgucauaacagggaccagcgcggaccugaccguggagaaggcagcugacgucaccugggaggaagaggccgaacagacugguguaucccacaaccugaugaucaccguggacgacgacgggacuaugcgaauaaaggacgaugagaccgagaacaucuuaacuguacugcugaagacugcucucuuaaucguuagcggaaucuucccuuacuccaucccggcgacccugcucguauggcacaccuggcagaaacagaccaggcgcagcggcguccuaugggacguucccagcccacccgagacucaaaaagccgaguuagaggagggugucuaccggaucaaacaacaaggaaucuuugggaaaacacagguuggcgugggggugcagaaggagggggucuuccauaccauguggcacguuacccggggcgcaguguuaacuuacaacggcaagcggcuggaacccaacugggcuuccguaaagaaggaccugaucuccuauggcgggggauggcgccucagcgcgcaauggcagaagggggaggagguccaggucaucgccgucgagccaggaaagaacccaaagaacuuucagaccaugcccggcacguuccagacgacgacuggggaaauuggugccaucgcacuugacuuuaagcccgggaccagcggcuccccuaucaucaaccgggagggcaaggucgugggacuguacgguaacggagucguuaccaagaauggcggcuacgugagcggcaucgcccagacaaaugccgagccggacggccccacccccgagcuugaggaggagauguucaagaagcgcaaucucaccaucauggaucugcaccccggguccgguaagacccguaaguaccugccggccaucguccgcgaggcgaucaaacguaggcuccggacgcucauacuagcccccacccgcgugguggcugcggagauggaagaggcccucaagggguuacccauccgguaccagacuacagccacuaaaucagagcacaccggccgcgagaucguugaccugaugugccacgccaccuucacaaugcggcuccugucuccugucagagugccgaacuacaauuuaaucaucauggacgaagcccacuucacagacccagcgagcauagccgcccgggguuacauauccacccgcgucgguaugggcgaggccgccgccaucuucaugacggcgacgcccccgggcacggcagacgccuucccgcagaguaacgcgcccauccaggaugaagaacgcgacauaccugagcgguccuggaacaguggcaacgaauggaucaccgacuucgcugggaagacagugugguucgugcccuccaucaaggccggcaaugauauugcgaacugccuacggaaaaacgggaagaagguaauccagcugagcagaaagaccuuugacacggaguaucagaaaaccaagcugaaugacugggauuucguagugaccaccgacaucagcgagaugggcgcgaacuucaaagcggaccgcgucaucgacccccggcgaugccucaagcccgugauccuaacggacggucccgagagggugauccuggccgguccaaugccggucaccgcggccagcgccgcgcagcgccggggccgcgucgggcgaaacccccagaaggagaacgaccaguacaucuucaccggccaaccccucaacaacgaugaggaccacgcccacuggacggaggccaagaugcuacuggacaacaucaacacaccggagggaauuauaccggcccuauucgaaccugagcgcgagaaguccgcggcgaucgacggcgaguaccggcugaagggagagagcagaaagacguucguagaacuuaugcggcguggggaucuccccgucuggcucgcacacaaggucgccuccgagggcaucaaguauaccgaccggaaauggugcuucgacggccagcgcaauaaccaaaucuuggaggagaauauggacgucgagaucuggaccaaggagggcgagaagaaaaagcugcggccucgcuggcuggacgcaagaaccuacagcgacccgcuggcgcucaaagaguucaaggacuucgccgccggcaggaagaguauagcucuggacuuggucacugaaauaggacgcgugcccagucaccucgcccaccggacccgcaaugcgcuggacaaucuggucaugcuccauaccagcgagcacggcggcaaggccuaccggcacgcaguggaggaacugcccgaaaccauggagacacuacuccugcucggccucaugauacuucugacggguggugcgaugcuguuccugauuuccggcaaagggaucggcaagaccagcaucgggcugaucugcgucaucgcauccuccggcaugcuauggauggcugagauuccucuucaguggauugccucugccaucguacuggaguucuucaugaugguucuccugaucccugagccagagaagcaacgcacaccacaagacaaccagcuggccuauguggucauugggauccugacgcuggccgcuaucaucgccgccaacgagaugggccuacucgaaaccaccaagcgcgaccugggcaugucgaaggagccggggguggugucccccaccaguuacuuggauguggaccuccaucccgcuucugcauggacguuguacgccguggccaccacuguuaucacaccuaugcugcgccacacgaucgagaauagcaccgccaacguuucccucgccgcgaucgccaaccaagccguggugcugaugggccuggacaaagguuggccuaucaguaagauggaucuugguguaccucuguuggcucucgggugcuacagucaggugaacccacugacccugaccgcggcggugcuccuucugauaacgcacuacgccaucaucggccccggccuccaagcuaaggccacgcgggaggcccagaagcgaacagccgccgggaucaugaagaaucccaccgucgaugguaucaugacgaucgaucuggaucccgucaucuaugauagcaaguucgagaagcaacuuggccaggugaugcuccugguucugugcgcaguucaacuccugcuaaugcgcaccuccugggcacucugcgaagcgcugacccuggcgacgggcccaauuacgacccuuugggagggcucgcccgggaaguucuggaacacgaccaucgcaguguccauggcuaacaucuuccgcggcagcuaccuggccggggcaggccuagccuuuuccauuaugaaaagcgucggcacgggcaaacguggcaccggcagccaaggcgagacccucggggagaaguggaagaagaagcucaaccagcugucccgcaaggaguucgaccucuacaagaaguccggcaucacagagguggaccggaccgaggccaaggagggauugaagagaggcgagaucacccaccaugcggugucccguggaagcgccaagcugcaaugguuugucgaacguaacauggugaucccggaggggcgggugaucgacuuaggcugcggccgagggggcugguccuacuauugcgcgggccugaagaaggucacagaagugcggggauacacgaagggcgggccggggcaugaggaacccgugcccaugagcacauacggcuggaacauugucaagcugaugucggggaaggacguauuuuacuugccacccgagaagugugacacccugcugugugacauaggcgagagcucccccucacccaccguggaagagucccguacuauccgcguucuaaagaugguggagccguggcucaagaacaaccaguucugcaucaaggugcucaacccauacaugccuaccguaaucgaacaccuagagcggcuccaacgcaagcacggcgggaugcuggugcggaacccccugagucggaauaguacgcacgagauguacuggauaagcaacggcacggguaacauaguggcgucuguaaacauggugagccggcugcuucugaacagauuuacuaugacacaccgcaggccaacgaucgagaaggacgucgaccucggcgcgggaaccagacacgucaacgccgagccugagaccccaaauauggaugugaucggugagcgcaucaaacgaauaaaagaggaacacaacuccacuuggcacuacgacgacgagaacccguacaagaccugggccuaucacgggagcuacgaaguuaaggcgaccgguuccgccagcagcaugauaaacggcgucgugaaguuacucaccaaacccugggacguugucccuauggucacucagauggccaugacagacacuaccccuuucgggcagcagcgcgucuucaaggaaaagguggacacccgaacgccgcgaucaaugccaggcaccagacgcgugaugggcaucaccgccgaauggcucuggcgcacccucgggcgcaauaagaagccccgccugugcacgcgcgaggaguucaccaaaaaggugcguaccaaugcggcgaugggggcaguguucaccgaggaaaaucagugggacucugcgaaggccgcaguggaggacgaagacuucuggaagcucguagauagagaaagggaacuccacaaacuugggaagugcggcuccuguguguauaacaugauggggaaacgcgagaagaagcucggcgaguucggcaaagccaagggaagccgcgccaucugguacauguggcugggcgcccgguaccuggaguucgaagcccucggguuccugaaugaggaccauugguucuccagggagaauagcuacaguggcguggagggugaaggacugcacaaguuaggcuacauccuucgggacaucagcaagaucccaggaggggcuauguacgccgacgacacggccgggugggacacccgcaucacagaggacgaccuccacaacgaggagaagaucacccaacaaauggacccggaacaccgccaacucgccaacgcaaucuuuaagcuaacguaccagaacaaggucgugaaggugcagaggcccacgcccacaggaaccguuauggauaucaucucccggaaggaccaacgcggaagcggccaggugggcaccuacgggcugaauacguucacaaacauggaggcgcagcucauccgacagauggaaggugagggggugcugaccaaggccgacuuggaaaacccccaccuauccgagaagaagaucacccaguggcuggagacuaagggcguggagcgccugaaacggauggccaucucuggugacgacugcguuguuaagccgauugaugaucgcuucgccaacgcacuucuggcgcugaacgacauggggaagguccggaaggacaucccccaguggcagcccuccaaggguuggcacgacuggcaacaggugcccuucugcagucaccacuuucacgagcucauuaugaaggacgggcgcaagcugguuguccccugccggccccaggacgagcugaucggccgcgcccggaucucccaaggggccggauggagcuugcgugagacggccugucucggcaaggcguacgcccagauguggagccugauguacuuccaucgccgggacuugcgccuggcgagcaacgccaucugcagcgcugugcccgugcacuggguccccaccagucggaccacauggucgauccacgcgcaccaccaguggaugaccaccgaggacaugcuaaccguguggaaucgaguuuggaucgaggacaacccguggauggaggacaagacgccugucacgaccugggagaacgugcccuaccucggaaagcgggaagaucaauggugcgguagccuuaucgggcugaccagccgagcuaccugggcccaaaacauccccacagccauccagcaaguccggucucucauaggcaacgaggaauuucuggauuauaugcccagcaugaagcgcuuccguaaagaggaggagagugagggggccaucugguga

SEQ ID NO: 25980 - RNA, 9873 nt, Artificial Sequence
  derived and/or modified CDS sequence (opt11) from DENV-3__FJ390372__SS-prME
acgucccugugucucaugauggugcugccugccgccuuggcguuccaccucaccagcagggacggggaaccccggaugaucguggggaagaaugaacggggcaagagccuccuguucaagacugccucggggauaaacaugugcacccucaucgccauggaccucggcgaaaugugcgacgacacaguaacauacaaauguccccacaucacggagguagagccugaggacauagacuguugguguaaccuaaccucaaccugggucaccuacggcacuugcaaccaagccggcgagcaccgacgcgacaaacgguccguggcgcucgcaccccacgugggcauggggcuggacacacguacgcagaccuggaugagcgccgagggugcguggaggcaggucgaaaagguggagacgugggcucuccgccauccagguuuuaccauccuggcgcuguucuuagcccacuacauugggaccucccucacccagaagguggugaucuucauccugcugauguuagugacgcccagcaugaccaugcggugcguaggcguuggcaaucgcgacuucguagagggccuguccggggccacuuggguggacguagugcuggagcacggcgggugugugacgacuauggccaagaacaagccaacccucgauauugaacuacagaagacggaggcuacccaauuggcaacgcuccgcaaacugugcaucgagggcaagaucacaaacaucacgaccgacucacggugucccacucagggagaggcgguccugccggaggagcaggaucaaaacuauguauguaagcacacguacguggaccggggguggggcaacgggugcggguuguucgggaagggaucccugguuaccugugccaaguuccagugucuugagccuauagaggggaagguggugcaguacgaaaacuugaaguacaccgucaucaucacggugcauacuggggaccagcaucaggucgggaacgagacccagggggugaccgccgaaaucacgccccaagcgucaacaaccgaggccauucugcccgaauacggaacccugggccucgaaugcagcccgcgcaccggccuugauuucaacgagaugauccugcucacgaugaaaaacaaggccuggaugguccaucggcagugguucuucgaccugccgcugcccuggaccucgggcgccaccaccgaaaccccgaccuggaaucgcaaagagcuccuggucaccuucaagaaugcccacgccaaaaagcaggaaguugugguuuuagguucucaagagggcgcgaugcacaccgcccugacaggggccaccgagauccagaauagcggugggaccuccauauucgcaggccaccuuaagugucgacugaagauggacaaauuggagcuaaagggaaugagcuacgccaugugcaccaacaccuucgugcuuaagaaggaaguguccgagacgcaacacgggaccauucucauaaaagucgaauacaagggagaggacgcgccgugcaagaucccuuucagcaccgaggaugggcaagguaaagcgcauaauggacgcuugauuaccgccaacccuguggugacgaaaaaggaggagcccguuaacaucgaagccgagccacccuucggcgagucuaacaucgugaucggcaucggggauaacgcgcuuaaaaucaacugguacaagaagggcuccagcaucgggaagauguucgaggccacugcccggggagcgcgccgcauggccauccuaggcgacaccgcgugggacuucgggaguguuggcgggguauugaauagccugggcaagaugguacaccagaucuucgguucagcuuacacagcgcuguucagcggggugucgugggugaugaagaucggcauagggguucuccugaccuggauuggccugaacagcaagaacaccuccaugagcuucuccuguaucgccaucggugugauaaccuuguacuugggagccguagugcaggccgacauggggugcgugauaaacuggaaagggaaggagcugaagugcggcagcggaauuuucgucacgaacgaagugcacaccuggacagagcaguauaaauuccaggcggacagccccaaacgccucgcuaccgccauugcgggggcgugggagaacgggguguguggcauccgcagcacgacacgaauggagaaccugcuguggaagcagauugcuaacgagcucaauuacauucugugggagaacaacauuaaacuuacuguuguggucggcgacaucaucggugugcuagaacaggguaagcggacccugacgccccagccgauggagcugaaauacucauggaagacaugggggaaggcaaagauuguaacagcugagacccaaaacucuuccuucaucaucgacggccccaacacuccagagugucccagcgcuagccgggccuggaaugugugggaggucgaggacuauggguuugguguguucaccacaaacauauggcucaaacuucgcgagguguauacucaguugugcgaccaccggcucaugucugcagccgugaaggaugagcgcgccgugcacgcggacaugggcuacuggaucgagagccaaaagaacgggagcuggaaacuugaaaaggccucacugaucgaggucaagaccuguacguggcccaaaagucauacacuuuggagcaacggaguauuagaauccgacaugaucauccccaaaagccuggccggucccaucagucagcacaaccaccggccggguuaccacacgcaaacggccgggcccuggcaccucgguaaacuugaacuggacuucaauuacugcgagggcaccaccguagugauuacagagaacugcggcacacgcggccccucgcuccggacaaccacgguuagcgggaagcuaauucacgaguggugcugucgcagcugcacacugccuccucuucgguacaugggugaggacgggugcugguacggcauggagauccgcccaaucucagagaaagaggagaacaugguuaagagccugguguccgccggcagcggcaaaguagauaauuucacgaugggggugcucugccuugcgaucuuauucgaggaggucaugcgggggaaguuuggcaagaagcacaugaucgccggggucuuuuucacuuuuguauuacuccuguccggucagaucaccuggagagacauggcccacacccuuaucaugauagggagcaaugccuccgaccgaauggggaugggcguuacuuaucuagcccugauagcaaccuucaagauccagccuuuccuggcccucggguucuuccugcguaagcugacuucgcgagaaaaccugcuucugggaguuggcuuagccauggcaaccacgcuacaacugcccgaggacaucgaacaaauggcgaacgggauagcucucggccugauggcucuaaagcucauaacacaguuugagaccuaccaacuguggaccgcuuuaaucagccucacaugcuccaacacuauguucacccuaaccguggccuggcggacggccacccuuauauuagccggcgucucccugcugccggugugccaaaguucauccaugaggaagaccgacuggcucccgauggcuguggccgccaugggcguuccgccucucccgcuguucauauucagccugaaagacacccugaagcgccguagcuggccacugaaugagggaguuauggcgguggggcucgucaguauccuugcgucaagccugcucaggaacgaugugcccauggcaggcccauugguugcugggggccuccucauugcuugcuaugugauaacggggaccagcgccgacuuaacaguugagaaggccgcagacaucaccugggaggaggaggccgagcagacgggugucagccacaaccuaaugauuacgguggacgacgacgggaccaugcgcauuaaggacgacgagacugaaaacauccuaaccguccuacugaagacggcccuccugaucgugucgggcgucuucccguauaguauccccgcgacacugcucguguggcacaccuggcagaagcaaacccaacgguccggcguccugugggacguccccagcccgcccgagacgcagaaggccgagcuggaggaggggguguaucgcaucaagcagcagggcaucuucgggaagacccaggugggcgugggagugcaaaaggagggaguguuccacacuauguggcacgucacccggggagccgugcugacuuauaacgguaagaggcuggagcccaacugggcauccgugaagaaagaccugaucagcuauggagggggauggcggcucagcgcccaguggcaaaagggggaggagguccaagugaucgccguggagcccggcaagaauccgaaaaacuuucagacgaugccuggcacuuuucagaccacgaccggggaaaucggugcaaucgcccuggacuuuaagcccgggaccagcgggucgccaauaauuaacagagaggguaagguaguggggcuuuacggcaacgggguggucaccaagaauggcggguacgugucgggcauugcccaaacaaaugcagagccggauggccccaccccugagcuggaggaagagauguucaagaagagaaaucucaccaucauggaccuccaccccgggagcggaaaaacccgcaaguaccugcccgccaucguccgggaagccaucaagcgccggcuaaggacacugauacuggcgccaacacggguaguagccgcggagauggaggaggccuugaaggggcuccccauccgcuaccaaaccaccgccacgaagucggagcauaccggccgggagauuguggacuuaaugugccaugccaccuucaccaugcgccuuuuaagcccugugcgggugcccaacuacaaucucaucaucauggacgaggcgcacuuuacggaccccgccuccaucgccgcacgcggguacaucucaacgagagugggcaugggcgaggccgcggccaucuucaugaccgccacgccgcccgggacagccgaugccuucccgcaauccaacgcgcccauucaggacgaggagaaggacaucccagaaagauccuggaacucggggaaugaauggaucaccgacuucgcagggaagaccguuugguuugugccuucgaucaaggcuggcaaugacaucgcgaacugccucaggaagaacggaaagaagguaauucagcucucucggaagacguucgacacagaguaccaaaagacuaaacugaacgacugggacuucgucgugacuacggacaucucugagaugggcgccaacuucaaagcggaccgcguuaucgacccgcggcgcugccucaaaccugucauacugacggacggccccgagcgggugauccuggcugggcccaugccugugaccgcugcgucagccgcgcagcgccggggccgagucggccggaacccgcagaaggagaacgaccaguauauuuucaccggccagccacuuaacaacgacgaggaucacgcucauuggaccgaggccaagaugcugcuggacaacauaaacacccccgaggggauuaucccggcccucuuugagcccgagcgagaaaaguccgcggcaaucgacggugaguaccggcugaagggagaaucucgcaagacguucguggagcuaaugcggagaggcgacuuacccgucuggcuggcccacaaaguggccagcgaaggaaucaaguacaccgaccggaaguggugcuucgacggacagcgcaauaaccagauccuggaggagaacauggauguggagaucuggacgaaagagggcgaaaagaagaaauuacgaccucgcuggcuugacgcccggacuuacuccgacccguuagcgcucaaggaguuuaaggacuucgccgccggaagaaagagcaucgcccucgaccugguaacagagaucggacgcgugccgucccaccucgcccaucguaccagaaacgcgcuggacaaccuagucaugcuacacaccucagagcauggcgggcgggccuacagacacgccgucgaagaacugccagagaccauggagacgcugcucuuauuggggcucaugauccugcugacagggggcgcuaugcuauuccuaauaagcggaaaggggaucggcaagaccuccaucgggcuaaucugugugaucgcuaguucaggaauguuauggauggcggaaaucccguuacaguggauugcgagugcgaucguacuggaguucuucaugauggugcucuuaaucccugaaccugagaagcagagaacgccccaggacaaccagcuggccuacguggugauagggauacucacccuggccgcgauuaucgccgccaacgagaugggccuucucgagacaacuaagcgcgaccuggguauguccaaagagcccgguguggugucgcccaccagcuaccuggacguggaucuccaucccgccucagcuuggacgcuuuacgccguagccacuacagugauaacaccaauguugcggcauacgauugagaacucuaccgccaaugugagccucgcagccaucgccaaccaggcggucgugcucaugggacuggacaagggguggccgaucuccaagauggaccucggcgugccucuucuggcccuugggugcuacucgcaggucaacccguugaccuugacggcagcggugcuacuucugauaacgcacuacgcgaucaucggucccgggcuccaggcgaaggccacccgggaggcccaaaaacggaccgcggcuggcaucaugaagaauccgacuguggacggcaucaugacgaucgaccuggacccggugaucuacgauuccaaauucgagaaacagcugggacaagucaugcuguuaguacucugcgccguccagcuccugcugaugcgcacauccugggcucucugcgaggcgcugaccuuagccaccgggcccauaacaacccucugggagggcucccccgggaaguucuggaacaccaccaucgccguuagcauggccaauaucuuccggggcuccuaccuggccggggcgggccuggcuuucuccauaaugaagaguguaggaacgggcaagcgaggcaccgggagccagggcgaaacccuuggggagaaauggaagaagaagcugaaucagcuuagccgaaaggaguucgaccuauacaaaaaguccgguauuacagaggucgaucgcacagaggcaaaggaggggcugaagagaggggaaaccacucaccacgccguaucccguggcaccgcgaagcugcagugguuuguggagaggaacauggucauccccgaaggccggguaauagaccucggcugcgggcggggcgggugguccuacuacugcgcuggacugaagaagguaaccgagguccgaggguauacgaaaggaggccccgggcacgaggagcccguacccaugagcaccuacggcuggaacaucgugaagcugauguccgggaaggacgucuucuaccuuccgccggagaaaugcgacacgcuacuaugcgauauuggcgaaagcagccccagcccuaccguggaagaguccagaacuauacgcguguugaagauggucgaaccguggcucaagaacaaccaguucugcauuaaaguguugaaccccuacaugccuaccguaaucgagcaccuggagcgccuccaacguaaacauggugggaugcuuguccgcaacccucugucacggaacuccacccacgagauguacuggauaagcaacggcacagggaacaucguggccuccguuaauauggucagccgccuccugcucaaccgguucacgaugacccaccgacgcccgaccauagagaaagacguggaccucggagcagggacccgccacgugaacgcggaaccggagacgcccaacauggacgucaucggggagcggaucaaaagaauuaaagaggagcacaacuccacguggcacuacgacgacgagaacccuuacaagaccugggcuuaccacgggagcuacgaggugaaggccaccggcucugccucuaguaugaucaacggcguugugaaguuacuaacgaaacccugggacgugguccccaugguuacgcagauggccaugaccgauaccacgcccuucgggcaccagcgggucuucaaggagaaggucgacacucgcaccccacggagcaugccugggccucgacgggccaugggcaucaccgcggaauggcucuggcggacguuagggcggaacaagaagccucgccugugcacucgagaggaguuuaccaagaagggccgcacaaacgccgcgaugggggccguguucacggaggaaaaccagugggacagcgccaaggcggcaguugaggacgaggacuucuggaaacucguugaccgcgaacgcgagcuacacaaacugggcaaaugcggguccugcguguacaacaugaugggcaagcgggagaaaaagcucggcgaguucgggaaggccaagggcagccgggcaauaugguauauguggcugggggcccgcuacuuagaguucgaggcccugggcuucuuaaacgaggaccacugguuuucucgggagaauagcuacucggggguggaaggugagggccugcacaagcucggguacauucugagggauauaagcaagaucccugguggggccauguaugcggacgccaccgccgggugggacacgcgcauuaccgaggacgaccuacacaacgaggaaaagauuacgcagcagauggaccccgaccaccgccaacucgcaaccgccaucuucaaacucaccuaucaaaacaaggucgugaagguucaacggccgacucccacugguacggucauggacaucauaucccgcaaggaccagcgggggagcggccaggucgggaccuacggucuaaacaccuucaccaacauggaggcccagcucauccgccagauggaaggggagggcgugcugagcaaagcugacuuagagaauccgcaccucccggagaaaaagauuacgcagugguuggagacgaaaggugucgaaaggcuucgacgcauggcaauaagcggagacgacugugucguaaagccaaucgacgacagguucgcuaacgcacuccuugcccugaacgacaugggcaagguccgaaaggacaucccacaguggcagccuuccaagggguggcacgacuggcaacagguccccuucugcagccaucauuuccaugaguuaaucaugaaggacggccgcaaacuggucguacccugucggccccaggacgaguuaaucgggcgagcucggauaucccagggagcgggcuggagccuccgcgagacugccugcuuagggaaggccuacgcgcagauguggucauuaauguacuuccaccgccgagaccuccgccucgccagcaacgcgaucugcucugcgguaccggugcacuggguccccacgagccggacgaccugguccauccacgcccaucaccaauggaugaccaccgaggacaugcugacuguuuggaaccgaguguggauagaggacaaccccuggauggaggacaagacgcccguaaccaccugggagaacgucccguaccucggcaagcgggaggaccaauggugugguagccugaucggccugacgucacgcgccaccugggcccagaacaucccuaccgccauucagcaagucagaucacugaucggaaacgaagaauuuuuagauuacaugcccagcaugaagcgcuuccggaaggaagaggaauccgagggcgcgauaugguga

SEQ ID NO: 25981 - RNA, 9873 nt, Artificial Sequence
  derived and/or modified CDS sequence (opt11) from DENV-3__FJ205870__SS-prME
accucgcuaugccucaugaugauccugcccgccgcucuggccuuucaccucacuagucgggauggggagccgcggaugauugugggcaagaaugagcgcggcaagagccuacuguuuaagacugcaucgggcaucaacaugugcacccucaucgccauggaucugggcgaaaugugcgacgacaccgugaccuacaaaugcccucacaucgcugagguggaacccgaggacauagacugcuggugcaaucugaccucaaccugggugaccuacgggacuuguaaccaggccggcgagcaccggcgcgacaaacgguccguggcgcucgcgccccacgucggcaugggacuggauacgcgcacccaaaccuggaugagcgccgaaggcgccuggcgccagguggagaagguggagaccugggcgcugcgccacccaggauucacuauccuugcccuguuucuggcccacuacaucggcaccucccucacccaaaagguggugaucuucaucuugcugaugcucguuaccccaagcaugaccaugcgaugcguggguguuggcaaccgcgacuucguugagggcuuguccggggcuaccuggguugacgucgugcuggagcacggcgggugcgugaccacgauggccaagaacaagcccacgcucgacauagagcuucagaagaccgaggcgacacagcuggccacucuccggaagcugugcaucgagggcaagaucacgaacaucaccaccgacagccguugccccacacaaggagaggcgguacugccggaggagcaggaccagaauuacgucugcaagcacacguacguggaccguggguggggaaacgggugcggccucuucgggaaaggcuccuugguuaccugcgccaaguuccagugucuagagccgaucgaaggcaaagucgugcaguacgagaaccucaaguauaccgugaucaucaccguccacacgggggaccagcaccaaguaggcaacgagacccagggugugaccgccgagauaacgccccaagcaagcacuaccgaggcuaucuuacccgaguacggcacccuugggcuggagugcuccccgcguacuggccuggacuuuaacgaaaugauccugcucacaaugaagaacaaggcguggauggugcaucggcagugguucuucgaucucccacugcccuggacgagcggcgccaccaccgaaacucccacguggaaccgcaaggagcuccuggugaccuucaagaacgcccacgcgaagaagcaggaggucguggugcugggcucccaagaaggcgccaugcacacagcccucacuggggccacggagauccagaauagcggcgggaccaguaucuucgcaggccaccugaagugccgacugaagauggacaagcucgagcugaaaggcaugagcuacgcgaugugcaccaacaccuucguccugaagaaggaggugagugagacgcaacacggcaccauacucaucaaaguggaguauaagggcgaggacgucccuugcaagauccccuucucuaccgaggacggucaggggaaggcucacaaugggcgccugaucacagccaaccccguggugacgaagaaggaggaacccgucaacaucgaggccgagccgccuuuuggggagagcaacauagugaucggcaucggggacaacgcgcugaagaucaacugguacaagaaaggcuccagcaucgggaagauguucgaggccaccgcccgaggcgccaggcgaauggccauauuaggggacacagcgugggauuucggguccgugggcggggugcucaacucguuaggcaagaugguacaucagaucuucggauccgccuacaccgcccuguuuagcggcgugucuugggucaugaagaucgguaucgggguacuccuuacguggaucggccucaacagcaagaacaccucuaugagcuucuccugcaucgcuaucgggaucaucacccucuaccugggggccguuguccaggcggacacggggugcguaaucaacuggaaggguaaggagcuuaagugcggcagcgggauuuucgugacuaaugagguucauacguggaccgaacaguacaaguuccaggccgauagccccaagcgcuuggccacggccauugccggugcgugggagaacgggguuuguggcauccguagcacuacccggauggagaaucugcuguggaagcagaucgccaacgaacucaacuauauacugugggaaaacaacaucaagcugaccguugucguaggggacaucaucggcaucuuagagcagggcaagcgcacccugacaccccagccgauggagcuuaaguacuccuggaagaccugggggaaggccaagaucgucaccgccgagacucagaacagcuccuucaucaucgacggccccaacacacccgaaugccccagcgcgucccgggccuggaacgucugggaaguggaggacuacggauucggcguguuuaccaccaacauuuggcucaaguuacgggaggucuacacccagcugugcgaccaccggcucaugagcgccgccgugaaagacgagcgcgccgugcaugcggacaugggcuacuggaucgaaagccaaaagaacggguccuggaagcuggagaaggccucacugaucgaaguaaagacaugcacguggccgaagucccacacccucuggagcaauggcgugcuggaguccgacaugaucaucccuaaaucgcuggcggggcccaucagucaacacaacuauagaccgggguaccacacccagaccgcgggacccuggcacuuaggcaagcuggagcuggauuucaacuacugcgagggcacgaccguggucaucaccgaaaacugcgggaccagaggccccagccuccggacgaccacagugucggggaagcuaauccacgaguggugcugccgcaguuguacccugcccccgcuccgguacaugggugaggacgggugcugguacggcauggaaauccgcccaaucuccgagaaggaggagaacauggucaaaucacugguauccgccggcuccgggaagguggacaacuucacuaugggcgugcugugucucgcgauccuguucgaggagguuaugcgggggaaguucgguaagaagcacaugauagccgggguguucuucacauuugugcugcuccuguccgggcagauuaccuggcgcgacauggcccacacccugauuaugaucggcagcaacgccuccgaccggauggggaugggcguuacguaccucgccuugauagcgacguuuaaaauccagccguuccuggcgcucggguucuuccugcgcaagcugacuucacgggagaaccuucugcugggcgucgggcuggccauggccaccacgcugcagcugcccgaggacauugaacaaauggcgaauggaaucgcccucggacuuauggcucugaaacucaucacccaauucgaaaccuaccaauuguggaccgcccugaucagccucacguguuccaacaccaucuucacccugacgguggccuggcgcacggcgacccugauucucgcaggggugucuauccucccgguaugccaguccucaagcaugcggaaguccgacuggcuccccaugaccgucgccgccaugggcguaccgccguuaccgcuguucaucuucucccugaaagacacgcucaagcgccgcagcuggccccucaacgagggggugauggccgucggccuugugucaauauuagcguccucccugcugcggaacgacgugcccauggcaggcccucucgucgccgggggccugcugaucgccuguuacgugauaacggguaccucagcugacuuaaccguggagaaggcggccgacgucacuugggaggaggaggccgagcagacgggcgugagucauaaccucaugaucaccguggacgacgacgggaccaugagaaucaaggacgacgagacugagaacauccugaccguccucuugaagacggccuugcucaucgugagcggaaucuucccauauuccaucccggccacccuucugguguggcacaccuggcagaagcagacccggcgaucuggcguauugugggacgugccaucaccccccgaaacgcaaaaggcggaacuggaggaggggguguaccggauaaagcaacaaggcaucuucgggaagacucaggugggagucggcgugcaaaaggagggcgucuuccacaccauguggcacgugacgcgcggcgcaguccugacguacaacgggaagcggcuggagcccaacugggccagcguaaagaaggaccugaucucuuacggcgggggcuggcgccugagcgcccaguggcagaagggggaggagguccaggugaucgcgguggagcccgggaagaacccgaagaacuuccagaccaugcccggcaccuuccagaccacgaccggggaaaucggcgccaucgcccuggacuucaagcccgggaccagcggcucacccaucaucaaucgggagggcaaggugguggggcucuacgguaacggcguggugaccaagaacggcggcuaugugagcggcaucgcgcaaacaaacgccgagccugauggccccaccccggagcuagaagaggagauguucaagaagcgcaaccuaacuaucauggaccuucaccccggaucuggcaagacucgcaaguaccuuccggcaauaguccgcgaggcgauaaagcgacgauuacggacgcuaaucuuagcccccacucgagucgucgcggccgagauggaggaggcccuaaaggggcucccaauccgguaucagaccaccgccacuaagagcgagcacacuggaagggagaucgucgacuuaaugugccacgcuacuuucaccaugcggcugcucucccccgugcgggucccgaacuacaacuuaaucauuauggaugaagcccacuuuacggaccccgccucaaucgcggccagaggauacaucagcacacggguggguaugggcgaggcugccgcgauauuuaugaccgccacgccgcccgggaccgcugaugccuucccgcaaucuaacgcccccauccaggaugaggaaagagacauccccgagcggagcuggaacagcggcaaugaguggaucacagacuucgcggggaaaaccgugugguucgugcccucaaucaaagccgggaacgacaucgcaaacugccugcgcaagaacgguaagaaggucauccaacucucccggaagaccuucgauacggaauaccagaaaaccaagcucaacgacugggauuucguggugaccaccgacaucuccgagaugggggcaaauuucaaggccgaccgcguuaucgacccgcggcgcugucugaagccggugauccucacggaugguccggagcgggugauccucgcugggcccaugccgguuacugcagccagcgcagcucagcgucguggccgcgugggucggaauccgcaaaaggagaacgaccaguacaucuucacgggccagccgcugaacaacgacgaggaccacgcccauuggacggaggcuaagaugcuccuggacaacaucaacacccccgagggaaucaucccggcccuguuugaaccagagcgcgagaaguccgcggcgaucgauggcgaguaccggcucaagggcgagagccgaaagaccuuuguggagcugaugcgaaggggggaccugcccgucuggcucgcccacaagguggccuccgagggcauuaaguauacagaucggaaauggugcuucgacgggcagcggaacaaccagauccuggaggagaacauggacgucgagauauggaccaaggagggagagaagaaaaagcugcgcccccgcuggcuggacgcccgcaccuauagcgacccgcuugcccucaaggaguucaaggacuucgcggccgggcgaaagucaaucgccuuagaccuggucacggagauuggccgcgugccaagccacuuagcccaccggacccgaaaugcucucgauaaucugguuaugcugcacaccucggagcauggcggaaaggcguaccgacacgcuguugaggaacuccccgagaccauggagacgcugcugcuccugggccugaugauccuccugacggggggcgccaugcuguuccuaaucuccggcaaggguaucggaaagaccaguaucgggcugaucugcguaaucgccuccaguggcaugcuguggauggccgaaaucccucuacaguggaucgcauccgcuauaguccuggaguucuucaugauggugcuguuaauccccgagcccgagaagcagcggacgccccaggacaaccagcuagccuauguaguaaucggaauccugacccucgccgccaucauagcggccaacgagaugggauuacuggagaccaccaagcgugaucucggcaugucaaaagagccggguguugugucccccaccagcuaucucgacgucgaccugcaccccgcaucugcuuggacacuauaugcgguugccaccaccgugaucacuccgaugcugcgccacacgauugagaacagcaccgccaaugucucccuagccgccaucgcgaaccaagccguggugcucaugggccuggacaagggguggccgaucagcaaaauggacuuaggggugccacuccuggcccuggguuguuacucccaagugaacccccucacucugaccgccgccgugcugcuccugaucacgcacuacgcaaucaucgggccaggucugcaggcgaaggccacccgagaggcucagaaacgcaccgcugcggggaucaugaagaauccgaccgucgacggcaucaugacgaucgaccucgaccccgugauuuaugauaguaaguuugaaaaacaguuaggucaggugaugcugcucguccugugcgcagugcaguugcucuuaaugcggacuagcugggcccugugcgaggccuuaacccuggcgacgggccccaucacgacccucugggaggguagccccggaaaguucuggaacaccaccauugccguguccauggcuaauaucuuccgcggaucauaccucgccggggccggccuggcguucuccaucaugaaauccgucggaacgggcaagcgcgggaccgggagccagggcgagacccucggagagaaguggaagaagaagcucaaccagcugagccgaaaggaguucgaccuguauaagaagaguggcauuaccgagguggaccggaccgaggccaaggaagggcucaaacgcggcgagaucacgcaccacgccgugagccggggcagcgccaaacugcagugguucgucgaacgcaacaugguuaucccggaggggcggguaaucgacuuaggaugugggcgggguggguggucguacuacugcgccggcuugaagaagguaacggaggugcggggcuacaccaaaggcgggcccgggcacgaggagcccgugcccaugagcaccuacggcuggaacaucgugaagcugauguccgggaaagauguguucuaccuuccccccgaaaagugcgauacgcucuugugugacaucggcgagucauccccuagccccaccgucgaggagucccgcaccauccgcgucuugaagaugguggagccguggcuuaagaauaaccaguucugcauaaagguccugaacccguacaugcccacugugauugagcaccuggagcggcugcagcgcaagcacggcgggaugcucgugaggaaccccuugagccgcaacuccacccacgagauguauuggaucagcaacggcaccgguaauaucguggcguccgucaacauggugagccggcugcuccugaaucguuucacuaugacccaccgccgcccgacaaucgagaaggacguagacuuaggcgcaggcacccggcacguaaacgcggagccggagacgcccaacauggaugugaucggggagcgaaucaagcggaucaaggaagagcauaacuccaccuggcauuacgacgacgagaacccguacaagacgugggcauaccacggaagcuaugaaguaaaggccacgggguccgcguccucuaugauuaacggcguggugaagcuucugaccaagcccugggacgucgugcccauggugacgcagauggccaugaccgacaccacccccuucgggcagcagcgcguuuucaaggagaagguggacacgaggaccccacgguccaugcccggcacccggcgcgucaugggcaucaccgccgaguggcuguggcggacucuggggcgcaacaagaagccccgauuaugcacgcgcgaagaauucaccaagaagguccgcaccaaugccgcgaugggggcgguguucaccgaggagaaccaaugggacagcgccaaggccgccguagaggacgaggacuucuggaagcuagucgaccgagagcgcgaacuccacaagcuggggaagugcgguuccugcgucuacaacaugauggggaagcgggaaaagaaguuaggugaguucggcaaggcgaaagggucgagggccaucugguacauguggcucggugcgcgguauuuagaguucgaagcccugggauuccucaacgaggaccacugguucagccgcgagaacucauacucgggcguggagggcgagggccugcccaaguugggcuacauccuccgggacauuagcaagauccccgggggggcuauguaugcggacgacacugcugggugggacacccgcaucacugaagacgaccugcacaacgaagaaaaaaucacccagcagauggaccccgagcaccggcaacuggcgaacgcgaucuucaagcucacguaccagaacaagguugugaagguccaacgccccacucccaccgguaccgucauggacaucauuucccggaaggaccagaggggcagcggccaggugggcaccuacggacugaacacuuucaccaauauggaggcccaacugauccgucagauggagggcgagggggugcucuccaaggcggaccuggaaaacccgcaccugagcgaaaagaagaucacccaguggcucgaaacgaagggcgucgagcgccuuaagcggauggcaaucucuggcgacgacugcguggugaagcccaucgacgaccgcuucgccaacgcccuccucgcacugaacgacauggggaagguccggaaggacaucccgcaguggcagccgagcaagggcuggcaugacuggcagcaggucccauucugcucccaccauuuccaugagcuuaucaugaaggauggccgcaagcucgugguccccugucggccacaggaugagcugaucggcagagcacggaucagccagggagccggcuggucccugcgcgagacugccugccucggcaaggccuacgcgcagauguggagcuuaauguacuuccaccgccgggaccugcggcucgcgucuaacgccaucugcagcgccgugcccguucacugggucccgaccagccggaccaccugguccauccacgcgcaccaucaguggaugacgaccgaggacaugcugaccgucuggaaccgaguguggaucgaggacaaccccuggauggaggacaagacccccgucacgaccugggaaaacgugcccuaccugggaaaacgggaggaccaguggugugguagccugaucgggcugacgucacgcgcgacgugggcccaaaacauaccgacggccauccaacagguccggagccugaucggcaacgaggaguuccuugauuacaugcccaguaugaagcgcuuccggaaggaagaggagagcgagggggcaaucugguga

SEQ ID NO: 25982 - RNA, 9873 nt, Artificial Sequence
  derived and/or modified CDS sequence (opt11) from DENV-3__FJ390373__SS-prME
accagcuugugcuuaaugaugauacuacccgcggcccuggcauuccacuuaacaagccgggacggggagccccggaugaucguggggaaaaacgagcggggcaagagccugcuguucaagacggcguccggaaucaacaugugcacucucaucgccauggaucugggagagaugugugaugauaccgugacauacaagugcccacacaucacggaaguggagcccgaagacaucgauuguuggugcaaccugaccagcaccugggugaccuacgguacgugcaaccaagccggcgagcaccgucgcgacaaacggagcgucgcacucgcuccccacgucggcauggggcuugacacccgcacccagaccuggaugagcgccgagggcgccuggcgccaaguggaaaaggucgagacaugggcccugcgccacccgggguucaccauucuugcccuguuccuggcccauuacaucggcaccagucucacccaaaaaguggucaucuuuauccuucuaaugcuggugacccccaguaugaccaugcggugcguuggggugggcaaccgcgauuucguagagggccuaaguggggccaccuggguggacguuguccuggagcacggagguugcgugaccacaauggcaaagaauaagcccacgcucgacauagagcugcagaaaaccgaagccacccagcuggcgacgcuucggaagcuuugcauagagggcaaaauaaccaauaucaccacagacagccgcugcccgacgcagggcgaggccguguugccggaggagcaggaccagaacuacguaugcaagcacaccuaugucgaucgggguuggggcaacgggugcggacucuucgggaagggcucgcugguuacuugcgcgaaguuccagugucuugagcccaucgagggcaaggucgugcaauacgagaacuugaaauauacagugaucauaacuguccacaccggggaucagcaccaagugggcaacgagacccagggggucaccgccgagaucacgccccaggccagcacgacggaggcaauccugccggaguacggcacucuggggcucgagugcuccccacgcaccggacucgacuucaaugaaaugauucugcucacgaugaagaacaaggccuggauggugcaccgacagugguucuucgaccuuccccugcccuggaccagcggagccaccacggagacacccacguggaacagaaaggagcuccuggugaccuucaagaacgcccacgccaagaaacaggaggucgugguucuggggucccaggagggggcgaugcacaccgcccucaccggggcaaccgagauccagaauucaggcgggacauccauuuuugccggccacuuaaaaugccggcuaaagauggacaaacucgaacugaagggcaugucauacgcgauguguaccaacacguucguccugaaaaaggagguauccgagacccagcacgguaccauccucauaaagguggaguacaagggcgaagacguaccuugcaagauacccuucaguaccgaagacgggcgcggcaaggcgcacaauggccggcugaucacggccaaucccgugguaaccaagaaagaggaacccgucaauaucgaggcugagccgccauucggagagagcaacaucgugaucggaaucggggacaacgcgcugaagaucaauugguacaagaagggcuccucaaucgggaagauguucgaggcaaccgcccgcggcgcccggcgaauggccauccugggcgacacggccugggacuucggguccgugggggggguucucaacucacugggaaaaauggugcaucaaaucuucgguuccgcguacacggcccuguucagcggcguguccugggucaugaagaucggaaucggggugcuccugaccuggaucggucuuaauagcaagaacaccucuaugagcuucuccugcaucgccaucgggauaaucacacucuaccugggcgccgugguccaggccgacaugggaugcguaauuaacuggaagggcaaagagcugaagugcggcuccgggaucuuuguaacgaacgagguccacaccuggaccgaacaguacaaguuucaggcggacucccccaagcgcuuagccacggccauugccggggccugggagaacggggugugcggcauucguaguacgacccggauggaaaaccugcuguggaagcagaucgcgaacgagcugaacuacauccuuugggagaacaacauaaagcugaccgugguggugggcgacacaaucggcgugcuggagcagggcaagcggacguugacgccccagccgauggagcugaaauacuccuggaagacuuggggaaaggcgaaaauugucaccgccgagacgcaaaacucauccuucaucauugacggacccaacacccccgagugucccagcgccucccgcgcuuggaacgucugggagguggaggacuacgguuucggggucuucacgaccaacaucuggcucaaacugcgggagguguacacucagcugugcgaccaccgccucaugucugccgccguuaaggacgagagggccguccacgccgacaugggcuacuggaucgagucucagaagaacggguccuggaagcuggagaaggccagccugaucgaggugaaaacgugcaccuggccgaagagucacacccuguggucuaacggcgugcuggaaagcgacaugauaauccccaaaagccucgcaggacccauuucgcagcacaacuaccgcccgggcuaccauacgcagacggcagggcccuggcaccuaggcaaacuggagcuggacuuuaacuauugcgagggcaccaccgucgugaucaccgagaauugcgggacgcgcggucccagccuccguaccaccacaguguccggcaaacucauccacgaguggugcugccggagcugcacgcugcccccccuccgcuacaugggggaggacggguguugguacggcauggaaauccggccgaucuccgagaaggaggaaaacauggucaagucucugguguccgcaggaucugguaaagucgacaacuucaccaugggcguccuaugccucgccauacuuuucgaagagguaaugcgcgggaaguucggcaagaagcacaugaucgcgggggucuucuucaccuucguuuuacuccugucaggccaaauuacguggcgggacauggcccauacccucauuaugaucggcagcaacgccuccgaccgcaugggcaugggagugaccuaccucgcccugauagcgacauucaagauccagccuuuucucgcguugggguucuuucuucggaagcuuacaagccgcgagaacuuacuguugggcgugggccucgccauggccaccacucugcaacugcccgaggacaucgagcagauggcgaaugggaucgcccucgggcucauggcacugaagcucacaacgcaguucgaaacguaccagcucuggaccgcccugaucagccugaccugcucaaacaccaucuucacccugaccgucgcguggcggaccgccacacugauccucgcgggggugagccugcuucccgucugccaguccagcucgaugcgcaagacggauugguugcccaugacaguugcugcuaugggcgugccgccccucccucuguucaucuucagcuugaaggacacgcugaagagacgguccuggcccuuaaaugagggcgucauggccgugggucucguguccauauuggccuccagccugcuccgcaacgacguccccauggcgggcccccuggucgcugggggucugcucaucgccugcuacguuaucaccgggacguccgccgaccugaccgucgagaaagcagcggacgugacaugggaggaggaggcugagcagaccggcguaagccauaaccugaugaucaccgucgacgacgacgggaccaugcguauaaaggacgacgaaaccgagaacauccucaccgugcuccugaagaccgcccuccucaucgugucgggcauuuuccccuauagcaucccggccacgcugcucgucuggcacaccuggcagaagcagacccaacgcuccggcguucugugggacgugcccagcccacccgagacccagaaggccgagcuggaagaaggcgucuaccggaucaagcagcagggcaucuuugggaagacccagguggguguggggguucagaaagaggguguguuccauaccauguggcacguaacccgcggagcaguacucaccuacaacgggaagcggcuggagccgaacugggcguccgugaagaaggacuugauuucuuacgggggcggcuggcggcucuccgcccaguggcagaagggggaggaggugcaggucaucgccguggagcccggaaagaaccccaagaacuuucagaccaugcccggaaccuuucagaccaccacgggcgagauuggcgcuaucgcucuggacuucaagccaggaaccucuggcucacccauaaucaaccgggagggcaagguagucggucuguauggaaacgggguagugaccaagaacggcggguacgugagugguaucgcccaaaccaaugccgagccggacggccccaccccggaacuggaggaagagauguucaagaagaggaaccucacaaucauggaccugcaccccgggucggggaagacccggaaguaucugccggccauugugcgcgaagcgauuaagcggcgccucagaacccugauccuugcccccacuagggugguugccgccgagauggaggaagccuugaaggggcugcccaucagguaccagacaaccgcgaccaaguccgagcacacggguagagagaucguggaccugaugugccaugcgaccuucaccaugagacuccuuuccccagugcgcgucccgaacuacaacuugaucauaauggacgaggcccacuucaccgauccugcaucuaucgccgcucgcggguacaucucaacccgcgucgggaugggcgaggccgccgcuaucuucaugaccgcuaccccgcccgggacagccgaugcguuuccccaguccaacgccccaauccaggacgaagagcgcgacauccccgagcgguccuggaacuccggcaacgaauggaucacugacuucgccgggaagacggugugguuugucccaagcauaaaggcggggaaugauaucgcaaacugccugcgaaagaacgggaagaaggugauccagcugucacggaagaccuucgacaccgaauaccagaagacgaagcugaacgacugggacuucguugucaccaccgauauuagcgagaugggcgccaacuucaaggccgaccgcgugaucgacccgcgacgcugccucaagccggugauccuuaccgacggcccugaacgggucauccuggcggggcccaugcccgugaccgcggccuccgcagcacaacgccggggccgcgugggucggaacccccaaaaagagaacgaccaauacaucuuuacggggcagccccucaacaacgacgaggaccacgcccacuggaccgaggcuaaaaugcuccuagacaauaucaacacccccgagggaaucaucccggcccucuucgagcccgaaagagaaaaguccgccgcgauagacggugaauaccgacugaagggcgaaucccgcaaaaccuuugucgagcucaugcggcgcggggcacuccccguguggcuggcccacaaggucgcgucugaaggcauaaaguacacggaccggaaauggugcuucgacggucagcgcaacaaccaaauccuggaggagaacauggacguggagaucuggaccaaagagggcgaaaaaaagaagcuccggccccgcuggcuggacgcccgcaccuacuccgacccgcuggcccucaaggaguuuaaggauuucgcggccggccgcaagagcaucgcccuggaccuggugaccgagaucgggcgcguccccucccaccucgcccaccgcacgcgaaacgcgcuggacaaucugguuaugcuccacaccagcgaacacggcgggaaagcguauaggcacgccguugaggagcugcccgaaaccauggagacccugcuccugcuggggcucaugauucugcugaccggcggggccauguuauuccugaucagcgggaaggggaucggcaagaccucgaucgggcuaauaugcgugauugccagcuccggcauguuauggauggcagagaucccucuucaguggauugcgagcgccaucgugcuggaguuuuucaugauggugcuacuuauucccgagcccgagaagcagcgcacuccccaggacaaccagcuggcuuacguagugaucgggauccucaccuuagccgccaucauagcggccaaugagaugggcuuacucgaaacgaccaagcgggaccugggcauguccaaggaaccggggguggucagccccaccucuuaucuugacguggacuuacaccccgccagcgccuggacccuuuacgcggucgccacaacugucauuacgcccauguugcgccauaccauagagaacuccacggcaaacgugagccucgccgccauugcaaaccaagcuguggugcuuaugggguuagacaagggguggccgaucuccaaaauggaucuaggggugccccuacuggcccucgggugcuacucccaggugaaucccuuaacccugaccgcggccgugcuccugcugaucacacacuacgcgaucaucgggcccggcuugcaggcuaaggccacgagggaagcucagaaacgcacagccgcggggaucaugaagaacccgaccgucgaugguaucaugacgaucgaucucgaccccguaaucuacgauuccaaguucgagaagcagcuggggcaggucaugcugcugguuuugugcgccgugcagcuccugcucaugaggaccagcugggcucucugcgaagcccugaccuuggcgaccggccccaucaccacgcucugggagggaucccccgggaaauuuuggaacacaaccaucgccguaaguauggccaacaucuuccgcggcuccuaccuugccggggcgggucuggccuucuccaucaugaaauccguagggaccggcaagcggggcaccgguagccagggcgaaacacucggagagaaguggaagaagaagcugaaccagcuaucucgcaaggaguucgaccucuauaagaaauccggcaucacagaaguggaccggaccgaggccaaggagggccuaaagcgcggugagauuacacaccacgccgugucucggggguccgccaagcugcagugguucguggagcgcaacauggugaucccggaggggcgggucaucgauuugggcugcggcagaggcggguggagcuacuacugcgcaggccuaaaaaaggugaccgaggugcggggcuacacgaagggcgggcccgggcacgaggagcccguccccauguccaccuacgguuggaacauugugaagcuaaugagcgggaaagacguguucuaucucccgccagagaagugcgacacccuguugugcgacaucggcgaguccagcccuucccccacggucgaggaaucgcgcacuauccgcguacugaagaugguugagccguggcuuaagaacaaccaguucugcaucaagguccugaacccuuacaugcccacggugaucgagcauuuggagcggcuccaacguaagcacggcgggaugcuggugcggaacccccuuucaaggaacagcacccacgagauguacuggaucuccaacgggacugggaauaucguggcgagcgugaacauggugucccggcuacuucugaaccgcuucaccaugacccaccggcgcccuacuaucgaaaaggauguagaccucggcgccggaacacggcacgugaacgcugagccggagacccccaauauggacgugaucggagaacgcaucaagcggaucaaggaggagcacaacagcaccuggcacuaugaugacgagaacccguacaaaaccugggccuaccacggauccuacgaggucaaggccacgggcucugcguccagcaugaucaacggcguugucaaguuacugaccaaaccgugggacguggugcccauggucacccagauggccaugaccgacaccaccccauucggccaacagcguguguucaaggagaagguggacacacggaccccgcgcagcaugcccggcacgcgacgcgucaugggcaucacugcugaguggcucuggcggacccuggggcgcaacaagaagccccggcugugcacccgcgaggaguucacgaagaaggugcgcacgaacgccgcaaugggcgccguguucaccgaggagaaccagugggacuccgccaaggcugccgucgaggaugaggacuuuuggaagcuaguagaccgggagcgugaacugcacaaacuggggaagugcggcagcugcguguacaacaugaugggaaaacgagagaaaaaacucggcgaauucggcaaagcgaaggggagucgcgccauaugguacauguggcugggcgcccgguacuuggaguucgaagcccucggguuccugaacgaagaccauugguucucccgugaaaacucuuacagcggaguggagggagagggccugcacaagcucggguacauccuacgggacaucuccaaaaucccugguggcgccauguaugcggaugacaccgccgggugggacacccggaucacggaggacgaucuacacaacgaggaaaagauuacccagcagauggacccggaacaccggcagcuagccaacgccaucuucaagcugaccuaccaaaacaaggugguaaagguccagcgccccacccccacaggcaccgugauggacaucauaucgcggaaggaccagcgcggcuccggucaggugggcaccuacgggcugaauacguucacuaacauggaggcucaguugauucggcagauggaaggcgaagggguacuuagcaaggcggaccuggagaacccccaccucccggagaagaagaucacccaguggcuggagaccaaaggcguagagcgucugaagcggauggcaaucucgggggaugauugcguggucaagccgaucgacgacagauucgccaacgcucuccuugcccucaaugacauggggaagguccggaaagacauuccccaguggcagcccagcaagggcuggcacgacuggcagcaggucccguucugcucccaccacuuccacgagcucaucaugaaggacggucgcaagcuggugguucccugccggccccaggacgagcuaauugggagggcacggaucagccagggggccggcuggucccugcgcgagaccgccugccuggggaaggccuacgcacagauguggagcuugauguacuuccaccggagggaccuacgccuggccuccaacgccaucugcagcgccgugcccguccacuggguuccgacgucccggacgacgugguccauacacgcccaccaucaguggaugaccacggaagacaugcugaccgucuggaacagggucuggaucgaggacaaccccuggauggaagacaagacgcccgugacgacgugggagaauguccccuaccucgggaagcgggaggaccaguggugcggcagccuuaucggguuaaccuccagggcgaccugggcccagaacaucccgaccgcgauccaacaggugcggagccuuaucggcaacgaggaguuccucgacuacaugcccuccaugaagagauuccggaaggaggaggagagcgagggggccaucugguga

SEQ ID NO: 25983 - RNA, 9873 nt, Artificial Sequence
  derived and/or modified CDS sequence (opt11) from DENV-3__FJ205871__SS-prME
accucgcuaugcuugaugaugaucuuacccgccgcccuggcuuuccacuugaccagcagggacggggagccccggaugaucguugggaagaacgagcgggggaagucgcugcuguucaagaccgccuccgggaucaacaugugcacccugauugcuauggaucugggagagaugugcgacgauaccgugaccuacaaguguccccacauaaccgagguggagccugaggacauagacugcuggugcaacuuaacuagcaccugggugaccuaugggacguguaaccaggcuggagaacaccgucgggacaagcggagcguagcgcucgcgccacacgucggcauggggcucgacacacgcacucagaccuggaugagcgccgaaggcgccuggcgccaggucgagaagguagagacaugggcacugcgccauccgggguuuaccauccucgcguuguuccuggcccacuacaucggcaccagccucacgcagaaaguggugaucuucauucugcugaugcucgugacgcccagcaugacgaugcgcugcgugggagugggcaaccgcgauuucgucgagggccucucaggugccacgugggucgacgugguccucgagcauggcgggugcguaacuaccauggcuaagaacaaacccacccucgacaucgagcuccaaaagacagaagccacgcagcucgcgacgcuccggaaacuuugcaucgagggaaaaaucacgaauaucacaaccgacagccgcugccccacacagggggaggccgugcuaccugaggaacaagaccagaacuacgucuguaagcacaccuacguagacagggggugggggaauggcugcggccuauucggaaaaggcagccuggugaccugugcaaaguuccagugccuggagcccauugaggguaaaguuguucaguaugaaaaccuuaaauacaccguuauuaucacaguucacaccggggaccagcaccagguugguaacgaaacccagggggucaccgccgagauaacgccccaagcaucuaccaccgaggcgauccucccggaauacggcacuuuagggcuagaaugcucaccgcguacuggccuggacuuuaaugaaaugauccuacucacgaugaagaauaaggccuggauggugcaccggcagugguuuuucgaccugccccugcccuggaccagcggugcaaccaccgaaacgcccaccuggaaucgcaaagaacuacuggugacuuuuaagaacgcccacgccaagaagcaggaagucguggugcuggggucgcaagaaggcgcgaugcacacggcgcuuacgggcgcgaccgaaauccagaacucgggcggcaccuccauauuugcaggccaccugaagugccggcuuaagauggacaaacuggagcuuaaagguaugagcuacgcgaugugcaccaacacguuuguuuuaaagaaagaggugucagagacccaacacgggaccauccuuaucaagguggaguacaaaggcgaagaugucccguguaagauaccuuuuucuacagaagacggccagggcaaggcucacaacgggaggcugauuaccgcuaaccccgucgugacaaagaaagaggagcccgucaacaucgaggcggagccuccguucggugagagcaauaucgugaucgggauuggggacaacgcgcugaagaucaauugguacaaaaaaggcuccagcauugggaagauguuugaagccaccgcccggggcgcccgccggauggccauucugggggacaccgccugggacuucggauccguggguggcguccucaacucucugggcaaaauggugcaccaaaucuucggcuccgccuauacggcuuuauucagcgguguguccuggguaaugaagaucggcaucggagugcuccugaccuggaucggcuuaaacagcaaaaacacaucaaugucauuuaguugcaucgcuauaggaauaaucacgcucuaccugggugccgucguccaggccgacauggggugcguuauuaacuggaagggcaaagagcugaagugcgggagcgguauauuugugacgaacgagguacacacguggaccgagcaguacaaguuucaagccgauucacccaagagguuagcuaccgccaucgcuggggccugggaaaacgggguuugcggcauacgcucaacgacccggauggagaaccuucuguggaaacagaucgcgaaugaacucaacuacauucucugggaaaauaacauaaaguugacgguggucguuggagauacaauuggcgugcucgagcaaggaaaacgcacacugacuccccagccgauggagcugaaguacuccuggaagaccugggggaaagcgaaaaucgucacggccgaaacgcaaaacucuucguucauuaucgauggccccaacacccccgaaugucccagcgccagcagagcguggaaugugugggagguagaagacuacggcuucggaguguucaccaccaacaucuggcucaagcuucgcgaggcguacacccagcuaugugaccaccgacucauguccgccgcggugaaggaugagcgcgccgugcacgcggacaugggguauuggauugagagccagaaaaaugguuccuggaagcuggagaaggcuagccucaucgaagucaagacaugcacuuggcccaagagccauacuuuguggucaaaugguguacuggagucggacaugauaauacccaagagccuggccgggcccaucucccagcacaacuaccggcccggguaucacacccaaacggccgggccauggcaccucgggaaacuggagcuggacuucaacuacugugaaggcacgaccgugguuaucaccgaaaacugugggacgaggggcccuucgcugcggacuaccaccguguccgggaagcucauacaugaauggugcuguagauccugcacgcugccgccccuccgguacaugggcgaagacggcugcugguacggaauggagaucaggcccauuucagagaaggaagagaacauggucaagagcuugguaucggcaggcuccgggaagguagacaacuuuaccaugggagugcuuugccucgcaauccuuuucgaggaggucaugcgggggaaguucgguaagaagcacaugauagccgggguguucuucaccuuugugcugcuacugucagggcaaaucaccuggcgcgacauggcacacacgcugaucaugaucggaagcaaugcuucggaccggaugggcaugggcgugacuuaucucgcucuaaucgcgaccuuuaaaauccaaccauuccuggcccugggguucuuccugcgcaaguuaaccagucgugagaacuuacuacuuggcguuggucucgccauggcuacgacccugcagcugccggaagacaucgagcagauggcuaacgggauugcccucggcuuaauggcccuuaagcucaccacccaauuugagacuuaccagcuguggacugcucugaucucccugacuuguuccaacacaaucuucacauuaaccguggccuggcgcaccgcgacccugauucucgcaggcgucagucugcugccggugugucaauccagcuccaugcgcaagacggacuggcucccaaugacagucgccgccaugggggugccuccccugccucuguucauuuucagccugaaggauacccugaagcggcgcuccuggccccugaacgagggcgugauggcggucggccucgugagcauccuggcgucgagccuacugcggaacgacgugcccauggcuggcccguugguugccgguggccuccucaucgccuguuacgugaucaccgggacgucagccgauuuaaccguggagaaggcagccgacgucaccugggaggaggaggccgagcagacaggcgugucccacaauuuaaugauuaccguggacgacgacgggacgaugcgcauuaaggaugacgagaccgagaacauccuaaccguucugcucaagaccgcccuccucauaguguccggcaucuucccauacagcauucccgccacacugcuaguguggcacacauggcaaaagcagacccagcggagugguguccucugggaugugcccuccccucccgagacacagaaggcggaacuggaagaggggguguaccgcaucaagcagcagggaaucuucggcaaaacacaaguggggguaggaguacagaaggaaggcgucuuccacacgauguggcacgugacccggggcgccguccucacguacaacgggaagcgcuuggagcccaacugggcauccguuaaaaaagaucugauuagcuacggcgggggcuggcgucucagugcgcaauggcagaaaggugaggaaguacaggugaucgccguggaaccggggaagaacccuaagaacuuccagacgaugccgggcacauuccagaccacgacuggagagauuggugcgauugcucuggacuucaagccagggacgagcgggagccccaucaucaaccgugaggggaagguggucgggcuguacggcaacggggucgugacgaagaacggcggguacguauccggaauugcccagacaaacgcugagccagaugggccaacgcccgaguuagaagaggaaauguucaagaaacguaaucucacaauaauggaccugcacccagggagcggcaagacacgaaaauaccugccugcgauuguucgggaggccaucaagaggagacucaggaccuuaauacuggcacccacacguguaguagccgccgaaauggaggaagcgcucaagggacugcccauccguuaucagaccacugccaccaaguccgagcacacgggccgagagaucgucgaccugaugugucaugccacguucacaaugcgccuucugucucccguucgggucccgaauuauaaccugaucaucauggacgaagcccacuucaccgaccccgccuccaucgccgcccgcgguuacauaaguacccggguuggcaugggcgaggccgccgcuaucuuuaugaccgcgacgccgcccggcaccgccgacgccuuuccgcaguccaaugccccgauccaggaugaggagcgugauaucccggagcgcagcuggaacuccggcaacgaguggaucacggacuuugcagggaagaccgugugguucgugcccagcauaaaggccggcaaugacaucgcgaacugccuccgcaagaacgggaagaagguaauccagcugucccgcaagaccuucgacaccgaguaccagaagacgaaacugaacgacugggauuucguagugaccacugacaucagcgagaugggcgcaaacuucaaggcggaccgcgucaucgauccgaggcggugcuugaaacccgugaucuuaaccgacggacccgagcgcgugaucuuagcagggcccaugccggucacugcggcuuccgcugcccagcgacgcggccggguggggcgaaacccacaaaaggaaaacgaccaauacaucuucacgggucagccacucaacaacgacgaggaccacgcccacuggaccgaggccaagaugcugcuggacaacaucaauacccccgaggggauaauaccagcccucuuugaacccgagcgggagaaaagcgccgcgaucgauggggaguauaggcugaagggugaaucccggaagacauuuguggagcuaaugcgccgcggggaccucccaguguggcuggcacacaagguggcuucugagggaaucaaguauacggaccguaaguggugcuucgacggacagagaaacaaccaaauccuagaggagaacauggacgucgagauauggacaaaggagggugagaagaagaaguugcgaccccgcuggcuggacgcccgcaccuauuccgauccacuggcccucaaagaguucaaagacuucgccgccgggcgcaagucgauugcgcucgaccuggugaccgagaucgggcgagugcccucccaccuugcccaucgcacucggaaugccuuggacaaucuggucaugcugcauacgucugagcacggcggaaaggcguaccgacacgcaguagaggaauugccagagaccauggagacucugcuucuguugggucucaugauucugcuaaccggcggggccaugcucuuccugauaagcgggaaggggauuggaaagacuuccaucggacugaucugcguuaucgccagcuccggcauguuguggauggccgaaaucccgcugcaauggaucgcgucugcgaucguccuggaauucuuuaugauggugcugcucauccccgaacccgagaagcagcggacgccacaggacaaucagcuagcuuacguugucauagggauuuugacccuggcggcuaucaucgcggccaaugagauggggcugcucgagacgaccaagcgcgauuuaggaauguccaaagaacccggcguggugucucccacuaguuaucuggacgucgaccuccacccugccucugccuggacgcuguacgcgguggccacgaccguuaucaccccgauguuacgccauaccaucgaaaacuccacggcgaaugucucguuggccgccauagcgaaucaagccgucguucuuaugggacuggacaaggguuggccgaucuccaagauggaucucggcgucccccugcuggcacuaggguguuacucacaggugaauccccugacucugacggcggcugucuuacuacugauaacccacuacgcuaucaucggaccuggcuuacaggcgaaggcuacgcgcgaagcccagaagcggaccgccgcggguaucaugaaaaacccgacugucgacggcaucaugaccauagaccuggaccccgucaucuaugacuccaaguucgaaaaacaacucggccaagugaugcuccuuguacugugugccguccaacuccugcuuaugcggacgagcugggcacucugcgaggccuuaacccuggcaaccggccccaucaccacgcucugggaggggucccccggcaaguucuggaacacgaccaucgcgguguccauggcuaacaucuuucgcggcuccuacuuagcgggugccggccucgcguuuagcaucaugaaguccgucgggaccgguaagcgcggcacggguucucagggcgagacacucggcgagaaguggaagaaaaaacugaaccaauugagccggaaggaguucgaccucuauaaaaaauccggcaucacagaaguugaccgcacugaggccaaggagggauugaagcggggcgagaucacccaccacgccguuagccguggaucggccaaacuccagugguuuguggaacggaauauggugaucccggaggggcgcguaauugaccucggcugugggcgaggaggguggagcuacuacugcgccggguugaaaaagguaaccgagguacgcggauauacuaaggggggaccggggcacgaggagcccguucccauguccaccuacggcuggaacaucgucaagcugaugucagggaaggacguuuucuacuugccucccgagaagugcgacacccugcugugugacaucggcgaguccagccccucgcccacggucgaggaaagucggacuaucaggguccugaaaaugguagaaccguggcucaagaacaaccaauucugcaucaaaguucuaaacccuuacaugccgaccgucauagaacaccuggaacgccugcagcggaagcacggcggcaugcugguccgcaauccccucuccagaaacagcacccacgagauguacuggaucagcaacgguacggggaauauuguugcgagcguaaacaugguguccagacuccuucuaaaccgcuucacgaugacccacagacggccuaccaucgaaaaagacguagaucucggugcagggacgcgucacgucaaugcugagcccgaaacccccaacauggacgugaucggggagcguaucaagcgcaucaaggaggagcacaacagcaccuggcacuacgacgacgagaacccguacaagacuugggccuaccauggaagcuaugaagucaaggccacagggagcgccuccagcaugaucaacggcguugugaagcuucuuaccaagcccugggaugucgugcccaugguuacccagauggccaugaccgacacgacuccguuugggcaacagagggucuucaaggagaagguagacacccgcaccccgaggagcaugcccggcacuagacgcgugauggggaucacagcagaaugguuguggcgcacucuggggcggaacaaaaagccuagacuguguacacgagaggaguuuacgaaaaaagugcggacgaaugcggcgaugggagccguuuucacggaggaaaaucagugggacagcgccaaggccgccguggaggacgaagauuucuggaagcuugucgaccgggagcgagaacugcacaaauuggggaaaugcggcagcugcgucuacaauaugauggguaaacgagagaagaaacuuggcgaguucggcaaggcaaaaggauccagagcuauuugguacauguggcuaggcgcccgcuaucuugaguucgaagcacucggguuuuuaaacgaggaccacugguuuagccgggagaacuccuauagcgggguggagggggaaggccugcacaagcucggcuacauacugcgugacauuaguaaaauucccggcggagccauguacgcugacgauaccgcugguugggauacgcgcauuaccgaggacgauuugcacaacgaggagaagauuacacaacaaauggacccagagcaccgccagcuugccaacgccaucuuuaaacugacuuaccagaacaaggucgugaaagugcagcggcccacacccacgggcaccgucauggacauuaucagccgcaaggaucagcgggggaguggccaggugggcacauacggguuaaacacuuucacuaacauggaggcccaacucauccgccagauggagggcgaagggguacuguccaaagcugaucuagagaacccccaccugccggaaaagaagaucacccaguggcucgagaccaaaggggucgagcgacugaagcgcauggccauuuccggugacgauugcguggugaaaccgaucgaugaccgguuugccaacgcccuccuggcauuaaacgacauggggaagguaaggaaggacauaccgcaguggcaacccagcaagggcuggcacgacuggcagcaggucccguuuuguagccaccacuuucaugagcuaaucaugaaggauggucggaagcuggugguccccugccgcccccaggaugagcucauuggccgggcccgcauuagccagggggcggguuggucccucagggagaccgcaugccugggcaaagccuacgcacagauguggagccugauguacuuucaucgcagggaccuccgccuggccuccaacgccauuugcagugcugugcccguucacugggucccgacaucccguaccacauggucgauccacgcgcaccaucaauggaugacaacggaagacaugcuaaccguguggaaccggguuuggaucgaagacaacccguggauggaagacaagacucccgucacgaccugggagaacgugccguaccuggggaagcgcgaggaccagugguguggcagccugauaggauuaacuucccgggccacaugggcccagaacaucccgacugccauccagcaggucagaagccucaucggcaaugaggaguuccuggauuacaugccuuccaugaagcgauuucguaaagaggaagagagcgagggggcuauaugguag

SEQ ID NO: 25984 - RNA, 9873 nt, Artificial Sequence
  derived and/or modified CDS sequence (opt11) from DENV-3__FJ390375__SS-prME
accucccugugcuugaugaugauccuaccggccgcccuggcguuccaccuaaccagccgugacggcgagccccguaugaucguggggaagaaugaacggggcaagagccuguuguucaagaccgccagcgggaucaacaugugcacccucaucgccauggaccugggggagaugugcgacgacacggucaccuauaagugcccccacaucacggagguggagccggaggacaucgauugcuggugcaaucugacgucaaccugggucaccuacgggacgugcaaccaggccggugagcacagacgggauaagcggucagucgcccucgcgccccacgugggaaugggguuggacacccgcacucagaccuggaugucugccgaaggcgcguggcgccagguggagaaggucgaaacgugggcccuucgccauccgggguuuaccauccucgcgcuauuucuggcccacuauaucggcaccucccucacccagaaggugguuaucuucauacugcugauguuagucacacccuccaugacuaugcggugcgugggggugggcaaucgcgauuucgucgagggucuguccggggcgacuuggguugacgugguccuagagcacggcgggugcguaaccacgauggcgaagaacaagcccacacucgauauagaacugcagaagacagaagccacccaacuggcgacgcugcggaagcugugcaucgaggggaagaucacgaacaucacgacagacagccgcugucccacgcaaggugaggccgugcucccggaggaacaggaucagaauuacgucuguaagcacaccuacguggacaggggguggggcaaugggugcggccuauucgguaaggguucgcuggugaccugugccaaguuccaaugccuggagcccaucgaggggaaagucgugcaguacgaaaaccugaaguacaccgugauuauaacgguccacaccggcgaccagcaccagguuggcaaugaaacccagggggucaccgccgagauaacgccccaagccagcaccaccgaggcgauccucccggaauauggcacccuggggcuggagugcuccccgcgcaccggccuggacuucaaugaaaugauccugcucacgaugaaaaauaaggccuggauggugcaccggcagugguucuucgaccugccccugcccuggacaagcggcgccacaacagagacuccaaccuggaaucgcaaggaacuacugguaaccuucaagaacgcacacgcaaaaaagcaggaggucgugguucuggggucacaggagggcgcgaugcauacggcgcucacgggggccaccgagauccaaaacaguggcgggaccuccaucuucgcaggccaucugaagugccgguuaaagauggacaagcucgaacugaagggcaugagcuacgccaugugcacaaacacguucguccugaagaaagaggucagugaaacacagcacgggaccauccucaucaaggucgaguacaagggggaggacgucccgugcaagauccccuuuaguaccgaagacgggcagggcaaagcgcacaacggccgucugaucacagccaacccuguagugaccaagaaagaggaaccagucaacaucgaggcugagccgcccuuuggggagagcaacaucgugaucgggaucggggacaacgcgcuaaagaucaacugguacaaaaagggcuccucgauaggaaaaauguucgaggcuaccgcccggggcgcccgcagaauggccauucugggcgacaccgcaugggacuucggguccgugggcgggguccucaacaguuuaggcaagauggugcaccagauauucggguccgcauauaccgcccuuuucuccggcguauccugggucaugaagaucggaaucgggguccuccugaccuggaucggccugaacuccaaaaacaccuccaugagcuuuuccuguauugcaauaggaaucaucacccuauaucuuggcgccguaguccaggccgacauggggugcgugaucaauuggaaagguaaggagcuaaagugugggucagggaucuucguaacgaacgagguccauaccuggacggagcaguacaaauuccaggcggauucccccaagcgccuagccacugcgauugcuggcgccugggagaacgggguuugcggaauacgcaguacaacccgaauggagaaccugcucuggaagcagaucgcgaacgagcucaacuacauccugugggagaacaacaucaagcugacagugguagugggggacaccaucggggugcuugagcaaggcaagcgcacgcugacaccccagccgauggagcugaaguacuccuggaagacguggggaaaggcgaagauagucaccgcggagacucaaaauagcuccuucaucaucgacggccccaacacccccgagugcccguccgcaagucgggcguggaacguuugggaaguggaggacuauggguucggcguuuucaccaccaacauuuggcucaagcugcgcgagguguauacccagcugugugaccaccggcucaugagcgcagccgugaaggacgagagagccguccacgccgauaugggcuacuggaucgagagccagaagaauggguccuggaagcuugaaaaggcuagccugaucgaagugaagacgugcacauggccgaagagccacacgcucuggagcaacggugugcuggaguccgacaugaucauucccaaaucgcuagccgggcccaucucccagcauaacuaccggccgggcuaccacacgcagacggccgggcccuggcacuuagggaagcuggagcuggauuucaacuacugugagggcacaaccgucgugauuaccgagaacugcgggacgcgcgguccuucacuccguaccaccaccguguccgggaagcugauccaugagugguguugccggucuuguacgcugcccccgcuccgguacaugggagaggacgguugcugguacggaauggagauucgaccuauauccgagaaggaggagaacauggucaagagccugguguccgccggaagcgggaagguugacaacuuuaccaugggcguccucugccucgccauacuguucgaggaggugaugagggggaaguucgguaagaagcacaugaucgcggggguguucuucacauucguccugcuccuauccggccagaucaccuggagagauauggcccacacgcugaucaugaucgguucgaaugccucugaucggauggggaugggcgugaccuaucucgccuugaucgccacuuucaagauccagcccuuccuggcgcuuggguucuuccugcgcaaauugacgucaagggagaaccuccuguugggcgugggccucgccauggccacgacgcugcagcuucccgaggacaucgagcagauggccaacgguauugcgcucggccugauggccuugaagcucaccacucaguucgagacguaccagcuguggacugcucugaucagccugacaugcuccaauacaaucuucacgcugacggucgccuggcggaccgccacccugauucucgcgggggugagcuugcugccagugugucagaguagcucaaugcggaaaacggacuggcuccccaugaccguggccgcuaugggcgugccacccuuaccguuguuuaucuucagccucaaagacacccugaagcgacgcuccuggccccugaacgagggcgucauggccgugggccucgugagcauccuggccuccagccugcuccggaacgauguccccauggcgggcccgcugguggccggaggccugcucaucgccugcuacgugaucaccgggacguccgccgacuugaccguagagaaggccgcggaugugaccugggaggaggaggccgagcagacuggcgugucacacaaccugaugaucacugucgacgacgacggaacgaugcgcaucaaggaugacgagaccgagaacaucuugaccguucugcugaagaccgcccucuuaauaguaaguggcaucuuuccuuacagcauucccgccacacuguuggucuggcauaccuggcagaagcagacccagcgguccggcgugcugugggacgugcccagcccgcccgagacucagaaagcagagcuagaggagggggucuaccgcaucaagcagcagggcaucuucgggaagacccagguuggcguggggguacagaaggagggcguguuccacaccauguggcacguaaccaggggcgcgguacucacguacaacgggaagcgcuuggaacccaacugggccaguguaaagaaagacuuaauuagcuauggcgggggauggcgacucuccgcccaguggcagaagggggaagaggugcaggucaucgccguggagcccggcaagaacccgaaaaacuuccagacgaugccgggcaccuuccaaacuaccacaggggagaucggcgcgaucgcccuggacuucaagcccgggacuagcggcagccccaucauuaaccgugagggcaagguggucggucuguacggcaacggggugguuaccaagaacggcggguacgucuccggcauugcgcagaccaacgccgagccggauggcccuacgccugagcucgaagaggagauguucaagaagcguaaccucacaaucauggaucugcaccccggguccggcaagacccgcaaguaccugcccgcuaucgugcgagaggcgaucaagcgccgucuucguacccugauucuugcccccacccggguggucgcggccgagauggaggaagcguuaaagggacugccaauccgcuaccagacgaccgcgaccaaauccgagcacacgggccgggagauuguggaccugaugugccacgccacauucacuaugcgccuccugagccccgugcgggucccgaacuacaacuuaauuaucauggaugaagcccacuucaccgaucccgcguccaucgcagcgcgcggguauaucagcacucgggugggcaugggcgaggcggccgccaucuucaugaccgcuacgccacccgggaccgccgaugccuucccgcaguccaaugcccccauacaggacgaggagcgcgauaucccggagcguagcuggaacuccggaaacgaguggauuacggauuucgccgggaagaccgugugguuugucccuagcaucaaggcgggaaaugacauugccaacugucuccggaagaacgggaagaaggugauacagcucuccaggaagaccuuugacacggaguaccagaaaacgaaacugaacgacugggauuucguggucaccacggacaucagcgagaugggcgccaauuucaaagccgaccgaguuauagacccgcgccgcugcuuaaaacccgugauccugaccgacggccccgagcgcgucauccuagcggggccgaugccggugaccgcggcauccgccgcccagcggcgcggacggguggggcgcaacccgcagaaagagaacgaccaguacaucuucacgggccagccccucaauaacgacgaggaccacgcucacuggaccgaggcgaagaugcuauuggacaacauaaacacucccgaggggaucaucccggcauuauucgaacccgagcgggaaaaguccgccgccaucgacggcgaguaccgcuuaaagggcgagagccgcaagacguuugucgaacucaugcgccgcggagaccucccaguguggcuggcgcacaaggucgccagcgagggcaucaaauacaccgaccgcaagugguguuucgacggacagcguaauaaccagauacuagaggaaaacauggacguugaaaucuggaccaaagagggugagaagaagaagcucagaccccgguggcuugacgcgcgcacuuacuccgacccgcuagcacucaaagaguucaaggacuucgcagcuggccgcaagucgaucgcacuggaccuggugaccgagaucggcagaguccccagccaccuagcacaccgcacccggaacgcccuugauaaccuaguuauguuacauacuucagagcacggagggaaagccuacagacacgcuguggaggagcugcccgagaccauggagacccugcuccuucugggcuugaugauccugcugacaggcggugccaugcuguuccugaucagcgggaaggggaucggcaagaccuccaucgggcugaucugcgucaucgcgagcucggguaugcucuggauggccgagaucccgcugcaauggaucgccagcgcgaucguucuggaguucuuuaugauggugcuccugauccccgaacccgagaagcagcggacuccgcaggacaaccagcuggcauacgucguaaucgggauacucacccuggccgccaucaucgccgccaacgagauggggcugcucgagacgaccaagcgagaucugggcauguccaaggagccggggguggucagccccaccuccuaucuggauguggaccuccaccccgccucugccuggacccuguacgccguggcgacgaccgugaucacaccaaugcugcgacacaccauagagaacuccacggccaacgugucccucgcugcuaucgccaaccaggcgguggugcugaugggccuugacaagggguggccgauuucgaaaauggacuugggggugccccugcuggcccucggcugcuacagccaggugaacccccugacacugacagcggccguccuauuacugauaacccacuacgccaucaucggcccaggccuacaggcgaaagccacgcgcgaggcccaaaaacguacagccgccgggauuaugaagaacccgaccguggacggcaucaugacaaucgaucuagaccccgucaucuacgacuccaaguucgagaagcagcuggggcaggucaugcuucuggugcuaugcgcagugcagcugcugcugaugaggacgagcugggcucucugcgaggcccugacgcuggcaacuggccccauaaccacgcucugggagggcucccccgggaaguucuggaacaccacaauagcggucagcauggccaacaucuuccgggggaguuaccuggcaggagccggccuggcguucuccaucaugaagucaguggggaccgguaagcgcggcacggggagccagggagaaacgcucggggagaaauggaaaaagaagcugaaccagcugagccgcaaggaguucgaccucuacaaaaaguccggcaucacugagguggaccgcacagaggcgaaggaggggcugaagcggggcgagaucacccaccacgcggugagcagaggcuccgccaaacuacagugguucguagagcggaacauggugaucccggaggggcgagucaucgaccugggcugcgggcggggcgguuggagcuacuauugcgccggccugaagaaggugacggagguacgcggcuacaccaagggagggcccggacacgaggagcccgugcccauguccaccuacggauggaauaucgugaagcugauguccgggaaagacgucuucuaccucccaccagagaagugcgacacccuguugugcgacauaggcgagucaucgcccucgccaacggucgaagagagccggaccaucaggguacugaagaugguggaacccuggcucaagaacaaccaguucugcaucaaagugcugaacccguacaugcccacugugaucgagcaccuagagcgccuccagcggaagcacggcggaaugcuaguacgcaauccccuguccaggaacuccacccacgagauguacuggaucuccaacgggacggggaacaucgucgccagcgugaacauggugucccgccuucugcugaaccgguucaccaugacccauaggcggccgacgaucgagaaggaugucgaucucggugcgggcacgcgccacgucaacgcagagcccgagacccccaacauggacgugaucggggagcggaucaagcgcaucaaggaggagcacaacagcaccuggcacuacgacgacgagaacccguacaagacgugggcguaccacggcaguuacgaggucaaagcaacggggucggccucaagcaugaucaacgggguggucaagcucuuaaccaaacccugggauguggugccgauggucacgcagauggcgaugacggacacgacccccuucggccagcagcguguguucaaagagaagguggacacucgcaccccgcgguccaugcccggcacgcgacgggucauggggaucaccgccgagugguuauggcgcacccuggggcggaauaagaagccccgccuguguaccagggaggaguucacgaagaagguuagaacuaacgccgcuaugggugcaguauucaccgaagaaaaccagugggacuccgcaaaggcggccgucgaagacgaggacuucuggaagcucguggaccgcgaacgggagcuccacaaacuggggaagugcggcucuuguguguacaacaugauggggaagcgcgagaagaaacucggagaguucggcaaagccaaggggucccgggcuaucugguacaugugguugggcgcccgcuaccuggaguuugaggcccucggguuccuaaacgaggaccacugguucucccgagaaaacucauacagcggcgucgagggggaggggcugcacaagcuuggauacauccugcgcgacauuucuaagauccccgggggcgccauguaugccgacgauaccgcggggugggacacgcguaucaccgaggacgaccuacacaacgaggagaagaucacccagcagauggacccugagcaccgacagcucgccaacgccaucuucaagcugaccuaccagaauaagguggugaaaguccagcggcccacccccacgggcaccgugauggacaucauuagucgcaaggaccagcggggcuccggccagguuggcaccuacgggcugaacaccuucacgaacauggaggcccaacucauuaggcagauggagggagaagggguccuguccaaagccgaucuggaaaacccccaccucccggagaagaagaucacccaauggcuggaaaccaaaggcguggagaggcugaaaaggauggcuaucuccggcgacgacugcguggucaagcccaucgaugaccgguucgcaaacgcccuccuggcccucaacgacauggggaaggugcguaaagauauuccccaguggcaacccuccaagggauggcaugacuggcagcaggucccuuucugcucccaccauuuccacgagcucaucaugaaggacggucggaaacuggucguuccgugccgcccccaggacgagcugaucggccgcgcccgcaucucucagggggcgggcuggucccuccgggaaaccgcuugccugggcaaggccuacgcccaaauguggagccugauguacuuucaccgacgcgaccuacggcuggcgucgaacgccaucugcagcgcuguuccaguccacuggguuccgacgucccgcaccacauggucuauccacgcccaccaccaguggaugaccacggaggauaugcugacggucuggaaccgugucuggaucgaggacaaucccuggauggaggacaagacccccguaaccacgugggaaaacgugcccuauuuggggaagcgcgaagaccaguggugcgggagccuaaucgggcugaccucgcgagccacgugggcgcagaacaucccgaccgcgauccaacaggugcgaagccucaucgguaacgaagaguucuuggacuacaugccauccaugaagcgguuccgcaaggaggaggagagcgaaggggccaucugguag

SEQ ID NO: 25985 - RNA, 9873 nt, Artificial Sequence
  derived and/or modified CDS sequence (opt11) from DENV-3__FJ390376__SS-prME
accagcuuaugccuaaugaugauccuucccgccgccuuagcguuccaccuaaccagccgcgacggugagccacggaugauaguggggaagaacgagcggggcaaaucgcuucuguuuaagaccgcauccgguaucaacaugugcaccuuaauagccauggaccugggcgagaugugcgacgacaccgugaccuauaaaugcccccauaucaccgagguggagcccgaggacauugacuguuggugcaacuugaccagcaccugggugaccuacgggacgugcaaccaggccggugaacaccgccgcgacaagagguccgucgcccucgcgccgcacguugguauggggcuggacacacgcacccagaccuggaugucugccgagggugccuggcgucaagucgaaaaagucgaaacgugggcccugcgccacccgggguucaccauccucgcgcuguuccuggcucacuacaucggcaccucccucacccagaaggucgugauuuucacgcuccugaugcuagucacccccagcaugaccaugagaugcgucggugucggcaaccgugauuucgucgagggacuguccggcgccaccuggguagaugugguccuggagcacggagguugugugacgacuauggccaagaacaagcccacgcucgacauagagcugcaaaagacggaggccacgcaguuggcuacacugcggaaacugugcaucgagggcaagaucaccaacaucaccacggacagccguugccccacucagggcgaggcuguguuaccagaggaacaggaccaaaacuacgucugcaaacacacguacgucgaccggggcuggggcaacgggugcggccucuuugggaagggcucucuggugaccugcgcuaaguuccagugccuggagcccaucgagggcaaggucguucaguacgagaaccuaaaguacacggugauuauaaccguccacacuggggaccagcaucaggugggcaaugagacccaggggguuacggccgagauaaccccccaggcgagcaccaccgaggcaauccugccagaguauggcacccucgggcucgagugcuccccgcguacaggccuugauuuuaacgagaugauccuacucaccaugaagaacaaggcauggauggugcaccggcagugguucuuugaccugccauugcccuggacaucuggcgcuaccacggaaacgcccaccuggaaucgcaaggagcucuuggucacauucaagaaugcucacgccaagaagcaggaaguaguggugcuggggucccaggagggggccaugcacacagcccugacaggugcgaccgagauccaaaacagcggcgggaccucaaucuucgcugggcaccuaaagugccggcugaagauggacaaacucgaacugaaggguaugagcuaugcuaugugcacgaacaccuuuguacugaagaaggagguuucggaaacucagcacgggacuauccucaucaagguggaguacaagggcgaggacgucccaugcaaaauccccuucagcacugaggauggccaggguaaggcgcacaacggucgccucauuaccgccaacccuguggugaccaagaaggaggagccuguuaacauagaggcagaaccgccauucggggaaagcaacauugucauuggcaucggggauaacgcccucaagaucaacugguacaagaagggcucaucgauaggaaaaauguucgaggccaccgcccggggugccagaaggauggccauccugggagacacggccugggacuucggguccgucggcggcguccucaacagccuggguaaaaugguucaccagauauucggguccgcguacaccgcuuuguucagcggcguguccugggucaugaagauuggcaucggggugcuccugaccuggauugguuuaaacuccaagaacacauccaugagcuuuuccugcaucgccauuggcaucaucacuuuauaucugggcgccgugguccaggccgauaugggcugcgugaucaacuggaagggaaaggagcugaagugcggaagcgggaucuucgugaccaacgaaguccacacuuggacugagcaauacaaauuccaggcggacucgcccaagcggcucgccacagccaucgccggcgccugggagaacgggguguguggaauccgaagcacaacccggauggagaacuugcuguggaagcagauagcgaacgagcucaauuauauccuuugggagaacaacaucaagcugacuguugucgugggggacauuauaggcguccuugagcagggcaagcgcacguuaacgccccagccgauggagcugaaguacaguuggaagacaugggggaaggccaaaaucgugacugccgagacucagaacaguagcuucaucaucgauggccccaacacccccgaaugccccucugccuccagagcguggaacgugugggaaguugaggacuacggauucggcgucuuuaccacuaacaucugguuaaagcugcgggagguguacacacagcugugcgaucaccggcuuaugagcgccgccguaaaggacgagcgagccguccaugcugacaugggcuacuggauugagagccagaagaacgggaguuggaaacucgagaaagcgucacugaucgaagugaagacgugcaccuggcccaaaucucacacccucuggucgaacggugugcuggaaagugacaugaucauccccaaaagccucgcugguccaaucucccagcauaacuaccgaccgggcuaccacacccagacggccggucccuggcaucuuggcaaguuggagcuggacuucaacuacugcgaagggaccacagucgugaucaccgagaacugugguacgcgcggcccaagccuccggacaaccaccguguccggaaagcugauucaugaauggugcugccgcagcuguacgcuaccgccacuccgauauaugggcgaggaugggugcugguacggcauggagauccgccccaucuccgagcgggaagagaauauggucaagagccugguguccgccgguuccggcaagguggacaacuucaccaugggcguucugugcuuggccauccuguuugaagaggugaugcgggggaaauuuggcaagaagcacaugaucgcugggguguucuucaccuucgucuuauuacuauccgggcaaauuauuuggagggacauggcccacacccugauaaugaucgggagcaaugccucggaccgcauggggaugggcguaacuuaucucgcucuuauagccaccuuuaaaauacagcccuuccuggcacuuggguucuuccugcgaaagcuaaccucgcgagagaaucuccuacugggcgucggccuagcuauggccaccacgcuccaacuucccgaggacaucgaacaaauggcaaacgggauagcgcucggccugauggcccugaagcuaaucacgcaguuugagaccuaccagcuguggaccgcgcuaaucagccucacgugcuccaauacuauauucacgcuuacggucgcauggcggacggccacccugauccucgcgggagugagccuguuaccgguaugccaguccagcucgaugcgcaagaccgacuggcuccccaugaccguggcugcuauggggguaccgccgcucccgcuguuuaucuuuucuuugaaggacacgcugaagcgccguuccuggccccugaacgaagggguuauggccgugggccucgugagcauccuggccucaagccugcuccgcaacgacguccccauggcggguccccugguagccggcggcuugcucaucgccugcuacguaaucaccgggaccucggccgaccugaccgucgagaaggccgcugacgugacgugggaggaggaagcugaacagaccggcguuucccauaaccugaugaucaccgucgacgacgacgggaccaugcgaaucaaagacgacgagacggagaauauacucacgguccugcuaaagaccgcccuccugauuguaagcggcaucuucccguauuccauccccgccacacuucucgucuggcacaccuggcaaaaacagacgcagcgcuccggcgugcugugggacgugcccuccccgccggagacacagaaggcugagcuggaggaggguguauaccggaucaaacagcagggaaucuuugggaagacccagguaggaguggggguccagaaggagggcguauuccacaccauguggcauguaacgcguggcgcaguccuaaccuauaacgggaagcgccuggaaccaaacugggcauccgugaagaaggauuugaucucauacggaggcggguggcgucucuccgcccaguggcaaaagggggaggaggugcaggucaucgcuguugagcccggcaagaacccaaagaacuuccagaccaugccgggcacauuccagacuaccaccggcgagaucggggcgauagcccuagauuucaagcccgggacgagcggcagccccauaaucaaccgggaaggcaagguggucgggcuguacggaaacggcguggugacgaaaaacggcggguacgucuccggcaucgcccagacuaacgcagagccggacggucccacacccgaauuagaggaggagauguucaagaagcgcaaccuuaccaucauggaucugcaucccggcucuggcaagacgcguaaguaccugccggccaucgugcgcgaggcgaucaaacggcgccuucgcacccucauccuggcccccacuagggucgucgccgccgagauggaggaagcccuaaaggggcugccuauccgguaccagaccacggcgacgaagucagagcacacgggacgugagauaguggaucugaugugccaugccaccuuuacgaugcggcuacucagcccggugcguguaccgaauuacaaccucauuaucauggaugaggcgcacuucaccgaccccgccagcauugcugcacgcggcuacauuagcacccgcguuggaaugggcgaggccgcagcaaucuucaugacagcaacgcccccugggaccgccgacgcguucccgcagucaaacgcccccauccaggacgaggaacgcgacauccccgaacggagcuggaacuccggcaacgaguggaucaccgacuucgccgggaagacgguuugguuuguccccagcaucaaggcaggcaacgauauagcgaacugccuccgcaagaacgggaaaaaggugauucagcugucucgcaagacauucgacacugaguaucagaagacaaaacucaacgacugggacuucguggucaccacagacaucagcgagaugggcgccaacuucaaggcagaccgcguuaucgacccgcggcgaugccugaagcccgugauucucaccgacgguccugagcgagucauccuagccgggcccaugccugugaccgcggccucggccgcccagcgccggggucgcgucgggcggaacccccagaaggagaacgaccaguacaucuuuaccggccagccacugaacaacgacgaggaccacgcccacuggaccgaagcgaaaaugcuucuggacaacaucaacacccccgagggaauuaucccugcucucuuugaaccggagcgcgagaaguccgcagccauugauggugaauaccgccugaagggcgagucccgcaagaccuucgucgaacucaugcggcgcggggaccuccccguauggcuggcgcacaaggucgccagcgaggguaucaaguacaccgaucguaaguggugcuucgacgggcagaggaauaaccagauccuggaagagaacauggauguagagaucuggaccaaggaaggcgagaagaaaaaacuccggccccgaugguuggaugcgcgcacauacuccgacccgcucgcccucaaagaguucaaagacuucgccgcgggccgcaaaagcaucgcccuggaccuggugacggagaucgggcgcgucccaucccaucucgcccacagaacccgcaacgcgcuggacaaucuggugaugcuucacaccagcgagcacggcgggaaggccuaccggcacgcgguggaggagcugccugagacgauggagacccugcuccuucuggggcucaugauccuccuaaccggcggagccaugcuguuccugaucuccggcaaagggaucggcaagaccucaauugguuuaaucugcgucauugccagcucggguaugcucuggauggccgaaaucccccugcaguggaucgcaagcgcaaucgugcuggaguucuuuaugauggugcuccugauccccgagccagagaagcagcgcacgccccaggacaaccaguuagccuacguagugaucgguauccucacacuugcugcuaucaucgccgcgaacgagaugggccuguuagaaaccacuaagcgagaccuggggauguccaaggagccgggggucgucucaccgacguccuaccuggacguggaccuccaccccgcgagcgcguggacccuguaugccguggcaacgaccgucaucacgcccaugcugcgccacacaaucgaaaacagcaccgccaacgugucacucgcagccauagccaaccaggcuguggucuugaugggucuggauaaggguuggccgauauccaagauggaccuaggcguaccacugcuggccuuaggguguuacagccaggugaacccucugacccugacggccgccguacuccuuuuaaucacacacuacgccaucaucggccccggccuccaggcgaaagcuacccgggaggcccaaaagcguacggccgccgggaucaugaagaauccgacggucgauggaaucaugacgauugaccuggaucccguaauauacgauucgaaguucgaaaagcaguugggccaggucaugcuacuagugcugugcgcuguacagcugcuguugaugcggaccucgugggcccucugcgaggcccuuacguuagccacgggccccaucacaacccucugggagggcucccccgguaaauucuggaacaccacgaucgcggugucaauggccaauaucuuccgcggcagcuaccuggccggggccgguuuagccuucagcauuaugaaguccguggggaccgggaaaagaggcaccggcucccagggcgagacccucggcgagaaguggaaaaagaaauugaaccagcugagccgcaaggaguucgaccuuuauaagaaguccggcauuacagagguggaccggacggaggcgaaggaggggcugaagcgcggcgagaucacucaccacgccgucucgcggggcuccgccaagcugcagugguucguugagcgcaauauggugaucccggaggggcgcgucaucgaucucggaugcgggcgcggcggguggagcuauuacugcgccggccugaagaaggucacagagguccgcggauacaccaagggugggccagggcacgaagagcccguccccaugaguacguacggcuggaacaucgucaaauuaaugagcggaaaggauguuuucuacuugccgccugagaagugugacacucugcugugugacaucggggaguccagccccagcccuaccgucgaggagagccgcaccaucagggugcugaagaugguugagccguggcucaagaacaaccaauucugcaucaagguacucaacccguacaugcccacggugauagagcaccuggagcggcuccagcguaagcacggagggaugcugguccgaaauccccuguccagaaacagcacccacgagauguacuggauuuccaacgguacuggcaacaucgucgcaagcgucaacauggugagucgucuccugcugaaccgcuucaccaugacgcacagacgccccaccauugagaaggacguugaccucggggcgggcacccggcacgucaacgccgaaccagagacccccaacauggaugugaucggugagcguaucaagcggauuaaggaagagcacaacucgaccuggcauuacgacgacgagaaucccuacaagaccugggcuuaccauggguccuacgaaguuaaggccaccgguagcgccagcucaaugauaaauggcguugucaagcugcugaccaagcccugggacgugguuccgaugguuacgcagauggccaugaccgacaccaccccauucggucagcaacggguguucaaggagaagguggacacgcggacaccgcgcagcaugcccggcacucggcgcgucaugggaaucaccgccgaguggcuuuggcgaacgcuggggcggaacaaaaaaccccgucugugcacccgcgaggaguucaccaagaaggugcgaaccaacgcagcgaugggcgcgguguuuaccgaggaaaaccagugggacuccgccaaggccgccgucgaggacgaagacuuuuggaagcucguggaccgggagcgagagcugcacaagcugggcaagugcggcagcugcguguacaacaugauggggaagcgugaaaagaagcugggcgaguucggaaaggcuaagggaucccgagcgaucugguacaugugguuaggcgcccgcuaucucgaguucgaagcccucggguuccugaacgaggaccacugguuuagccgcgagaacagcuacaguggcguggaaggugagggucugcacaaguuaggcuacauccuucgggauaucuccaagaucccagguggcgcuauguacgccgacgacaccgcggggugggacacgcgcaucaccgaggacgaccugcacaacgaggagaagaucacgcagcagauggacccggagcaccggcagcucgccaacgccauuuucaaguugacguaccaaaacaaaguggucaaggugcaacgcccuaccccuaccggcaccgugauggauauuaucucucggaaggaucagagaggaucuggucagguggguacguaugggcugaacaccuucaccaacauggaagcccaacucaucagacagauggaaggcgaggggguccugagcaaggccgacuuggagaacccucaucucccagagaaaaagaucacccaguggcucgagacgaaggggguggagcgccugaagcggauggcgaucuccggcgaugacugcguggucaagccuaucgacgacagauucgccaacgcucugcucgcccugaacgacaugggaaagguccggaaggacaucccccaauggcagccuaguaagggcuggcaugacuggcagcaggucccguucugcagucaccacuuccaugagcucaucaugaaggacgggaggaaguuggucguacccugucggccucaagacgagcugaucggaagagcccgcauaagccagggggccggcuggucccuccgugagaccgccugcuugggcaaggccuacgcucagauguggucccugauguacuuccacagacgggaccuacggcuggcguccaacgcuauuugcagcgccguucccguccacugggugcccaccucccgaacaacguggagcauccacgcccaccaccaguggaugaccacugaggacaugcuaaccgucuggaaccgugucuggaucgaggacaaccccuggauggaggauaaaacgcccgugacgacgugggagaaugugcccuaucucgggaaaagagaggaucaguggugcggcagccugaucgggcugacaucccgagccacgugggcgcagaacauuccgacugcgauccaacagguacgaagucucaucggaaaugaggaguuccuggauuacaugccauccaugaagcgauuccggaaggaggaggagagcgagggagccauuugguga

SEQ ID NO: 25986 - RNA, 9873 nt, Artificial Sequence
  derived and/or modified CDS sequence (opt11) from DENV-3__FJ390377__SS-prME
accagucucugucucaugaugauccugcccgcggcacuggcguuucaccucacaagccgugacggggagccccgaaugaucgucggcaagaaugagcggggcaagagccuucuguucaagaccgccuccgggaucaacaugugcacccuaauugccauggaccugggcgagaugugugacgacaccgugacguacaagugcccacacaucaccgagguggaacccgaggacaucgacuguuggugcaaccucaccagcaccuggguuaccuacgggaccugcaaccaagccggcgagcacagacgcgauaaacggagcgucgcucucgcgccucacgugggcauggggcuugacacacgcacccagaccuggaugucagccgaaggcgccuggcgccaggucgaaaaggucgagaccugggcccugcgccauccggguuucaccauccucgcgcuuuucuuagcgcacuacaucggcacgucccucacccagaagguggugaucuucacccugcucaugcucgucaccccaagcaugaccaugcgcugcguggggguggggaaccgcgauuucguggagggccuguccggggccaccuggguggacguaguucuggagcacggagggugugugacaaccauggcuaaaaacaaacccacccucgacauugaguuacagaaaaccgaggccacgcagcuggcuacucuacggaaguuaugcaucgaggggaagauuacgaacaucacuacggacagccgcugccccacacaaggcgaggccgugcucccggaggaacaggaccaaaacuacgucugcaagcacacuuacguggaucgagggugggguaacgggugcggccucuuugguaagggcagccugguuaccugcgcgaaauuccagugccuggagcccaucgagggaaaggucgugcaauacgagaaucucaaguacacuguaauaaucaccguccacaccggggaucagcaccagguagguaacgagacacagggugucacggccgagaucacgccccaggccagcaccaccgaggcaauccuacccgaguacggcaccuuaggguuggagugcucaccgcgcacggggcuggacuucaacgagaugauacuguugacaaugaagaacaaggcguggaugguucaucggcagugguuuuucgaccugccccugcccuggaccaguggcgccacgacggaaacgccgaccuggaaccgcaaagagcuccuggugaccuucaagaacgcccacgccaagaaacaggagguggugguccuugggucccaagagggcgcgaugcacacggcccuaaccggcgccaccgagauccagaacagcggcgggacguccaucuucgccggccaccugaagugccggcugaagauggauaagcucgagcuaaaaggaaugagcuacgccauguguacgaauaccuucgucuugaagaaggaggugucugagacgcagcacgggaccauacuuaucaaaguggaguacaagggcgaggacgucccgugcaaaauuccguucaguacggaggacgggcagggcaaggcgcacaacggccgacugaucaccgcuaaccccgugguaaccaaaaaggaggagcccgucaacaucgaggccgagccccccuucggcgagagcaauauagugaucggcaucggggacaacgcccugaagauaaacugguacaagaagggcaguagcaucgggaagauguuugaggcuacugcacggggcgcccgccggauggccauccuuggcgacacggccugggacuucgggucggugggcgggguccucaacagccugggcaaaauggugcaccaaaucuucgggagcgccuauaccgccuuauuuagcggcgugucguggguuaugaagaucggcaucggggugcuccugacuuggaucggacugaacagcaaaaacaccuccaugagcuucuccugcauugccaucgggaucaucaccuuguacuugggggcagucguccaagccgacauggggugugugaucaacuggaagggcaaagagcucaaauguggcagcgggaucuucgugacuaacgagguccacaccuggaccgagcaauacaaguuccaggcugauuccccaaagcgccuagcuacggccaucgcgggcgcaugggaaaauggggugugcggcauccggagcaccacgcggauggagaaccugcuguggaagcagaucgcaaaugagcucaacuacauccucugggagaacaacaucaaacuuaccgugguugucggggacauaauaggcgugcucgagcagggcaaacgcacgcugaccccccagccgauggagcugaaguacaguuggaagaccugggggaaggcaaagaucguuaccgccgaaacgcagaacagcuccuucaucaucgacggcccgaauaccccugagugccccagcgcaucccgggcguggaacgugugggagguggaggacuacggauucggcgucuucaccaccaacaucuggcucaaacugcgggagguauacacccaguugugcgaccaccggcucaugucggccgcagugaaagacgaacgcgcuguucacgccgacaugggcuacuggaucgagucgcaaaagaacgggagcuggaagcuggagaaggcgucccugauagaggugaagacauguaccuggccgaagucccacacccuauggagcaacggcgugcuggagucagauaugauuauacccaagagccuggcggggcccauuucccaacacaacuaucggccgggguaccacacccagacggccggccccuggcacuugggcaagcuagaguuggacuucaacuacugcgaggggacuaccguugugaucaccgagaacugcgggacgcgcggccccagccuccgcaccaccaccgugucggggaagcugauucacgaguggugcugucguagcugcacgcugcccccgcuccgcuacaugggggaggauggcugcugguauggcauggagauccgcccuaucagcgagaaggaagaaaacauggucaagagccugguguccgcuggaagcgggaagguggacaacuuuaccaugggcguccuuugucucgccauccuguucgaggaggugaugcgggggaaguucggcaagaagcacaugaucgcggggguguuuuucacauuuguccugcuccuauccggacagauaaccuggcgcgacauggcccacacgcugaucaugauaggcagcaaugcuucggaccgcauggggaugggaguaacauacuuggcccugaucgccaccuucaaaauucagccauuccuggcgcucggguuuuuccugcgcaagcugaccucgcgggagaaccuccugcuuggcgugggccucgccauggcgacgaccuuacaguugcccgaagauaucgagcagauggccaacgggaucgcgcucggccugauggcccugaagcucauaacccaguucgagaccuaccagcucuggacggccuugaucagccucaccugcucaaacaccauauucacccugacgguggcauggagaacugccacccuuauccucgcgggaguaagccugcugccggucugucagucaagcucgaugcggaagacggauuggcuccccaugacgguggccgcgaugggugugcccccccugccgcuguucaucuuuagccucaaggacacccugaagagacgcuccuggccccugaacgagggggucauggccgugggccucgucagcauccuggccucaagccugcugcggaacgacguccccauggcgggcccccugguggccgggggccugcuuaucgccugcuacgugaucaccgggaccuccgccgacuugacgguagagaaggccgcggacgucacgugggaggaggaggccgagcagaccggugugagucauaaccugaugaucaccgucgacgacgauggaaccaugcguaucaaggaugacgagacggagaacauucucaccguucugcuuaaaaccgcccucuuaauaguguccggcaucuuuccguauagcauccccgcgacauugcucgucuggcacacguggcagaagcaaacccaacgguccggcguacugugggacguuccuagcccgccggagacucagaaggcugagcuggaagagggggucuacagaaucaagcagcaaggcaucuucggcaaaacccaaguggguguggguguucagaaggagggaguguuccacacaauguggcacgugacacggggagcgguacucaccuacaacgggaagcgccuggaacccaacugggccuccgugaagaaggaccugauaagcuacggagggggcuggagacucucugcccaguggcagaagggggaggagguccaggucaucgccguggaacccggcaaaaauccaaagaacuuccagaccaugcccggcaccuuccaaaccaccaccggggagaucggcgcgauagcccuggacuucaagccgggaacgagcggaagccccaucauaaaccgcgagggcaagguggucggguuguacggcaacggggucgucaccaagaacggcggguacguaagcggcaucgcccagaccaacgcugagccggacggcccaaccccugagcuggaagaagagauguucaaaaagcggaacuugacuaucauggaccugcacccuggaagugguaagacucgcaaauaccugccggccaucgugcgggaggcgaucaagcgccggcuucgcacccucauccuggcacccacgcggguggucgcagccgagauggaggaggcuuugaaggggcugcccauccgcuaccagacgaccgcgaccaaguccgaacacaccggccgggagauuguggaccugaugugccaugccacguucaccaugcgccuccugagccccguccgcgucccgaacuacaaucugaucauuauggacgaagcacacuucaccgaccccgcgagcaucgccgcgcggggcuacauuagcacuagagugggcaugggugaggcggcagccaucuucaugacggcuacaccucccgggaccgccgaugccuucccgcaguccaaugcccccauacaggacgaggagcgugauauccccgaacgcagcuggaacuccggcaacgaguggaucacugacuuugccgggaagaccgugugguucguccccagcaucaaggcgggcaacgacaucgcgaauugucuacggaagaacgguaagaaggugauccagcugucccgcaagaccuuugacaccgaauaccagaagacuaaacuuaacgacugggauuuuguggucacgaccgacaucuccgaaaugggagccaauuucaaggcugaccgggugaucgacccgcgccggugccuaaagccaguuauccugaccgacggccccgagcgcgucaucuuagccgggcccaugccagucaccgcggccuccgccgcccagcggcgaggacgggucgggcgcaauccccagaaagaaaacgaucaguacaucuucacuggccagccccucaacaacgacgaggaccaugcccacuggacggaggcgaagaugcugcuggacaauaucaacacccccgaggggaucauuccggcccucuucgagccugagcgagagaagucugccgccaucgacggggaauaccgccugaagggcgagucccggaagacauucgucgaacugaugcgcaggggggacuuacccgugugguuagcucauaaggucgccagcgagggcaucaaguacaccgaccgcaaauggugcuucgacgggcagcggaacaaccagauccuggaggaaaacauggacguggagaucuggacgaaggagggcgagaagaagaagcuccgccccagguggcuggacgcgcgcaccuacuccgacccguuggcccucaaggaguucaaagacuucgccgcgggccguaagagcaucgcccuagaucugguaaccgagaucgggcggguccccucucaccucgcgcaucggacgcggaaugcccuagacaaucuggugaugcuccauacgagcgagcacggugggaaggcguaccgccacgcgguggaggagcugcccgagacaauggagacccugcuucuuuuaggccucaugaucuugcugacggguggcgccaugcuauuccugauaagcggaaaggggauuggcaagacuagcaucggacugaucugcgucauagccagcucagguaugcucuggauggcugagauaccgcuccaguggauugcgucugcgauagugcuggaauuuuucaugaugguacuacugauccccgagcccgagaagcagcguacaccccaagauaaccagcucgccuacgugguuaucgguauccucacgcuugcagccauuaucgccgcgaacgaaaugggccugcucgagaccacgaaacgcgaccugggcauguccaaggagccggggguugucagccccaccucuuaucuggacguggaccuacaccccgccagugcguggacacuauacgccguggcgaccacggucaucacccccaugcuacgacacaccaucgagaauuccaccgccaaugugagccucgccgccaucgccaaucaggcgguuguccugaugggccuggauaagggguggccgaucuccaaaauggaccucggcgugccacugcuggcccucggguguuacagccaaguuaacccccuuacgcugacggccgccguccuccuguugaucacccacuaugccaucaucggccccggccuacaagcgaaggccacccgcgaagcccagaagcgaacggcggccgguaucaugaagaacccgaccguugauggcauuaugaccaucgacuuagauccugugaucuacgauuccaaguucgagaagcagcugggacaggucaugcuccuggugcuaugcgccgugcagcuccugcugaugcgcacaagcugggcccucugugaggcccugacgcuggccaccggccccauuaccacacucugggaagggucccccgggaaauucuggaacacgaccaucgcggucagcauggccaacaucuuccggggauccuaccuggccggagccggccuggcauuuucgauuaugaagaguguggggaccggcaagcgcggcaccgggagccagggcgagacccucggcgagaaguggaagaagaagcuuaaccagcugagccguaaggaguuugaccucuacaagaagucugggauaacugagguggaccgcaccgaggcgaaggaggggcucaaacggggcgaaauaacacaccacgcggucagccgcggcucugccaaguuacagugguuuguugagcggaacauggugauuccggaggggagagucaucgaucucggaugcgggcggggcggguggaguuacuacugcgcaggacugaagaaggucaccgaaguaagaggcuacacaaagggcggacccggucacgaggagccagugcccauguccaccuauggcuggaacaucguaaagcugaugagcgggaaagacguguucuaucuuccacccgagaaaugcgauacccugcucugcgacaucggcgaguccagccccagcccuaccguagaagagucgcgcacgaucaggguucugaagaugguggagccguggcucaagaauaaucaguucugcaucaagguccuaaaccccuauaugccaaccgugaucgagcaucuggagcgccuccagcguaaacauggcggcaugcuggugagaaacccgcuaucccggaacaguacccacgagauguauuggaucuccaacggcacagguaacauagucgccucugugaacaugguguccaggcuccuccuuaaccgguucaccaugacccaccgccggcccacuauagagaaggaugucgaucucggcgcaggcacccgccacgugaacgccgagcccgagacgcccaacauggacgucaucggggagcggaucaagcgcaucaaggaggagcacaacagcaccuggcacuacgaugacgagaacccguacaagaccugggccuaccacggcuccuacgaggucaaggcgaccgggagcgccucaagcaugaucaacggcgucgucaagcuguugacgaagcccugggauguggugcccauggucacccagauggcuaugaccgacacaacgccuuucgggcagcagcgcguguucaaggagaaaguugacacccgcaccccacggagcaugcccgguacacgccggguuaugggcaucacggccgaguggcucuggcgaacccuagggagaaacaagaaaccccgccucugcacccgggaggaguucaccaagaaggucagaacgaacgcugcgaugggcgcuguguucacugaggagaaucagugggacuccgccaaggccgcgguggaggacgaggauuucuggaaacucguggacagagagcgggagcugcacaagcuagggaagugcgguagcugcgucuacaauaugauggggaagcgcgagaaaaagcucggcgaauucggcaaagcgaaggguucucgggccaucugguacauguggcugggcgcccgcuacuuggaguucgaggcccucggguuccugaacgaagaucacugguucagccgggagaacucauauagcgguguagagggggagggccugcacaagcucggcuauauccuucgcgacaucuccaagauccccgggggcgccauguacgccgacgacaccgcggggugggacacccgcauuacggaggaugaccugcacaacgaggagaagaucacccagcagauggacccggagcaccgccagcucgccaacgcgauauucaagcugacauaccagaacaagguggugaagguccagcgcccgacccccaccggcacggugauggacaucaucucacgcaaggaccagcggggcuccggccaagugggcaccuauggucugaacaccuucaccaacauggaagcccaacucauacgccagauggagggcgaagggguccugagcaaggccgaccuggagaauccccaccucccagagaagaagauuacgcaguggcuggagacuaagggcguggagcggcugaaaagaauggcgaucuccggcgacgacugcguggucaagccgaucgacgaccguuucgccaacgcccuccuggcacucaacgauaugggcaaggugcgcaaggacauuccccaguggcagccaagcaagggcuggcacgacuggcagcaggucccguucugcucccaccacuuccaugagcucauuaugaaggacgggcggaagcugguggugcccugccgcccccaggaugagcugaucggacgggcaaggauaagccaaggcgccggauggucgcugcgggagacggcuugucugggcaaggccuacgcccagauguggagccuuauguacuuccacagacgcgaucugagacuggcguccaacgccaucugcagcgccgugcccguccacuggguacccaccucacgcacgaccuggagcauccacgcgcaccaucaauggaugaccaccgaggacaugcuaacgguguggaaccgugucuggauagaggacaacccauggauggaggacaagacccccgugaccaccugggagaacguuccuuaccucgggaagcgcgaagaccaguggugcggcagccugaucgggcugacaucccgggcuaccugggcucagaauaucccaaccgccauccagcaagugcgcucauuaaucggcaacgaagaguuccuggacuacaugccgagcaugaaacgguucagaaaggaggaggagagcgagggggcuaucugguga

SEQ ID NO: 25987 - RNA, 9873 nt, Artificial Sequence
  derived and/or modified CDS sequence (opt11) from DENV-3__FJ547069__SS-prME
accagccugugucucaugaugauccuccccgccgcguuggcguuccacuuaaccagccgcgacggugagccgcggaugaucguggguaagaacgagcgcggcaagagccuacuguucaagaccgccuccgggauuaacaugugcacacucaucgcaauggaucugggcgagaugugcgaugacaccgugacuuacaagugcccccacauuacggagguugagcccgaagacaucgacugcuggugcaaucucacuagcaccugggugaccuacgggacgugcaaccaggccggcgagcacaggcgcgacaagcggagugucgcccucgcuccccacgugggaauggggcuggauacgcgcacccagaccuggaugucugcagagggcgcguggcgacagguggagaaggucgagacuugggcacugagacaucccggguucaccauccuggcgcuguucuuggcccacuacaucggcaccucacuaacccagaagguggugaucuuuauccugcugaugcucgucacgcccagcaugaccaugcggugcguaggaguuggcaaccgcgacuucgucgaaggccuguccggggccacuuggguggacgugguucuugaacacggcgggugcgugaccacgauggcuaagaacaagcccacccuggacauugagcugcagaagaccgaggccacucagcuggcaacgcuccgaaaauuguguauagagggcaagaucacaaacaucaccaccgacagccgcugccccacgcagggcgaggcugugcucccagaggagcaggaucaaaacuacgucugcaagcacaccuacguggaccgggggugggggaacggaugcggauuguucggaaaaggcucccugguaaccugcgccaaauuccagugccuggagccaaucgagggcaaggucguucaguacgaaaaccucaaauacaccgugaucaucacgguccacacaggcgaucaacaccagguggguaacgagacucaggggguaaccgccgagauaacgccccaggccucaaccacggaagcgauccugccggaguauggcacccuggggcucgaaugcuccccgcggacggguuuggacuucaacgagaugauacuguuaacgaugaagaacaaggccuggaugguucaccgacagugguucuucgaccuuccccucccuuggaccagcggggccacaaccgagacucccaccuggaaccgcaaggagcuccuggugacauuuaaaaacgcccacgccaaaaagcaggagguagugguucuugggucccaagagggugcgaugcacacagcccuaaccggggcaacagaaauccagaaccugggagggacgagcaucuucgccggccaccugaagugccgguuaaagauggacaaacuggagcugaaggguauguccuacgcaaugugcaccaacacguucguccucaaaaaggagguuucagagacccagcacgggacuauacugaucaagguggaguacaaaggcgaagacgugccgugcaagauccccuucuccaccgaggacgggcagggcaaggcucacaauggccgcuugauaacggccaaccccguggugaccaagaaggaggagccagucaacauagaggccgagccgccguuuggggaaagcaacaucguuauaggcaucggagacaacgcccugaagauuaauugguacaagaaagguagcucgaucgggaagauguucgaggcuaccgcccggggcgcucgacggauggccauacucggugauaccgccugggauuucggcagcgugggagggguucuaaacucccugggaaagauggugcaucagaucuucggcagugcauacacugcucucuucuccgguguuagcugggucaugaaaaucgggaucggagugcuauuaaccuggaucggccugaacucuaagaacaccagcauguccuuuagcugcaucgccaucgggaucaucacgcucuacuuaggagcaguuguccaggccgacauggggugcgugaucaacuggaagggcaaggaacucaaaugcggcuccgggaucuucgugacgaacgagguccacacauggaccgagcaguauaaauuucaagccgauagccccaaacgccuggccaccgcaauugcuggagccugggagaacggaguaugcggcauccgcuccacuaccagaauggaaaaccugcuguggaagcaaaucgcgaacgagcugaacuacaucuuaugggaaaauaauauuaagcucaccgucgucguuggggacauuaucggcgugcuggaacagggcaagcgcacgcugacgccucagccgauggaauuaaaguacagcuggaagacuuggggaaaagcuaagauuguaaccgccgagacccaaaauucuagcuucauuaucgacggccccaacacgccugagugccccuccgccagcagggccuggaacguuugggagguggaagacuacggguucggcguuuuuaccacaaacaucuggcuaaagcuucgagagguguauacccagcuuugcgaccacagacucaugagugcggcugucaaagaugagcgcgccguacacgccgauaugggauacuggaucgagagucagaagaacggaagcuggaaguuagagaaggcgucccucauugaggugaagacuugcacguggcccaagagccacacccuuuggucaaacgggguauuggagucugacaugaucauccccaagucccuggccgggcccaucagccagcacaauuaucggccgggcuaccacacucagaccgccgggcccuggcaccugggcaagcuggagcucgacuucaacuacugcgagggcacuaccguugugaucacggagaacugcggaacccgcggcccuucccugcgaacgaccaccgugucaggaaaguuaauccacgaguggugcugucgcuccuguacacuaccgccccugcgauacaugggcgaagacggaugcugguacgguauggagauuagacccaucagcgagaaggaggaaaacauggucaagucccucguuagcgccggauccgggaagguggauaacuucacaaugggcguccucugccuagccauccuguucgaggaagugaugcgggggaaguucgggaagaagcacaugaucgcggggguguucuucaccuuuguccuccuucugucaggacagaucaccuggcgcgacauggcccacacccucaucaugaucggaucaaacgccucggaccggauggggaugggcgugacuuaccuggcccugaucgccaccuucaagauccagccuuuccucgcgcuaggauucuucuuacgcaaguuaaccucccgggagaacuugcugcucggcgucggccuggccauggccaccacgcuacagcuucccgaagacaucgagcagauggccaacgggaucgcguuaggucucauggcccucaagcugaucacacaauuugagaccuaucaguuguggaccgcgcucauuagccuuacgugcucuaacaccaucuuuacauuaacaguagccuggagaaccgccacccucauacuggcgggugucucccugcuccccgucugccaaagcuccaguaugcggaagacugauuggcugcccaugaccguggccgccauggggguaccgccccuaccccuguucauuuucucccugaaggauacgcugaagcggcgcagcuggccccucaacgagggugucauggcgguugguuuaguguccauacuugccagcucccuccugcggaacgacguccccauggcgggcccccugguggccgggggccuacugauagcgugcuacgugaucaccggcaccuccgcugaccugacagucgagaaggccgcggacguaaccugggaagaagaggccgagcagaccggcgugucucacaaccucaugaucacaguugacgacgacgggacaaugcgcaucaaggacgacgagaccgaaaauauccuuacggugcuacucaagaccgcccuccugaucgucagcggcaucuucccguauuccauacccgccacccugcugguguggcauaccuggcagaagcagacgcaacgguccggagugcugugggacgugccaucucccccagagacccagaaagccgagcucgaagagggggucuaccggauaaagcagcagggcaucuucgggaagacccaggugggcgucggaguccagaaggagggcguguuccacaccauguggcaugugacgcggggugcugugcugaccuacaaugggaagcgcuuggagcccaacugggccagcgugaagaaggaccucaucuccuacggcgggggcuggcggcugagcgcccaguggcaaaaaggggaggaggugcaggugauugccguggagccggguaagaaccccaagaacuuccaaaccaugccgggcacuuuccagacaaccacuggggagaucggagccauugcccuggacuuuaaacccgggaccuccgggagcccgaucaucaaccgcgaaggcaaagugguuggacuguacggcaacgggguggugacaaagaaugguggguacgucagcggcaucgcucagacgaacgcggagccugacggcccgacaccugaacucgaagaggagauguuuaagaagcggaaccugaccaucauggaccugcaccccggguccggcaaaacgcgcaaguacuugccggccaucgugcgggaagcaauaaaacgccggcugcgcacccugauccucgcccccacccggguagucgccgccgagauggaggaggcccugaaggggcugcccauccgcuaccagacaacggcgaccaagagcgagcacaccggccgggagaucgucgaccucaugugucaugccaccuucacgaugcgccuucugaguccagugcgcgucccgaauuacaaccucaucauuauggacgaggcucacuucacagaccccgcgagcaucgcggcccgcggguacaucucaacgcgggugggcaugggcgaagccgccgcgauuuuuaugaccgccacuccgcccgggaccgccgaugccuucccgcagaguaaugcgcccauccaagacgaggaacgcgacauacccgagcgaucguggaauagcggcaacgaguggauaaccgacuucgccgguaagaccguaugguucguucccuccauaaaggcugggaacgacaucgcgaacugucuccggaagaacgggaaaaaggucauccagcucagccgcaagacguuugauaccgaguaccaaaagaccaagcuaaacgacugggacuucguggugacgacggacaucuccgaaaugggcgcaaauuuuaaagccgaccgagucaucgacccgcgccggugccugaaaccugugauccugaccgacggaccagagagaguaauacucgcagggccgaugcccgugacugcggccucugccgcccagcggagaggccggguggggaggaacccacagaaagaaaacgaucaguacauauucacgggccagccucuuaacaacgacgaggaccacgcccacuggaccgaggcgaagaugcuccucgacaacauuaauacgcccgaggggaucaucccggcccuguucgaacccgagcgggaaaaaucagcggccauagacggugaguaccgccuaaagggggagagcaggaagaccuucguugaacuaaugcggcgcggggaccugccuguguggcuggcacacaaggucgccuccgagggcaucaaguacacggaccggaaguggugcuucgacggccagcggaacaaucagauccucgaggagaacauggacguggagaucuggacgaaggagggugagaagaagaaacugaggccccgguggcuggaugcccgcacguauuccgacccgcucgcccugaaggaguucaaggacuucgcggccggccgcaaaucaaucgcccucgacuuagugaccgaaaucggacggguccccagccaccuggcccaccgcacccggaacgcgcuggauaaccucgugaugcuucauaccucagaacacggagggaaggcguaccgccacgcgguugaggaguugcccgaaacgauggagacccuccuacugcucggucugaugauucugcugaccgguggugccaugcuguuccuuaucagcgggaaaggcauuggcaagaccuccaucggucucaucugcgucaucgcaucaaguggcaugcuuuggauggccgagaucccgcuccaguggaucgccuccgcaaucgugcucgaguucuucaugauggugcugcuuauucccgagcccgagaagcagcgaacgccccaggacaaccaacuggccuacgucguuaucgggauccuaaccuuagccgccaucaucgcagcgaacgaaaugggccuccuggaaaccaccaagcgcgaucuggguaugagcaaagagccggggguugucucccccacgagcuaccucgacguggaccugcaucccgccuccgcuuggacacuguaugccguggcaaccacggucaucacgcccaugcuccggcauacuaucgagaacagcacagcuaacgugucauuggccgccaucgcaaaccaggcgguuguccuuaugggacucgacaaaggguggccgaucucuaagauggaucugggcgucccacugcucgcccuggggugcuacucccaagugaacccccuaacccucacggccgcugucuugcugcucauaacccacuacgccaucaucggccccggucugcaagcgaaagcuacccgcgaggcccaaaagagaacugccgccgggaucaugaagaacccgacgguggacggcaucaugacaaucgaccuggacccggugauauaugauagcaaguuugagaaacagcucgggcagguuauguugcuggugcucugcgcggugcagcugcugcucaugcgcacuuccugggcccucugcgaggcccugacccuugccacaggccccaucaccacucugugggaaggcagcccugggaaauucuggaacacuacgaucgcggucuccauggccaauauauuccggggcagcuaccuggccggggccggccuagccuucuccaucaugaaguccguugggacaggcaaacguggcacugggagccaaggugaaacccugggagagaaauggaagaaaaagcugaaccagcucagccggaaggaguucgacuuguacaagaaguccggaaucaccgagguggacagaaccgaagcgaaggagggucuaaaaaggggagaaaucacccaccacgcggucucccgcgguucugccaagcuccagugguucguggagcgcaauauggugauccccgaggggcgcgucauugaccuaggcugcggucgcggcggguggucuuacuacugugccggccugaaaaaggugacugaggugagggguuacaccaagggcgggcccgggcaugaggaacccgucccuaugagcacguauggcuggaacaucguaaaguugauguccggaaaggauguguucuaucugccacccgaaaagugugauaccuuacugugcgacauaggugaaagcucccccagcccaacuguagaagagucccggaccauucgcgugcucaaaauggucgagccguggcugaagaacaaccaauuuuguaucaagguccugaaucccuacaugcccacuguuauugaacauuuagaacgccuccagcgaaagcacggcgggaugcuggugcgcaacccccucucaaggaacuccacacacgaaauguacuggaucagcaacgggaccgggaacauugucgcuuccgugaacauggugagcagacuucuucucaaccgguucaccaugacucaccgacggccgaccaucgagaaagaugucgaucuaggcgcgggcacccgccacgugaacgccgagcccgaaacccccaacauggacgucauuggggagcguauuaaacgcaucaaggaagagcauaacuccacguggcacuacgacgacgagaauccuuacaagaccugggcguaccacggcagcuacgaggucaaagccacugggucagccucaucuaugauaaacggcguggucaagcuccucaccaagcccugggacguuguacccauggucacucagauggcuaugaccgacacgacccccuucgggcagcagaggguguucaaggagaagguggacacucggacgccgcggagcaugcccgggacccgccgggucaugggcaucacagccgaguggcuguggcguacccuuggucggaacaagaagccacgccucugcacgagagaagaguucacuaagaaggugcgcaccaaugccgccaugggcgcgguguucacagaggagaaccagugggacagcgcuaaggccgcggucgaggaugaggacuucuggaagcuuguggaccgggagcgggagcugcacaaguugggcaaaugcggcuccugcgucuauaacaugaugggaaagcgggagaagaagcugggagaauucggcaaggccaagggcagccgggcgaucugguacauguggcugggcgcccguuaccuugaguucgaagcacugggguuucucaaugaggaccacugguucuccagagagaacucuuauagcggcgucgaaggggagggccuccacaagcugggcuacauacugcgcgacaucagcaagauuccggggggcgccauguacgcagaugauaccgcgggcugggacacccguaucaccgaggaugaccuacacaacgaggagaagauaacgcagcagauggacccagagcaccgccaacuggccaacgccauuuucaaacugaccuaucaaaacaaggucgugaagguccagcggcccacgcccaccggcaccgucauggacauaaucucaagaaaggaucagagaggcagcggccagguaggcacguacggacucaacaccuucaccaacauggaggcccaacucauaaggcagauggagggcgaggggguccuguccaaggccgaccucgagaacccccaccucccagagaaaaagaucacccaguggcuggagacgaagggcguggaacgucuuaaacgcauggcgauaagcggcgacgacugcguggugaagccuaucgacgaccgguucgccaacgcccucuuagcguuaaacgacauggggaaggugcgaaaggacaucccccaguggcagccuucuaagggauggcacgacuggcagcaggucccguucugcagccaccacuuccacgagcugauuaugaaggacgggcggaaguuggugguuccaugcaggccccaggacgagcucauaggccgggcgcgcaucucccaaggggcggguuggagccuccgggaaaccgccugccucggcaaggccuacgcccagauguggagccucauguauuuucaccgccgugaccugaggcuggccucaaacgccaucugcuccgcugugccaguccacugggugccaaccagccguaccacguggucgauccacgcccaccaucaguggaugaccaccgaggacauguuaaccguuuggaaccgggucuggaucgaggacaaccccuggauggaggauaaaacgccaguuaccacaugggagaauguaccauaccuggggaagcgcgaggaccaguggugcggcagucugauuggucucaccagccgggccacgugggcgcagaacaucccgacggccauacagcagguccgcucccugauuggcaacgaagaguuccuggacuacaugcccucuaugaagcgauuucgaaaggaggaggaguccgagggggcuaucugguga

SEQ ID NO: 25988 - RNA, 9873 nt, Artificial Sequence
  derived and/or modified CDS sequence (opt11) from DENV-3__FJ562107__SS-prME
accagccugugccucaugaugauccugcccgcagcgcucgcuuuucaccucaccagccgggauggcgagccccggaugaucguugggaagaacgagcgcgggaagucccugcuuuucaagacugcaagcgggaucaacaugugcacccucaucgccauggaccugggcgagaugugcgacgacaccgugaccuacaaguguccccacaucacggagguggagcccgaggacaucgacugcugguguaaccugacgagcacgugggugaccuacgggacgugcaaccaggccggcgaacaccggcgcgacaagcgguccguagcccucgcgccccaugugggcaugggccuggacacccguacccagacauggaugucagccgagggugcuuggcggcagguagagaaggucgagacgugggcccugcgccacccuggguucacaauccucgcucuguuccuggcacacuacaucgguaccucccucacccagaaggugguuaucuucauccugcugaugcucgucacgcccucaaugaccaugaggugugucggggugggcaacagggacuucguugaggggcuguccggggccaccuggguggacgugguccuggagcauggcgggugcgugaccacaauggcuaagaacaagcccacccucgauaucgagcugcaaaagaccgaagccacccaacuggcgacgcuccgcaaacuuugcauagagggcaagauaaccaacauuaccaccgacucccggugccccacgcagggcgaggccguguugccugaggaacaggaucagaacuacgugugcaagcacaccuacgucgaccggggguggggcaacgggugcggacucuucgggaagggaucgcuggugaccugcgccaaauuccaaugucuggagcccaucgagggcaaggucgugcaguacgagaaccucaaauauaccgugaucauuacgguacacaccggggaccagcaccaaguaggcaacgagacccagggggucaccgccgagauaacgccccaggccucgaccaccgaagcgauccugcccgaguauggcacucugggucucgagugcuccccgcgcacgggucuggauuucaacgagaugauccugcucacgaugaagaauaaggccuggauggugcaccggcagugguucuucgaucugccccugcccuggaccagcggcgccacaacugagacgcccaccuggaauaggaaggaauuacuggugaccuucaagaaugcccacgcuaagaaacaggagguggucguguuagggucccaggagggggcgaugcacaccgcauugacgggggccaccgagauccagaacucgggcgggaccuccaucuuugccggucacuuaaagugccggcugaaaauggacaaacucgagcugaaaggcaugagcuacgccauguguaccaacacguuuguucugaagaaggagguguccgagacccagcaugggaccauucucaucaaaguggaguacaagggcgaggacgucccgugcaagaucccguucaguaccgaggacggucagggcaaggcgcacaauggccgccugaucacggccaacccuguggucaccaagaaggaagaaccggucaacaucgaagccgagccacccuucggggagagcaacaucgugauuggaaucggggacaacgcccugaagaucaacugguacaaaaagggaucuuccauuggcaagauguucgaggcaaccgcccggggcgcccgccggauggcaauacugggcgacaccgccugggacuucggguccgugggcgggguccuaaauagccugggcaaaauggugcaccagauauucgggucggcguacacugcccuguucuccggcguauccuggguaaugaagaucgggaucggaguccuccugaccuggaucggccugaacagcaagaacaccuccaugucguuuuccugcauuguuaucgggaucaucacccucuauuugggcgccguagugcaggccgacaugggaugcguuauuaacuggaaggggaaggagcugaagugcggcagcggcaucuucgugacgaacgaagugcacaccuggaccgaacaguacaaguuccaggcugacucccccaagcgcuuagcgaccgccaucgccggcgccugggagaauggugugugcggcauccgcagcacgacccggauggagaaccugcuguggaagcagaucgcaaacgaacucaacuacauacugugggagaacaacauuaagcugacugucguggugggggacaucauuggcguccucgagcaaggcaagcgcacccugacgccacagccgauggaacugaaauacucauggaagaccugggguaaggcgaaaaucgugaccgccgaaacucagaacucguccuuuaucaucgacggccccaacacgccagagugccccagcgccucccgggccuggaacgugugggaggucgaggacuacggguucggaguguucaccaccaacauauggcucaaacugcgcgagguguacacccagcuaugcgaccaccggcucaugucggcggccgucaaagacgagagagccguucacgccgacaugggguacuggauugagagccagaagaacgguuccuggaagcuggagaaggcgucacuuaucgaggucaagacaugcacguggccgaagucccacacucuguggagcaauggaguccucgaguccgacaugaucauccccaagagccuagcggggcccaucucccagcacaacuaccggccggguuaccacacccagacggccggucccuggcacuugggcaaauuggagcuggacuucaauuacugcgagggcacgaccguggugaucaccgagaacugcgggacccgcgggcccagccuccggacaaccaccgucuccgggaaacuaauacacgaauggugcugccgcucuugcacuuugcccccgcuccgguacaugggcgaggacgggugcugguacggcauggaaauccgccccaucuccgagaaggaggagaacauggucaagagccuggugucagccggcagcggcaaggucgacaacuuuacgaugggggugcucugccucgccauccuguucgaagagguaaugagggggaaguucgggaagaagcacaugaucgcuggagucuucuucaccuucgugcugcuacuguccggccagaucaccuggcgcgacauggcgcauacccugaucaugauuggcagcaacgcauccgaccggauggguaugggcgugacguaccuggccuugaucgccaccuucaagauccagcccuucuuagcgcucggguucuuccucagaaagcugaccagccgggagaaucuucuacugggcgucggccucgcgauggccacaacacugcaacuacccgaggacaucgagcagauggccaacgggauugcccucggccugauggcgcugaagcucauuacucaguucgaaaccuaccaguuguggaccgcgcugaucagccucacguguuccaacacgaucuucacccuaaccguggcguggcgaacggcgacccugauccuggccggggucucucugcugccggugugccagucgagcuccaugcggaagaccgacuggcuccccaugaccguugcggccaugggugugccucccuugccgcuguucaucuucucgcuuaaggacacgcugaagaggcgcuccuggccacugaacgagggaguaauggccgugggccucgucagcauccucgcguccagucugcuccggaacgacguacccauggccggcccucugguggccggcgggcuccucaucgccugcuacgucaucacaggaaccuccgcggaccugacaguugaaaaggccgcggacgugacgugggaggaggaggcggagcagaccggggucagccacaacuuaaugauuaccguggacgacgacgggaccaugcgcaucaaggacgacgaaacagagaacaucuuaaccgugcugcugaaaacagccuugcuuaucgucuccggcaucuucccauacucgauccccgccacccugcugguguggcacaccuggcagaagcaaacgcagcgguccggcguucugugggacguccccagcccgcccgagacccagaaggccgagcuugaggaggggguauaccgcaucaagcaacagggcauauucgggaagacacaggugggcguaggggugcagaaggagggcguguuccacacaauguggcacgucacgcggggcgcagugcuaacuuacaacgggaagcggcuggagcccaacugggcguccgugaagaaggaucugaucagcuauggcgggggcuggcggcucagcgcccaguggcagaagggggaagagguacaggugaucgcaguggagcccggcaagaaccccaagaacuuccagacuaugccaggaaccuuucagacgaccaccggagagaucggcgccaucgcgcuugacuucaagcccgggaccagcggcagcccgaucaucaaccgcgaaggcaagguaguggggcuguacggcaacgggguuguaacaaagaauggaggguaugugucaggaaucgcucagaccaacgccgagccggacggccccacgcccgagcuggaggaggagauguucaagaaacggaauuugaccaucauggaccugcaccccggguccggcaagacgcgcaaguaccugccggccaucguacgcgaggcuaucaagcgccggcuccgcacacugauccuggcgcccaccaggguuguggccgccgagauggaagaggcacucaaggggcugcccauccgcuaccagaccacggcgaccaaguccgagcacaccggccgggagauuguggaucuaaugugucacgcaaccuucacgaugcgccuucugagccccgucaggguucccaacuauaaccuaauaaucauggacgaggcccacuucaccgaccccgccuccauugccgcccgcggguacaucagcacccgggugggcaugggcgaagcggccgccaucuucaugacugccaccccgcccgggaccgcggacgccuucccgcagaguaacgcccccauccaggacgaagaacgcgacauccccgagcgcagcuggaauagcggcaaugaguggaucaccgauuucgcugggaagaccgucugguucgugcccagcauaaaggccggcaacgacauagcgaauuguuuacggaagaacgggaagaaggugauccagcugucccgcaagacauucgauaccgaauaccagaagacaaagcugaacgauugggacuucgucgugaccacagacaucagcgagaugggcgccaacuucaaggccgaccgagugaucgacccgcgccggugccucaagcccgucauucugaccgacggccccgaacgcgugauccuggcagggcccaugccgguuacagcggccuccgccgcacagcggcgcggccgggucgggcgcaacccucagaaggagaacgaccaguacaucuucaccggccagccccucaacaaugacgaggaccacgcucacuggaccgaggccaagaugcuucucgacaacaucaauacacccgaggggaucaucccggccuuauucgaacccgagcgggagaaguccgccgccaucgacggcgaguacagauuaaagggcgagucccggaagacauucgucgaguugaugagacgcggggaucucccggucuggcuggcauacaagguggcguccgagggcaucaaauacaccgaccgcaaguggugcuuugaugggcagaggaacaaccaaauccuggaggagaacauggacguggaaaucuggacgaaggagggagagaagaagaaacuucgcccccgguggcuagacgcccgcaccuacuccgacccgcuagcccugaaggaguucaaggacuucgccgccggccgcaagagcaucgcgcuggaccuggucaccgaaauagggcgggugcccucccacuuagcccaccggacccggaacgcccuggacaaccuggugauguuacauaccagcgagcacggcgggaaggcuuaccgccaugccguugaggaacuccccgagacgauggaaacccugcuccugcucggccucaugauucuccugaccgggggcgcgaugcuuuucuuaauaagcggcaaagggaucggcaaaaccucuaucgggcuaaucugcgugaucgccagcaguggcauguuauggauggcggagaucccccugcaguggaucgccucagcuaucgugcuggaguuuuucaugaugguccuccugauccccgagccggagaagcagcggacgccccaagacaaccagcuagcauacguugugaucgguaucuuaacccuggccgccaucauagccgccaaugagaugggcuuacucgagaccacaaagcgcgaccugggcauguccaaggagcccgggguugucagccccacguccuaccuggacguggaccuccaccccgcgucagcauggacccucuacgcagucgccacuaccgugauaacgccuaugcugcgacacaccaucgaaaacuccaccgcgaacgugucuuuagccgccaucgccaaccaagcuguggugcugaugggccuggacaagggguggcccaucuccaagauggacuugggcgucccccuccuggcacugggguguuacagccaggucaauccccugaccuuaacggccgccgugcuccuccugaucacucacuaugccaucauuggacccggccuccaggccaaggcgacccgcgaggcccagaagcggaccgccgccgggauuaugaaaaacccgacgguggauggcaucaugaccaucgaccuagaccccguuaucuacgauuccaaguucgagaagcagcuaggccaggugaugcuccuggugcugugugccguccagcugcugcugaugcgcacgagcugggcgcucugcgaggcacugacccuggccacgggcccaaucaccacccugugggagggcucccccgggaaauucuggaacacuacgaucgccgugagcauggcgaacaucuuccggggcuccuacuuggccggggccggccuggccuucuccaucaugaagucuguggggacaggcaaacgcgguacggggagccagggcgagaccuuaggggagaaguggaagaagaagcugaaccaacugagccggaaggaguucgaccucuacaagaaguccggaaucaccgaggucgaccgcacggaggccaaggaggggcugaagcggggcgagauuacccaccacgcggugagccgcggcucggcgaagcugcagugguucguggagaggaacauggucauaccggaaggucgcgugaucgaccucggcugugggcggggaggguggagcuacuacugcgccgggcugaagaaggugaccgaggucagaggcuacacgaaaggcgggcccgggcacgaggagccggugccgauguccacguacggauggaacaucgugaaguuaaugagcgggaaggacgucuucuaucucccgcccgagaaaugcgacacccugcugugcgacaucggagaguccagccccucuccgaccguggaggagagccggaccauccgugugcugaaaauggucgagcccuggcucaagaacaaccaguucugcaucaaggugcugaaccccuauaugcccacggucaucgagcaucuggagcgucuccagcggaagcacggggguaugcugguacgcaacccccugagucggaacagcacccacgagauguacuggaucuccaacggcaccggcaacauaguggccagcgugaacauggucucccgccuccuguuaaaccgguucaccaugacgcaccgccgaccaaccauagagaaggauguggaccucggcgccggcacccgccacgugaacgcugagcccgaaaccccuaacauggacguuaucggggagcggaucaagcgcaucaaggaagaacacaacucaacguggcacuacgacgacgagaacccguacaagaccugggccuaccauggcuccuacgaggugaaggccaccggcagcgcuuccagcaugaucaacggcgucguuaagcugcugaccaagcccugggacgugguccccauggugacgcagauggccaugaccgacacaaccccuuuuggucagcagcggguguucaaggagaaggucgacacgcguaccccgcggagcaugcccggcacucggcgggugaugggcauuaccgccgaguggcuguggcgcacgcuuggccggaacaagaagccccgccuaugcaccagagaagaguucaccaagaaggugcgaacaaacgcagccaugggcgccgucuucacugaggagaaccagugggacuccgcgaaggccgccguggaggacgaggacuucuggauccucguggaccgcgagcgggagcugcacaagcuggggaagugcggcagcugcgucuacaauaugauggggaagcgcgagaagaaacucggcgaguucggcaaggcuaaggggucgagggccaucugguauauguggcuuggcgcgcgcuauuuggaguucgaggcucucggguuccugaacgaggaccacugguucucacgggagaacuccuacagcggcguggaaggggaaggccugcacaaacuaggcuacauacugcgggacaucuccaaaaucccagggggcgccauguacgccgacgacaccgcuggcugggacacucggaucacagaggacgaccugcacaacgaggagaagauuacucagcagauggacccggagcaccgccaacucgcgaacgcuaucuucaaacuaacuuaccaaaacaagguugucaaggugcagcggcccacccccacagguaccgucauggacauaauaagccgcaaggaccagcgcgguagugggcaagucggcacguacgggcugaacaccuucaccaacauggaggcccagcucaucagacagauggagggugagggggugcugagcaaggccgacuuagagaacccccaccucccugagaagaagaucacccaguggcuggagacgaaggggguggagaggcuuaaacgcauggccauauccggcgaugacugcgucgugaagccaauagacgacagauucgcaaaugcccuccuggcccugaacgauauggggaaggugcgcaaggacaucccccaguggcagcccagcaaggguuggcacgacuggcagcaggucccguucugcucucaucacuuccacgagcucauaaugaaggacggccguaaacuuguggugccuugccgcccccaggaugagcuaaucggccgggcccgcaucagccagggggcuggauggucccuccgggagaccgcgugccuggggaaggccuaugcacaaauguggagccugauguacuuccaccgccgcgaucuccgacuugcgaguaacgcgaucugcagcgccguuccugugcauugggugccgaccucgcgcaccacauggagcauccacgcgcaccaccaguggaugaccaccgaggacaugcugacuguauggaaccggguguggauagaggacaaccccuggauggaggauaagacgcccgugaccaccugggagaauguacccuaccucgggaaacgcgaggaccaguggugcggcagccugaucgggcugacuucccgagccacgugggcccagaacaucccgaccgcgauccagcagguccgcagccuaauuggcaacgaggaguuccuggauuacaugccauccaugaagcgguucaggaaggaagaggagagcgagggcgcgaucugguga

SEQ ID NO: 25989 - RNA, 9873 nt, Artificial Sequence
  derived and/or modified CDS sequence (opt11) from DENV-3__FJ547071__SS-prME
acuagcuuaugccucaugaugauccugccagcggcccuggcguuccaccucaccagccgggauggagagccccggaugaucgucgguaaaaacgagcgcgggaagagccugcuguucaagaccgccuccgggaucaacaugugcacacucaucgccauggaucugggcgaaaugugcgacgacacagugaccuacaagugcccccacaucaccgaggucgagcccgaggacaucgacugcuggugcaaccugaccagcacgugggugaccuaugggacuugcaaccaggccggcgagcaccggcgcgacaagcgguccguggcccucgcgccccacguuggcauggggcuggauacccgcacccagacuuggaugagcgccgaaggcgccuggcgucagguggagaaggucgagacgugggcccugcgacacccgggguucaccauccucgcgcuguuccuggcgcacuacaucggcaccucccucacccagaagguggugaucuucauccuguugaugcucgucacgcccagcaugacgaugcgcugcgucggcgugggcaaccgcgacuucgucgagggccugagcggggccaccuggguggacgugguccuggagcacggugggugugugaccacgauggccaagaacaagcccacuuuagauaucgagcugcagaagacugaggcaacccagcuggcgacgcuccgaaagcugugcauugagggcaagaucaccaacaucaccacggacagccgcugccccacgcagggcgaggccguccugccggaagagcaggaccaaaacuacgucugcaagcacaccuacguggaccggggguggggcaauggcugcggccucuucgggaagggcuccuuagugaccugcgcaaaguuucagugccuggagcccaucgagggcaagguggugcaguacgagaaccucaaguacaccguuaucaucacgguccacacaggggaucagcaccaggugggcaacgagacccagggggucaccgccgagaucaccccccaggccagcaccaccgaggccauccugcccgaguacgggaccuuagggcucgagugcuccccucgcacuggccuggacuucaacgagaugauacugcucacgaugaagaacaaggccuggauggugcaccgacagugguucuucgaccugccacugccguggaccagcggcgccaccaccgagacgcccaccuggaaccgcaaggagcuccuggugaccuucaagaacgcccacgcaaagaagcaggaagucguagugcuggguucccaggagggcgcuaugcauaccgccuugacgggggccaccgagauccaaaacagcggcgggaccuccaucuucgccggccaucucaagugucggcugaagauggacaagcucgagcugaagggcaugagcuacgcuauguguacgaacacguucgucuuaaagaaggagguguccgagacccagcacgggaccauccucaucaagguggaguacaagggcgaggacgucccgugcaaaauccccuucagcaccgaggacgggcagggcaaggcgcacaacggccgccugauaacggcaaaucccgucgugacaaagaaagaggaacccgucaacaucgaggccgaaccgcccuucggggagagcaacaucgugauuggcaucggggacaacgcccugaagauaaacugguacaagaagggcuccagcaucgggaagauguuugaggcgacagccagaggcgcccgccggauggccauccugggcgacaccgcaugggacuucgggucggugggcgggguccucaacagccugggcaagauggugcaccagaucuucgggucggcguacacggcccuguucucgggcguuagcugggucaugaagaucggcaucggcgugcuccugaccuggaucggccugaacagcaagaacaccuccaugagcuucuccugcaucgccaucgggaucaucaccuuauaccugggcgccgugguccaggccgacauggggugcgugaucaauuggaagggcaaggaacugaaguguggcagcgggaucuucgugacgaacgagguccacaccuggaccgagcaguacaaguuccaggcggauagccccaagcgccucgccaccgccaucgccggcgccugggaaaacgggguauguggcauccgcucuacuacccggauggagaaccuucuguggaagcagaucgcgaacgagcuuaacuacauccugugggagaacaacaucaagcugaccguagucgugggugacaucaucggcgugcucgagcagggcaagcgcacacugacgccccagccgauggaacugaaguacuccuggaagaccugggggaaggcuaaaaucgucaccgccgagacccagaacagcuccuucaucaucgauggcccaaauacgcccgagugccccagcgccucccgggcguggaacgugugggagguggaagacuacggguucggcgucuucacuaccaacaucuggcucaaguugcgugagguguauacccagcucugcgaccaccggcugaugagcgcggccgugaaagacgagcgcgccguccaugcagacaugggcuauuggaucgagagccagaagaacggguccuggaagcuggagaaggcgagccugaucgaagugaaaacaugcaccuggccgaagucucacacccucuggagcaacggcgugcuggaguccgacaugaucauccccaagagccucgccgggcccauuucccagcacaacuaccggccgggcuaccacacccagacagccgggcccuggcaucucggcaagcuggagcuggacuucaacuacugcgaaggcacgaccgucgugaucacggagaacugcggaaccaggggccccucacugcggacgaccaccguuucugggaagcuuauccacgaguggugcugccgcuccugcacccugcccccgcucagauacaugggcgaggacgguugcugguacggcauggagauccgccccaucucggagaaggaggagaacauggucaagagucugguguccgccggcagcgggaagguggacaauuucacgaugggcgugcugugccucgcaauccuguucgaagaggugaugcgggggaaguucggcaagaagcauaugaucgccgggguauucuucaccuucguccugcuccuguccggccagaucaccuggcgcgacauggcccacacacugaucaugaucggcuccaacgccuccgaucggauggggaugggcgugacguaccuagcacugaucgccaccuucaagauccagcccuuccuggcgcucggguucuuccugcgcaaacugaccagccgggagaaccuccuguugggcgugggccucgcgauggccacgacgcugcagcugcccgaggacaucgaacagauggcaaacgggauagcgcucggucugauggcccugaagcucaucacccaguucgagaccuaccagcuguggaccgcccuuaucagccuaacgugcucuaacaccauuuucacccugaccgucgccuggcgcacggccacccugauccucgcuggggugagucugcugccggugugucaguccagcuccaugcggaagaccgauuggcuccccaugaccguggccgccaugggcgucccgccccucccucuguucaucuucagccucaaggacacgcugaagcgccgcuccuggccacugaacgagggggucauggccgugggacucgugagcaucuuggccuccagccuacuccggaacgacguccccauggcgggacccuuaguggccggaggccugcucaucgccugcuacguuaucacugggaccuccgccgaccugaccgucgagaagaccgccgacgugacaugggaggaggaggcugagcagaccggcgugagccacaaccugaugaucacugucgacgacgacgggaccaugcgcaucaaggaugacgaaacggaaaacauacuaaccgugcugcugaagaccgcccuccucaucguguccggcauuuucccguacagcauccccgccacccugcucgucuggcacacauggcaaaagcagacccagcgguccggcgugcugugggacgugccgucaccgcccgagacccaaaaggccgagcuggaggaaggggucuacagaaucaagcagcagggcauauucggcaagacccaggugggcgugggcguccagaaggagggcguguuccacacgauguggcacgugaccagaggggccgucuuaacguacaacgggaagcgccuggagcccaacugggcguccgucaagaaggaccugaucagcuacggcgggggcuggcgacucuccgcccaauggcagaagggggaagaagugcaggucaucgccguggagcccggcaagaaucccaaaaauuuccagaccaugcccggcacguuucagaccaccaccggugagaucggcgcuaucgcgcuggacuuuaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgguagcggcaagacccgcaaguaccugccggccaucgugagggaggccauaaagcgccgccuccggacccuuauccuggcgcccacccggguugucgcugcagagauggaggaggcacucaaggggcuccccauccgcuaccagacgaccgccaccaaguccgagcacaccggacgggagaucguugaccugaugugccaugcgacuuucaccaugcgccuccugagccccgugcgggucccuaacuacaaccuaauuaucauggacgaggcccacuuuacagacccggccuccaucgcagcccguggguauauuagcacccgggugggcaugggugaggcggccgccaucuucaugaccgccacgccgcccgggaccgcggaugccuucccccaguccaacgccccaauccaggacgaggagcgcgauauccccgagcgcagcuggaauuccggcaaugaguggaucaccgacuucgccgggaagacggugugguuugucccuagcauaaaagccggcaacgacaucgcgaacugcuuacggaagaacgggaagaaggugauccagcugucccgcaagaccuucgacaccgaguaccagaagaccaagcugaacgacugggauuucguggucacaacugacauaagcgagaugggcgccaacuucaaggccgaccgggugaucgacccgcgccggugccugaagccggucauccuaacugacggccccgagcgcgucauccuggccgggcccaugccagugacagccgcguccgccgcccagcggcgcggccggguggggcgaaacccccagaaggagaacgaucaauacaucuucaccggccaaccccucaauaacgacgaggaccacgcacacuggacggaagccaagaugcugcuggacaacauaaacacccccgaagggaucauuccugccuuguucgagcccgaacgggagaaguccgccgccaucgacggcgaauaccgccugaaaggcgagagccggaagaccuucguggagcugaugcgccgcggagaccuccccguguggcuggcccacaaggucgcgagcgagggcaucaaguacacagaccgcaaguggugcuucgacgggcagagaaacaaccagauccuggaggagaacauggacguggagauauggacuaaggagggggagaagaagaaacuccgcccccggugguuagacgcccguaccuacucugacccgcuugcacucaaggaguucaaggacuucgccgccggccgcaagagcauugcgcuggaccuggugacugaaauagggaggguacccagucaccucgcccaccgcacccggaacgcccuggacaaccuggugaugcuccacacaagcgagcacggcgggaaagcguaccgacacgccguggaggagcugccagaaacuauggagacccugcucuugcugggccucaugauccugcugaccgguggcgcgaugcuguuccugaucucgggaaagggaaucggcaagacguccauagggcugaucugcgucauugccucguccggcaugcucuggauggcugagaucccgcuucaguggaucgccagcgccaucguccuggaguucuucaugauggugcuccuaauccccgagcccgagaagcaacguacgccccaagacaaucagcuggcauacgucgugaucgggauccucacccuggccgccauaaucgccgcgaaugagaugggccugcucgagacuacgaagcgcgaccuagggauguccaaagagccggggguggucagccccaccuccuaccuggacguggacuugcaccccgcgagcgccuggacucuguaugccguggccacuacggucauaacccccaugcugcggcacaccaucgagaacuccaccgcgaacgugagccucgccgccaucgccaaccaggccguggucuuaaugggccuggacaaaggguggccgaucuccaaaauggaccuuggcgucccucugcuggcguuaggcugcuacagccaggugaacccccugacgcugaccgccgccgucuuacugcugauaacccacuacgccaucaucggccccggccuccaggcgaaggccacccgugaggcccagaagcgaaccgccgccgggaucaugaagaacccgaccguggacggcauaaugaccaucgaccuagaccccgugaucuacgacagcaaguuugagaagcagcuggggcaggucaugcuucugauccugugcgcagugcagcuccugcugaugcgcacaagcugggcccucugcgaggcgcugacgcuggccaccggcccgaucaccacccucugggagggcucucccgggaaguucuggaacacuaccaucgccgugagcauggcaaacaucuuccggggcuccuaccucgcuggggccggccuggcuuucagcaucaugaaguccgucgggaccggcaagcgcggcaccgggagccagggcgagacccucggggaaaaguggaagaagaagcugaaucaguugucacggaaggaguuugaccucuacaagaagagugguaucacugagguagaccgcaccgaggccaaggagggccugaagcggggcgagaucacccaccacgcgguuagucgaggcuccgccaagcugcagugguucguugagcggaacauggugaucccggaggggcgcgugaucgaccucggcugcgggcggggcggguggagcuacuauugcgccggacugaagaaggucacggaggugcgcggcuacacgaagggcggucccgggcacgaagagcccgugcccaugucgaccuacgguuggaacauagucaagcugaugagcgggaaagacguguucuaccucccccccgagaagugugacaccuuacugugugacaucggcgaauccagccccucccccaccguggaggagagccggacgauacgcgugcugaagaugguggagccguggcucaagaacaaccaguucugcaucaaggugcugaacccauacaugcccaccguuaucgagcaccuggagcgccuccagcggaagcacggcgggaugcuggugcgcaacccccugucccggaacagcacccacgagauguacuggauuuccaacgggacagggaacaucguggcuagcgucaacauggugucccgccuccugcugaaccgguuuacgaugacacacaggcggccgaccaucgaaaaggacguggaccucggcgcaggcacccgccaugugaacgcggagcccgagacgccaaacauggacgugaucggggagcguaucaagcguaucaaggaggagcacaacuccaccuggcacuaugacgacgagaacccguacaagaccugggccuaccacggguccuacgaagugaaggcgaccgggagcgccucgagcaugaucaacggcgucgugaagcugcugacgaagccuugggacgucgugcccauggugacccagauggcuaugacagacaccacgccuuucgggcagcagcgggucuucaaggagaagguggacacuagaaccccgcggagcaugccgggcacccgccgggugaugggcauuaccgcggaauggcuguggcgcacccuggggcggaacaagaagccccgccugugcacccgggaggaguucaccaagaagguccgcacgaacgccgcgaugggcgccguguuuacugaggagaaccagugggacuccgcgaaggccgcaguggaggacgaggacuucuggaagcucgucgaccgcgagcgggagcugcacaaacuggggaagugcggaagcugcguguacaacaugauggggaagcgcgagaagaagcuuggcgaguucggcaaggccaaagggucccgugcuaucugguacauguggcugggcgcgcgcuaccuggaguuugaagccuuaggguuccucaaugaggaccacugguuuagccgggagaacuccuacuccggcguggagggggagggccugcauaaguuaggcuacauccugcgcgacaucuccaagauccccgguggcgccauguacgcggacgacaccgccgggugggacacccggaucacggaggacgaccugcacaacgaggagaagaucacccagcagauggacccggagcaccgccaguuagcgaacgccaucuucaagcugacguaccagaauaaggucgucaaggugcagcgccccacccccaccggcacggucauggacaucaucagccggaaggaccaacggggauccggccaggugggcacauacgggcugaacaccuuuaccaacauggaagcccagcucauccgccagauggagggcgaggggguccugagcaaggccgaccuggagaacccccaccucccggaaaaaaagaucacccaguggcuggagaccaagggcgucgagcgucugaagcgcauggccaucucuggugacgacugcguggugaagcccauugacgacagguucgcgaacgcucuccuggcacugaacgacauggggaagguccgcaaggacaucccacaauggcagcccagcaagggcuggcacgauuggcagcaaguccccuucuguucccaccacuuucacgagcucaucaugaaggacgggcggaagcuggugguccccugccgcccccaggaugaguugaucggccgggcccgcaucagccagggggccggcuggucacuccgggagacagcgugccuggguaaggccuacgcgcagauguggagccugauguacuuccaccgccgcgaccuccggcuggccucuaaugcgaucugcagcgccgugcccgugcacugggucccgaccaguagaaccacuuggagcauacaugcccaucaccaguggaugaccaccgaagacaugcugacaguguggaaccggguguggauugaggacaaccccuggauggaggacaagacccccgucacuaccugggagaacgugcccuacuuggggaagcgcgaggaccaguggugcggaagccugaucgggcugacgucccgggccacuugggcccagaacaucccaaccgcaauccagcagguccgcucacuuauaggcaacgaggaauuccuggacuacaugccguccaugaagcgguuccgcaaagaggaggagagcgagggggccaucugguga

SEQ ID NO: 25990 - RNA, 9873 nt, Artificial Sequence
  derived and/or modified CDS sequence (opt11) from DENV-3__FJ410176__SS-prME
acuagccugugccucaugaugauacugcccgcugcccuggcguuccaccucaccucccgggacggcgagccccguaugauuguggggaagaacgagagaggcaagagccugcuguucaagaccgccagcgguaucaacaugugcacacucaucgccauggaccugggugagaugugcgacgacaccgugaccuacaaaugcccccacauuaccgagguggagcccgaggacaucgacugcuggugcaaccugaccagcaccugggucaccuacgggacgugcaaccaggccggggaacaucggcgcgacaagcggucgguagcccuugcgccccacgugggcaugggcuuggacacccgcacccagaccuggaugagcgccgagggggccuggcgccagguggagaaggucgagacaugggcucugcgccaccccggguucaccauccucgcucuguuccuggcccacuacaucggcaccucccugacucagaagguggugaucuucauccugcugaugcucgucacgcccucgaugaccaugcggugcgucggggugggcaaccgcgacuucgucgagggauugucaggggccaccuggguggacgugguccuggagcacggggggugcgugaccacgauggccaaaaacaagcccacccucgacaucgagcugcagaagaccgaggccacucaguuagcgacgcuccggaagcugugcaucgagggcaagaucaccaacauaaccaccgacagccgaugccccacgcagggcgaggccguguuacccgaagagcaggaccagaacuauguaugcaagcacaccuauguggaccggggguggggcaacggcuguggccucuucgggaagggcucccucguuaccugcgccaaguuccagugccuggagcccaucgaggggaaggucgugcaguaugagaaccucaaguacaccguuaucaucacgguccacaccggcgaccaacaccaggucggcaacgagacccagggggucaccgccgagaucacgccccaggccagcaccaccgaagcgauccugcccgaguacggcacccuggggcucgagugcuccccccgcaccggcuuagacuucaacgagaugauccuccucacgaugaagaacaaggcauggauggugcaccggcagugguucuuugaccugccucugccuuggaccagcggcgcaaccaccgagacccccaccuggaaccgcaaggagcuccuggugacauucaagaaugcccacgccaagaagcaggaggucguuguccuggggucacaggagggcgcaaugcacacagcccucacaggggcaaccgagauccagaauagcggcgggacauccaucuucgccggacaccugaagugccggcugaagauggacaagcucgagcugaagggcaugucuuacgccaugugcaccaacacguucguacugaagaaagagguguccgagacccagcacgguaccauacucaucaagguggaguacaaaggggaggaugucccgugcaagauccccuuuagcacggaggacgggcagggcaaggcgcacaacggucgccugauuacggccaacccaguggugacaaagaaggaagagcccgucaacaucgaggccgaaccgcccuucggagagagcaacauugugaucggcauuggcgacaacgcucugaagaucaacugguacaagaaaggcuccagcaucgggaagauguucgaggccaccgcccggggcgcccgccggauggccauccugggagacacggccugggacuucggguccguuggggguguccucaacagccugggcaagauggugcaccagaucuucggguccgcguauacggcauuguucagcggcguguccuggguuaugaagauaggcaucggggugcuccugaccuggaucggacugaacagcaagaauaccuccaugagcuucuccuguaucgccaucgggaucaucaccuuauaccugggcgccgugguacaggccgauauggggugcgugaucaacuggaagggcaaagagcugaaaugcggcagcgggaucuucgugacgaacgagguucauaccuggaccgagcaguacaaguuccaggcagacucgcccaagcgccucgccaccgcuaucgcaggcgccugggaaaacgguguauguggcauccgcagcacgacucggauggagaaccugcuguggaagcagaucgccaacgagcucaacuacauccuuugggagaacaacaucaagcugaccguagucgugggggauacuaucggggugcucgagcaaggcaagcggacgcugacgccacagccgauggagcugaaguacagcuggaagaccugggggaaggccaagaucguuaccgccgagacgcagaacagcuccuucauuaucgacggccccaacaccccagaaugccccagcgccuccagagcguggaacguaugggagguugaagauuacggguucggcguguucaccaccaauauauggcucaagcugcgcgagguguacacccagcucugcgaccaccggcugaugucagccgccgugaaggacgagcgagccguccaugcggacaugggcuacuggaucgagagccagaagaacggguccuggaagcucgagaaggcgagcuuaaucgaggugaagacgugcaccuggccgaagucccacacccucuggucaaacggcgugcuggaguccgacaugaucauccccaaaagccuggccgggcccaucucccagcacaacuaccggccgggcuaucacacccagacggccggacccuggcaccuuggcaaacuggagcuggacuucaacuacugcgaaggcaccaccgucgugaucaccgagaacugcgggacgcguggcagcucccuccggaccaccaccgugagcgggaagcucauccacgaguggugcugccgcuccugcacgcugccuccccugcgguacaugggcgaggaugggugcugguacggcauggagauccgcccgaucuccgagaaggaggagaacauggucaagucccuggugucggccggcuccgggaagguggacaacuuuaccaugggcgugcuaugccucgccauccuguucgaggaagugaugcgggggaaguucggcaaaaagcacaugaucgcgggggugcuguuuaccuucguacuccugcugagcggacagaucaccuggcgagacauggcccacaccuugauaaugaucggcucuaacgccagcgaccggauggggaugggcgugaccuaccuggcgcugaucgccaccuucaaaauccagcccuuccucgcgcugggguucuuucuucggaagcucaccagccgggagaaucuccugcugggcguaggccuggccauggccacgacccugcagcucccggaggacaucgagcagauggccaacgggaucgcgcugggccugauggcgcucaaacugaccacccaguucgagaccuaccagcuguggaccgcccucaucagccugaccuguagcaacacaaucuucacccugaccgucgccuggcgcaccgccacccucaucuuagcgggugugucccugcucccuguuugucagagcuccagcaugcggaagacggacuggcuuccgaugaccguggcugcuaugggcgugccgccccuacccuuauucaucuucucccugaaggacacucugaagcgccgcagcuggccgcucaacgagggugugauggccgugggccugguuuccaucuuggccagcucacuccugcggaacgacgucccuauggcuggcccccugguggccgggggucuucugaucgccugcuacgugaucaccgguacgagugccgaucugaccguugagaaggccgcggacgugaccugggaggaggaggcggagcagacuggugugucccacaaccuaaugaucaccgucgaugaugacggaacgaugcgcaucaaggacgacgaaaccgaaaacauccugaccgugcugcucaaaaccgccuuacugaucgugagcggcaucuucccguacucaaucccggccacacuccuggucuggcacaccuggcagaagcaaacccagagaagcggcgugcugugggacguacccagcccgcccgagacccagaaggccgagcucgaagagggggucuaccgcaucaagcagcaggggaucuucgggaagacccaggugggcguggggguccagaaggaggguguguuccauaccauguggcacguaacccggggcgccguccugaccuacaacgggaagcgccuggagccgaacugggccagcgugaagaaggaccugauuuccuauggcggggguuggcggcugagcgcccaguggcagaagggggaggaagugcaagucaucgccguggaacccggaaagaacccuaagaacuuccagacgaugcccggcaccuuccagacuaccacgggggagaucggggcgaucgcccuggacuucaagccggggacaagcggcucccccaucaucaaccgcgaaggcaagguggucgggcucuacggcaacgggguggugaccaagaacggcggcuaugucagcggcauagcccagaccaacgccgaaccugacggaccgacgcccgagcucgaggaggagauguucaagaaacggaaccugaccaucauggaccugcauccggggagcggcaagacccgcaaguaccuacccgccaucgugcgggaggcaaucaagcgccggcugcgcacccuuauacucgcaccgacgcggguugucgccgccgagauggaagaggcgcugaagggccugcccauacgcuaucagaccaccgcgacuaagagugagcacacggggcgggagaucguggaccucaugugccacgccaccuucacgaugcgcuuauugucccccgugcggguucccaacuacaaccucaucaucauggacgaggcccacuuuaccgacccggccucuaucgcugcgcgcggguacaucuccacgcgggugggcaugggcgaggccgcagccaucuucaugacugcgacgccacccgggaccgccgacgccuucccgcagagcaacgccccgauccaggacgaggagcgcgacauccccgagcgcucguggaauagcggcaacgaguggaucacggauuucgccgguaaaaccgugugguucguccccucaaucaaggcgggcaacgacaucgccaacugccugaggaagaacgggaagaaggugauccaacugagccgcaagaccuuugacaccgaguaccagaagacaaagcucaacgacugggacuucguagucaccacggacaucuccgagaugggcgccaacuucaaggccgaccgggugaucgacccccgccggugccugaagccggucauccuaacugacggcccggagcgcgucauccucgcagggcccaugcccgugacggcggcaagcgccgcccagcggcgcggccggguggggcgcaauccgcagaaggagaacgaccaguacaucuucaccggccaaccccugaauaacgaugaggaccaugcgcacuggaccgaggcgaagaugcugcucgacaacaucaacacacccgaggggaucaucccggcccuguucgagccggagcgggagaaguccgccgccaucgacggcgaguaccgccugaaaggggagagccggaagaccuucgucgaacucaugcgccgcggggaccugcccguguggcuggcgcacaagguagccuccgagggcaucaaguacaccgaccgcaaguggugcuucgacgggcagcggaacaaccagauacucgaggagaacauggacgucgagauauggacuaaagagggcgagaagaagaagcugcgcccccgguggcuggacgccaggaccuacagcgaccccuuggcccugaaggaguucaaggauuuugcugcaggccgcaagucgaucgcccucgaucucgucaccgagaucgggcggguaccgagccaucuggcucaucgcacgaggaaugcucucgacaaccucguuaugcugcacaccagcgaacacggcgggaaggccuaccgccacgcgguggaggagcugcccgagacgauggagacccuccugcugcucggccugaugauccugcucaccggcggggccaugcuguuccugaucuccgggaaggggaucggcaagacuucuauugggcucaucugcgucaucgccucuagcggcaugcuguggauggccgagaucccccugcaguggaucgcguccgcgaucguguuggaguucuucaugauggugcugcugaucccggagcccgagaagcagcgcacgccccaggacaaccagcucgccuaugucgugaucgggauccugacccuggccgccaucauugcggcgaacgagauggggcuccuggagacgacaaagcgcgaccucggcaugagcaaggagcccggaguggucuccccgaccagcuaccucgacguggaccugcaccccgccucagcauggacccucuacgccguggcgacgaccguuaucacacccaugcuccggcacaccaucgagaacagcacggccaacguguccuuggccgccaucgccaaucaggcgguugugcugaugggccucgacaaaggauggcccaucagcaagauggaucugggcgugccgcugcucgcccuggggugcuacucccaagucaacccccugacccucaccgccgccgucuuacugcuaaucacccacuaugccaucaucggacccggccugcaggcgaaagccacgcgcgaggcucaaaagcggaccgccgccgggaucaugaagaaccccaccguggacggcauaaugaccaucgaccuggauccgguaaucuacgacagcaaguucgagaaacagcucgggcaggucaugcuacuggugcugugcgcggugcagcugcugcucaugcgcacgaguugggcccugugcgaggcccugacccuagccaccggccccaucaccacgcugugggagggcucuccggggaaguucuggaacaccaccaucgcggucuccauggccaacauauuucggggcagcuaccucgccggggccggccucgccuucuccaucaugaaguccguggggaccggcaagcgcggcaccgggagccagggcgagacucugggggaaaaguggaagaagaagcugaaccagcucucccggaaggaguucgaccuguacaagaaguccggcaucacagaggucgaccgcacugaggcgaaggaggggcugaagcggggcgagaucacccaccacgccgucucccgcggcagcgccaagcuccagugguucguggagcguaacauggugauccccgaggggcgcgucauagaccuuggcugugggcggggugggugguccuacuauugcgccggccugaagaaggugacagaggugcgcggcuacacgaagggcgggccggggcacgaggagcccguccccaugagcaccuacggcuggaacaucgugaagcucauguccgggaaggacguguucuaccugcccccggaaaagugcgacacucugcucugcgacaucggcgaaagcucccccucucccacggucgaggaaucccggaccauccgcgugcucaagaugguggagcccuggcugaagaacaaccaguucugcaucaaggugcugaacccguacaugcccaccguuaucgagcaccucgagcgccugcagcggaagcacggcgggaugcucguacgcaacccccucagccggaacucuacccacgagauguacuggaucagcaacggcacugggaacauagucgccuccgugaacauggugagccgccuguugcugaaccguuucaccaugacccaucgccggcccacgauagagaaggacgucgaucugggggccggcacgcgccaugugaacgccgagccggagaccccgaauauggacgugaucggagagcggaucaagcgcaucaaggaggagcacaacuccaccuggcacuacgaugacgagaaucccuacaaaaccugggccuaccacgggucauacgaggucaaggccacgggguccgccagcagcaugaucaauggcgugguaaagcugcucaccaagccgugggacguggucccaauggucacccagauggcgaugaccgacacuacccccuucgggcagcagagaguguucaaggagaagguggauacucgcacgccccgaucaaugccgggcacgcgccgggugaugggcaucaccgccgaguggcuguggagaacccuggggcggaauaagaagccccgucucugcacucgggaggaguucacgaagaaagugcgcaccaacgccgccaugggcgcgguguucaccgaggagaaccagugggauagcgccaaggccgccgucgaggacgaggacuucuggaagcugguggaccgcgagcgggagcugcacaagcucgggaagugcggcuccugcguguacaacaugauggguaagcgcgagaaaaagcugggcgaguuuggcaaggccaaggggucacgcgcgaucugguacauguggcugggcgcccgcuaccucgaguucgaggcucugggguuccuaaacgaggaccacugguucucacgggagaacaguuacuccggagucgagggcgaaggccuccacaaacugggcuacauucugcgcgauauaagcaagauucccgggggcgccauguacgccgacgacaccgcgggcugggacacgcggaucaccgaggaugaccuccacaacgaggagaagaucacgcagcagauggaccccgagcaccgccagcuggcgaacgcgaucuucaagcugaccuaccaaaacaaaguugugaagguacagcggccgacccccacgggcaccgugauggacaucaucucccgcaaggaccagcgaggcagcggacagguuggcaccuacgggcucaacaccuucaccaacauggaggcccagcugauacgccagauggagggcgaggggguccuguccaaggcagaucucgagaacccccaccuccccgagaaaaagaucacccaguggcuggagaccaaggguguggagcggcucaagcgcauggcgauaagcggagacgacugcgugguaaagccgaucgacgaccgguucgccaacgcgcuguuggcccucaacgauauggggaaagugcgcaaggacaucccgcaguggcaacccuccaagggcuggcacgacuggcagcagguccccuucuguucgcaccacuuccacgagcugaucaugaaggaugggcggaagcuggucgugccgugucgcccccaagaugagcucaucggucgggcccgcaucucccagggggcagguuggagcuugcgggaaaccgcaugccugggcaaggcuuacgcccagauguggucccucauguacuuccaccgccgggacuugcgccuggcgagcaacgccaucugcuccgccgugcccguccauugggugcccacgagccgcaccaccuggucaauccacgcccaccaccaguggaugaccacggaggacaugcucaccguguggaaucgggucuggaucgaggauaaccccuggauggaggacaagaccccagugaccacgugggagaacgugcccuacuuagggaagcgcgaggaccaguggugcggaucccugaucggguugaccagccgagccaccugggcgcagaacauccccaccgccauccagcagguccgcucccuaaucggcaacgaggaguuucuggacuacaugccgagcaugaagcgguuccgcaaggaagaggaguccgagggagccauuugguga

SEQ ID NO: 25991 - RNA, 9873 nt, Artificial Sequence
  derived and/or modified CDS sequence (opt11) from DENV-3__FJ410177__SS-prME
acaagccucugccucaugaugauauugcccgccgcccuggcauuccacuuaacuagccgggacggcgaaccccggaugaucguggggaagaaugaacgcggcaagagccugcuguuuaagaccgccagugggauaaacauguguacccucauugccauggaucugggcgagaugugcgacgacacggugaccuacaagugcccgcauaucaccgagguggaacccgaggacaucgauugcuggugcaaccuuaccagcaccugggugacguacgggacuugcaaccaggccggcgagcaccggcgcgacaagcggagcgucgcucucgccccccacgugggcaugggucuggacacaagaacccagacuuggaugagcgccgagggcgccuggcgccagguggagaagguggagacgugggcacugcgucacccgggguucaccauucucgcgcuguuuuuggcacacuauaucggcaccucccucacccagaaaguggugaucuucauccugcugaugcuugucaccccuagcaugaccaugagaugcgugggggugggcaaccgcgauuucguagagggccuguccggggcaaccugggucgacgucguccuggagcacggcgggugugugaccacgauggccaaaaacaaacccaccuuagacaucgaacugcagaagaccgaagccacccaacuggcgacgcuccggaagcugugcaucgaaggcaagaucaccaacaucacuaccgacagccggugccccacgcagggcgaggccgugcugccggaggagcaggaccagaacuaugucugcaagcacacguacguggaccgggggugggguaacgggugcggucuuuucgguaaggguuccuuagucaccugcgccaaguuccagugucuugagcccauagagggcaaggugguccaguacgagaacuugaaguauaccguuaucauaacuguccacaccggggaccagcaucaggugggcaaugagacccagggggugacugccgagaucacgccccaggccucaaccaccgaagcgauccugcccgaauacggcacccuggggcuagagugcuccccgcgcaccggccuggacuucaacgagaugauacugcucacuaugaagaauaaggcguggaugguucaccggcagugguucuuugacuugccccugcccuggaccagcggcgccacuaccgagacgccuaccuggaacaggaaggagcuccuggugaccuucaagaacgcccacgccaagaagcaagaaguaguggugcuggggucccaggaaggugcgaugcacaccgcgcucacgggggccaccgagauccagaauagcggcgggaccuccaucuuugccggccaucugaagugccggcuaaagauggacaagcucgagcucaagggcaugagcuacgccauguguaccaacacguuuguccugaaaaaggaagugagcgagacccaacaugggaccauccucaucaagguggaguacaagggcgaagaugucccaugcaaaauccccuucucuaccgaggacgggcagggcaaagcgcauaacgggcgccugaucaccgccaacccugugguuaccaagaaggaggagcccgucaacaucgaggccgagccgcccuucggggagagcaacaucgugaucgguaucggggauaacgcccugaagaucaacugguacaagaagggcuccagcaucgggaagauguucgaagcgaccgcucguggggcccgccgaauggcuaucuuaggagacacugccugggacuucgggucugugggggggguccucaacucccuggggaagaugguacaccagaucuucggguccgcuuacaccgcccuguucuccgguguguccugggucaugaagauagguauaggggugcuccugaccuggaucggccugaacagcaagaacacguccaugaguuucuccuguaucgccaucgggaucaucacccucuacuugggggcggugguccaggcugacauggggugcguuaucaacuggaaaggcaaggaguuaaaguguggcagcggcaucuucgugacuaacgagguacacaccuggacagaacaauauaaguuccaagcggacucccccaagagacucgccacugccaucgccggggccugggagaacggggucugcggcauccgcagcacgacccguauggagaaccugcuguggaagcagaucgcgaacgagcucaacuacauacugugggagaauaacaucaagcuuacuguggugguaggggauaccauuggaguucucgagcaagggaagcgcacucugacgccccagccuauggaguuaaaauacuccuggaagaccugggggaaggcgaaaauagucaccgccgagacgcagaacuccuccuuuaucaucgacggccccaacaccccugagugcccuagcgcuucccgggcguggaacgugugggagguggaggacuacggguucggcgucuucaccaccaacaucuggcucaagcugagagagguguacacccagcucugugaccaccgucucaugagcgccgccgugaaggacgagcgugccguucacgccgauaugggcuacuggauagagagccagaagaacggguccuggaagcuggagaaggcgagccugaucgaggugaagacguguaccuggccaaagucccauacccucuggagcaacggcguccuggaaucggauaugauaauacccaagagcuuagccgggcccaucucccagcacaacuaucggcccggcuaccauacccagacggccgggccuuggcaccucggcaagcuggaacuggacuucaauuacugcgagggcaccaccgucgucaucaccgaaaacugugggacgggcgggcccucccuccgcacuaccaccgugaguggcaaauugauccacgaguggugcugccggaguugcacgcugcccccgcuccgcuacaugggggaagacggcuguugguacggcauggagauccggcccauuuccgagaaggaggagaauauggucaagucccugguauccgccgggagcggcaagguggacaacuucacaauggggguucugugccucgccauccuguuugaggagguaaugcgcggcaaguucgggaagaagcacaugaucgcuggcguguucuucaccuucguccuccuccuguccggccagauaacuuggcgggauauggcacacacucugaucaugaucgggagcaacgccuccgaccggaugggcaugggggugaccuaucucgcucugaucgccaccuucaaaauccagccguuccuggcgcucggcuucuuccugcggaaacugacaagccgcgagaaccuccugcugggcguggggcuggccauggccacgacguuacagcugccagaggacaucgaacagauggccaacgguaucgcgcucgggcugauggcccugaagcucaccacccaguucgagacguaccaacuguggaccgcccuaaucagucugaccugcuccaacacaaucuucacucugaccgucgccuggcggaccgcuacgcugaucuuagcgggcgugagccugcucccggucugucaguccagcuccaugcgcaaaacagacuggcuccccaugaccguggcggccaugggggugccuccacucccgcuguucaucuucagucucaaagacacacugaagcggagauccuggccacugaacgagggcguaauggccgugggacucgugagcauccuggccuccagccugcuacgcaaugacguccccauggcggggccucugguggccggcggguuacucaucgccuguuacgugaucaccggcacguccgccgaccugaccguggagaaggccgcggacgugaccugggaagaggaggccgagcagaccggggugagccauaaccugaugaucacuguagacgacgacggcacgaugcggaucaaagacgaugagaccgagaacauccucaccgugcugcugaagaccgcccuccugaucguguccggaaucuucccauacucaauccccgccacccugcucgucuggcauaccuggcagaagcagacccagcgcucgggcgugcugugggacgugccgagcccgcccgagacccagaaggcagagcucgaggagggcgucuaccguaucaagcagcaagggaucuucggcaagacccaggugggggugggaguccagaaggaaggcguguuucacaccauguggcacguaacccgcggggcgguccuaaccuauaacggcaaacgccuggagccaaacugggccucagugaagaaagaccucaucagcuacgguggcggcuggaggcuauccgcgcaguggcagaagggcgaggaagugcaggucaucgccguggagcccggaaagaaccccaagaacuuccaaacgaugcccgggaccuuccagaccaccacgggcgagaucggggcgaucgcccuggauuucaagcccggcacaagcggcagccccauuauaaaccgggaggggaagguggucggacuguacgggaacggcgucgugaccaagaacggggguuacgucaguggcaucgcccagacuaacgccgagccggacgggccaacgcccgagcuggaggaagagauguucaagaagcgcaaccugaccaucauggaucugcaccccgguagcgggaagacccggaaguaccuaccggccaucgugcgcgaagcgaucaagaggcgccuccggacccugauauuggcccccacgcggguggucgcagccgagauggaggaggcccucaagggccugcccauccguuaucagaccaccgcaaccaaguccgagcacacggggcgcgagaucguggacuuaaugugccacgccaccuucaccaugcggcuccugagccccguacgcgucccgaacuacaauuuaaucaucauggacgaggcgcacuucaccgaccccgcguccaucgcugcucggggcuacaucagcacgcgcgugggcaugggugaagcggccgccaucuuuaugaccgcgaccccgcccggcaccgccgacgccuucccgcaguccaacgcgcccauccaggacgaggagcgggauaucccugagcguagcuggaacuccgggaacgaguggaucacggacuucgccggcaagaccgugugguucguccccagcauaaaggcggggaacgauaucgccaauugucuccgcaagaacggcaagaaagugauccaacugucccggaagacuuucgacaccgaauaccagaagacgaaguugaacgacugggacuuuguggugaccacugacaucagcgagaugggagccaacuucaaggccgaccgcguaaucgacccgcggcgcugccucaagccagugauucugaccgacgggcccgagcgggucauccuggccggcccaaugccggugaccgccgccuccgccgcgcagagacgggggcgcgugggccggaacccgcagaaggagaaugaucaguacaucuucacggggcagccucucaacaacgacgaagaccacgcccacuggaccgaggcuaagaugcugcuagacaacaucaacacccccgagggcaucaucccggccuuauucgagcccgagcgcgagaaguccgccgcgaucgacggcgaguaccggcugaagggggagucucgcaagacguucgucgagcugaugcgccgcggcgaccuccccguguggcuggcgcauaaggucgccagcgagggcauaaaguacacggaccggaaauggugcuucgauggccagcgcaacaaucagaucuuagaagaaaacauggacguagagauuuggaccaaggagggcgagaagaagaaacuccggccucgcugguuagacgcccggacguauucugacccguuagcucucaaggaguucaaagacuuugccgcggggcgcaaaagcaucgcccuggaccugguaaccgagaucggccgcgucccaucccaccucgcccaucgcacgcgcaacgccuuagacaaccugguuaugcuccacaccucugagcaugggggcaaggccuaucgccacgcgguggaggagcugcccgagaccauggagacacugcucuuauuagggcucaugauccugcugacgggcggcgcaaugcuguuccugaucucugggaaaggcaucgggaagaccuccauuggccugaucugcgucaucgcaagcuccgggaugcucuggauggcugagaucccgcugcaguggaucgcgucugcuauuguccuggaguucuucaugauggugcuccugaucccugagcccgagaaacagcgcacgccccaggacaaccagcuugcuuacgucgugaucggcauccucacccucgcugcgaucaucgccgcgaacgagaugggccugcucgaaacgaccaagcgggaccugggcauguccaaggagccgggcgugguuagccccaccucauacuuagacguggaccuccaccccgcuucggccuggacccucuacgccguugccacuacggucaucacccccaugcugcgccacaccaucgagaauuccacagccaacgugucgcuugccgccauagccaaccaggcgguggugcugauggggcuugacaagggcuggccgaucucaaagauggaucucggggugccccugcucgcacucgguuguuauagucagguaaacccacugacccucaccgccgccguccuccugcugauuacccacuacgccaucaucggccccgggcuccaggcgaaagccacgcgcgaggcccagaagcgcacugcagccggcauaaugaagaacccgaccguggacggcaucaugaccaucgaccuggaucccgugaucuacgacucaaaguucgagaagcagcuuggccaggugaugcugcuggugcugugcgcugugcagcugcuacugaugagaaccagcugggcccucugcgaggcccugacccucgccaccggccccaucaccacgcucugggaggggucucccggcaaguuuuggaacacaacaauugccgucagcauggccaacaucuuccgaggguccuaccuggcuggcgccgggcuggccuucucuaucaugaaguccguaggcaccggcaagagggggacuggcagccagggggagacccucggcgagaaauggaagaagaagcugaaccaacugagccgcaaggaguucgaccucuauaagaaguccggcaucaccgaaguggaccggaccgaggcgaaggagggccugaagcgcggcgagaucacccaccaugccgucagcaggggguccgccaagcuacagugguucguggagcgcaacaugguaaucccggagggcagagucaucgaccucgggugcggccgcggcggcuggucauacuacugcgcuggccugaagaaggugacggagguacgggguuacacaaaaggcgggcccggccacgaggagcccguucccauguccaccuacgguuggaacaucgugaaacugaugagcggcaaggaugucuucuaccucccgcccgagaaaugugacacccugcugugcgacaucggcgagucgagccccucccccaccguggaagagagccgcaccauccggguacucaagaugguagagccuuggcucaagaacaaccaguuuugcauaaaaguccugaaccccuacaugcccacugucaucgagcacuuagagcgucuccagcgcaagcacggcggcaugcuggugagaaauccccugucccggaacagcacccacgaaauguacuggaucuccaauggcacgggcaauaucgucgccagcgugaacauggucucacggcucuugcuaaaccguuucacaaugacccaccgccgccccaccaucgagaaggacgucgaccucggcgcggggacccggcacgucaacgccgagcccgagacccccaacauggacgugaucggcgagcgcauaaagcggaucaaggaggagcacaacagcaccuggcauuacgacgacgaaaauccguauaagaccugggccuaucacggguccuacgaggugaaggccacugggagcgccuccagcaugauaaaugggguggucaaacugcugacgaagcccugggacguggugcccaugguaacgcagauggcgaugacugacacgacucccuucggccagcagcgcguguucaaggagaagguggacacuagaacuccgcgcucaaugcccggaacgcggcgcguuauggggaucaccgccgaguggcucuggagaacccugggccgcaacaaaaagccccgguugugcacccgcgaggaauuuaccaagaaggugcggaccaacgccgccaugggggcaguguucaccgaggagaaccagugggacuccgccaaggccgccgucgaggacgaggacuucuggaagcucguugaucgcgagcgcgagcuucacaagcugggcaagugugggagcugcguguacaacaugauggggaagagagagaagaaguugggcgaguucgggaaggccaaaggcucccgcgcgaucugguacauguggcugggcgcccgguaccuggaauucgaggcgcuugguuucuugaacgaggaccacugguucagccgcgagaacuccuacagcggggucgagggcgagggucuucauaaacucggguacauccuucgggacauaaguaagauccccggcggggccauguacgcugacgauaccgcgggcugggacacucgcaucaccgaggacgacuuacacaacgaggagaagaucacccagcagauggaccccgagcauaggcaguuggccaacgccauauuuaagcugaccuaccagaacaaggugguuaagguccagcgccccacgcccacgggcaccgugauggacaucauuagccggaaggaucagcgaggcuccggccagguagggacuuacggacucaacaccuucacgaacauggaggcccaacucauccggcagauggagggggagggcguccugucgaaggccgaccuggagaacccccaccucccggagaagaagaucacccaguggcuugagacaaagggcguggaaagacugaagcggauggcgaucuccggcgacgacuguguggucaaacccaucgacgaccgcuucgccaacgcccuccuggccuuaaacgacaugggcaaagugcggaaggacaucccccaguggcagcccagcaagggguggcaugacuggcagcaggucccguucuguucccaccacuuccaugagcucaucaugaaggacggccgcaagcuggucgugcccugccggccacaggacgagcugaucggacgcgcucggaucucacagggugcgggcugguccuuacgcgaaaccgccugccuggggaaggccuacgcccagauguggagcuugauguacuuccaccgccgggaccuccgccuggcguccaacgccaucugcagcgccgugcccguccacugggugcccacaucgcgcaccaccuggagcauccacgcccaccaucaguggaugacaacggaggacaugcugaccguguggaauagagucuggauagaggacaaccccuggauggaggacaagacccccgugaccacgugggagaacgugccauaucucggcaaaagagaggaccaguggugcgggagcuuaaucggacuuaccucccgcgccaccugggcacagaacaucccgaccgccauccagcaaguccggagccucaucgggaacgaggaguuccucgacuacaugccguccaugaagcgcuucagaaaggaggaagagagcgagggcgccaucugguaa

SEQ ID NO: 25992 - RNA, 9873 nt, Artificial Sequence
  derived and/or modified CDS sequence (opt11) from DENV-3__FJ547072__SS-prME
accagccugugccucaugaugauacugccagcggcgcuggcuuuccaccuaacuucccgggacggcgaaccgcguaugaucguggggaagaacgagagaggccguagccuuuuguucaagacagccucggggaucaacaugugcacccuuaucgccauggaccuuggugagaugugugacgauaccgugaccuacaagugcccgcacaucacggaggucgagcccgaagauauagauugcuggugcaaccugaccagcaccugggugaccuacgggaccuguaaccaggccggcgagcaccgccgggacaaacgcuccgucgcgcucgcaccccacgugggaaugggccuggacacccgaacccagaccuggaugucugccgagggcgcguggcggcagguugagaagguggagaccugggcccugcggcauccgggguucaccauacucgccuuauuccuggcccacuacaucggaaccucccuaacacagaagguggugaucuucauucugcugaugcucgucacgcccucgaugacuaugcgcuguguugggguggguaaccgggacuucgucgagggccuguccggagcuaccuggguggacguaguccuagagcauggcgggugcgugacaaccauggccaaaaacaagcccacccucgacaucgaacugcaaaagaccgaggccacccaacuggcgacacuccgcaagcugugcauagaggggaaaaucacaaauauuaccaccgacagccggugcccuacgcagggcgaggccguccugccggaggaacaggaucagaacuacguguguaagcacaccuacgucgaccgcggguggggcaacggcugcggacucuucgggaagggguccuuagugaccugcgccaaauuccagugccuggagcccaucgagggcaaggucguccaguacgaaaaccucaaguacacugugaucaucacgguccauaccggggaccagcaccagguaggcaacgagacacaaggggucaccgccgagauuacuccccaggccuccacaaccgaggcgauuuugcccgaauacggcacccuggggcucgagugcuccccgcguaccggcuuagacuucaacgagaugauccugcucacgaugaagaacaaggcguggauggugcaucggcagugguucuuugaccugccccugcccuggaccagcggcgccaccacugagacgccaacuuggaaccggaaggaauugcugguaaccuucaaaaaugcccacgccaagaagcaggaggucgugguucucgggagccaggagggcgccaugcacacugcuuuaacuggggcuaccgagauccagaacagcggugggacguccaucuucgcugggcaccugaagugccgccugaagauggauaagcucgaguuaaaggggaugagcuacgccauguguaccaauacauuugugcugaagaaggagguguccgagacccaacacgggaccauccucauaaaggucgaguacaagggcgaggacgucccguguaagauuccuuuuagcacggaagaugggcagggcaaggcgcacaacgggcggcugauuacggccaacccuguggugaccaagaaagaggagccagucaacaucgaggccgagccgccuuucggcgaaucuaacauugugaucgguaucggagacaacgcccugaagaucaacugguacaagaagggcaguaguaucgguaagauguucgaggcgaccgcccgcggggcaaggcgcauggcuauccugggcgauaccgcuugggacuucggguccgugggagggguccugaacagccugggcaagauggugcaucagauauuugguucugcuuacacagcccuguucagcggcgugaguugggucaugaaaauaggcaucggcguacuccugacguggaucggucugaacucgaaaaacaccuccaugaguuucuccugcaucgugauugggauaaucaccuuauaccugggggccguaguucaggccgacauggggugcgugauaaacuggaaggguaaggaacuuaagugcgguagcgggaucuucgucacaaacgagguucacaccuggaccgagcaauauaaguuccaggcagacucgccaaaacgucuagcgacagccaucgcgggagccugggaaaacggggugugcggcauccggagcacuacucgcauggagaaccugcuuuggaagcagaucgccaaugagcucaacuacauccugugggagaacaacauuaagcugacggucgugguuggggauauuaucggcgugcucgagcaaggcaagcguaccuugacuccucaaccaauggagcugaaguacucguggaagaccuggggcaaggcgaagauuguuacugccgaaacccaaaauagcucauucaucauagacggcccuaacacacccgaguguccuagcgccucccgagcauggaacguuugggaggucgaggacuacggguucgggguguucaccaccaacaucuggcucaagcugcgggaaguauauacccagcugugcgaccaucgccucaugagcgccgccguaaaggacgagcgggccguucacgcugacaugggcuacuggaucgagucgcaaaagaacgggagcuggaagcuggaaaaggccucguuaauagagguaaagaccugcacguggccgaagucccacacucuuuggucaaacggcgucuuggaaucugauaugauaaucccuaagagccuggcugggccuaucucccagcacaacuaucgcccgggguaccacacccagaccgcgggucccuggcaccucggaaagcuggagcuggauuucaacuacugcgagggaacgaccguggugaucaccgagaauuguggcacccggggucccucacuacgcacgaccaccguguccggaaaguuaauccacgaguggugcugucggucgugcacccuacccccucuaagguacaugggcgaagauggcugcugguauggcauggaaauccggcccaucuccgagaaggaggagaacauggucaagucacucguaagugcaggcagcgggaagguugacaacuucacaauggguguguugugccucgccauccuguucgaggagguuaugcgcggcaaguuugguaaaaagcacaugaucgccgggguuuucuucaccuucguccuacuccuguccgggcagaucaccuggcgggacauggcgcacacccugauaaugaucggcagcaacgcguccgaccgcaugggcaugggcgugacguaccucgcacugauagccaccuucaagauccagccguucuuagccuugggguucuuccugcggaagcugaccucucgcgagaaucuccugcugggggucggccuagcuauggccacuacgcugcaacuccccgaggacaucgagcaaauggcgaaugggauugcguuggggcugauggcgcugaagcucaucacgcaguuugagacuuaccagcuauggacagcccugauaucgcucacgugcuccaacaccauauucacgcugaccgucgccuggcguacggccacucugauuuuagcgggcgucucucuccugcccgugugucaguccagcucgaugcgcaagaccgauuggcuccccaugacuguggcggccaugggcguuccgccccuaccacuguuuaucuucagccucaaggacacgcugaagcgccgguccuggccccugaaugagggcgugauggccgugggccucgugagcauccuggccucgagccugcuccgcaacgacgugcccauggccggaccgcugguggcaggcggccuccuuaucgcgugcuaugucaucaccgggacaucggccgaccugacuguugagaaggccgcugacgugacgugggaggaggaggcggagcaaacaggggucagccacaaccuaaugauuaccguugacgacgacgggacgaugcggaucaaggaugacgagacugagaacauacucaccguccuguuaaaaacagcccuccugauaguuuccggaaucuuucccuauagcauccccgcaaccuuacugguguggcauaccuggcagaagcaaacgcagcgcuccggcgugcuuugggacguacccagcccacccgagacccagaaggccgagcuugaggaggggguguaccggaucaagcagcaggguauauucgggaaaacccaggugggcguagggguccaaaaggaaggcguguuccacaccauguggcacguuacgcgcggcgccgugcucaccuacaaugggaagaggcuggagcccaacugggcguccgugaagaaggacuugaucucguauggcggaggcuggagacucuccgcgcaauggcaaaagggggaggagguacaggugauugccguugagcccgggaagaaccccaagaacuuccagacuaugcccggcacauuccagaccaccacgggggagauuggggccaucgcguuggauuucaaacccgggacaagcgguagccccauaauuaaccgggagggaaaggucguggguuuauauggcaacgguguggucaccaagaauggcggguacgucuccggcaucgcccagacaaacgccgagccggacggccccacccccgagcuggaagaggagauguucaagaagcgcaaucucaccaucauggaccugcacccgggaagcggaaagacgcggaaguaccuaccggccaucgugagagaggccaucaaacguagacuccguaccuuaauucuggcgcccacgcgcgucguugccgccgagauggaggaggcacucaaggggcugccuauacgguaccagaccacggccacaaaauccgagcauacaggaagggagaucguagaucugaugugccacgcgacauuuacgaugaggcuccugagccccgucaggguucccaacuauaaccugaucaucauggacgaagcccacuuuaccgaccccgcaucaaucgccgcccggggguacauuagcacgcgcgugggcaugggagaagcugccgcgaucuucaugaccgcaacgccgcccgguacugcggaugcuuucccgcaguccaacgccccaauccaggacgaggagagggacauccccgagcggagcuggaacaguggaaacgaguggaucaccgauuucgcagggaagacaguaugguuuguacccagcauaaaagcaggcaacgauaucgccaauugccuccguaagaaugggaagaaggugauccagcucucccggaaaacguucgacaccgaguaucagaaaaccaagcucaacgacugggacuuuguugugaccacggacaucagcgagaugggcgccaacuuuaaagccgaccgcguaauagacccaagacgcugccuaaaacccgucauccuaacagacggccccgagcgagugauucuggccgggcccaugccggugaccgccgcuuccgccgcccagcgccgaggcagaguagggcggaacccccagaaagagaacgaucaguacaucuucaccggacagccccucaacaaugacgaggaccacgcccauuggacugaggccaagaugcugcuggauaacaucaacacgcccgaggggaucauccccgccuuauucgagcccgagcgggagaaaagcgcugccauugacggcgaguaccgccugaagggggagucacgcaagaccuuuguggagcugaugcggagaggugaccuccccguguggcucgcccacaagguggccucagagggcaucaaguauaccgaccggaaauggugcuucgaugggcaacgcaacaaucagaucuuagaggaaaauauggacguggagaucuggacaaaggagggcgaaaagaagaagcucagaccucgcuggcuggacgcucgaacguauuccgacccguuggcacucaaagaguucaaggacuucgccgccgggcgaaagagcaucgcgcuagaccuggucacagagaucgggcgagugccaucccaccucgcucaccggacgcgcaacgcccucgacaaccuuguaaugcuccacacgagcgaacacggcgggaaggccuaccggcaugccguggaggagcugcccgagacgauggagacccuccucuuacugggccugaugauccugcugaccgggggcgcaaugcuuuuccuaauuagcggcaaagggaucggcaagaccuccaucgggcugaucugcgucauugccagcagcggaaugcucuggauggccgaaauuccguugcaguggaucgccagcgccaucguguuggaguucuucaugaugguccuccugauacccgaaccggagaagcagcgcacuccccaggacaaccagcuggcguacguggugauugggauccucacccuggcagccauaauagccgcgaacgagaugggccuguuagaaacgaccaagcgggaccuaggcaugagcaaggagccgggggucgugagccccacguccuaucuggacguggaccuccaccccgcaagcgcauggacccuguaugccguggccacgaccguaaucacgcccaugcugcgacacaccaucgaaaauucaaccgcuaacgucagccucgccgcgauugccaaccaagccgucgugcucaugggccuggacaagggauggccgauuuccaagauggaucuaggcgugccccuguuagcgcucggcugcuacucacaagucaacccccuaaccuuaacggccgccguucuccuacucaucacccacuaugcgauaauuggccccggccuccaggccaaagcaaccagagaggcccagaagcgcaccgcugccgggauaaugaagaacccgacgguggauggcauuaugaccaucgaucuagaccccgucaucuacgacucaaaguucgaaaagcagcugggccaggugaugcuccucgugcugugcgcuguccagcuccugcugaugcggacaagcugggcacucugcgaggcccuuaccuuggcuacgggccccauaacgacccucugggagggauccccugguaaguucuggaacaccacuaucgccgucagcauggcgaacaucuuccgcggcuccuaccuggcaggggccggcuuggccuucaguauaaugaaguccguggggaccggcaagcgagguaccgguagccagggcgagacucugggggagaaauggaagaagaaacuuaaucagcugucacgcaaggaguucgacuuauauaaaaagucuggcaucaccgaggucgaccggacagaggccaaggagggguugaagcgcggcgagaucacccaccacgcgguaagccggggcuccgcuaagcuacagugguucguggagcgcaacauggucaucccugaggggcgugucaucgaccucggcuguggucgaggaggguggagcuauuacugcgccggccugaagaaggugaccgagguccggggguacaccaaaggagggccuggccacgaagaaccagugcccauguccacguacgguuggaacaucgugaagcuaaugucagggaaggacgucuucuaucucccgcccgagaagugugauacacuacugugugacauaggugaaaguagcccuucgcccaccguggaggagagccgcaccauccgcgugcugaagaugguggagccuuggcucaagaacaaccaauucugcaucaaggugcugaacccuuacaugccuacggucauugagcaucuugagcggcuccaacgcaagcauggcgggaugcugguccggaacccauuaucccgcaacucgacccaugagauguacuggauuagcaacgggaccggcaauaucguggccagcgucaacauggucagccgccugcugcugaaucgcuucacgaugacgcaccggcggcccaccaucgagaaggauguugaccucggcgccggcacaaggcacgugaaugcugaacccgagaccccaaauauggacgucauaggggaaagaaucaaacggaucaaagaggagcacaacucgacguggcacuacgaugacgagaauccauauaagaccugggcuuaucacggcuccuacgaagugaaggccacagggagcgccuccagcaugaucaacgguguagugaaacuccugaccaaacccugggacguuguacccaugguuacgcagauggccaugaccgacacgacgcccuucggccagcagcggguguucaaggagaaggucgacacgcggaccccgcgcucuaugccgggcacacgcaggguaaugggcauaacagcggagugguuguggcggacgcuggggagaaacaagaaaccccgucugugcacacgcgaagaguuuacuaagaagguucgcaccaaugcugccaugggcgccgucuucacggaagagaaccagugggacuccgcgaaggcagcgguagaggaugaggacuucuggauccuuguggaccgggagcgcgaauuacacaaacuugggaaaugcggauccugcguguauaacaugauggggaaaagggagaagaagcugggagaguuuggcaaggccaaaggcucucgcgcaaucugguauaugugguuaggcgcgcgguaccuggaguucgaggcccucggauuccuuaacgaagaccacugguuuaguagggaaaauuccuacagcggcguggagggggagggccugcacaaguuaggcuauaucuugcgggacaucuccaagauccccggaggcgccauguaugccgacgacaccgcggggugggacacccgcaucaccgaggaugacuugcacaacgaggagaagaucacgcaacagauggacccagagcaccggcagcucgcgaacgcgauuuucaagcugaccuaccagaauaagguggugaaagugcagcgccccacuccuaccggcacgguaauggauaucaucucacguaaggaccagagaggcuccgggcaagucggcaccuauggccugaacaccuucaccaacauggaggcacagcucauaagacagauggagggggaaggaguucugagcaaggcagaucuggagaacccucaccucccggaaaagaagauaacgcagugguuagaaacgaaggggguggagagauugaagcggauggccauauccggcgacgacugcguggugaagcccaucgacgaccgcuuugcgaacgcgcuccuggcccugaacgauaugggaaaggugcggaaggacaucccccaguggcagcccaguaagggcuggcaugacuggcagcaggucccguucugcagccaccacuuucacgaauugaucaugaaggacggacgcaaacuuguaguucccuguagaccccaggacgagcuaauugggcgugccaggaucagccagggggccgguuggucccuccgcgaaaccgcgugccuaggaaaggccuacgcccagauguggagccugauguacuuucaccggcgugaccuuaggcuggccuccaacgcgaucugcagcgccguccccgugcacuggguaccgaccuccaggaccaccuggagcauccacgcccaccaccaguggaugacuaccgaggauaugcugaccguauggaaccgcguauggaucgaggacaauccauggauggaggauaagacccccgugaccacuugggagaacguacccuaccucggaaagcgagaggaccagugguguggcucgcugauagggcugaccucccgcgcaacgugggcccagaacaucccaacugcuauccaacagguacggagccucauaggcaaugaagaguuccuggacuacaugcccuccaugaagcguuuccggaaggaggaggagagcgagggggccaucugguga

SEQ ID NO: 25993 - RNA, 9873 nt, Artificial Sequence
  derived and/or modified CDS sequence (opt11) from DENV-3__FJ547073__SS-prME
accagccugugucugaugaugauccugccggcggcccuggcuuuccaccucacguccagggacggggagccccguaugauaguggggaagaacgagcguggcaagagcuugcuguucaaaacggccucagggaucaacaugugcacccucauugccauggaccugggcgagaugugcgacgacaccgugaccuacaagugcccucacauaacggaaguagagcccgaggacaucgacugcuggugcaaccugacgagcaccugggugaccuaugggacgugcaaccaggcaggcgagcaccggcgcgauaagcgguccguggcccuugcgccucacgugggcauggggcuggacaccaggacucaaaccuggaugagcgccgagggcgccuggcggcaaguagaaaaggucgagacgugggcccugcgccacccuggguucaccaucuuggcgcuguuucuggcccacuacaucggcaccucccugacccagaagguaguaaucuucauccugcugaugcucgugacccccucuaugacaaugcggugcgugggcgucggcaaccgcgauuucgucgagggcuuauccggggcuaccuggguggacgugguacuggaacacggcgggugcguaaccaccauggcgaagaacaagcccacccucgacaucgaguugcaaaagaccgaagcuacacagcuggcgacgcuccggaagcugugcaucgaagguaaaaucaccaacaucaccacagacagccggugcccgacgcagggcgaagcugugcugccugaggaacaggaccagaacuacgucugcaagcacaccuacguggaucgcggauggggcaacgggugcggucucuucgggaagggcucccuggucacgugcgccaaauuccagugccuggagccaauagaagggaagguugugcaguacgagaaccucaaguacacugugaucaucacgguccacaccggggaccagcaccaagugggcaacgagacccagggggucaccgccgagauuacgccccaggccagcaccaccgaggcgauccugcccgaguacggcacucuggggcucgagugcuccccgcgaaccggccuggacuucaacgagaugauccugcucacaaugaaaaacaaggccuggaugguacaccggcagugguucuucgaucugcccuuacccuggaccagcggcgccacaacggagacgccgaccuggaaccgcaaggagcuccuggugaccuucaagaacgcccaugccaagaagcaggaggucguggugcuggggucccaggagggugcgaugcacaccgcccucacgggggcuaccgagauccaaaauaguggggggaccuccaucuucgccggucaccucaagugucggcugaaaauggacaaacuggagcugaaggggaugagcuacgccauguguaccaauacguucguccugaagaaagagguguccgaaacccaacacgggaccauccuuauuaagguggaguacaagggcgaagacgucccuuguaagauccccuucagcaccgaggacgggcagggcaaggcgcacaacggucgccugaucacggccaaccccguggugacgaagaaggaagagcccgucaacauugaggccgagccgccguucggcgagagcaacauugugaucggcaucggggauaacgcccugaagaucaauugguacaagaagggcuccucaaucgggaagauguucgaggcaaccgccagaggcgcccgccggauggccauucugggcgauaccgccugggauuucggcagcgugggcggagucuugaacagccugggcaaaaugguucaccagauuuucggaagugcguacacagcucuguucagcggcguguccugggucaugaaaaucggcauuggggugcuccugaccuggaucggccucaacucaaagaauaccucuaugagcuuuuccugcaucgugaucgggaucaucacccucuaccugggcgccgucgugcaggccgacaugggcugcgugaucaacuggaagggcaaggagcugaagugcggcagcgggaucuucguuacgaacgaggugcacacuuggacggagcaguacaaguuucaggccgauagcccaaagcgucuagccaccgccaucgccggugccugggagaacggggugugcggcaucaggaguacgacacggauggagaaucugcuguggaagcagaucgcuaacgagcucaacuacauccugugggagaacaacaucaaauugaccguaguggugggggacaucauaggcguccucgagcagggcaaacguacccugaccccacagccgauggagcugaaguauuccuggaagaccugggggaaggcgaagaucguuaccgccgagacccagaacagcuccuucaucauagacggccccaacacccccgagugccccagcgccucccgcgccuggaacgugugggaagucgaagacuacggguuuggcguguucaccaccaauaucuggcuaaagcugagggagguguacacccaguugugugaccacagguuaaugagcgcggccguuaaggacgaacgcgccgugcacgccgacauggguuauuggaucgagagccagaagaauggguccuggaagcuggagaaggccagccugaucgaagugaagacaugcacguggccgaaaucccacacccuguggaguaacgguguacuggagucagacaugaucauccccaagagccuggcggggcccauaucccaacauaacuaccgcccgggcuaucacacccagaccgccgggcccuggcaccucggaaagcuggagcuggacuucaacuacugcgaggggacgaccguggugaucaccgagaacugugggacccgcggccccagccuccgaacuacgaccgucucgggcaagcuaauccaugaguggugcugccgaagcuguacccucccaccucugcgguacaugggggaggauggcugcugguacggcauggagauccgccccaucucagaaaaggaggagaacauggucaagucacugguguccgcgggcagcggcaaaguagacaacuuuacgauggggguguugugucucgccauccuguucgaggaggugaugcgggggaaguucggcaagaagcauaugaucgcuggggucuucuucacauucgugcugcuacuguccggacagaucacauggcgcgacauggcgcacacccugaucaugaucggcagcaacgcauccgaccggauggggaugggcgucacguaccucgcccugaucgccaccuucaagauccagcccuucuuagcccucggguucuuccugcgcaaacugaccagccgggagaaccucuuguugggggucggccucgcgauggccaccacgcugcagcugcccgaggacaucgagcaaauggcgaacggcaucgcguugggccugauggcgcugaaacucaucacccaauucgagacauaccagcuauggaccgcccucaucagcuuaacuugcuccaacaccaucuucacccugacaguggccuggcgcacggccacccugauccucgccggggucagccugcugccggugugccaguccagcuccaugcggaaaaccgacuggcuccccaugaccguggcggcgauggguguuccgccccucccgcuguucaucuucagccucaaggacacacugaagaggcgcuccuggccccuaaacgagggggugauggccgugggccucgugagcauucuggccuccagccuccuccggaacgacgugcccauggccggcccccugguggccggcgggcugcucaucgcuugcuauguuaucacagggaccuccgcagaccugaccguagaaaaggccgccgacgugacgugggaggaggaggccgagcagaccggggucagccauaaccuaaugaucaccguggacgaugacgggaccaugcgaaucaaggacgacgaaaccgagaacaucuuaaccgugcugcugaagaccgcccuccugauagucaguggcaucuucccguacagcauccccgcaacccuacucguauggcauacguggcaaaagcaaacacagagauccggagugcugugggacguccccucgccgcccgaaacacagaaggccgagcuggaagagggagucuaccggaucaagcagcagggaauauucggaaagacacaggugggugucggggugcagaaggagggcguguuccacaccauguggcacgucacgcggggagccgugcucaccuacaacgggaagcgcuuagagcccaacugggcgagugugaagaaggaccugaucagcuacggcgggggcuggcggcuuuccgcgcaguggcagaagggggaggaagugcaggugauagcaguggagccaggcaaaaaucccaagaacuuccagaccaugcccggcacauuccagacgaccaccggcgagaucggcgccaucgcgcuggauuucaaacccgggacgagcggcucucccauaauaaaccgcgagggcaaggugguggggcuauacggcaacgggguggucacgaaaaacggcggcuacguguccggcaucgcccagaccaacgccgagccggauggucccacccccgagcucgaggaggagauguucaagaagcggaaccucaccaucauggaccugcaccccggauccggcaagacgcgcaaguaccugccggccaucgugcgggaggccauaaagcgccggcuccgcacccugauccuggccccgacacgggucguggccgcggaaauggaggaggcccugaaagggcugcccauccgguaccagaccacggccaccaagucggaacacaccggccgcgagaucguggacuuaaugugccacgcuaccuuuacgaugcgccuccugagccccguccgggucccgaauuacaaccugaucaucauggacgaagcgcacuucaccgaucccgccuccaucgccgcccgcggauacauuagcacccgggugggcaugggcgaggcagccgcgaucuucaugaccgccacgccgcccgggaccgccgacgccuuuccgcaguccaacgcccccauccaggacgaggaacgggacauccccgagcgcagcuggaacuccggcaacgaguggaucacugacuucgccgggaagacagucugguucgugcccucgaucaaggccggcaacgacaucgcaaacugccuccggaagaaugggaagaaggucauccagcugucccgcaagacguucgacaccgaguaccaaaagacgaaacugaaugacugggacuucgucgucacaacggacauaagcgagaugggcgccaacuucaaagccgaucgggugaucgacccgagacgcugccuaaagcccgucaucuuaaccgacggcccugagcgcgugauccuggccggacccaugccggugacagccgcguccgccgcccagcggcgcggccggguggggcgcaauccacagaaggagaacgaucaguacaucuucaccggccagccccucaauaacgacgaggaccacgcccauuggaccgaggccaagaugcugcuggacaacaucaacacgccugaggggauuaucccggcucucuucgagccugagcgggagaaguccgccgccaucgauggcgaguaccgccugaagggcgagucucggaaaaccuucguggagcugaugcgucgcggggacuugcccguauggcuggcccacaagguggcgagcgagggaauuaaguacaccgaccgcaaguggugcuucgacggucagcgcaacaaucaaauccuggaggagaacauggacgucgagaucuggaccaaggagggcgagaagaagaagcucagaccccgguggcuggacgcccgcacguacuccgacccgcucgcccucaaggaauucaaggacuucgccgccgggcgcaagagcaucgcgcuggaccuggucacugagaucgggcggguacccagccaucucgcucaccgcacccggaacgccuuagacaaucuagugaugcuccacaccucagagcacggcgggaaggccuaccgauacgccgucgaggagcugcccgagacgauggagacccugcuccuucugggucuuaugauccugcugaccgggggcgccauguuguuccugaucagcggcaaggggauagguaagaccuccaucggucugaucuguguuaucgcuagcucuggcaugcucuggauggccgagaucccacugcaguggaucgccagcgccauagugcuggaauucuucaugaugguccuccugaucccugagcccgaaaagcagcggacgccgcaggacaaccagcuagcguacguggugaucggcauacugacccuggcugcuaucauagccgccaacgaaaugggcuuacucgagaccaccaaacgcgaccugggcaugagcaaggagcccggggucgucucacccacgaguuaccuggacguagaucuccaccccgcgucagccuggacccuguacgccgucgccacuacagugaucacgccgaugcugcggcacaccaucgagaauucaaccgcgaacgugagccucgccgccaucgccaaccaggccgucguuuuaaugggccuggacaagggguggccuauuuccaagauggaccuaggcgugccccugcucgcgcucgggugcuauagccaggucaacccccugacauugacggccgccgugcuccugcuuauaacccacuacgccaucaucggccccggacuccaggccaaggcgacccgcgaggcccagaagcggaccgccgccgggaucaugaagaacccgacgguggacggcauuaugacgaucgaucuggaccccgugaucuacgacucaaaguucgagaagcaacugggccaggugaugcuccugguucugugcgcgguccagcuccugcuaaugcgcaccuccugggcgcucugcgaggcccugacccucgccaccggacccauaaccacgcucugggagggcucccccgguaaauucuggaauaccaccauugcgguaagcauggccaacaucuucagggguuccuaccuggccggggccggccuggccuucagcaucaugaaguccguggggaccggcaagcgcggcaccgggagccaaggcgagacccucggggagaaguggaagaagaagcugaaccagcugagccguaaggaauucgaccuguacaagaaguccggaaucaccgaggucgaccgcacagaggccaaggagggguugaaacggggcgagaucacccaccacgccgugagccgcgguagugccaagcugcagugguucguggaacggaauauggucauaccugaggggcgcgugaucgaccucgguugcgggaggggcggguggagcuacuacugcgccggccugaagaaggugaccgaaguccgcggguacacuaagggcggucccgggcacgaggagcccgugccaauguccacguacggguggaacaucgugaagcugaugagcggcaaggacgucuucuaccucccgcccgagaagugcgauaccuuauuaugcgacaucggcgaguccucccccucccccaccguggaggagucucggaccauccgcguccugaagauggucgagccguggcucaagaacaaccaauucugcaucaaggugcugaacccauacaugcccacggugaucgagcaccuggagcgcuuacagcguaagcacggggggaugcuggugcgcaaucccuuaucgcgaaacagcacccacgagauguacuggaucuccaacggcaccggcaacaucguggcuagcgugaacauggugucccgccucuugcugaaccgguucaccaugacccaccgccggccgaccaucgaaaaggacguggaccucggcgccggcacccgacacguaaacgcggagcccgagacaccgaacauggacgucaucggagagcggauaaagcgcauaaaggaggagcacaacagcacuuggcacuacgacgaugaaaacccguacaagacaugggccuaccacggcuccuacgaggugaaggcgaccgggagcgccuccucaaugauaaacggaguagugaagcugcugaccaagcccugggacgugguacccauggugacacagauggcaaugaccgacaccacccccuucgggcagcagcggguguuuaaggagaaagucgauacacgcaccccgcggagcaugccaggcacccgccggguuauggguaucaccgcggaguggcucuggcgcacguuagggcgcaacaagaagccccgccugugcacccgggaggaguucaccaagaaggugcgcacuaaugccgcuaugggcgccgucuucaccgaggagaaccagugggacuccgcgaaggccgcaguggaggacgaagacuucuggauccuaguggaccgcgagcgggaacugcacaaacuggggaagugcggcaguugcgucuauaauaugauggggaagcgcgagaagaagcucggcgaguucggcaaggccaaggguuccagggccaucugguacauguggcuaggcgcaagguaccuggaguucgaggcgcucggguuccugaacgaagaccacugguuuagccgggagaacuccuacagcggcguagagggggaaggccugcacaagcucgguuacauccugcgcgacaucuccaagauccccgggggcgccauguacgccgacgacaccgccgggugggacacccggaucaccgaggacgaccugcacaacgaggagaagaucacgcaacagauggauccggagcaccgccagcucgcaaacgcaaucuucaaacugaccuaccagaacaagguggugaaagugcagcggcccacccccacggggaccgugauggacaucaucagccgcaaggaccagcggggguccgggcaggucggcacguacgggcugaauaccuucacaaacauggaggcacagcucauccgccaaauggagggcgagggggugcugucaaaggccgaccuggagaacccccaccugccggaaaagaagaucacucaguggcuggagacgaagggcgucgaacgguugaagcgcauggccaucuccggcgacgauugcgucguaaagcccaucgacgaccgguucgcgaacgcccuccuagcccugaacgauauggggaaggugcgcaaggacaucccccaguggcagcccagcaagggguggcacgacuggcagcaggucccuuucugcucccaccacuuccacgaguuaaucaugaaggacgggcggaagcugguugugccaugcaggccacaggacgagcugaucggccgggcuagaaucagccagggugccggcuggucccuacgggagaccgcaugccugggaaaggcguacgcgcagauguggagccugauguauuuccaccgccgcgacuugcggcuggccuccaacgcgauuuguucggccguucccgugcacugggugccgaccucccgcaccacauggagcauccacgcccaccaccaauggaugaccaccgaggacaugcuaaccguguggaaccggguguggaucgaggauaaccccuggauggaggacaagacgcccguaaccaccugggagaacgugcccuaccucgggaaacgggaggaucaguggugcggcagccugauugggcugacgucccgggcaacgugggcccagaacauccccacugccauccagcaaguccgcagccucauuggcaacgaagaguuccuggacuacaugccguccaugaaacgguuucgcaaggaggaggaaagcgagggugccaucugguga

SEQ ID NO: 25994 - RNA, 9873 nt, Artificial Sequence
  derived and/or modified CDS sequence (opt11) from DENV-3__FJ547074__SS-prME
accucccuaugucucaugaugauccugcccgcggcgcuagcguuucaucucaccagccgggauggggagccucggaugaucguggggaagaacgaacgcgguaagagccuccuguucaagacugccagcgggaucaacaugugcacccucaucgcgauggacuuaggagaaaugugcgacgauaccgugacguauaaguguccccacauaacggaggucgaacccgaggacauugacuguuggugcaacuuaacuagcaccugggugaccuacgggacaugcaaucaggcaggcgaacaccgaagagacaagcgcaguguggccuuagcgccccacgucggcauggggcuggacacgcgcacccagacauggauguccgccgagggcgcauggcggcaaguagaaaaagucgagacgugggcgcuacggcacccgggcuuuaccauccuugcguuguuccuggcucacuauaucggcacauccuugacccagaagguggugaucuuuauauugcugaugcucguaacgcccuccaugaccaugcgaugugucggggucgguaaccgcgacuucguugagggccuguccggggccaccuggguggauguagucuuggaacacggggggugugucacgacgauggccaagaauaagcccacccuagacaucgaguugcagaaaacugaagcaacccaacucgcgacgcuccggaaguugugcaucgaagguaagauuaccaacaucaccacugacagcagaugccccacgcagggcgaggccgugcugccagaggagcaggaccagaacuacgucugcaagcauaccuacguggaccggggguggggcaacgggugcggccucuuugggaaggguucccucgugacgugcgcgaaguuccagugccuagagcccauagagggcaagguugugcaguaugagaaccucaaguauacgguaaucauaacggugcauaccggugaccagcaccaagugggcaacgagacccaggggguuaccgcggagaucacgccucaggccuccacgacugaggcgauccugccugaauacggcacccuggggcuggaaugcuccccgcgaacgggcuuagacuucaacgagaugauccugcuaacuaugaagaacaaagcuuggauggugcaccggcagugguucuucgaccugccccuacccuggaccuccggcgccaccaccgagacuccuacguggaacaggaaggaacuccuggugaccuucaaaaacgcccacgccaagaagcaggaagucguagugcuggggucccaggagggcgcuaugcacaccgcccuuacgggggccacugagauccagaacucggguggcacguccaucuuugccggacaucugaaauguagacugaagauggacaaacucgaacuuaaaggcaugucguacgccauguguaccaacacguuugugcugaaaaaggagguaucagagacccaacacgggacuauccugaucaaggucgaguacaaaggcgaggacgucccguguaagauucccuuuagcaccgaggacgggcagggcaaggcucacaacgggcgccuaauuacggccaaucccguggugaccaagaaggaggagcccguaaacaucgaggcggaaccgccauuuggggagucuaacaucgugaucggcauuggagauaacgcacugaagauuaauugguacaaaaaaggcuccucaaucggcaagauguucgaagcgacggcccgcggcgcccgccguauggccauccugggcgacaccgccugggauuucggguccguaggcgggguccucaacagccugggcaagauggugcaccagauuuucggcuccgcguacacggcccuguuuagcggcguguccugggucaugaagaucggcauaggggugcuccuaacguggaucggccugaauagcaagaacaccuccaugagcuucuccugcaucgugauugggaucauuaccuuauauuugggcgcagucgugcaggcagacauggggugcgugaucaacuggaaagguaaggaacugaagugcggcagcgggauuuucgucacgaaugaggugcacaccuggacggagcaguacaaguuccaggccgauucgcccaaaaggcucgcaaccgcaaucgccggagccugggagaacggggugugcggcauccgcucaacgacuaggauggagaacuuacuguggaagcagaucgccaaugagcucaacuauauccugugggagaacaauauaaaacugaccguugugguuggggacaucaucggcgucuuagagcagggcaagcgcacgcuuacgccccaaccgauggagcugaaguacuccuggaagaccuggggaaaggcaaagaucgugaccgcagagacacagaacagcuccuucaucaucgacggccccaauacgcccgagugcccuagugccucccgagccuggaacgugugggaggucgaggacuacggguuuggcguuuuuaccaccaacauauggcucaagcugcgcgagguguacacgcagcugugcgaucacagacuuaugagcgccgccgucaaggacgagcgggccgugcacgcugacaugggcuauuggaucgagagccagaagaacggguccuggaaacuggagaaggccagccugauagaagugaagacuugcacguggccgaagucacacacucucuggucaaauggcguccuggaauccgacaugaucaucccuaaaucgcuggcggggcccauuucccagcacaacuaccggccuggauaccacacgcagaccgccgggcccuggcaccuggguaagcuggaguuggacuucaauuacugcgagggcacgacuguggugaucaccgagaacugcggaacgcgcggccccagcuuacggacgacgaccgucuccggaaagcugauccacgaauggugcugccguaguugcacguugcccccguugcgguacaugggugaggaugggugcugguacggcauggagauacgaccaaucuccgagaaagaggagaacauggucaagagcuuggucuccgcggguuccgggaaggucgacaacuuuacgaugggcguacucugucucgccauccuguucgaagaggugaugcgaggaaaauucggcaagaagcacaugauagccggggucuucuucaccuuugugcugcuccuauccggccagauuacuuggcgggacauggcgcacacacugaucaugaucggcaguaacgcuuccgaccggauggggaugggcguaacguaccuagcccugaucgccaccuucaaaauccagcccuuccuggcauuaggguucuuccugcgaaaacugaccucacgggaaaaucuccuccugggggucgguuuagcgauggcaacgacgcugcaacuccccgaagacauagagcagauggccaacgggaucgcccucggcuugauggcguugaagcucaucacccaguucgagaccuaccaguuauggaccgcccucauuucucugacaugcuccaacacaaucuuuacccugaccgucgccuggcgcaccgccacacucauccucgccggagucagccugcugccggucugccaguccagcuccaugcggaagacggacuggcugccuaugacuguugcggccaugggcgugccgcccuuaccucuguuuauauucagccuuaaggacacgcugaaacggagguccuggccacucaacgagggggugauggccgucggcuuggucagcaucuuagccuccaguuuacuccggaacgacgugccgauggcaggaccgcugguggccggugggcugcucaucgccugcuacgucauaaccggcaccuccgccgaucugaccgucgagaaagccgcugacguuacaugggaagaggaagcagagcagaccggggucucacacaaccugaugaucacgguggacgacgaugggaccaugcgcaucaaggaugacgagaccgagaacauccuaacggugcugcugaaaaccgcucugcugaucgucuccggaaucuucccuuacagcauccccgcgaccuuacucguguggcacaccuggcagaagcagacgcaacggucgggcgugcugugggacguccccagcccucccgagacccagaaagcagaguuagaggaggggguguacagaaucaagcagcaggggaucuucggaaagacgcaaguaggggucgggguucaaaaggaaggcguuuuccacacgauguggcacguuaccagaggcgccguacuaaccuauaacgguaagcgucuggaacccaacugggcaucugucaagaaggaccugaucagcuacgggggcggcuggcggcucagugcccaauggcagaagggugaggagguccaggugaucgcgguggagccugggaagaaucccaagaacuuucagaccaugcccggcaccuuucagacgacgacgggggaaaucggcgccaucgcgcuggacuuuaagcccgggaccaguggcagcccuauuaucaacagagaggguaaggucgugggccuguacggaaacggggucgugacaaagaacgguggguauguguccggcaucgcccagaccaaugccgaaccggacgguccaacccccgagcuggaggaagagauguucaaaaagcggaaccucaccaucauggaccugcacccagggaguggcaagacgcgcaaauaccugccggccaucgugcgggaggccauaaagcgccgguuacguacccugauccuggccccgacucgugucguggccgccgagauggaggaggcacucaaggggcucccgauacgcuaccagaccacagccacgaaguccgagcauaccggucgggagauaguggaccugaugugucacgcgaccuucacgaugcggcugcugagccccguacgggugccuaacuacaacuugauuaucauggacgaggcccacuucacggacccggcaagcaucgccgcccgcggguacaucagcacccgugugggaaugggcgaggcggccgccauauuuaugacagcgaccccccccgggaccgccgacgccuuuccacagucgaacgccccaauccaggacgaagaacgcgacauccccgagcgcagcuggaacagugguaaugaguggaucaccgacuuugccgguaaaaccgucugguucguuccaucaaucaaagccggcaaugauaucgcgaacugucuacggaaaaauggcaagaagguaauucagcugagucgcaagacuuucgacaccgaguaccagaaaaccaagcugaacgauugggacuucgucguaaccacagacauuagcgagaugggcgccaauuucaaggcagaucgaguaaucgauccgcgacgcugccucaagcccgugauucugaccgauggccccgagagggugauccuggccggucccaugccugucacagcagcgucggccgcccagcgucggggccgggucgggcgcaauccccagaaggaaaacgaccaauacauuuucacaggccaaccccucaacaacgaugaggaucaugcccacuggaccgaggcgaagaugcugcuagacaauaucaauacccccgaggggaucaucccggcccucuucgagcccgagcgggagaagucggccgccaucgauggcgaauaccgccugaagggcgagucccggaagaccuucguugaacugaugcgccgcggugaccuucccgucuggcuggcccacaagguggcgagcgagggcauuaaauacaccgaccgcaaguggugcuucgacgggcagcggaacaaucagauccuggaggaaaacauggacguagagaucuggaccaaagagggcgagaagaagaaacuccgcccccgguggcucgacgccagaacuuacuccgacccccuggcccucaaggaguucaaagacuucgccgccggccgcaagucuaucgcccuggacuuaguuacugagaucgggcggguacccucccaccucgcccacagaacccggaacgcgcuagacaaccuagugaugcuccacacgagcgagcacggcggcaaggccuaccgccacgccgucgaggagcugcccgagacgauggagacacuguugcugcucggccuaaugauacugcugacagggggcgcuaugcuguuucugaucagcggcaaggggaucggcaaaacguccaucgggcucauuugcgugaucgccaguuccgggaugcucuggauggcugagaucccgcuacaguggaucgccucggcuaucguccuggaauucuucaugaugguccuucuaauccccgagcccgagaaacaacgaacgccccaagauaaccaguuggccuacguggugaucggaaucuugacgcucgccgccauaaucgccgcaaacgagaugggccugcuagagaccacuaaacgggaccugggcauguccaaggagccgggagucguguccccgacgaguuaccuggacguagaccuccaucccgcgucagccuggacccuauacgcuguagccaccacagucaucacgccuaugcuccggcacaccaucgagaacucuaccgcuaacgugagccuggcagcgaucgccaaccaggcgguggugcuaaugggccuugacaaagguuggccuauauccaagauggaccucggcgugccguuauuagcgcucgggugcuacagccaagugaacccccugacccugacggcagccguauugcuccucauaacccacuacgccaucaucggcccuggccuccaggccaaggcgacuagggaggcacagaagcggaccgcugccgggaucaugaagaacccuacgguggacgguaucaugaccaucgaccuggacccagucaucuaugacuccaaguucgagaagcaacugggacaagugaugcucuuagugcugugcgccguccagcuucuacugaugcgcacuagcugggcuuuaugcgaggcacugacccuugccacgggccccaucaccaccuugugggaaggcagccccgggaaauucuggaacacgacgaucgccgucagcauggcgaacaucuuccggggcucguacuuagccggagccggccuggccuucagcaucaugaaguccguggguaccgguaaaaggggcaccgggagccaaggcgagacccuuggggagaaguggaaaaagaagcugaaccagcucagccggaaggaguucgaccucuacaagaaguccggaauuaccgagguagaccgcacggaggcgaaggaggggcugaagcggggcgagauaacccaccaugcggugagccgcgguuccgcaaagcuucaaugguucguugaacggaacauggucaucccggaagggcgcgugauagacuuggggugcgggcggggggggugguccuacuacugcgccgggcugaaaaaggugaccgaggugaggggcuacaccaagggcgggcccgggcacgaggagcccgugccuauguccacauacggcuggaacaucgugaaacugaugucaggcaaagacgucuucuacuugccaccggagaaaugcgacacucuucuuugugacaucggcgaauccagucccucccccacuguagaggaauccagaacaauccguguccugaagauggucgaaccguggcuuaagaacaaccaguucuguaucaagguucugaaccccuauaugcccacgguaaucgagcaccuggaacgacuucagcgaaagcacggcggcaugcugguacgcaacccccugucccggaauagcacccacgagauguacuggaucuccaacggcacugggaacauuguagccagcgugaacauggucuccaggcuccugcugaaccgguucaccaugacuuauagacggccgaccauugaaaaggacguggugcucggcgccggcacccggcacgucaacgcggagccggagacccccaacauggaugugaucggggagcggaucaagcgcaucaaggaggagcacaacagcacauggcacuaugacgacgagaacccguacaaaaccugggccuaccacggguccuaugaggugaaagccacugguucggcuuccagcaugaucaacggcgugguuaagcuucugaccaagcccugggacgucguaccuaugguaacgcagauggccaugaccgacaccacucccuucggccaacagcgggucuucaaggagaagguggacacucgcaccccgcggagcaugcccggcacccgccgggugauggggauuacggccgaauggcucuggcgcacgcuugggcggaauaagaagccccgccuguguacccgggaagaguucacuaagaaaguccgcacaaacgccgccaugggagccguauucacggaagagaaccagugggauuccgcgaaagccgcgguggaagacgaggacuuuuggauccucguggacagagagcgagaacuucacaagcugggcaagugcggcaguugcguguauaacaugauggggaagcgcgagaagaagcuaggcgaauucgggaaggccaaggggucuagggccaucugguacaugugguugggggcgcgcuaccuagaguucgaagcucucggguuccugaacgaggaccacugguucagccgcgagaauaguuacuccggcgucgagggagagggccugcacaagcugggcuacauccugagagacauuuccaagauaccagggggcgccauguaugcugaugacaccgccgggugggacaccaggaucaccgaagacgaccugcacaacgaggagaaaaucacucagcagauggacccggaacaccgacagcuugcgaaugccaucuucaaguuaacguaccagaacaaggucgucaaggugcagcgacccacccccacaggcacagucauggauaucauaucgcgcaaggaccagcgcggcuccgggcaggugggcacguacggguugaauaccuucaccaacauggaggcccagcuaauccgccagauggaaggcgaggggguauuaagcaaggccgaccuggagaacccccaccuaccagaaaagaagaucacccagugguuggaaacgaaaggcguagagagacugaagcgcauggccauauccggcgacgacugcguggugaagccaauagacgaucgguucgcgaacgcccugcuugcacugaacgacauggguaaaguccguaaggauaucccucaguggcagcccagcaagggcuggcaugacuggcaacaaguccccuucugcucacaccacuuucacgaacucaucaugaaggacggucggaagcucguggucccuugccgaccucaggacgagcugauaggcagggcucgcaucucccagggggccggcuggucucuccgggagaccgcgugccuagggaaggccuaugcccagauguggagccugauguacuuccacaggcgcgaccuccgguuggccuccaacgcgaucuguagugcgguuccugugcacugggugccaaccucccgcacaacguggagcauccacgcgcaucaccaguggaugaccacagaagacaugcugacaguguggaaccguguguggaucgaggacaaccccuggauggaggacaagacgcccgucacaaccugggagaauguucccuaccucggcaagcgagaggaccaguggugcggcagcuuaaucggacugacgagccgggccacgugggcucaaaacauuccaacagcgauccagcagguccgaagccucaucggcaacgaggaauuccuggacuauaugccaucuaugaaacgauucaggaaagaggaggagucagagggggccauaugguaa

SEQ ID NO: 25995 - RNA, 9873 nt, Artificial Sequence
  derived and/or modified CDS sequence (opt11) from DENV-3__FJ547075__SS-prME
acgagucucugccuaaugaugauacuucccgcagcucucgcauuccaucucaccuccagagauggagaacccagaaugaucgucggcaaaaacgaaagaggcaagagcuugcuauuuaaaacggccucaggaauaaauaugugcacccugauagcgauggaccugggagaaaugugcgaugacacugugacguauaaauguccccacauaaccgaagucgaaccagaagacauagacugcuggugcaaccugacaaguaccuggguaacauacggaacaugcaaccaggcgggggagcaccgacgagacaagaggucggucgcacucgccccacaugugggcaugggccuagacacucgaacacagacuuggaugucugcagaaggcgcauggcgccaagucgaaaaaguggaaaccugggcccucaggcaccccgguuuuacaauccuagcacucuuccucgcucacuacaucggaacuagccuaacacaaaaagucgugaucuuuauuuugcucaugcucgugacgccgagcaugacgaugcgauguguaggagucggaaaccgcgauuucguugaaggccuaagcggcgccacuuggguggacguagugcuagaacaugguggcuguguaaccacgauggcgaaaaacaaacccacgcuugacauugagcuacagaaaaccgaggcaacacaacucgcaacuuugcgaaaacugugcauagaagguaagaucacgaacauaaccaccgacagccggugccccacacagggcgaagccguacugccagaagaacaggaccaaaacuacguauguaagcacacauacguagaucgggggugggguaauggcugcggccuguucggaaaggggucgcuagucacgugcgccaaauuucaaugucuagaaccaaucgagggcaaaguuguccaauacgagaaccuaaaauacacggucaucaucacaguccauacgggagaucagcaccaggucgguaacgaaacgcaggggguaacagccgaaauaacuccucaggcaagcaccaccgaagccauacuaccagaguacgggacgcucggccuagagugcagcccgcgaaccggccuggacuuuaaugaaaugauccuccuaaccaugaaaaacaaagcauggaugguucaccgccagugguucuucgaccugccccuuccguggacgucaggagcuacgacagagaccccaaccuggaauagaaaagagcuccucgugacauucaagaaugcccaugcgaagaagcaagaggucguaguccuagguucucaggaaggcgccaugcacacagcacucacaggugccaccgagauccaaaacuccgggggaacaucgaucuuugccggucaccucaaaugcagguuaaaaauggacaaacuagagcuaaaaggcaugagcuacgcaaugugcacaaauacguucguucucaagaaggaggucucggagacacaacacgguacgauacugauaaaaguggaguacaaaggagaggacgugccaugcaagauacccuucucgacagaagacggucaagggaaggcacacaacggaagguugaucaccgccaaucccguggucaccaagaaagaagaacccguaaacaucgaagcugaaccacccuucggagaaaguaacaucgugaucggcauuggggacaacgcacuuaaaaucaacugguacaagaaaggcagcuccauuggcaagauguucgaagcaacagcacgaggagcccgaagaauggcgauccuaggugauaccgcaugggacuucggaucgguaggcggagugcucaauagccuggggaaaaugguacaccagaucuucggaucugcauacacagccuuauucucagggguuucgugggucaugaaaaucgggauagguguccugcuuaccuggaucggguugaacagcaagaacaccuccauguccuuuucaugcauagucauagggauaauaacacuauaccuaggggcagucguacaagcagacaugggcugcguuaucaacuggaaggggaaagagcuuaaguguggauccgguaucuucgucaccaacgaaguucauacauggacagagcaauacaaauuccaagcugacucccccaaaagacuagccacagcaaucgcaggggcaugggaaaacggcguaugugggauuagauccaccaccagaauggaaaaucuguuguggaaacagauugccaacgagcucaauuauauacuuugggaaaacaacauaaaacuaacgguaguugugggggacauuauaggaguucuagaacagggaaaacgcacccuaaccccacagcccauggagcucaaguauaguuggaagacguggggaaaggcaaagauaguuaccgcggagacgcagaauagcucguucauaauugaugggccgaacacgccagagugccccagcgccucccgggcguggaaugugugggaaguagaggacuacggcuucggggucuucacuacgaauauuuggcucaagcucagagagguauacacacaacucugugaccaccgacucaugagcgcagcaguaaaagacgaaagagcggugcacgcggacaugggauacuggauagaaucccagaaaaacgguucuuggaaacucgagaaggccucgcugaucgaaguaaaaacgugcacauggcccaaaagccacacucucuggagcaauggaguacucgaaucagauaugauuauaccgaaaagccucgcagguccaaucucucaacacaacuaccgccccggauaccauacccaaaccgccgggccuuggcaucuaggaaaacuggaacuagacuucaacuauugcgaagggacgacuguagucauaacagaaaacugcggaacucgaggcccaagucuccgaaccaccaccgucucaggcaagcuaauccacgaauggugcugucgcagcuguacucuaccucccuuaagauacaugggggaagauggguguugguacggcauggagauucggccuaucagcgagaaagaggaaaacauggucaaaagccucgugagugccggcagcgggaagguggacaauuuuaccauggggguccuaugccuagcaauacuuuucgaggaggucaugcguggcaaguucggaaagaagcacaugaucgcaggcguauucuucacauucgucuuacuacuuagcggacagaucaccuggcgggacauggcacauacgcugaucaugauaggaaguaacgcaagcgacagaaugggcaugggaguaaccuaccuagcucucauagcgacauucaagauucagccguuccucgcucuuggguucuuccugcgaaaacuuaccucuagggagaaucuccuacugggcgucggccuggcgauggccacgacgcuacaacuucccgaggacauagagcaaauggcgaacggaauugcgcuuggccuuauggcccugaagcuaauaacucaauuugagacauaccaguuauggacagcucucauuucccuaaccuguagcaacacaaucuucacgcugacgguugcauggcguaccgccacccuaauauuagccggagucucccuacuaccugugugccagagcaguucaaugcggaaaaccgacuggcuacccaugacaguugcggcgaugggaguaccgccgcugccgcuguucaucuucucacuaaaagauacgcuaaaacgucgauccuggcccuugaacgagggaguaauggcggugggacucguauccauacuagcgaguucccucuugcgcaacgacgucccaauggcagggccccuaguggcgggugggcuccuaauugcguguuacgugauaacagggaccagcgccgaucuaaccguggaaaaagcggcggauguaacaugggaagaggaggccgaacagacagguguaagccacaacuuaaugauuacaguagacgacgaugggacuaugcguauaaaagaugaugaaacggagaacauccugaccguacugcuaaaaacagcgcuccuuauuguaagcgggauauuccccuacucaauaccugccacucuacugguauggcacacauggcagaagcagacccagaggagcggagugcuaugggauguuccaucaccuccagaaacacagaaagcugaacuagaagaaggggucuaccgaaucaaacagcaagggauauucgggaaaacccaaguuggcgucggaguccaaaaggaagguguguuucacacaauguggcaugucacccgcggagccguacucacguacaacgggaaacgacuagaaccgaacugggccuccguaaagaaagaucucauaaguuacgggggcggauggcgccuaagcgcacaauggcagaaaggggaagaaguucaggugauagcaguggagccuggcaaaaacccgaaaaacuuccagaccaugcccggaacauuccaaacaacuaccggcgaaauuggcgcaauagcucuggauuucaagccagguacaaguggaucaccgauaaucaacagggaaggaaaggucgugggacuauacgggaacggcguagucacuaagaauggaggguauguauccggaaucgcucaaacuaacgcagaauccgauggacccaccccagaacuagaagaggaaauguucaagaaacgaaaucuaaccauaauggaccugcacccgggcagcgggaaaacucgcaaguaccugcccgcgauagugcgggaggcgaucaaaagacgacucagaacacuaaucuuagcaccaacaagaguagucgccgccgaaauggaagaagcacugaaggggcuacccauacgguaccagacaacagcgacuaaaagugaacauaccgggagagagaucgucgaccuuaugugccacgccaccuucacuaugcgacuucucucgccagugcgcguaccgaacuacaaccuaauuauaauggacgaggcccacuucacagacccagcgagcaucgccgcacggggauauauaucgacccguguggggaugggggaagccgccgcuauauuuaugacggccaccccgcccggaacagcggacgccuucccgcaaaguaacgcaccgauccaagaugaggaaagagacauccccgagcgcucguggaacucagggaacgaauggauuaccgacuuugcaggaaaaacaguaugguucgugccaagcauaaaagcuggaaacgacaucgcaaacugccugagaaagaauggaaagaaaguaauacaacuaucacguaagacauucgacacagaauaucaaaagacaaaacuaaacgacugggauuucguaguaacgaccgauauauccgagaugggagcaaacuuuaaagccgacagagucaucgacccaaggaggugccuaaaacccguaauuuuaacugacgggcccgagcgaguuaucuuagcggggccaaugcccguaacggcggcuuccgcggcgcagagaagaggaagagugggacggaacccgcagaaagagaacgaccaauacaucuuuacaggccagccguugaacaacgacgaagaccaugcccacuggaccgaggccaaaaugcucuuggacaacauuaacacccccgaaggaauaaucccagcucucuucgagccggaaagggaaaaauccgccgcaauugacggagaauacagacugaagggcgaaucaagaaagaccuucguagaacucaugcgccggggagaucuccccguauggcuugcgcacaaaguagcauccgaaggcauaaaauacacagaccggaaauggugcuuugacggccaacgcaacaaucagauauuggaagagaacauggaugucgaaauuuggacgaaggagggcgaaaagaagaaauugcgcccaagauggcuugaugcacgcacauacucugacccccuagcucuaaaagaauuuaaagacuucgccgccggacgaaagucaauagcgcuggaccuagugacggagauaggccgcguuccgagccaccuggcacaccgaacacgaaaugcccucgacaaccuagucauguugcacaccuccgaacacgggggcaaggccuaccgccaugccgucgaagaacuaccugaaacgauggagacacuccugcuguuagggcucaugauccuauuaacagggggcgcaaugcuauuccucaucuccggcaaagguauuggaaagacgucuauaggccuaauuugcguaauagcuaguuccggcaugcuauggauggccgaaaucccgcugcaauggauagcguccgcgauuguacuagaguucuuuaugaugguccugcuaauccccgaaccagaaaagcaaaggacgccgcaggacaaucaguuagcauacguagucauugggauccugacucuagcagcaauaaucgcagcaaacgaaaugggacuacucgagacaacgaaacgagaucucggaauguccaaggagcccggcgugguaucuccaaccagcuacuuggacguagaccuucaccccgccucagcguggacgcucuaugccguagcaacaacaguuaucacaccaaugcuacgccacacaauagagaacucaaccgcaaacguuucacucgccgcgauagcgaaccaggcagucguccucaugggacuggacaaaggguggcccaucaguaaaauggaccuagggguaccgcuccucgcccugggguguuacucgcaaguuaauccccugacacuuacagcagccguucugcuccucauuacccacuaugccaucauuggcccaggcuuacaggccaaggcaacacgcgaggcccaaaaacgcacggcugccggcauaaugaagaaccccacgguagacgggauuaugacgauagaccuagaccccguuaucuacgauagcaaauuugagaagcaacugggccaaguuaugcuauuagugcugugcgccguccaauuacuacuaaugagaaccaguugggcacuaugugaagcucuaacacuggcgaccgggcccauuacaacauuaugggagggcaguccgggaaaguucuggaacacaacaauagcgguuaguauggccaauaucuuccgcggcucauaccuggcgggagccggcuuagccuucagcauuaugaaaaguguuggcacgggaaaacggggcacagggucucaaggcgaaacacucggagaaaaauggaaaaagaagcugaaucaacuuagccgcaaagaguucgaccuguacaagaaaagcggcauaacagagguugacaggacggaggcaaaagaagggcuaaaaagaggagaaaucacacaucacgccgucucgcgggguagcgcaaaacuacaaugguucguggaacgaaacaugguuauccccgagggcagaguaaucgaccuugggugugguagaggcggcugguccuacuauugcgcaggccuuaagaaggucacagaaguaaggggguauacaaagggcggccccggacacgaagaacccgucccgaugagcacuuacggcuggaacauugugaaacuuaugucuggcaaagacguauuuuaucuaccaccagagaagugcgacaccuugcuuugcgauaucggagaaucgucuccuuccccaacaguggaagagucaagaaccauaagggugcuaaaaaugguugaacccuggcucaaaaauaaccaguucugcaucaaagugcugaauccguauaugccaacaguaaucgaacaccuagaacgccuacagcgaaaacauggcggaauguuaguacgaaacccgcugucacgcaacucgacgcacgagauguacuggaucaguaacggaacagggaauauaguagccucagucaauauggucagccgccuauuacucaacagauuuacuaugacccaucgacggccuacuauagaaaaagacguagaccuaggagcagguacucgucacgucaaugcggagccagaaacuccgaauauggacgucaucggcgaaaggauaaaaaggauuaaggaagaacauaauagcacguggcauuacgaugacgaaaaccccuacaaaacaugggcguaccacggaagcuacgaagugaaggcaacagguucagccucgagcaugauuaaugguguagucaagcugcucaccaaacccugggacgugguacccaugguaacccaaauggcaaugacagauacgaccccauucgggcagcagagggucuuuaaagaaaaggucgacacgcguaccccucgauccaugcccgguacgcgccgaguuaugggaauaacagcggaaugguuguggcgaacgcucggacgcaacaagaaaccccggcuaugcaccagagaagaguucaccaaaaaggugcgaacgaacgcggcaaugggggccgucuucaccgaggaaaaccagugggacucagcgaaagcagccguagaggacgaagacuucuggauucuuguagaccgggaacgagaacuccacaagcuagggaagugcgggucauguguguacaacaugaugggcaaacgggagaagaaacuuggggaguucggaaaagcaaaagggucacgggcgauuugguacauguggcugggagcgcgguaccuagaguucgaagcgcugggcuuccuaaaugaggaccacugguucagccgagaaaacuccuacaguggcguggagggggaaggccuccauaaacugggguacauacuccgcgacauuagcaagauacccggcggggccauguacgcagacgauacggccggcugggacacaaggaucaccgaggacgaccuucacaaugaggagaaaauaacacaacaaauggaccccgaacauagacaguuggcaaacgccaucuuuaaacugacauaccaaaacaaaguagugaagguccagcggccaacaccaacuggaaccgugauggacauuaucaguagaaaagaucagcgcggcagcgggcaagucgggaccuaugggcuaaauacauucacaaacauggaagcacaacuaauaagacagauggaaggagagggagugcuaagcaaggcagaucucgaaaacccgcaccucccggaaaagaaaauaacccaauggcucgaaacaaagggcgucgaacgacuaaagcgaauggcgauaagcggggacgacuguguugugaagccuauugacgaccgcuuugcuaacgcacugcuugcucuaaacgauaugggaaaagucagaaaagacauaccgcaauggcaacccuccaaaggcuggcaugacuggcaacaagucccuuucugcagccaccacuuucaugagcucauaaugaaggacggaaggaagcucguaguuccaugcagaccccaagaugaacugauaggaagggccagaaucagccaaggggcuggauggagccuuagggagaccgcgugcuuggggaaagcauaugcgcagauguggucacuuauguacuuccaccgacgagaccuacgccuagcuagcaaugccauaugcagcgcaguacccgugcacuggguaccaacaagccggaccaccuggagcauacacgcccaucaccaauggaugacaacugaggacaugcucacugucuggaaccgagucuggauagaagacaacccguggauggaagauaagacccccguaaccacgugggaaaacgucccguaccuagguaaaagggaagaccagugguguggcucacucauagggcuaacuucacgugccacaugggcccagaauauucccacugcgauucagcaaguaaggucgcucaucgggaacgaggaauuucuggacuacaugccgucaaugaaacgcuucagaaaagaagaagaaagugagggagcaaucugguga

SEQ ID NO: 25996 - RNA, 9873 nt, Artificial Sequence
  derived and/or modified CDS sequence (opt11) from DENV-3__FJ547076__SS-prME
accagucuuugccucaugaugauccugcccgccgcacuugcguuucaccucaccagucgggacggugagccccggaugaucgugggcaagaacgaacgcggaaagagucugcuuuucaagacggccuccggcauuaacauguguaccuuaauagccauggaccucggcgagaugugcgacgacaccgugacauacaaguguccacacaucacggagguggagcccgaagauaucgacugcuggugcaaccucacuagcaccugggucaccuaugguacgugcaaccaagccggcgagcaccggcgcgacaagcgaucugucgcucuagcuccccacgugggcauggggcuggacacccgcacccagaccuggaugagcgccgagggcgccuggcgucaggucgagaaagucgagacgugggcccugcgucacccuggauucaccaucuuggcgcucuuucuagcucacuauaucggcaccucgcucacccagaagguggugaucuucauacugcuuaugcuagucacgcccagcaugaccaugcgaugcguuggggugggaaaccgcgacuuuguugaaggucuauccggggccacgugggucgacgugguccuggagcacggcgggugcgugaccacgauggccaagaacaagcccacccucgacaucgagcugcagaaaaccgaggccacccagcuggcgacgcucaggaagcuaugcaucgaaggcaagauuaccaauaucaccaccgauagucgcugccccacgcagggagaggcugugcugccugaggagcaggaucagaacuacgucugcaagcacaccuacguagaucggggaugggguaacggcuguggcuuguucgggaagggcucccuggugaccugcgccaaguuccagugccuggagcccaucgagggcaaggucgugcaguacgagaaccucaaauacacaguuaucauuacgguucauaccggggaccagcaccaggugggcaaugaaacccagggggugaccgccgagaucacgccucaggcuagcacaaccgaggcaauccugcccgaguauggcacccugggacucgaaugcucaccaaggacaggccuugacuucaaugagaugaucuuguuaacgaugaagaacaaggcauggauggugcaccggcagugguuuuucgaccugccgcugcccuggaccucaggagccaccaccgagacucccaccuggaaccgcaaagagcugcugguaaccuucaaaaacgcccaugccaagaagcaggaggucguggugcuuggcagucaagagggcgccaugcauaccgcacuuacgggggcgaccgaaauccaaaacagcggcggcaccucaaucuucgcuggccacuugaagugccggcugaagauggacaagcucgaacuuaaaggcaugagcuacgccauguguaccaacacguucguccugaagaaggagguauccgagacccagcauggcaccauccuaaucaagguagaguacaaaggcgaggaugucccgugcaaaauucccuuuagcaccgaggacgggcagggaaaggcgcacaacggucgucucaucacggcaaaccccgugguaaccaaaaaggaagaacccgucaacaucgaggccgagccucccuuuggggaaagcaacaucguuauagggaucggggacaacgcgcuuaagaucaacugguacaagaaagggagcagcaucgggaagauguucgaggcgacggcccggggcgcccgccggauggcaauucuaggcgacaccgccugggacuuuggaucuguagggggcguccuaaacucgcugggaaagaugguccaccagaucuuuggguccgcguacacggcccuuuucucuggcgugucgugggucaugaagaucggcaucggggugcuacuaaccuggaucggccugaacagcaagaacaccuccaugucauucuccuguauagccaucgggaucaucacgcucuaccugggcgcuguuguccaggccgacaugggcugcgugaucaacuggaaaggcaaggaacuuaaguguggcagcgggaucuucgugacgaacgagguccacacguggaccgaacaguacaaguuccaggcggacucccccaagcgccucgccacagccaucgccggggccugggagaacgggguaugcggaauccggucaacgacacguauggagaaucuguuguggaagcagaucgcgaacgagcugaacuacauccugugggagaacaacaucaagcugacagugguagugggcgacaucauuggagugcucgagcaaggaaagcgcacucugacgccccagccgauggagcugaaauauuccuggaagaccugggggaaggccaagaucgucacugcggaaacccagaacucuucauucauaauugauggccccaacacgcccgaguguccaagcgccucccgugcguggaacgugugggaaguggaggacuacgguuuuggcgucuucaccaccaauaucuggcucaagcugcgcgaaguguacacccagcugugugaccaccggcucaugagcgccgccgugaaggacgagcgcgccguccaugcggauaugggcuacuggaucgagagccagaagaacggguccuggaagcuggagaaggcuagccugaucgaggugaaaaccugcacauggccgaagucucacacccucuggagcaauggcguucuggaguccgacaugaucauaccgaaaagccuggcugggcccaucagccagcauaauuaccggccgggcuaccacacucagaccgccgggcccuggcaccucgggaagcuggagcuggauuucaauuacugcgagggcacgaccgucguuaucaccgaaaacugugggacccgaggccccagccuccggacgaccaccgucuccgggaagcugauccacgaguggugcugccgcaguuguacccugcccccgcuacgguacaugggagaggacgggugcugguacggcauggagauccgccccgucucggagaaagaggagaacaugguaaagagcuugguuuccgccggcagcggcaaggucgacaacuucacgaugggagugcugugucucgccauccuuuucgaggagguaaugcggggaaaguucggcaagaagcacaugaucgcuggggucuucuucacauucgugcugcuccugaguggccagaucaccuggcgcgacauggcccacacccugaucaugaucggcagcaacgccagcgauagaauggggauggguguuacguaccucgcucugaucgccaccuucaagauucagccuuuucuugcucucggauuuuucuugagaaaauuaaccagccgggagaaucucuuacuuggcgucggucuggcuauggccaccacguugcagcugccugaagacauagagcagauggccaacgggaucgcgcucggcuuaauggcccuaaagcucaucacccaauucgagaccuaccagcuguggaccgcccugaucagcuuaacgugcuccaacaccaucuucacccugaccguggcuuggcggacggccacacugauccucgcgggggucagccuguugccggucugccagucaagcuccaugcggaagacggacuggcuccccaugaccguggccgccaugggcgugccgccacugccgcuguuuaucuucagccucaaggacacucugaagcgccgcucuuggccccugaacgaggggguuauggcagugggccucgucagcauccuggccuccucacugcucaggaacgaugugccaauggccggcccccugguugccgggggacugcucauugcgugcuacguuaucaccgggaccuccgcagaccugaccguggagaaggccgcggaugugaccugggaggaggaggccgagcagaccggcgucucgcacaaccugaugauaaccguggaugacgacgggacgaugcgaaucaaggacgacgagacagagaauauccucaccgugcuccuaaagacggcucuccugaucgucuccgggaucuucccauacuccauucccgcgacccugcucguguggcauacauggcaaaagcagacccagcggucgggcgugcuaugggacguccccagcccgccagagacccagaaggccgaacuggaagaggggguauacaggaucaagcagcaaggcaucuucgguaagacccaagugggugucggugugcagaaggagggcguguuccacaccauguggcacgucaccagaggcgcagugcuuaccuauaacgguaagcgcuuggagccaaacugggccucggugaagaaggaccuuaucagcuacgguggcggcuggcgguuauccgcgcaguggcagaagggggaggagguccaggugaucgccguggagcccggcaagaaccccaaaaacuuucaaaccaugcccggcaccuuccaaacgaccaccggggagaucggcgcgaucgcacuugacuuuaagccugguaccucagguaguccuaucaucaaccgcgagggcaaagucguggggcuguacggcaacggcguggucacgaagaacgguggcuauguguccggcauugcccagacuaaugccgagccggauggccccacgcccgagcucgaggaggagauguucaagaagcggaaccuaaccaucauggaccugcaucccgggucaggcaagacacggaaguaccugccggccaucgugcgggaggccaucaagcgccgucuccgcacccugauucuggcccccacccggguaguggccgccgagauggaggaagcacucaaggggcugccuauacguuaccagaccaccgcgaccaaguccgagcacaccggccgggagaucguggaccugaugugucacgccacuuuuaccaugcggcuucuaucgcccguccgggugccaaauuauaaccugaucaucauggacgaagcccacuucacagauccggccuccauagccgcgcguggguacaucagcacccgggugggcaugggcgaggccgccgccaucuucaugaccgcuacgccgcccgggacggccgacgccuucccgcaauccaaugcaccgauccaggacgaggagcgcgacauccccgagcgcagcuggaacaguggcaacgaguggaucaccgacuuugccgggaagacggucugguucguaccuagcaucaaggcgggcaacgacaucgccaacugccugcggaaaaacggaaagaaggugauccagcugucccgcaaaacguucgacacggaguaccagaagaccaagcugaacgacugggacuucgucgugaccacggacaucucggaaaugggugccaacuucaaggccgaccgggugaucgacccgcgccggugccucaagccaguaauccugaccgacggccccgagcgcgugauccuggcuggacccaugccgguaaccgcggccucagccgcccagcggaggggccgagucggucgcaacccccagaaggaaaaugaucaguauaucuucaccggacagccccucaauaaugacgaggaccacgcccacuggaccgaagcuaagaugcugcuggacaauaucaacacgccggaggggaucaucccggcucucuucgaacccgagagagagaaguccgccgccaucgacggugaguaccgccugaagggcgaaucccggaaaaccuuuguggagcugaugcgccgcggggaccuccccgucuggcuggcgcacaagguggccagcgagggcaucaaauacaccgaccggaagugguguuuugacgggcagcggaacaaccagauacuggaggagaacauggacguagagaucuggacgaaagagggcgagaagaaaaaguugcgcccccguuggcuggacgcucgcacauauuccgacccgcuggcccucaaggaauuuaaggacuucgccgcuggccguaagaguaucgcacuggauuuggucaccgagaucggccgggugccaucccaccucgcccauaggacgcgcaacgcccuggacaaucugguuaugcuccacaccagcgagcauggcggcaaggccuacagacaugcugucgaagaguugcccgagacgauggagacccugcuccugcugggcuuaaugauccuucugacugggggcgccaugcuguuccugaucagcggcaagggcauagggaagaccuccauagggcuuaucuguguuauagcaucaagugggaugcucuggauggcagagaucccgcuccaguggaucgccagcgcuaucguccuggaguucuucaugaugguacuccuaauacccgagcccgaaaagcagcgcacuccccaggacaaccagcuggcuuacguggugaucgggauacucacauuagcugcuaucauagccgcgaacgaaaugggccuguuggagaccaccaagcgugaccuggggauguccaaggagccgggggucgugagccccacguccuaucuggauguggacuugcacccagccagcgccuggacccuguaugcaguggcgaccaccgugaucacgcccaugcugcgacacacuauagagaacucaacagccaaugugagccucgccgcaaucgccaaccaggcagucguucugaugggauuagauaagggcuggccuaucaguaagauggaucucggagugccccugcuugcgcucggguguuacucgcaggucaacccgcugacacuuacggccgccgugcugcugcugaucacucacuacgccauaauaggccccggccuccaggcgaaggcgaccagggaagcccagaagagaacggccgccggaaucaugaagaacccuaccguggacggcauaaugaccaucgaccuggaccccgucaucuacgacuccaaguucgagaagcagcugggccaggugauguugcuggugcugugcgcaguccagcucuugcugaugcgcacaagcugggccuuaugcgaggcccugacccuagccacgggacccauaacgacccucugggaaggcuccccagggaaauucuggaauaccacuaucgcggugaguauggccaacauuuuccgcggauccuaccuggccggggccggccuugcauucagcauuaugaagucuguggggaccggaaagagagguaccgggagccaaggagaaacccucggggagaaguggaaaaagaagcugaaccagcuaucacggaaggaguucgaccuauacaagaaguccggcaucaccgagguugaccguacggaggcgaaggaaggguugaagcggggcgagaucacccaccaugccgugagccggggcuccgcuaagcugcagugguucguggagcggaacauggucaucccggagggucgcgugaucgaccucggcugcgggcggggcggguggucauacuauugcgcaggccugaagaaggugaccgaggugcgcggcuacacuaagggugggcccgggcacgaggagcccguccccaugucaacauacggcuggaacaucgugaagcugaugagcggcaaggacgucuuuuaccuaccacccgagaagugcgacacccugcugugcgacaucggcgaauccagccccucacccaccguggaagagagccggaccaucagagugcugaagauggucgaaccguggcucaaaaauaaccaguucugcaucaaggugcugaaccccuacaugcccacggugaucgagcaccuggagcgccuccagcggaagcacggcgggaugcugguccguaacccccucuccaggaauagcacccacgagauguacuggauauccaauggcaccgggaauaucguggccucgguuaauauggucucgaggcuguuacucaaccgguucaccaugacccaccgccggccgaccaucgagaaggacguggaccucggggcuggcacccgccaugugaacgcggagcccgaaacccccaacauggaugucauaggggagaggaucaagcgaaucaaggaggagcacaacagcacauggcacuacgacgacgagaacccguacaagaccugggccuaccacggcuccuacgaggugaaagccaccggcagcgccaguagcaugauaaacggugucguaaagcugcuuaccaaacccugggauguuguccccauggugacgcagauggcgaugaccgacaccacaccuuucgggcagcagcggguguucaaggagaaaguugacacuaggacaccgcggucuaugcccgggacccggcggguaaugggcaucaccgccgaguggcuauggcguacgcuggggcgcaacaagaaaccccggcugugcacccgggaggaguuuaccaagaaagugcgcaccaacgcagcaaugggggcugucuucacggaggaaaaccagugggacuccgccaaggcugccguggaggacgaggacuucuggaagcucguagaccgcgagcgggagcugcacaagcugggaaagugcggcagcugcgucuacaacaugauggggaagcgggagaagaagcucggcgaguucggcaaagcuaagggguccagagcgaucugguacauguggcugggcgcccgcuaucuggaguucgaggcucucggguuccugaaugaggaccauugguucagcagggagaacuccuacagcggcguggagggggagggccugcacaagcucgguuauauccugcgcgacaucuccaagauccccgggggagcaauguacgccgacgacaccgcggggugggacacccggauaaccgaggaugaucugcacaacgaggagaaaaucacacagcaaauggacccggaacaucgccagcucgcgaacgccaucuucaagcucaccuaccagaacaagguggucaaggugcagcggccuacaccgaccggcaccgugauggacaucaucagccgcaaggaccaacguggcagugggcaggucggcacguaugggcugaauaccuucacaaauauggaggcccagcuaauccgccagauggaaggcgagggaguuuuaagcaaagccgaccuggagaacccccauuuaccggagaagaagaucacccagugguuggagacgaaagguguggagcgucugaagcgcauggcgaucagcggggacgacugcguagugaagcccauagaugaccgguucgccaaugcgcuccuagcccugaaugauauggggaaggugcgcaaggacaucccccaguggcagccuagcaagggauggcaugacuggcaacaggucccguucuguucgcaccacuuccacgaacucaucaugaaggacgggcggaagcucgugguccccugccgcccccaagacgagcugaucggucgggcgcgcaucagccaaggggcgggcuggucgcuucgggaaacagcgugccuuggcaaggccuacgcccagauguggagccugauguacuuucaccgacgcgaccucagacuggcuagcaacgcgaucugcagugccguccccguacacugggugccgacuagccgcaccacguggagcauccacgcacaccaucaauggaugacgaccgaggacaugcuaaccgucuggaaccggguguggaucgaggacaaccccuggauggaggacaagaccccggugaccaccugggagaacgucccauaccucgggaagcgcgaggaucagugguguggcagccugaucggucugaccucccgggccacgugggcgcagaacaucccgaccgccauccagcagguacgaagccucaucggcaacgaggaguuccuggacuacaugcccuccaugaaacgguucagaaaggaggaggagagcgagggggcaauuugguaa

SEQ ID NO: 25997 - RNA, 9873 nt, Artificial Sequence
  derived and/or modified CDS sequence (opt11) from DENV-3__FJ547077__SS-prME
accucccugugucucaugaugauccugcccgccgcccuggcguuccaucucacuagccgggacggggaacccagaaugaucguggggaagaaugaaaggggcaagagccuucuguucaagacggcuuccgggauuaacaugugcacgcucaucgcaauggaccugggggagaugugcgacgacacugugacguauaagugcccccacaucacggagguagagcccgaggacaucgacugcugguguaaccucaccucgaccugggugaccuacgggacgugcaaccaggcuggcgagcaccggcgugacaagcggaguguggcccucgcgccccaugugggcauggggcucgauacucgcacccagaccuggaugucugccgagggugccuggcgccagguggagaagguggagacgugggcucuacgccacccaggguucaccauauuggccuuauuccuggcccacuacauugggaccagccucacccagaagguggugaucuucauccugcucaugcuaguaacgcccagcaugaccaugagaugcgucggcgugggcaaccgcgauuucgucgaggguuugucaggggccacauggguggacgucguucucgagcacggcgggugcguaaccacgauggcaaagaacaagccuacccuggacaucgagcugcagaagaccgaggccacacagcuagcgacauugcguaaauugugcauagagggcaagaucacuaacauaacuacugacagcagaugccccacgcagggcgaggcuguguugccggaggaacaagaccagaauuacgucugcaaacacaccuacgucgaccggggguggggcaacgggugcgggcucuuugggaaaggaagucuggugaccugcgccaaauuccagugccuggaacccaucgagggcaagguugugcaguaugagaaccucaaguauaccgugauuauaacgguucauacaggggaccagcaccaagucggcaacgagacccaaggggugacagcggagaucacgccccaagcgagcaccaccgaggcgauucugccggaauacggcacucuggggcucgagugcaguccgcgcaccggccuggacuucaaugagaugauacugcucacgaugaagaacaaagcauggauggugcaucggcagugguuuuucgaucugccgcugcccuggacaagcggcgccaccaccgagacuccuaccuggaaccgcaaggagcuucugguaaccuucaaaaaugcccacgcuaagaagcaggaggucguagugcuggggucccaggagggagcgaugcacaccgcccucacgggggccaccgagauccagaacuccggcgggaccuccaucuucgcgggccaccuuaagugccggcugaaaauggauaagcucgaacugaagggcaugagcuacgccauguguacaaacacguucguccugaagaaggaagugucugaaacccagcacgggacuauacuaauaaaaguggaauacaaaggcgaggacgcgccgugcaaaauccccuuuagcaccgaggacggccaaggcaaagcccacaacggccgacucaucacugccaaccccguugugaccaagaaggaggaaccagugaacauagaggccgagccgccauucggcgagagcaacaucgucaucggaaucggggacaacgcgcucaaaauaaauugguacaagaaaggaagcucgaucgggaaaauguucgaagccaccgcccggggcgcccgccgaauggcgauccuuggagauaccgcgugggacuucggguccgugggaggggugcucaacagccuggguaagaugguccaucaaaucuucggguccgccuacacagcacuguucagcggagugucuugggugaugaaaaucggcauugggguacuccugaccuggauaggcuuaaacagcaagaacaccagcaugagcuucucuugcaucgccaucgggaucaucacccucuaccugggcgccgugguccaggcggacaugggcugcgucauaaauuggaagggcaaggaguuaaagugcggcucugggauauucgugaccaacgagguccacaccuggacggagcaguacaaguuucaggccgacucucccaagcgucucgccaccgcgaucgcuggcgcaugggagaacggggucugcggcaucaggucaacuacgcggauggagaaccugcuguggaagcagaucgcgaacgagcuaaacuacauccuuugggagaacaacaucaagcugacagugguggugggggacaucaucggcguacuggaacagggcaagcgcacguugacgccccaaccgauggagcugaaguacaguuggaagaccugggggaaggccaaaaucgucaccgcggagacacaaaacagcaguuucauaaucgacggccccaacacgccugaaugccccucagcaaguagggccuggaacguaugggagguagaggacuauggcuuugggguguucaccaccaacaucuggcucaagcugcgcgagguuuacacacagcugugugaccaccgguugaugagcgccgccgugaaggacgaacgcgccgugcaugcagacaugggcuacuggaucgagagccagaagaacggcucuuggaaguuagagaaggccucgcugaucgaggugaagaccugcacguggccuaagucgcacaccuuguggagcaacggcgugcuggagagcgacaugaucauccccaagagcuuggccgggccgaucucccaacauaauuaccggccggguuaccacacccagacugcagggcccuggcaucucggaaagcuggaacuggacuucaacuacugcgagggcacgacuguggucaucaccgaaaacugcgggacgcgcgguccaucgcuccggacgaccacugucagcgguaagcugauacaugaguggugcugccgcagcugcaccuuacccccgcuccgauauaugggcgaggacggaugcugguauggcauggagauccgccccauuagugaaaaggaggaaaauauggucaagucacuggugucagccgggucugggaagguggacaacuucacgaugggcguguugugccucgcaauacuguucgaagaagugaugcgggggaaguucggcaaaaagcacaugaucgcugguguguucuuuaccuuuguucuauuacugucuggccagaucacauggagggacauggcgcacacucugaucaugauuggcagcaacgccuccgaccggauggggaugggcgucacguaccucgcgcugauagcgaccuucaagauacaacccuuccuggcacucggguucuuccugcgcaagcugaccagccgggaaaaccuccugcugggcgucggccucgccauggccaccacgcugcagcugcccgaagacauugagcaaauggcuaacgggaucgcuuuaggccucauggcccugaaacuuaucacccaguucgagacguaccagcuguggaccgcccugauuucucucacgugcuccaacaccaucuucacccugaccguggccuggcgcacggcgacccugauccucgccggggucagucugcugccgguuugccaguccagcucuaugcggaaaaccgauuggcuucccaugaccgucgccgccaugggcgugcccccucucccgcuguucauauucagccucaaggauacgcugaaacgccgaucguggccccugaacgaaggggucauggccgucggccuuguuagcauuuuggcaucuagccucuuacgcaacgacguaccuauggccggccccuuaguagcagggggccugcuaauagccugcuaugugaucaccggcacauccgccgacuugaccguggagaaggccgcagacgucacaugggaagaggaggcagaacagaccggggugucucacaaccuuaugauuaccguggaugaugacgggaccaugcgcaucaaggacgacgaaaccgagaauauccucacgguccugcucaagaccgcccuccugauaguguccgggauauuuccguacagcaucccagccaccuuacucguguggcacacauggcagaagcagacgcagcgguccggcguccugugggacgugcccagcccgcccgagacccagaaggcggagcuggaggaagggguguaccguaucaagcagcaggggaucuuugggaaaacccaggucggcgugggagugcagaaggagggcguauuccacaccauguggcacguaacgagaggagccguacucaccuacaacggcaaacgccuggaaccuaauugggcuuccgucaagaaggaccugauuagcuacggagggggcuggcggcucucugcccaguggcaaaagggggaggaaguccaggugaucgcggucgagcccgguaagaacccgaagaauuuccagaccaugcccggcaccuuccagacgaccaccggggagaucggggccauugcccuggacuucaagcccgguaccucugggagccccaucauuaaccgggagggcaaggugguagggcuguauggcaacggcguaguuacgaagaacggcggguacgugagcgggaucgcccagacaaacgccgagccggacggcccgacccccgaguuagaagaggagauguucaagaaacgaaaccucacaaucauggaucugcaccccgggucaggcaagacgaggaaauacuugccugcgaucguccgggaggccaucaagcggcggcuccgcacgcugauucuggcucccacccggguuguggccgcugagauggaggaggcccucaaagggcugccuauccgcuaucaaaccacggccacuaaaucagaacacacaggccgggagaucgucgaccugaugugccacgcuacauuuacgaugcgccuccuaagucccgugcgggugccuaacuacaaucugaucauaauggacgaagcccauuucaccgaccccgcuucuaucgcggccagaggguacauuagcacgcgggucggaaugggcgaggccgcagccaucuucaugaccgccacgccgcccgggaccgcggacgccuucccgcaguccaacgcccccauccaggacgaggagcgcgauaucccugagcguagcuggaacuccgguaaugaguggaucaccgacuucgcagggaaaacggugugguuugugcccucgaucaaagcugggaacgacaucgccaauugccuacggaagaacgggaaaaagguaauccagcuguccagaaaaacauucgacaccgaguaccagaagaccaagcugaaugacugggacuuugugguaaccacugacaucagcgaaaugggcgccaacuuuaaagccgaccgggucaucgauccccgccggugccucaagccggugaucuuaaccgacggcccagaacgcgugauccuugcggggcccaugccggucacagccgccuccgccgcccagcggcgcggccggguaggccgcaacccccagaaagagaacgaccaguacaucuucaccggccagccccuaaacaacgaugaggaccacgcgcauuggacugaggccaagaugcuguuagacaacaucaacacaccggaggggaucauuccggcccucuucgagcccgaacgggagaaaucagccgcgaucgacggcgaguaccgccugaagggcgagucacggaagaccuucgucgagcugaugcgccgaggggauuugccagucuggcuggcccauaaaguagccuccgaaggcauaaaguacaccgaucgcaaguggugcuucgaugggcagcggaacaaccagauccuggaggagaacauggacguggaaaucuggaccaaggagggcgagaagaagaagcuccgcccccgguggcuggacgcuaggacguacucggacccgcuggcccucaaggaguucaaggacuucgcggccggccguaagagcauagcccuggaucugguaaccgagauugggcgggugccgucccaccucgcccaucgcacccggaacgcgcuggacaaucuggucauguuacacacaucugagcauggcgggaaggcguaccgccaugccguagaggaauugccugagacgauggagacgcugcuccugcugggcuuaaugauccuacugaccggaggagcgaugcuguuucugaucagcggcaaggggauuggcaagaccuccauaggguugaucuguguuauugccagcuccggcaugcuauggauggccgaaaucccgcugcaguggaucgcguccgccaucguccuggaguucuucaugauggugcucuuaauccccgagcccgagaaacagcggacgccccaggacaaccagcuagccuacgugguaauagggauccucacccuggccgcgaccaucgcggccaacgagaugggccuucucgagaccacaaagcgcgacuuaggcauguccaaggagccggggguggucagccccacguccuaccuggacgucgacuugcauccagcuucggccuggacauuguacgcaguugccaccacggugaucacccccaugcuucggcauacuauagagaacucaaccgccaacgugucucucgccgccaucgcgaaucaggccguggugcugaugggucuggacaagggguggccuaucuccaagauggaccucggcguuccccuucuggcccucgguuguuacucacaggugaauccucugacguuaaccgcggccguacugcugcugaucacccacuacgccaucaucgggcccggucuacaggccaaggccacccgcgaagcccagaagcggacagccgccgggauaaugaagaacccgaccguagacggaauuaugacuaucgacuuggaccccgugaucuaugacuccaaguucgagaagcaacuuggccaagugaugcuccugguucugugugccgugcagcucuuacugaugcgcaccagcugggcccuaugcgaggcccucacgcuggcgaccggccccauaacgacccucugggagggcucgcccgguaaguucuggaacacgacgauugccgugagcauggccaacaucuuccggggcuccuaucuggccggcgccggccuggccuucagcaucaugaaaagcguaggaacaggcaagcggggaacugggagccagggagagacccucggcgagaaguggaaaaagaagcugaaccagcuuagcagaaaggaguucgaccucuacaagaaguccggcauuacagagguggaccgcacugaggccaaggagggccugaagcgcggcgagaucacccaccacgccgucagccgaggcagcgccaaacuucagugguucguagagcggaauaugguuauacccgaggggagagugaucgacuugggcugcgggcggggcgggugguccuacuacugcgccgggcugaagaaggucaccgagguacgcggguacacgaaaggcgggccaggucacgaggaacccgugcccauguccaccuacggguggaauaucguuaaacuaaugucaggcaaagacguguucuaccucccuccagagaagugugacacccugcugugcgacaucggcgaguccucccccagccccaccguggaggagucgaggacgauccggguccugaagaugguagaaccguggcuaaagaauaaccaauucuguauaaaagugcuuaacccguauaugccaaccgugaucgaacaucuggaacguuugcagcggaagcacggcgggaugcugguccgcaaccccuuaucccggaacagcacccacgagauguauuggaucuccaacggcaccgggaacaucguggcgagcguaaacaugguuucccgccucuuacugaaucgauucacgaugacccacaggcggccgacaaucgagaaggacguggaccucggcgccggcacccgccacgucaacgcggagcccgagacccccaacauggacgugaucggagaaaggaucaagaggaucaaggaggagcacaauagcacguggcacuaugacgacgagaacccguacaagaccugggccuaccauggcucguaugaggucaaggccaccgggagcgcguccagcaugauuaacggcguagugaagcugcuaaccaaacccugggacgucguccccauggugacccaaauggccaugaccgacacuacuccguucgggcagcagcgggucuucaaggagaaggucgacacacguaccccgagauccaugccgggcacccgcagagucaugggcauuacggccgaguggcuguggcgcacccuugggcggaacaagaagccccgccugugcacccgagaggaguucaccaaaaagguaagaacgaacgccgcgaugggcgcgguguuuacagaggagaaucaaugggacucggcuaaggccgccguggaagaugaggacuucuggaagcucgucgaccgugagcgggaauuacauaagcuggggaaaugcggcagcugcguauauaacaugauggggaagcgagagaaaaaguuaggcgaguucggcaaggcaaaagggagccgggccaucugguacaugugguugggugcccgcuaucuggaguucgaggcacucggcuuccugaaugaggaucacugguuuucacgggagaacuccuacagcggcguggagggugagggccuacacaagcucggguacauacugagagacaucaguaagauccccgggggcgccauguacgcggacgacacagccgguugggacacgcgaaucacggaggaugacuugcacaacgaggagaagauuacccagcagauggacccggagcaccgccagcuugcaaacgccaucuucaagcugacguaccaaaacaaggucgucaaggugcagcggcccacccccaccggcacggucauggacaucauaagccgcaaggaccagagggguaguggccagguaggcaccuacgggcugaacacauucacaaauauggaggcccaacucauccgccagauggagggagagggggugcuuagcaaggcggaucuugagaauccccaccucccggagaaaaagaucacgcaguggcuggagaccaagggcguagagcggcugaaacgcauggccaucuccggcgacgacugugucguuaaacccauugaugaucgauuugccaacgcacuauuggcccugaacgacauggggaagguucgcaaggauaucccgcaauggcagcccagcaagggguggcacgacuggcagcaagucccguucugcucccaccacuuccacgagcucaucaugaaagacgggcggaagcugguggugccaugccgcccgcaggacgagcugauaggccgggcgcggaucagccagggggccggcuggucucuucgggagaccgcgugcuuagggaaggcauacgcgcagauguggaaccuuauguauuuccaccgucgcgaccuccgguuggcgagcaacgccaucuguuccgcagugcccgugcacugggucccgaccagccguacgaccugguccauccaugcccaccaccaguggaugacuacugaggacaugcucacgguguggaaccggguuuggaucgaggacaaccccuggauggaagauaaaaccccggucaccaccugggagaacgugcccuaccuagggaagcgagaggaccaauggugcggcucccugaucgggcuuacgagccgggcgaccugggcccagaacauaccaaccgccauccagcaagugcgcucccugaucggcaacgaggaguuccucgacuacaugccgaguaugaagcgcuuccgcaaagaagaggagucagagggugccauuugguag

SEQ ID NO: 25998 - RNA, 9873 nt, Artificial Sequence
  derived and/or modified CDS sequence (opt11) from DENV-3__FJ547078__SS-prME
accagccuaugccugaugaugauauugccugcagcgcuagcguuucaccucacaucacgggacggggaaccaagaaugauagucggcaaaaacgaacgagguaaaaguuuacuauucaaaacugccagcgggauaaacaugugcacgcucauugcgauggaccuaggagaaaugugcgaugauacagucaccuauaaauguccacacaucacggaaguugaacccgaagacauagacugcuggugcaaccuaacaaguacgugggugaccuacggaaccugcaaccaagcaggggaacaucgccgugacaaaaggagcguugcccucgccccacauguaggaaugggacuggacacgagaacacaaacauggaugagcgccgaaggggccuggcgccaagucgagaagguagagacgugggcacuacgacacccaggguucaccauccucgcgcuguuccucgcacacuacaucgggacaucccucacacaaaaagugguaaucuuuauacuacuuauguuagucacgccgucaaugacaaugcgguguguaggagucggcaaccgagacuuuguggaaggacuuuccggagccacguggauugaugugguccuagagcaugggggcugcguaaccacuauggccaaaaacaaaccaacccuugacauagaacuccaaaagacggaagcgacccaacuggccacauuacgcaaacucugcauagaaggcaagaucacaaacaucacaacagacucgcgcugccccacgcagggggaagccguucugccggaggaacaagaccaaaacuacguaugcaagcacacuuacguggaccggggauggggaaacggguguggacuguucggaaagggcagccucguaacaugcgcaaaauuucagugccucgaacccauugaagguaaagucguccaguacgaaaaucuaaaauacacagucauaaucaccgugcacaccggagaucaacaccaagucggcaacgaaacccagggaguaaccgcggaaaucacgccccaggcuucaaccacggaggcgauauuaccggaauacggaacauugggacuggaauguucgccgagaacgggacuggacuucaaugaaaugauacuccucaccaugaagaacaaggcauggaugguccaccgacagugguuuuucgaccucccacuucccuggacaucaggcgccacaaccgagacaccaacauggaaccggaaggagcuccucgucacuuucaaaaacgcacacgcuaagaaacaagaaguaguugucuuaggaucccaggaaggggccaugcauacggcacucaccggcgccaccgaaauacagaacaguggaggcaccagcaucuucgcagggcaccugaagugucgacucaagauggacaagcuggagcucaagggcaugagcuacgcaaugugcacgaacacguuugugcucaagaaagaggucagcgaaacacagcacggcacaauauugaucaagguagaauacaaaggcgaggacguaccaugcaaaauaccuuucuccacagaagacggacaaggcaaagcucacaacggaagacugauuacggcgaauccaguaguaacgaagaaagaagaacccgugaauaucgaagccgaaccaccuuucggcgaauccaauauagucauaggcauaggcgauaacgcguugaagauaaauugguacaaaaagggaucauccauaggaaaaauguucgaggcaacagcacgaggcgcccggcguauggcuauucuaggggacaccgcgugggacuuuggcagcgucggagggguccuaaacucucucggcaaaaugguacaccagaucuucggaucagcauauaccgcuuuguucuccgggguaagcugggucaugaagaucggcaucggcguccuccucaccuggauugggcugaacagcaagaacacauccaugagcuuuaguugcaucgccaucggcaucaucacccuguaucucggggcaguugugcaagcagauauggggugcgugaucaacuggaagggcaaagaacuaaaaugcgggagcgguaucuucgugaccaacgagguucacaccuggacugagcaguacaaguuucaagccgacucacccaaacgacuggcaaccgcaauagcuggcgcgugggaaaacggcguaugcggaauccgcagcacuacuaggauggaaaaccugcuuuggaaacaaaucgcgaacgaacuaaacuauauauugugggagaacaacauaaaacugacgguuguaguaggcgacaucauaggcguccuagaacaagggaagagaacccucacaccucaacccauggaacugaaauacucauggaaaacgugggguaaggcgaagauaguaaccgcagagacccagaacagcucguucauaauagacggaccgaauacacccgaaugcccgagcgcaagcagagcguggaaugugugggagguagaagacuacggcuucgggguguuuacgacgaacauaugguugaaacuccgagaaguauacacccaacuaugcgaccaccggcuaaugagcgccgcagucaaagaugaacgugcggugcaugccgauaugggguauuggauagaaucacagaaaaacgggagcuggaaacuggagaaagccagucuaauugaaguaaaaacguguacguggccuaaaucccacacgcuuuggucgaacgggguccucgagucggauaugaucauacccaagucccucgcuggcccgaucucccaacacaauuaucgcccaggcuaccacacgcagacagcagggccguggcaucuaggaaaacuagaacucgacuucaauuauugcgaagguacaaccgucguuaucacugagaacugcggcacccgggggcccagccuucggacaacgacuguaucuggaaagcugauucacgaauggugcugccgaucaugcacgcugccaccccugagguacaugggggaagauggaugcugguaugggauggaaauaagaccgaucagcgagaaagaagaaaauauggucaaaucccucguaagcgcaggauccgguaaagucgacaacuucacaaugggcguacuaugucuugccaucuuguucgaagaggucaugcguggcaaguuugggaaaaagcacaugauagcggggguguucuucacguucguacuccuucugagcggccaaaucaccuggcgagauauggcccauacacuaauaaugauuggaaguaaugcaagcgaccgcaugggaauggguguuacguaccuugcauuaauugccacuuuuaagauacagccauuccuagcacuuggauucuuccuccguaagcuaacaagcagggaaaaucuacuacuuggaguggggcuggccauggcaaccacgcuccaacuaccagaagacaucgaacagauggcuaacggcaucgcccuagggcugauggcucuaaaacuuauaacccaauucgaaaucuaccagcuauggaccgcccugauauccuuaacauguucgaacacaauauucacccucacaguggcauggcgaaccgccacgcuaauauuagcuggcguaucacugcucccgguuugccagucaagcucaaugcguaagaccgacugguuaccgaugacuguagccgcuaugggagugccgccgcucccucucuuuauauucucccucaaagacacacucaaacggcgcucuuggccgcucaacgagggaguaauggcaguaggucucguaagcauacuggccagcagccugcuccgaaacgauguucccauggcgggcccacuuguagcaggcggccuacuuauugcauguuacgugaucacaggcaccucugcagaucucacaguagagaaagcggccgaugucacaugggaagaagaggcggaacagacaggcgugagccacaaccugaugauaacuguggacgacgacggcacaaugaggauuaaggacgacgaaacggagaacauucucaccguauuacucaaaacagcgcuguugaucgugagugggauauucccguacuccaucccggcaacccucuuaguauggcacacuuggcagaagcaaacccaacgaucaggaguccuaugggauguaccgagcccgccggaaacccaaaaggcggaacuggaggaaggagucuaccgaauaaaacaacaaggcauauucggaaagacccaaguaggcguaggcguccaaaaagaaggggucuuccacaccauguggcaugucacucgaggugcuguacugaccuacaacgggaagcggcuugaacccaauugggcuaguguaaagaaagaccuaauauccuaugggggcggauggcgucuuagcgcgcaguggcagaagggagaggaaguacaagucaucgcugucgagccgggcaaaaacccgaaaaauuuccaaacgaugccgggaacguuccagacgacaacgggcgagauaggagcuauagccuuggacuucaagccggggacaucaggcagcccuauaaucaaccgagagggaaaggugguggguuuauacgggaauggcguaguuaccaagaacggaggcuacgucucggguauugcccaaaccaacgcagagccagacggaccuacacccgagcucgaggaagaaauguucaagaaacgaaaucuaacgaucauggaucuacaccccgggucgggaaaaacccggaaauaccugcccgcuauaguacgcgaggcaauaaagcgcagacuacgaacgcuaauacucgcacccacgcgggucguagcggccgaaauggaagaagcucugaaagggcuaccaauccguuaucaaaccacugcaacgaaaagcgagcauaccggcagggaaaucguagaucucaugugccacgcuacauucaccaugaggcuacugagccccgucaggguaccaaacuacaaccuaaucaucauggacgaagcacauuucacagaucccgccuccaucgccgcccgcggguacaucucgacccggguuggaaugggcgaggcagcagccauauucaugacggcaacgccgccgggcaccgcagacgcauucccccaaucuaaugcaccuauccaagaugaggaaagggauaucccggaaaggucuuggaacagugguaacgaguggauaaccgacuuugcaggcaaaaccguuugguucguaccgagcaucaaagccggcaacgacauugcuaacugccuaagaaagaauggaaagaaagugauacagcuuagccgaaaaaccuuugauaccgaguaccagaaaaccaaacucaacgacugggacuucguggucacaacugacauuagugagaugggagcaaauuucaaagcggacaggguaauugacccucggaggugccucaagccgguaauacuaacagacggucccgaacgcgucauacuggccgggccuaugccggugaccgcagcgagcgccgcacaaaggcgggggcgggucggaagaaacccucagaaagaaaacgaccaauacauuuucaccgggcagccacugaacaacgacgaagaccaugcccacuggacugaagcaaaaaugcuacucgacaauauaaauacgccagagggaauaaucccagcccucuucgagccagagcgggagaaaagcgcugccauagacggggaguacagacucaagggcgagucaagaaagacguucgucgaacuaaugaggcguggagaccucccgguauggcuugcucacaaagucgccagcgagggaaucaaauacacagaucggaaaugguguuuugacggccagcgaaacaaccaaaucuuagaagagaauauggacgucgaaaucuggacgaaagaaggagaaaagaagaaacugagaccccgauggcuggaugcucgcacauauucggauccuuuagcucucaaagaguucaaggacuucgcagcgggccguaaaagcaucgcccuggaccuggugaccgagauuggucgaguccccagccacuuagcccaucgaacaaggaaugcacuggacaacuuaguaaugcuccacaccucagaacauggagguaaggcauaccgccaugccgucgaagaacugccagaaaccauggagacucuccuauuauuaggguuaaugauccuacucacugggggagcaaugcuguucuugauaagcggaaaaggcauuggaaagacgucgaucgggcugauaugcguaauagcaaguagcgguauguuauggauggcugagaucccacuacaauggauugccuccgccauaguacuggaguucuucaugaugguucuccugauuccagagcccgaaaaacaacgaaccccacaagacaaccaacucgcuuauguagucaucggaauacuaacccucgcggcaauaauagccgccaaugagauggggcuacuugaaacuacgaaaagagaccucggcauguccaaggaaccggguguugucagcccuacauccuauuuggacguugaccuccacccggcaagugcauggaccuuguaugcaguggcaacgacggucauaacgccuaugcugcgucacaccauagagaacucgacugcaaacguaagccuagccgccauugcaaaccaagcaguaguucucaugggccucgacaagggguggccgauaagcaaaauggaccugggagucccacugcuagcccuuggcugcuacucacagguaaacccacucacacucacagcugccguccuacuccucauuacccacuacgcuaucauuggccccggacuccaagcuaaagcgacaagggaagcgcagaaacgcaccgcagccgguauuaugaagaaccccaccgucgauggaauuaugacaaucgacuuggaucccgucaucuacgauucaaaguuugagaaacagcucggccaagugauguuacuggugcugugcgcuguacagcuacugcugaugcgaacauccugggcacuuugcgaagcgcuaacgcuugcaaccgggccuauaacaacucugugggagggcagcccaggcaaguucuggaauacuaccaucgccguaaguauggcuaauaucuuucgagguucguacuuggccggcgcgggucucgcguucuccauaaugaaaagcgugggcacggggaaacgcgguaccggcagccagggcgaaacacucggagaaaaauggaagaaaaagcuaaaccaacucucgcgaaaggaguucgaccuauacaagaagaguggcaucacggaaguagacaggacagaggcgaaagagggccugaaaagaggagagauuacacaucacgcgguaucgcgaggaagcgcgaagcuccaaugguucguugaaagaaacauggucauaccggaaggacgugugaucgaccucggguguggacggggcggauggagcuacuacugcgcaggucucaagaaggucacggaaguacgaggguacaccaaaggcgggcccggucacgaggaaccgguaccaaugagcacuuacggauggaacaucguaaaacuaaugucagggaaggacguguucuaucuacccccugaaaaaugcgacacucuacuaugugacaucggagagagcucacccucgccgacgguugaagaaagucggacaaucagaguauugaaaaugguagagccuuggcugaaaaacaaccaguuuugcaucaaagugcuaaacccauacaugccgacaguuauugagcaccuagaacggcuacaacgcaaacacgggggaaugcuugugcggaauccacugagcagaaacucgacccacgaaauguacuggauaagcaacggaacgggcaauaucgucgcuagcgucaacauggucucgcgucuccuucugaaccgauucacaaugacacacagaagaccgacgauagagaaagauguggaccucggagcgggcacaagacacgucaacgcggagccugaaaccccaaacauggacgugaucggggagagaaucaaaagaaucaaggaagaacacaacuccacuuggcacuacgacgaugaaaacccauacaaaacaugggcguaccauggaagcuacgaagucaaggcuaccggcucggcaucaucuaugauaaacgguguugugaagcuacugaccaaaccaugggacgucguuccaaugguaacacaaauggccaugacagacacgacaccguucggacaacaacgggucuuuaaggagaagguagacacaaggacaccaaaauccaugccaggaacaagacgcgucaugggaaucaccgcagaguggcuauggcgaacucucggacgcaauaaaaagccuagauugugcacgagagaggaauuuaccaaaaagguacguacgaaugcggcaaugggugcggucuucacggaagagaaucagugggacucggcaaaggcugccguugaagacgaagacuucuggaagcuaguggaccgcgaacgagaacugcauaaacugggcaagugcggcaguugcguauauaacaugaugggcaagcgagagaagaaacuaggcgaguucggcaaggcuaagggcucgcgggcgauaugguacauguggcucggggccagauacuuggaguuugaggcucuaggguuccugaaugaggaccacugguucucacgcgaaaacucauacagcgggguggaaggggaggggcuacacaaacugggcuacauacuaagggacaucucgaagauaccaggaggggcaauguacgcugacgacacggcaggaugggauacgcgaaucacagaggacgacuuacacaacgaagagaaaauaacgcaacaaauggaccccgaacauagacaacuagcaaaugccaucuucaagcuaacauaccaaaacaagguagugaaaguacagagacccacuccaaccggaacagugauggacaucauaucuaggaaagaccagcgaggguccggccaggucggcacauauggacugaacacguucaccaauauggaggcccagcucauacgccagauggaaggagaggguguccucagcaaagcggaccucgagaacccccaucuacccgagaagaaaaucacgcaauggcuggagacaaaaggagucgaaaggcuaaaacgcauggccauaagcggugacgacugcguugucaaacccauagacgaccgauuugccaacgccuugcuggcacuaaacgacaugggaaaagugcgaaaagacaucccgcaguggcagccgucuaaaggcuggcacgacuggcaacaaguuccauuuuguucacaccauuuccaugaacucauaaugaaggacggucguaaacucguaguaccuugcagaccgcaagaugagcuuauagguagagcacgcauaagucaaggagccggcuggaguuuaagagaaaccgcaugccuagggaaggcuuacgcgcagauguggucacuaauguauuuccaccggagagacuuaagacuggcaagcaaugcaauuuguagcgcagucccagugcacugggucccgacaagucgcacaacguggucaauccacgcgcaccaucaguggaugacaacagaggacaugcuaaccguguggaaccgaguguggaucgaagacaauccguggauggaggacaaaacaccaguuacaacuugggaaaacgugccauacuuaggaaagcgagaagaucaauggugcggaucucuuaucggacugacuagcagggcgacaugggcgcagaacauaccaacagccauacaacagguacgaagccucauaggaaacgaagaauuucuagacuacaugcccagcaugaagcgauucagaaaagaagaggaaagugaaggagcgauaugguga

SEQ ID NO: 25999 - RNA, 9873 nt, Artificial Sequence
  derived and/or modified CDS sequence (opt11) from DENV-3__FJ547079__SS-prME
acgagccucugccucaugaugauacucccggccgcccuggcguuccacuuaacgucgcgggacggggagccccggaugauuguggggaaaaacgaacgagguaaaagccugcuguuuaagacggcguccgggauuaacauguguacacucaucgccauggaccucggcgagaugugcgacgacaccgucaccuacaagugcccccacauaacagaaguggagccugaggacaucgacuguuggugcaaccugaccucaaccugggugacuuaugggacgugcaaccaggccggcgagcaucggcgagacaagcgguccgucgcccucgcgccccacguggguauggggcuggacacccgcacccagaccuggaugagcgccgagggagccuggcgccagguggagaaagucgagacgugggcccugcggcaccccggguuuaccauccucgcgcuguuccuggcgcacuacaucggcacuucccugacucagaagguggugaucuucauccugcugaugcucgucacgcccagcaugacgaugcgcugcguggggguaggcaaccgcgacuuugucgagggccugucaggggccaccuggguggauguaguccuggagcacggcgggugugugaccacuauggccaagaacaagcccacguuagacaucgaacuacagaagaccgaagcaacgcagcuggcgacgcuccgaaagcugugcaucgaggguaagaucacaaacaucaccaccgacagccgcugccccacgcagggcgaagccgugcugccugaagagcaggaccagaacuaugucuguaagcacacuuacgucgaccggggcuggggcaacggguguggcuuguucgggaagggcucgcugguaaccugcgcgaaauuccaaugucuggaacccaucgaaggcaaggucgugcaguacgagaaccugaaguacaccguaaucaucacgguacacaccggggaccagcaucaggucgggaacgagacccaaggggugaccgcagagaucacgccccaggccucgaccaccgaagcgaucuugccggaguacggcacccuggggcuggagugcagcccacguaccggccuggacuucaaugagaugaucuuacucacaaugaagaacaaggcuuggauggugcaccggcagugguucuuugaucuucccuugcccuggacaagcggcgccacgacugagacgcccaccuggaaccgcaaggaguuacuggugaccuucaagaacgcccacgccaagaagcaggaagucguagugcuggggucccaggagggcgcgaugcauaccgcccucacgggggccaccgagauccagaacucugguggcacauccaucuuugccggucaccucaaaugccgucugaagauggauaagcucgaguugaagggcaugucauacgcuaugugcaccaacacauucguccugaaaaaggagguguccgagacucagcacgguaccauucucauaaagguggaguacaagggugaggacguaccguguaagauccccuucagcaccgaggauggacagggcaaggcacacaacggacgccucaucacugcuaaccccguggugaccaagaaagaggagccagucaacaucgaagccgaaccgcccuucggcgagagcaacaucgugaucgggauaggggauaacgcccugaagaucaacugguacaagaaggggucgagcaucgggaaaauguucgaggcuacagcacggggagcgcgacggauggccauccugggcgacaccgccugggacuucggaaguguugguggagugcucaauucucucggcaagauggugcaccagaucuucggguccgcguacacagcccuguuuucaggcguguccugggucaugaagaucgguauuggagugcucuuaaccuggaucggacugaacagcaagaacaccuccaugagcuucuccugcaucgccaucgggauuaucacccucuaccugggcgcggugguacaggccgacauggggugugugaucaauuggaagggcaaggaguuaaagugcggaagcgggaucuuugugacgaaugagguccacacguggaccgagcaguauaaguuccaggcggacucccccaaacgccuggccaccgccauagccggggccugggagaacggggugugcgguauccgcucgacuacacggauggagaaucuacuguggaagcagaucgcgaacgaguuaaauuacauccugugggagaacaacaucaagcugaccguugucgucggggauaucaucggcguucucgaacagggcaagcgcacucugacgccccagccgauggagcugaaguacuccuggaaaaccugggggaaggcgaagaucgucaccgcagagacgcagaacagcuccuucauaauagacggucccaacacuccggagugccccagugccucccgggcauggaacgugugggagguagaggacuauggguucggcgucuucaccaccaacaucuggcuuaagcuuagggagguuuacacccagcugugcgaucaucggcucaugagugcggcugugaaggacgaacgagccguccacgccgacaugggauacuggauugagucucaaaagaauggauccuggaagcuggagaaggcgucacugaucgagguuaagacgugcacguggccgaagucccauacccucuggaguaacggcguacuggaguccgacaugaucaucccuaaaucucuggccgggccaaucucccagcacaauuaccggccgggcuaccacacccagacggccgggcccuggcaccuaggcaaacuagagcuggacuuuaacuacugcgaggguacgaccgucgugauuaccgagaacugcggaacccgcggcccuagcuuacgaaccaccaccgugucagggaagcugauacaugaguggugcugccgcaguugcacccugcccccgcuccgguacaugggcgaggacgggugcugguauggcauggagauccgccccaucucugagaaggaggagaauauggucaagagccuagucuccgccgggagcggaaagguugacaacuucacgaugggcgucuuaugccucgccauccucuucgaggaagugaugcgggggaaguuuggcaagaagcauaugaucgcggggguguucuucacuuucguucuguugcuguccggacagauaaccuggcgcgacauggcccacaccuuaauaaugauagguuccaaugccagcgaccggauggguaugggcgugacguaccuagcccugauagcuaccuucaagauucagccauuccuggcgcuuggguucuuccugaggaagcugaccagccgggagaaccuccugcugggcguuggacucgccauggccaccacccugcagcuccccgaggacaucgagcaaauggccaacgggaucgcgcucggccugauggcacuuaagcucaucacccaguuugaaacuuaccaacuguggacagcccugaucagccucacuugcuccaacaccaucuucacgcugacugucgcuuggaggacggcuacacugauccuugcgggggugagccuccugccuguaugucaguccagcuccaugcggaagaccgacuggcuccccaugacuguggccgcgaugggagugccgccccucccucuguucaucuuuagccucaaggauacgcugaagcgccgcuccuggccccucaacgaaggcgucauggccguggggcucgugagcauccuggcuuccagccuacuccggaacgacguccccauggcggggccccugguggcaggcggacugcucauugccugcuaugugauaaccgggaccuccgccgaccuuaccgucgagaaggccgcggaugugacgugggaggaggaggccgagcagacaggcguuucccacaaccugaugauuacagucgacgaugacggcaccaugcguaucaaggacgacgaaaccgagaauauccuaacugugcuacucaagaccgcguugcugaucgugaguggcaucuucccguacagcauccccgccacccugcucgucuggcacacuuggcacaaacagacgcagcgcuccggcguucugugggacguucccaguccgcccgagacccagaaagccgagcuggaagagggugucuaucguaucaagcagcagggaauauucgggaaaacccaggucggcgucgguguacagaaggagggggucuuccacaccauguggcacguaacgaggggcgcgguccucaccuacaacgggaagcgccuggagcccaacugggccucugugaaaaaggaccugaucucguauggcggcgguuggcgguuaagugcccaguggcagaagggggaagaagugcaggugaucgccguggagccgggcaagaaccccaaaaauuuccagaccaugcccggcaccuuccagacaaccacaggagagaucggugcgaucgcccuggacuucaagccugggaccagcggcucucccaucaucaaccgcgaaggcaagguggucggacuguacggaaacgggguggugaccaagaacggcggguacgucagcggcaucgcccagacgaaugccgaaccggacggcccaaccccugaacuggaggaagagauguuuaagaagcgcaaucucaccaucauggaucugcaucccgggagcggcaagacgcgcaaguaccugccggcuaucgugcgggaggccaucaagcgccggcuccgaacccugauccuagcccccacgcgggugguagccgcagagauggaggaggcccucaagggccugcccauucguuaccagaccacggcgaccaaguccgagcacaccggccgggaaaucguggaccugaugugucaugccaccuucacgaugagacuccucagccccguucgggucccgaacuacaaccugauuaucauggacgaggcccauuucaccgaucccgccucaaucgcagcgcggggguacauaagcacacgcgugggcaugggcgaagccgccgccauuuucaugacggcgacgccgcccggaaccgcagaugccuucccacagagcaaugccccuauccaggaugaagagagagacauucccgaacgcagcuggaauuccggaaacgaguggaucaccgacuucgcagggaagaccgugugguucguccccucaauuaaggcuggcaacgacauagcgaacugccuccggaagaaugggaagaaggugauccaguuaagcaggaagacguucgacacugaauaccagaagaccaagcugaaugacugggacuucgucgucaccacggacauuucggaaaugggggccaacuuuaaagcugacagagugaucgacccgcgaagaugccucaagcccgugauccugaccgacggccccgagcgggucauccuggcagggccuaugccgguaaccgcggccuccgccgcccagcggcgcggcagaguggggcgcaacccucagaaggaaaacgaccaguacaucuucaccggccagccccugaacaacgacgaggaccacgcacacuggacugaggcgaagaugcugcuggacaacauuaacacgcccgaggggaucaucccagcccucuucgaacccgaacgcgagaaguccgcugcgaucgacggcgaguaccgcuugaaaggcgaaucccggaagaccuuugucgagcugaugcgccgcggggaucucccaguguggcuggcgcauaaggucgccagcgaggggauuaaguacacagaucgcaaguggugcuucgaugggcaacggaacaaccagauccuggaggagaacauggacguagagaucuggacuaaggagggugagaagaagaagcuccgcccucgguggcuggaugcccgcacguacuccgacccgcuggcucucaaagaguucaaggauuucgcagcgggucgcaagagcaucgccuuagaccuggugacagagaucgggcggguacccucccacuuggcccaccgcacgaggaacgcccuagacaaccuggugaugcuccacacaagcgaacauggcgggaaggcguaccgccacgcgguggaggagcugccggagacaauggagacccuguuacugcugggccucaugauucugcuuaccgggggcgcuaugcuguuccucaucagcggaaaagggaucggcaagaccucuauagggcugaucugugucaucgcuaguuccggcaugcucuggauggccgagaucccgcugcaguggauugccagcgcgaucguacuggaguucuucaugaugguguugcugauccccgagcccgagaagcagcggacuccccaggacaaccaacuggccuacgucgucauugggauccuuacccuagccgcuauaaucgccgcgaacgaaaugggccugcucgagaccaccaagcgagaccugggaauguccaaggagccggggguaguuagcccuacgagcuaccuggauguggaucuccacccugcaagcgcguggacgcuguacgcgguugcgaccacggucaucacgcccaugcuucgccacacgaucgagaacuccaccgccaacgugagccucgcggccaucgcgaaccaggcuguggucuuaaugggccuggacaaggguuggccuaucagcaaaauggaccucggggugccgcugcuggcccucggguguuauucacaggugaauccacugacccucacggccgccguccuccugcugauaacccauuacgccaucaucggucccggcuugcaggcgaaggccacacgcgaggcccagaaaaggaccgccgccgggauaaugaagaacccaacgguggacggcaucaugaccaucgaccuggaucccguaaucuacgauaguaaguucgagaagcagcuggggcaggucaugcuccugguucugugcgcagugcagcuccugcuuaugcgcaccagcugggcccucugcgaggcccuuacacuggcgacgggcccuaucaccacucucugggagggcagcccggggaaauucuggaauaccacgaucgcggugagcauggccaauauauuccggggcuccuaccuggccggggccggccuggcguuuuccaucaugaaguccguggggaccggcaagagggguacugguagccaaggugagacucucggggaaaaguggaagaaaaaacugaaucaacugucccggaaagaguucgaccuuuacaagaaguccggcaucacggagguggaccgcacggaggccaaggagggccugaagcggggcgagaucacccaucacgccgucagccgcggcucugccaagcuccagugguucguggagcgcaacauggugauuccggagggucguguuaucgaccucggcugcgggcggggcggguggagcuacuauugcgccggccugaagaaggugaccgaggugcgcggcuacaccaagggcgggcccggccacgaggagccgguccccauguccacguacggcuggaauaucguuaaacugaugagcgguaaggaugucuucuaccucccgcccgagaagugcgauacacugcugugcgacaucggcgagucaagccccucccccaccgucgaggaaagccggacgaucagggugcugaaaaugguagaaccguggcucaagaacaaccaauucugcauaaagguccuaaacccauauaugcccacggugaucgagcaccuggagcgccuccagcggaagcacggcgggaugcuagugcgcaacccccugucccggaacagcacccacgaaauguacuggaucuccaacgggaccgggaauaucgucgccagcgugaacaugguauccaggcucuuacucaacagauucaccaugacccaccgccggccgaccauagagaaggauguugaucucggcgcuggcacacgccacguaaacgccgagcccgaaacgcccaacauggacgugauuggugagcggaucaagcgcaucaaggaggaacacaacagcacauggcauuaugacgacgaaaacccguacaagaccugggcguaccacggcuccuacgaggucaaggcaaccgggagcgccuccagcaugaucaacggcguagucaaacuguugaccaagcccugggacguggugcccauggucacgcagauggcgaugaccgacaccacccccuucggacagcagcggguguucaaagagaagguggacacgcgcacuccgcggagcaugcccggcacccgccgggucaugggcaucaccgccgaauggcucuggcgcacacuggggcggaacaagaagccccgccugugcacccgggaggaauucaccaagaagguucgcacgaacgccgccaugggggcgguguucacggaagagaaccagugggauuccgccaaagccgcugucgaggacgaggacuuuuggaagcucguggaccgcgagcgggaacugcacaaauugggaaagugcggcagcugcguguacaacaugauggggaagcgcgagaagaaacugggcgaguucggcaaggcaaaggguaguagagcgauuugguauauguggcugggcgcucgcuaccuggaguuugaggcccucggcuuccugaacgaggaccacugguucagccgggagaacuccuacagcggcgucgagggggaaggcuuacacaagcucggauauauccugcgugauauauccaagauacccgggggggcuauguacgcagaugacacugcggggugggauacgcggauuaccgaggaugaccugcacaacgaggagaagaucacacagcagauggacccggaacacaggcagcucgccaacgccaucuucaagcuaacauaucagaacaagguugugaaaguccagcggcccacccccaccggcaccguaauggacaucaucagccgcaaggaccagcggggcuccggccagguggguacguacggguugaacaccuucacgaauauggaggcccagcucauccgccagauggagggggagggugugcuguccaaggccgaucuagagaacccccaccucccggagaagaaaaucacccagugguuagagacuaagggcguagagcgccugaaacgcauggcgaucagcggcgacgacugugugguuaagccaauugacgacagguucgccaacgcccuccucgcacugaacgacauggggaaggugcgcaaggauauuccccaguggcagccuucgaaggguuggcacgacuggcagcaggucccguucugcucccaccacuuccacgagcucauaaugaaggacgggcggaagcuggucgugcccugccgcccgcaggacgagcugaucggucgcgcccgcaucagccaaggggcuggcuggucucuccgugaaaccgccugccugggcaaggccuacgcccagauguggagccugauguacuuccaccggcgcgaccuccggcuggccagcaacgccaucugcagcgccgugcccguccacuggguaccgacuucccgcaccacguggucgauccacgcccaucaucaguggaugaccaccgaggacaugcuuaccgucuggaacagggucuggauagaagacaaucccuggauggaggacaagacgcccgugaccacuugggagaacgugcccuaccucggaaagagggaggaucaguggugcggcucgcugaucgggcugaccucccgugcaacgugggcacagaacaucccgaccgccauccaacagguccgcagccucaucggcaacgaggaguuccuggacuacaugcccucgaugaagcgguuccgcaaggaggaggagagcgagggggccaucugguga

SEQ ID NO: 26000 - RNA, 9873 nt, Artificial Sequence
  derived and/or modified CDS sequence (opt11) from DENV-3__FJ547080__SS-prME
accucacugugccucaugaugauccugcccgcggcguuagcuuuccaccucacaucgcgggacggcgaaccgcggaugaucgugggaaagaacgagcgcggcaaaucccuguuguuuaagacggccucaggaauuaauaugugcacccucaucgcuauggaccugggagagaugugcgacgacaccgugaccuauaagugcccucacauaacugagguggagcccgaggacauugacugcuggugcaaccugaccagcaccugggugaccuacggcacuugcaaccaggcaggcgaacauaggagagacaaacguagcguggcucuugcaccccacgugggcauggggcuggacacccgcacgcagaccuggaugagcgcggagggugccuggaggcaggucgagaaggucgaaacgugggcccugcggcaccccggguucaccauccucgcccuguuucuugcacacuacaucggcacuucccucacccagaaaguugugaucuuuauccuuuugaugcucguuacgcccagcaugacuaugcggugcguugggguuggcaaccgcgacuucgucgaaggguugagcggagccacauggguggauguggucuuggaacacgguggguguguuaccacgauggccaagaacaagcccaccuuagacaucgaguuacagaaaacggaggccacccagcucgcgacgcuccgaaagcugugcauagagggcaagaucaccaacauuacgaccgacucucgaugccccacgcagggugaggcagugcugccugaggagcaggaccagaauuacgugugcaagcacacguacguggaccgcggguggggcaacggcugcggccucuucgggaaaggaucccugguaaccugcgccaaguuucagugccuugagcccauagagggcaaggugguucagcacgagaaucucaaguacaccgugauuaucacgguccacacaggggaccagcaccaggugggcaaugaaacccaggggguaaccgccgagaucacgccacaggccucgaccaccgaggcgaucuugcccgaguauggaacacucggcuuagaauguaguccccgcacuggccucgauuucaacgagaugauccugcucacgaugaagaauaaggccuggauggugcaccgacaaugguucuuugaccugccccuucccuggaccagcggcgccaccaccgagacacccacuuggaaccgcaaggaacuccuagucaccuucaaaaacgcccacgccaagaagcaggaggucguggugcugggaagucaagagggcgcuaugcacaccgcccucacgggggcaacugagauucagaacagcggcgggacauccaucuucgccggccauuuaaagugccgucucaagauggacaaguuggagcugaagggcaugagcuaugccauguguaccaacacguucguacucaaaaaggagguguccgagacacagcacggcaccauccucaucaaagucgaguauaaaggcgaagacguccccuguaaaauaccuuuuagcaccgaagacgggcagggaaaagcgcacaauggccgccugauaacggcuaaccccguugucacgaaaaaggaggagccggucaacaucgaggcagaaccgccauucggggagucuaacaucgugaucggaauaggggacaacgcacucaagaucaauugguacaaaaaggguucguccaucgggaaaauguuugaggcaaccgcucggggcgcccgccggauggcgauacugggcgacaccgccugggacuucggguccgugggcggcgugcucaacagccugggcaagauggugcaucagaucuuuggguccgcguauacugcguuguucagcgggguguccugggugaugaagaucggcaucggggugcuucuaacauggaucggccugaacucuaaaaacaccuccaugucguucuccugcauugugauugggaucaucacucucuaucugggcgccgucguacaagccgacauggggugcgugaucaauuggaagggcaaggagcugaagugcggcagcgggauuuuugucacuaacgaagugcacaccuggaccgagcaguacaaguuucaagcggacagccccaaacgccuggccacggcaaucgcuggggccugggagaacggugucuguggcauaaggagcacgaccaggauggagaaccugcuguggaagcagauagccaacgagcucaacuauauccuuugggaaaacaacauuaaguugaccguugugguaggugacauaauuggcguccucgaacagggaaagcgcacccugacgccccagccaauggagcugaaguauucuuggaagaccuggggaaaagcgaaaaucguuaccgccgagacccagaacaguucauucaucaucgauggcccuaacacacccgaaugccccagugccucacgggcguggaauguaugggaggucgaggacuacgguuucggaguguucaccaccaacaucuggcugaaauugcgcgaaguguacacgcagcuuugugaccaccgucuuauguccgcugcggugaaggaugaacgugccguucacgccgauaugggcuacuggaucgaaucacagaaaaacgggagcuggaagcuggagaaggcuucucugauagaagucaaaaccugcacuuggccaaagucccacacccucuggagcaauggcgugcuggaguccgacaugaucauccccaagucacuggcgggucccaucagucaacauaauuaucggccugguuaucacacgcagacugcgggccccuggcacuuaggcaagcuggagcuggacuuuaacuacugugagggcacgaccgugguuaucaccgagaacugugggacacgcggccccagccucagaaccaccaccgucuccgggaagcuuauccacgaguggugcugccgcagcugcacccugccaccgcuccgguacaugggcgaggaugggugcugguauggcauggagauccgucccaucuccgagaaagaggaaaacaugguaaagucguuggugagcgccggaagcgggaaggucgacaacuucaccaugggcguguuaugccucgcgauccuauuugaagaggugaugcgugggaaguuuggaaaaaaacauaugauagccggggucuuuuuuacguucgugcugcuacuguccggacaaaucacuuggcgcgacauggcgcacacgcugauaaugaucggcagcaaugccuccgaccggauggggaugggggugacguaccuagcccugaucgccaccuucaagauccagcccuuccuggcccucggcuuuuuccugaggaagcugaccucgagggagaacuuacuacugggaguuggccucgcgauggccaccacguugcagcugccggaggacauagagcaaauggccaacgggauagccuugggccugauggcgcuaaagcucaucacacaauucgagacuuaccaacuauggacagcccuaauaagccuuacuugcuccaacacaaucuuuaccuugaccguggccuggcgcacggccaccuugauccucgcuggcgucagccuucuucccguaugccagaguagcucgaugagaaaaaccgacuggcuacccaugaccguugcggccaugggggugccuccccucccgcuguucaucuucagccucaaagacacgcugaagcgccgcucguggccccuuaacgaggguguaauggccgugggccuagucagcauucuggcauccagcuugcucagaaaugaugugccaauggcuggccccuugguggccggcggacugcucaucgccuguuaugucauaacugggacgagcgcagauuugaccguugaaaaggccgccgaugugacgugggaggaggaggcggagcagacuggcgucucucacaaccugaugaucacaguggacgaugacgggacgaugagaaucaaagaugacgagacggagaauauccucaccgugcuacugaagaccgcacuccugauugucuccggcaucuucccguacagcauccccgccacauuacuaguguggcacaccuggcagaaacaaacucagcggucuggcgugcuuugggacgucccgagcccccccgagacccagaaggccgaacucgaggaaggaguuuaucgcauuaagcagcaggggaucuucgggaaaacucaagugggcgucggugugcagaaggaggguguguuucacacgauguggcauguaacccggggcgcagugcucacuuauaacgggaagcgccuggagcccaacugggcgagcgucaagaaagacuugaucaguuacggugggggcuggcgccucuccgcccaguggcagaaaggagaggagguccaggugauagcgguggagccgggcaagaaucccaaaaacuuccagaccaugcccgguaccuuccagaccaccacuggagaaauuggagccaucgcgcucgacuucaagccugggacuagcggcagccccaucaucaacagagagggcaaggucgugggguuauauggcaacggcguggugacgaagaacggcggguacguguccggcauagcccaaaccaaugccgaaccggacggcccgacgcccgagcuggaggaggagauguucaaaaaacggaaucuuacaaucauggaccuacaccccgggagcggcaaaacgcgcaaauaucugccggcgauugugcgggaggccaucaagcgccggcuccgcaccuugauccuggcgcccacgcgggucguggccgccgagauggaggaggcccucaaagggcugcccauccgcuaccagacgacggccacuaaguccgaacacacagggcgggagaucguggaccuaaugugccaugcgacuuucacgaugcgccuccugagccccguccgggucccgaauuacaaccugaucauuauggacgaagcccacuuuaccgauccugccuccauagccgcccgaggguacaucagcacccgggugggcaugggagaggcagcggccaucuucaugaccgccacgccgcccggaacggcggacgccuucccgcaaaguaacgccccaauacaggacgaggagcgcgacauccccgaacgcagcuggaacucugggaaugaguggauaacggauuucgcagggaagaccgucugguucgugccgagcaucaaggccgggaacgacaucgcaaacugccuccggaaaaaugggaagaagguaauucagcugucacgcaagacguucgacaccgaguaccagaagaccaaguugaacgacugggauuucgucguuaccacggauaucucugagaugggcgccaacuuuaaggccgaccggguuauagacccgcgccggugccucaagcccgugauacugaccgacggccccgaacgagugauccuggccgggcccaugccugugaccgccgcuagugccgcucaaagacgcggccgggucggccgcaacccccggaaagagaaugaccaguauaucuucacaggucagccccucaacaaugacgaggaccacgcccacuggaccgaagccaagaugcugcuggacaacaucaacacgccugaggguaucauuccagcauuauucgagccugaaagggaaaagagcgccgccauugacggugaguaccgccugaagggcgagucgcgcaagaccuucguggaacugaugcgccgcggggaccuacccguauggcuagcccauaaaguggcgagugagggcaucaaauacaccgacaggaaauggugcuucgacgggcagcgcaacaaucagauacuggaggaaaacauggauguggaaaucuggacgaaggagggcgaaaagaagaagcuaaggccgcgcuggcuugaugcccgcacguacuccgacccguuagcccucaaggaauucaaggacuucgccgcggggcgcaagucuauugcgcuggaccucgugaccgagaucgggcgcgugccaucccaccucgcccaccggacucgcaacgcacuggacaaccugguuaugcuccauaccucggagcacggagggaaggcauaccggcaugccgucgaagaacugcccgagacuauggaaacccugcuccugcugggucucaugauccuguugacagggggugcuauguuauuccugauaucuggcaagggcauagggaagaccuccauagggcugauuugugugaucgcaagcuccggcaugcuauggauggccgagauaccgcugcaguggauugccucagccaucgugcuggaauucuuuaugauggugcuccucauccccgagcccgagaagcaacgcacgccacaggacaaccagcuggcguauguaguuaucgguaucuugacccuagccgcaaucauagccgcaaacgagaugggccugcucgagaccaccaagcgcgaccugggaauguccaaagagccgggcgucgucagcccuacgagcuaucuggacguagaccuccaccccgcuagcgcuuggacacucuacgcugucgccaccaccgugaucacacccaugcugcgccacaccauagagaacaguacagcgaacgugagccuggccgcuaucgccaaccaagccgucguuuuaaugggccuggacaaaggguggccgaucucaaaaauggacuuagguguaccucugcuggcguuagggugcuacagccaagucaacccccucacgcugacggcugcgguccuccugcucaucacccauuacgccaucauagguccaggacuccaggccaaggcgacacgugaggcccagaagcgcacagcggccggcauaaugaagaaucccacuguagacggaaucaugaccauugaucuggaccccgucaucuacgacagcaaguuugagaagcaguuaggccaggugaugcuccucgugcugugugccguucaacuccugcugaugagaaccuccugggcccuaugcgaggcccugacccuggccacaggcccaauaaccacccuaugggagggcucucccgguaaguuuuggaauaccacgaucgccgucucgauggccaauaucuucaggggaucauaucucgccggggccggccucgccuucagcaucaugaaguccguggggacuggcaagcggggcaccgggucacagggagaaacacucggggaaaaguggaagaaaaagcuaaaccaauuaagccggaaggaguucgaccucuacaagaaguccggcaucacggaagucgaucggacggaggccaaagaagggcuuaagcgcggggagauuacccaccacgcagugucaagaggcagcgccaaacugcaaugguucguggaacgcaacauggucaucccagaggggagaguuaucgacuuagggugcgggcgcggcggguggagcuacuacugugcaggccucaagaagguaaccgagguccggggcuacacgaagggaggccccggccacgaggagccagugcccaugucaacuuacgguuggaacaucgugaaguuaauguccgggaaggaugucuucuaucuuccgccugagaagugcgacacccuucugugcgauaucggagaguccagcccuucacccaccguggaagagagccgcaccauccgcguucugaagauggucgagccguggcuuaagaacaaucaguucugcauuaaagugcuaaaccccuauaugccaacggucaucgagcaccuggagaggcuccagcguaagcacggugggaugcugguucggaaucccuuaucccgcaauagcacacaugagauguacuggaucuccaacggcaccgggaacauuguggcgagcgugaauauggucucccgguugcugcucaacagguucaccaugacgcaccguaggccgaccaucgagaaagacguggacuuaggcgccggcacccgucaugugaacgcggagcccgagacacccaacauggacguuaucggggaaagaaucaaaagaaucaaggaggagcacaacucgacguggcacuacgacgacgagaacccguacaagaccugggccuaccacggcagcuacgaaguaaaggccacugggagugccagcaguaugauaaacggcgucgugaaacuccugaccaagcccugggaugugguucccauggugacucagauggcaaugaccgauacuacccccuucggacagcagcgcguguucaaggaaaagguagauacccggacgccccgcucuaugcccgguacccgcagggugaugggcaucaccgcugaguggcucuggcggacacugggccgcaauaagaagccccgguuaugcacacgcgaggaguucaccaagaagguccgcaccaacgccgcgaugggcgccguuuucacggaggagaaccaaugggacucggcgaaggccgccguggaagacgaggauuucuggauccucguggaucgagagcgcgagcugcacaagcuugggaagugcggaagcugugucuacaacaugaugggcaaaagggagaagaaguuaggcgaguuuggcaaagccaaaggguccagagcuaucugguauauguggcucggcgcacgguaccuggaguucgaggccuuaggauuccugaacgaagaccauugguucucccgcgaaaauuccuauucgggcguggagggagaaggccuccauaaacucggcuacauccuacgagacauuagcaagauccccgguggcgcuauguacgcggacgacacagcuggaugggauacgcggaucaccgaggacgacuugcacaacgaagaaaagaucacgcagcagauggacccggagcaucggcaguuagcgaacgccaucuucaagcugaccuaucagaauaagguggucaagguucagcgaccgacgccuaccggcacggugauggacaucaucagccggaaggaccagcggggguccgggcagguaggcaccuacgggcugaauaccuucaccaauauggaggcccagcuaauacggcagauggagggcgaggggguguugagcaaggccgaccuggaaaacccccaccucccagagaagaagauuacccaguggcuggagacgaagggaguggaacgcuugaaacggauggccaucuccggcgacgacugcguggugaaacccaucgacgaucgcuucgcgaacgcgcuccuggccuuaaacgacaugggcaagguucguaaggauaucccccaauggcagccgagcaaaggcuggcaugauuggcagcagguaccguucugcucccaccacuuccacgagcucaucaugaaggacggacgcaaguuggucguucccugcagaccccaggacgaacuaaucgggcgcgcgcggaucagucagggggcuggcuggucccuccgcgagaccgcgugccugggcaaagcauacgcccagauguggucccuaauguacuuucacaggcgggaucuccgcuuagccagcaaugccaucugcucagccguaccuguacacugggugccgacaucucggaccaccuggagcauccacgcacaccaucaguggaugaccaccgaagacaugcugaccgucuggaaccgcguguggauugaagacaaccccuggauggaagauaaaacccccgugacgacuugggaaaauguaccuuaccuaggcaaaagggaagaccaguggugcggcucccugaucgggcucaccuccagagccacgugggcccagaacauccccaccgcgauccagcaagugcgaagccucaucggcaaugaggaguuccuggacuauaugcccuccaugaagcgcuucagaaaggaagaggagucggagggugccaucugguag

SEQ ID NO: 26001 - RNA, 9873 nt, Artificial Sequence
  derived and/or modified CDS sequence (opt11) from DENV-3__FJ547081__SS-prME
acgagccuaugucucaugaugauucuccccgccgcguuagcguuccaccucaccagccgcgacggcgagccgcggaugauaguggguaagaacgagcggggcaagucacuacuguucaagacugcgagcgggaucaacaugugcacccuuauagccauggaccugggugaaaugugugaugacaccgugacuuacaagugcccacacaucaccgagguggaacccgaagacaucgacuguuggugcaacuugaccagcaccuggguuacauacgggacguguaaucaggccggcgaacaccggcgcgacaagcgguccgucgcccuagcgccacacgugggaauggggcuugauacccgcacccagaccuggaugagcgcugagggugccuggagacaggucgagaaaguggagacgugggcguugcgccacccgggguucaccauccucgcgcuguuccuggcucauuauaucggaacuucuuugacccaaaagguggugaucuuuauucuucugaugcucgucacgccgagcaugacgaugcggugcguggguguggguaaucgcgacuucguagagggccuguccggggccaccuggguggacgugguccuugaacacggcgggugcgugaccacgauggccaagaacaagccgacucucgacauugagcugcagaagacggaggccacccagcuagcgacgcuccggaagcucugcaucgagggcaagauuacgaacauaaccacggauagccgcugucccacgcagggcgaagccgugcugccggaggaacaggaccagaacuacgugugcaagcauacauacguagacaggggguggggcaaugggugcggccuguucgggaagggcagucuggucaccugugccaaguuccagugccuggagcccaucgaggggaaggucgugcaguacgaaaaccugaaguacacagugaucauaacgguccacacuggggaucagcaccaggugggcaacgagacccagggcgucacggccgagauaacgccccaggcguccaccaccgaagccauccugcccgaguacggcacccuggggcucgagugcuccccucguaccggccuggacuucaacgaaaugauucugcucacgaugaagaacaaagccuggauggugcaccgacagugguuuuucgauuuacccuugccguggaccaguggcgccaccaccgagacgcccaccuggaaccgcaaggagcuucucgucaccuucaagaacgcgcacgcaaagaagcaggaaguggugguguuggguucccaggagggcgcgaugcacaccgcccuaacgggggcgacagagauccagaacaguggagggaccucuauuuucagcggccaccugaagugccgucucaagauggacaaacuugaacuaaaggggauguccuaugccaugugcaccaacacguucguucugaagaaggaggugagcgagacccagcaugggaccauacuuaucaaaguagaguacaagggugaggacgucccgugcaagauaccuuucaguaccgaggacgggcagggcaaggcccacaauggccggcuaauaacggcgaauccaguaguuaccaaaaaggaggagcccgucaacaucgaggccgagccgcccuucggggagaguaacaucgugaucggcaucggggacaacgccuuaaagaucaacugguacaagaagggcucgagcaucgggaagauguucgaggccacggcgcguggcgcccgccgaauggcgauccugggugacaccgcaugggacuucgggagcgucggcgggguguuaaacagcuuagguaagaugguccaccagaucuucgggagcgcuuacacggcacucuucucgggggucagcugggucaugaagauagguaucggggugcuccugaccuggaucggguugaacuccaagaacaccucuaugucuuuuagcuguaucgccaucgguauuaucacauuguacuugggcgccgugguccaggccgacauggggugcgugaucaacuggaaaggcaaggaacugaagugcggauccgguauauucguaacgaaugagguccacacauggaccgagcaguauaaguuccaggcugacagcccaaagcgccucgcgaccgcaaucgccggcgcuugggagaacggugugugcgggauccgcucgacgacccggauggagaaccugcuguggaagcagauugcaaacgagcucaacuacauccugugggagaacaacaucaaacuuaccguugucgugggggacaucaucggcguucucgagcaggguaagcgcaccuugacgccacagccaauggagcugaaguauaguuggaagaccugggggaaggcuaagaucguaaccgccgagacccaaaacuccagcuucaucaucgacggcccaaacacgcccgagugccccucugccucucgggcuuggaacgugugggagguggaggacuacggguucggcgucuuuaccaccaauaucuggcucaaacugcgcgaggucuacacccaguugugcgaccaccggcuaaugagcgcugccgugaaggacgagcgcgcgguccacgcggacaugggcuauuggaucgaaucccagaagaacgggagcuggaagcuggaaaaggcuagccuaaucgaagugaagaccugcacguggcccaagucucacacccucugguccaacggcgugcucgagagcgacaugaucauccccaaaucccuggcggggcccauuucgcagcauaacuaucggccgggcuaccacacacagaccgcgggucccuggcaucucggcaagcuggaacuggauuucaacuacugcgaaggcacgaccgucguaaucaccgagaacugcggaacuagaggccccuccuugcggacgaccaccgucagcgggaagcucauccacgaguggugcugucgcuccuguacucugcccccacuccgguacaugggugaggacggcugcugguacggcauggagauucgcccuaucagugaaaaggaggagaacauggucaagucccuggugagcgccgggagcgguaagguggacaauuuuaccaugggcgucuugugccucgcuauacuguuugaggaagugaugcgggggaaauuuggaaagaagcacaugaucgccgggguguucuucacguuuguccuacugcuaagcggccagaucacauggagggacauggcacacacacugauuaugaucggcuccaacgccucggaccggaugggcaugggagugacguaucucgcauuaauagccaccuucaaaauccagcccuucuuggcgcuaggguucuucuuaagaaaacuuaccagccgggagaaccuacugcugggagugggccucgcuauggccaccacguugcaguuacccgaagacauagaacagauggccaacgggaucgcgcugggccucaugacacuuaaacucaucacccaauucgagaccuaccaacuguggacggcgcugaucucccugacaugcagcaauaccaucuucacccugacgguggccuggcggacggccacccugaucuuggccggggugagucugcucccggucugccaaagcaguagcaugcgaaaaacggacugguugcccaugacgguggcugcgaugggcgugccgccacucccguuauucaucuucucucucaaggacacccugaagcgccgcagcuggccccugaacgaggggguaauggccgugggccucguauccauucuggccagcucccugcugagaaacgauguuccuauggccggcccgcugguggccgggggccugcucaucgcguguuacgugaucacgggcaccagcgccgaucugacgguagagaaggccgccgacgugaccugggaggaggaggccgagcagacuggcgugucccacaaccugaugauuaccgucgaugacgaugggaccaugcgcauuaaggacgacgagacggaaaacauccuuacgguccugcugaagaccgcgcuccugaucgucagcggcauuuucccguauaguaucccagccacucugcuagucuggcacacauggcagaagcaaacccagcguucaggcgugcugugggauguaccuagcccgcccgaaacccagaaggccgagcuggaggaaggggucuaccgcaucaaacagcaggggaucuucgggaaaacacaggugggcguugggguucagaaggaaggcguuuuucacacgauguggcacgugacccgaggcgccguccucaccuacaacgggaagcgccuggagcccaacugggcaagcgugaagaaggaccugaucuccuacggcgggggauggcgguuaagcgcgcaguggcagaagggcgaagagguacaggucaucgccguggagcccggcaaaaaccccaagaauuuccagacgaugccaggaacguuccagacaacuaccggagagauaggcgccauugcccuggacuucaagcccgggacgagcggcucccccauaauuaaucgcgagggcaaaguggucggccuguacggaaacgggguggugacuaaaaacggcgguuacgugagcgguauugcacaaaccaaugccgagccggauggcccgacaccggagcuggaagaggaaauguucaagaagcgaaaccuaacgaucauggaucugcaccccggcuccggcaagacacgcaaguaccugccugccaucgugcgagaagcuaucaagaggcgucugcguaccuugauccuugcgccgacccgcguggucgcggccgaaauggaagaggcccucaaggggcugcccauucgauaucagacgacggcaaccaagucugagcacaccggccgugagaucguggacuugaugugccacgccacguucacgaugcgccuccuauccccgguacggguuccgaauuacaacuuaaucaucauggaugaagcgcacuucaccgaccccgcuucuauugccgcccguggguacaucuccacacgcgucggcaugggcgaagccgccgccauauucaugacggccaccccgccagggacggccgacgcauuuccgcagagcaacgccccgauccaggaugaggaacgagacauacccgagcgcuccuggaacagcgggaacgaguggauuaccgacuucgccggaaaaacaguuugguucguccccucaaucaaggcaggcaacgacaucgccaacugcuugcggaagaacgguaagaaaguuauccagcugagcagaaagaccuucgauaccgaauaccaaaagacaaagcugaacgacugggauuucguggucacaaccgacauuuccgagaugggcgccaauuucaaggccgaccgagugaucgacccucgacggugccucaagcccgucauccuaaccgacggacccgagcgcgucauacucgccgggcccaugccugugaccgccgcuuccgccgcccaacggcgcggacgagucggucgcaacccccagaaggaaaaugaucaguauaucuucaccggccagccccucaacaacgacgaagaccacgcccacuggaccgaggcaaaaaugcugcucgacaacaucaacacccccgaggggaucaucccggccuuauuugagcccgagcgggagaaguccgcggccaucgacggcgaguacaggcucaaaggcgagagccgaaagacuuucgucgagcugaugcggcgcggugacuuaccagugugguuggcccauaaagucgcguccgaaggcaucaaguacgcggaccgcaaguggugcuucgacgggcagcggaacaaccagauucuggaggagaacauggacguggagaucuggaccaaggagggcgagaagaagaagcuccgcccacgguggcuggacgcccggacauacagcgacccgcuggcccucaaggaguucaaggacuucgcagccggccgcaagucaaucgcgcuggauuuggugaccgagauuggucggguccccagccaucucgcccaccgcacacgaaacgcucuggacaaccuggucaugcuacacacuagcgaacacggagguaaggccuaucgucaugcgguagaggagcuaccagagacgauggagacacuucuccugcucggacucaugaucuuacugacagggggcgcgaugcuguuucuaaucucgggcaaggggaucggcaagacgucgauagguuuaaucugcgucauagccuccagcggcaugcucuggauggcggagaucccacugcaauggaucgccagcgcuauagugcuggaguuuuucaugauggugcucuuaaucccagagcccgagaagcagcgcacgccccaggacaaccagcuggcuuacguggugaucgggauccucacucuggccgcuaucaucgccgccaacgagaugggucugcucgagaccaccaagcgcgacuuaggcaugagcaaggagccggggguagucucgucuacuucauaccuagacgucgaccuccaucccgccucagcuuggacccuguaugcuguggccaccaccgucaucacacccaugcuucggcacaccaucgagaacagcaccgcgaacguguccuuggccgccaucgccaaccaggcugugguccuuaugggccuggauaaggguuggcccaucuccaaaauggaucucggcgugccgcugcucgcucucgggugcuacagccaggugaacccccugacucuuacggccgcagugcuccuccugaucacccacuacgccaucaucgggcccggccuccaggcgaaggcaacccgcgaggcccaaaaacggaccgccgcgggaaucaugaagaaccccacgguagauggaauaaugacuauugaccuugacccagugauauacgacagcaaguucgaaaagcagcuagggcaggucaugcuccugguguuaugcgcagugcagcugcuauugaugcggaccagcugggcguuaugcgaggccuugacucuggccacgggucccauaaccacccucugggagggaucccccggaaaguucuggaacacuacuaucgccgucagcauggcgaauaucuuccggggcuccuaccuagccggggccggccuggccuucagcauaaugaagucaguggguacugguaagcgcggcaccgggucccagggugagacacucggggagaaguggaagaagaaacugaaccagcugagccggaaggaguucgaccucuauaagaaauccggcaucacugagguggaccgaaccgaggccaaggaggggcuaaaacggggcgagaucacccaccacgcugugucccgcggcuccgccaagcugcagugguucguagagcggaacauggugauccccgaggggcgcgucaucgacuuagggugcggacggggcgggugguccuacuauugcgcggggcugaaaaaggugaccgaagugcgcgguuacaccaaaggcgggcccgggcacgaggaaccaguccccauguccacauacggcuggaacaucgugaagcugaugagcgguaaggacguauucuaccuucccccugagaagugcgauacccugcugugcgauaucggcgaauccagcccaucccccaccgucgaggagucacguaccauccguguccugaagaugguggagcccuggcucaaaaauaaucaauuuugcaucaagguccuuaacccguacaugccaacggugauagaacaccuggaacgcuugcagcggaagcacggaggaaugcugguacggaauccccugucccggaacucgacccacgagauguacuggaucuccaacggcacagggaauaucgucgcaucggugaacauggugucuagacugcugcugaaccgguucaccaugacgcacagaaggccaaccaucgaaaaggacguggaccucggcgccggcacgcggcacgucaacgcggagccagagacacccaauauggacgugaucggggagagaaucaaacgcaucaaggaagaacauaacuccacguggcacuacgacgacgagaacccguacaagaccugggccuaccauggcuccuacgaggucaaggccaccgggagcgcuagcuccaugaucaacggugucgucaaacugcugaccaagccgugggacguggugcccauggucacacagauggccaugaccgacaccaccccguuugggcagcaacgcguguucaaagaaaagguggauacgcgcacgccuagaagcaugcccgguacccgccgugucaugggcauuaccgcggaguggcucuggcgcacgcuugggcguaauaagaaaccccgccuuugcacccgagaggaguucacgaagaaggugcggacuaacgccgcuaugggggccguguucacggaggagaaccaaugggauagcgcgaaggccgccgucgaagacgaagacuucuggaaguuaguggaccgcgaaagagagcugcauaagcugggaaagugcgguuccugcguguauaacaugauggggaagcgggagaagaaacucggcgaguucggcaaggcgaaggggucccgggccaucugguacauguggcugggcgcgcguuaccuagaguucgaggcucucggguuccugaaugaagaucacugguucucccgggaaaauucuuacagcggcgucgaaggcgagggccugcacaagcuagguuacauacugcgcgacaucuccaaaauccccggaggggccauguacgccgacgacacugccggcugggauacccggaucaccgaggaugaucugcacaacgaagagaaaaucacgcagcagauggacccugagcaccgucagcucgcgaacgcaaucuucaaacugacguaccagaacaagguuguuaaaguccagcggccgacaccgacggguacagugauggacaucauuucccgcaaagaccagcggggaagcggccaggugggaacguacucuuuaaacacauucaccaacauggaggcccagcucauucgacagauggagggggagggcguccuauccaaggccgaccuggagaacccccaccuccccgagaagaagaucacccaauggcuggagacuaaagggguggaacgauugaagcguauggccaucagcggcgaugacugcguggucaagcccaucgacgaccgguucgcaaacgcucuccuggcccugaacgauauggggaaggugcgcaaggacauaccucaguggcagcccucaaaggguuggcaugauuggcagcagguucccuuuugcagccaccacuuucacgagcucaucaugaaagacgggcggaagcuaguugugccgugccgcccacaggacgaguuaaucgggagagcgcgcauuucccagggggccggauggagccuccgggagaccgcgugccugggcaaagccuacgcccagauguggucccugauguacuuucaucgccgcgaccuccgccuggccagcaaugcaaucugcuccgccgugccaguacacuggguacccaccaguaggaccaccugguccauccacgcacaccaucaguggaugacgaccgaggacaugcugaccguguggaaccgggucuggaucgaagacaacccguggauggaggacaagacgcccgugaccaccugggaaaacgugcccuaucucggcaagcgcgaggaucaguggugcgggucccugauaggccugaccagcagggcaacgugggcucagaauauccccaccgccauccagcagguacggagucuaauagggaacgaagaguuccuugacuacaugccgucaaugaagagguucagaaaagaggaggaauccgagggagcgaucugguga

SEQ ID NO: 26002 - RNA, 9873 nt, Artificial Sequence
  derived and/or modified CDS sequence (opt11) from DENV-3__FJ547082__SS-prME
acuagcuuaugccuuaugaugauccugccggcugcccuugcuuuccaccucaccucccgggacggcgaaccccguaugaucguggggaaaaacgagcgcggcaagagccugcuguucaagaccgccagcgggauuaacaugugcacccucauugccauggaccugggcgagaugugcgacgacacggugaccuauaaauguccccacaucgccgagguggaaccugaggacaucgacugcuggugcaaucugacuagcaccugggugacauacgggaccugcaaccaagccggcgagcaccgacgcgacaagcggucggucgcgcuggcuccccacguugggaugggacuggacacgagaacccagaccuggaugagcgccgaaggcgccuggcgccagguggagaaggucgaaaccugggcgcuccgccacccgggcuucacgauucuagcccuguuucuggcccacuacaucggaaccucccuuacccagaaggugguaaucuucauccugcucaugcucgucacuccgucuaugacgaugagaugcgugggcgugggaaaccgcgauuuuguugaggggcuguccggggccaccuggguugacgugguccuggagcacggcgggugcguuacaaccauggcaaagaacaaacccacacucgacaucgaguugcagaagaccgaggcuacccaguuagccacccuccgaaaacugugcaucgagggcaagaucacgaauaucaccaccgauucgcgcugucccacccagggcgaagccgugcuaccggaggagcaggaccaaaacuacgucugcaagcauacuuacguggaccggggguggggcaaugguugcggccucuucgggaagggcucccuggucaccugcgcaaaguuccaaugccuugagcccaucgagggcaaggucgugcaguacgagaaccucaaguacaccgugaucaucacaguccauacgggggaccaacaccaggugggcaaugagacccagggggucaccgccgagauaacuccccaggccaguacgaccgaggcuauccuucccgaguacgggacacugggucucgaaugcuccccgcgcaccggccuagacuucaacgaaaugauccugcugacaaugaagaacaaggccuggaugguacaccggcagugguuuuuugaccugccccugccauggacaagcggagccacaaccgagaccccgacguggaaccgcaaggagcuccugguaaccuucaagaacgcccaugccaagaagcaggaggucguagugcuggggucccaggagggugccaugcacaccgcgcucaccggcgccacggagauacagaacagcggugggacuuccaucuucgccggucaccugaagugucggcugaagauggacaagcucgagcugaaggguaugagcuaugcgaugugcaccaauaccuucguccugaagaaagagguguccgagacgcagcacgggacuauucucaucaagguggaauacaaaggagaggacgucccgugcaagauuccguuuucgacagaggaugggcaggggaaggcccauaacggccgccuuauaaccgccaacccuguggugacgaagaaggaggagcccgucaacaucgaggccgagccgccuuucggugagagcaauaucgugaucggcaucggcgacaaugcgcuaaaaaucaacugguacaagaagggcaguagcaucgggaagauguucgaggcaaccgcccggggcgcccgccggauggcuauacuuggcgacaccgcuugggauuucgguucagugggcggggugcuaaacagccuaggcaagauggugcaccagaucuuuggguccgccuacacugcccuguucucaggggugagcugggucaugaagauuggcauaggggugcuccugacguggaucggccugaacucgaaaaacacuuccaugagcuuuucguguaucgccaucgggauuauaacucucuaccugggcgccgugguacaggccgacaccgggugcgugauuaacuggaaaggcaaggagcugaagugcggcagcgggaucuucguuacgaacgagguccacacuuggacugagcaguacaaguuccaggcagauuccccaaaacgccuggccaccgccaucgcaggagcgugggagaauggggugugcggcauuagaucuacgacucgaauggagaacuuauuguggaaacagaucgcuaacgagcucaacuacaucuugugggagaacaacaucaagcugaccguggucgugggcgacaucauaggcgugcucgagcagggcaagcguacccugacaccucagccgauggagcuuaaauacucuuggaagaugugggggaaagccaagaucgucaccgccgagacccagaauagcucuuucaucaucgacggcccgaacaccccggagugccccagcgcuucccgagccuggaacgugugggagguggaggacuacggguucggcgucuucacgaccaacaucuggcugaaacugagagaaguguacacucagcugugcgaccaccggcucaugagcgccgccgugaaggacgagcgagccguccacgcggacaugggcuacuggaucgagagccagaagaacggguccuggaagcuggagaaagccucucugaucgagguuaagacuugcacguggccaaagucccacacgcucuggucuaacggcgugcuggaguccgacaugaucauccccaagagccuggcagggcccaucucccaacauaacuaucggccuggguaucacacccagaccgcaggcccuuggcaccucgguaaguuagagcuggacuuuaacuacugcgagggaaccacggucgugaucaccgagaacugcggaaccagaggaccgagccuccggaccaccacaguguccgggaagcugauccacgaauggugcugccguucgugcacauuacccccgcuccguuacaugggcgaggauggaugcugguacggcauggagauccgccccauaucugaaaaagaggagaacauggucaagucccuggucucggccggcagcgggaaaguggacaacuucaccaugggggucuugugccucgccauccuguuugaggaggugaugcgcgguaaauucgguaaaaagcauaugaucgcgggggucuucuucacguucguccugcuccuguccggacagaucacauggcgcgacauggcccacacccucaucaugaucgguagcaacgccuccgaucggauggggaugggcgucaccuaccucgcacugaucgcgacguucaagauccagcccuuccuggcccucggauucuuucugcgcaagcugaccagccgggagaaucucuuacugggcgucgggcucgccauggcgaccacccugcagcugccugaggacaucgagcagauggcuaacggaaucgcccucggccugauggcccugaagcucaucacgcaguucgagaccuaccagcuguggacagcccugaucagccugacgugcuccaauacgauauucacccugacggucgccuggcgcaccgcgacgcugauccuggcugggguuucucuguuaccggucugccaguccagcuccaugcggaaaagugacuggcuccccaugaccguugccgccaugggcgugccgccccucccguuauucauauucucccugaaggacacccugaagcgacggagcuggccccugaaugaggggguaauggcagugggccucguauccauccuggcgagcucccuguugcggaacgauguaccgauggccggcccgcugguggcggggggccugcucaucgcguguuaugugauuacagggacgagcgcggaccugacggucgagaaggcggccgacgugaccugggaggaggaggccgagcagaccggggugucccacaaccugaugauaacggucgacgacgacgggaccaugcgcauuaaggacgacgagaccgagaacauccucacagugcuacugaagaccgccuuacugaucgucagcggcaucuucccguacuccaucccagccacucuacuagucuggcacacuuggcagaagcagacccggcgcagcggugugcugugggacguucccagcccgcccgaaacccaaaaggcagagcuggaggaagggguuuaccggaucaagcagcagggaaucuucgggaagacacaggugggaguagggguccaaaaggagggcguguuccacacuauguggcaugugacccguggcgccguucucaccuacaacgggaaacggcuagagccgaauugggccucagugaagaaggaccuaauauccuacggcgggggcuggcgccucagugcccaguggcagaaaggcgaagagguucaaguuauugcaguggaacccgggaagaacccgaagaacuuccaaacgaugcccggcaccuuccagacuaccaccggggagaucggugcuaucgcccuggacuucaagccugggaccagcggcagccccaucaucaaucgcgagggcaagguggucgggcuguacggaaacgggguggugacuaagaacggcggguacgucagcggaauugcccagaccaacgccgagccggacgguccaacgccagaacuggaggaggagauguucaaaaagcgcaaccucaccaucauggacuuacaccccggguccggcaagaccaggaaguaccugccggcaaucgugcgcgaggcuaucaagcgccggcuccgaacacugauccuagccccuacgcgcguggucgccgccgaaauggaggaggcgcugaagggccuccccauucgauaucagacaaccgccaccaagagcgagcacacuggacgcgaaauagucgacuuaaugugucaugccaccuucacuaugcggcucuuaucucccguccgcgucccgaacuacaaccugaucaucauggacgaggcgcacuucaccgaccccgccaguaucgcggcccguggauacaucucgacacgcguuggcaugggggaggccgccgcgauuuucaugaccgcgacgccgcccgguaccgccgacgccuucccgcaaucaaacgccccuauucaggaugaggagcgcgacauaccggagcgcuccuggaauucuggcaacgaguggaucacggacuucgcggggaagacagugugguucguccccucgaucaaggcagguaacgacauagccaacugccuacgcaagaacgggaagaaagugauccagcugagccggaagaccuucgacacggaauaccaaaagacgaaguuaaacgacugggacuucgugguaacgaccgacaucuccgagaugggcgccaacuucaaggccgaccgcgugaucgacccucggcguugccuaaagcccguuauccugacagacggccccgagcgcgucauccuggcagggccgaugccggugacagccgcuagcgccgcccaacgccggggccgaguggggcggaacccccaaaaggaaaaugaucaguacaucuucaccggccagccccucaacaacgacgaggaccacgcgcacuggaccgaggccaagaugcugcucgauaacaucaacacccccgaggggaucaucccggcccucuucgagcccgagcgcgagaagagcgcagcgauagacggcgaguaccggcucaagggagagagccgcaagacuuucgucgaacuaaugagacgcggugaccuccccguguggcuugcacauaaggucgccuccgaggggaucaaguauacggaccggaaguggugcuucgacgggcaacgcaacaaccagauucuggaggaaaacauggacguggagaucuggaccaaggagggcgagaaaaaaaaacuccggccgcgcuggcuggacgcccgcacuuacagcgacccacuggcucucaaggaguucaaggacuucgcggccggccggaaguccaucgccuuggaccuugugacagagauaggucgcguccccagccaccucgcacaccggacgcgcaacgccuuagauaaccugguaaugcuacacaccagcgagcacggcgggaaggcauaccggcaugccguugaggagcugcccgagaccauggagaccuugcuccuucugggucucaugauccugcugaccggaggcgccaugcucuuccucaucuccgggaaggggaucgguaagaccagcaucggucugaucugcguuauugccaguagcggcaugcucuggauggccgagaucccgcugcaguggauugcgucagccaucguucuggaguuuuucaugauggugcuguugaucccugagcccgagaagcaacgcacaccccaggauaaccagcuggcuuacgucgugaucggcauacuuacccuagccgcuaucaucgccgccaacgagaugggacuucuagagacaaccaagcgggaccugggcaugucaaaggagccggggguggucagccccaccagcuaucuggauguggaucuccaucccgccuccgccuggacccuauacgcagucgccacgaccguaaucacccccaugcugcgacacaccaucgagaacucgacggcuaacgucucccucgccgccaucgcgaaccaagccgugguccugaugggccuggauaagggguggccgaucagcaaaauggaccucggcgugcccuuacuggcccucggcugcuacucacagguaaacccccugacccugacggccgccguccuccuccugaucacccauuaugcgaucaucggcccgggccuacaagccaaggccacucgagaagcccagaaacgcaccgccgcugggaucaugaagaacccgaccguggacggcaucaugaccauugaccuagaucccguaauauacgacagcaaguucgagaagcagcugggccaggucaugcuccugguucugugcgcggugcagcuccuacugaugcggacguccugggcgcucugugaggcccugacccuggcgaccggucccauaaccacucugugggaaggcagcccugggaaguucuggaauaccaccaucgccguauccauggcgaacaucuuccgcgggagcuaccuggcaggggcaggcuuggcguucuccaucaugaaguccguggggacgggcaaacggggcacugggagccagggagagaccuugggcgaaaaauggaagaagaagcugaaucaacuaucccgcaaggaguucgaccucuauaagaagagcggcaucaccgaaguggaccgcaccgaggccaaggagggccugaagcgcggugagauaacccaucaugccgucucccggggaagcgccaagcugcagugguucguggagcgcaauauggugaucccugaagggcgaguuaucgaccucgggugcgggagaggcgggugguccuacuacugugccggccugaagaaggugacagaggugcggggcuacaccaagggcgggcccggucacgaggaacccguucccaugaguacuuacggcuggaauaucgucaagcuaaugagcgguaaagacguuuucuaccucccgccggaaaaaugugacacauugcucugcgauaucggugagagcagucccagccccacagucgaggagucccguacaauccgcgugcugaagaugguggagccauggcucaagaacaaccaauucugcauaaaggucuuaaaccccuacaugccaacggugaucgagcacuuagagcgccuacagaggaaacauggcgggaugcugguacggaacccucugagcaggaacuccacacacgagauguacuggauaagcaacggcaccgggaacaucguugcguccgugaauauggugucgcgguuacugcugaaccgcuucaccaugacccaccggcgcccgaccaucgagaaggacguugaccuaggcgccggcacgagacauguuaacgccgagcccgagacccccaacauggacgucaucggggagcgcauaaagcggaucaaggaggagcacaauuccaccuggcacuacgaugacgagaacccguacaagaccugggccuaccacgguagcuacgaggucaaagccacaggcuccgcgagcagcaugaucaauggcguggucaagcugcuaacaaagcccugggacguggugcccauggucacccagauggccaugaccgacacgacucccuucgggcagcagcgcgucuucaaggagaagguugauacccgaaccccgagguccaugccgggcacgcggcgcguuaugggcauuaccgcugaguggcucuggcgaacccugggacgaaacaaaaagccccgacuaugcacucgcgaggaguucacuaagaaggugcggaccaacgccgcgaugggcgccguguucaccgaggagaaccagugggacagcgcuaaagcugccgucgaggacgaggacuucuggaagcucguggaccgggagcgcgagcugcacaagcuagggaaaugcggcucguguguguauaacaugauggggaagcgagagaagaaacuaggcgaguuuggcaaggcgaaagggagccgcgccauuugguacauguggcugggcgcacgguacuuagaguucgaggcccucggguuccugaacgaggaccacugguucucccgcgagaauagcuacuccggcguggagggagaaggccuccauaaauuaggcuacaucuuacgggacaucagcaagauucccggcggcgccauguacgccgaugacaccgcagggugggauacgcgcaucaccgaggacgaucugcacaaugaagagaaaaucacccagcagauggacccggagcaccggcaguuagcgaacgccaucuucaaacugaccuaccagaacaagguggugaaaguccagagacccacucccaccgguaccgugauggacaucaucucccggaaggaccagcggggcagcggccaggugggcaccuacgggcugaacaccuucacgaacauggaggcccagcucauccgccagauggagggcgagggaguacugucgaaggcagaccuugaaaacccgcaucucagcgagaagaagaucacccaguggcuggagaccaagggcguagagcgccuuaagcggauggccaucucgggagacgacuguguggucaagccuauagacgaccgcuucgccaacgcucuccucgcccugaacgacauggggaaggugcgaaaggacaucccccaguggcagcccucaaagggcuggcacgauuggcagcagguccccuucugcucccaucauuuccacgagcucaucaugaaagacggucgcaagcugguagugccgugucggccgcaggacgagcugauuggaagggcgcggaucagccagggggccggcuggucacuccgcgagaccgccugccugggcaaggccuacgcgcagauguggagccugauguacuuccacaggcgggaccuccgauuagcuuccaacgcgauuugcucagcagugcccguccacugggugcccaccucgaggacaacguggaguauccacgcccaucaucaauggaugaccacugaggacaugcugaccgucuggaaccgcguauggaucgaagauaacccguggauggaagacaaaacccccgugaccacgugggaaaacguacccuaccucgggaagcgugaagaccaguggugcggaagccugauugggcugacuuccagggcgaccugggcccaaaacauccccaccgccauucagcagguucgcagccucaucgggaaugaggaguuccuggacuacaugccgucgaugaagcgcuuccgaaaagaggaggagagcgagggggccaucugguga

SEQ ID NO: 26003 - RNA, 9873 nt, Artificial Sequence
  derived and/or modified CDS sequence (opt11) from DENV-3__FJ547083__SS-prME
accagccucugcuugaugaugauccugccggcagcccuggcguuccauuuaacaucacgggacggggagccgcggaugaucguggggaagaacgagcgcggcaagagcuugcuguucaagaccgccagcgggauaaauaugugcacacucauugccauggaucugggcgagaugugugaugacaccguaaccuacaagugcccacauaucaccgagguggagcccgaagacaucgacugcuggugcaaccuuaccuccaccugggugacguacggcacgugcaaucaggcuggggaacgacgccgggauaagcgcuccguggcacucgccccacacgugggaaugggguuggacacccggacccagaccuggaugagcgcugagggggccuggcgccagguggagaagguggagacgugggcguugcgacacccgggguucaccauccuagcgcuguuuuuagcucacuacauaggcacaagccuaacccagaagguagugaucuucauucuccuuaugcucgucacgcccagcaugaccaugcgcugcguugggguggggaaccgggacuucgucgagggccucaguggugccaccuggguggacguggugcuggagcacggugggugcgugaccacgauggccaagaacaaacccacccucgacaucgaguuacagaaaaccgaagcuacacagcuggcaacgcuccgaaagcugugcaucgaggggaaaaucaccaacaucaccaccgacucccguugccccacgcagggcgaggccgugcugccggaggagcaggaccaauccuacguuugcaaacacaccuacguggaucgcggguggggaaacggguguggccuguucgggaagggauccuuggugaccugcgccaaauuccagugucuggagcccaucgagggcaaggucgugcaguacgagaacuugaaguacaccguaaucaucacuguucacaccggggaccagcaccagguuggcaacgagacccagggggugacggcagagauuacgccccaggcaucuacuaccgaggccaucuugccggaguacggcacccuugggcuugagugcucuccgcggacgggccuggacuucaacgagaugauucugcucacgaugaaaaacaaggccuggauggugcaccgccagugguucuucgaccugccccugcccuggacuuccggagccaccaccgagacgcccaccuggaaccgcaaagaauuacuggugaccuuuaagaacgcccacgccaagaaacaggaagucguagugcuggggucccaggagggcgcgaugcacacugcccucacaggggccacugagauacagaacuccggcgggaccagcauauucgcgggacaccugaagugccgccugaagauggacaagcucgaacugaaggggauguccuacgccaugugcacuaauacuuucguccugaagaaggagguuucagagacgcagcaugggacuauacucaucaagguggaguauaaaggcgaggacgcgccgugcaaaaucccuuucagcacagaagacgggcagggcaaagcccacaaugggcgccugaucacggcuaaucccgucgugaccaagaaagaggagcccgugaacaucgaggcggagccgcccuuuggcgaguccaauaucgucauaggcauaggggacaacgcguugaaaaucaacugguacaagaaaggcagcuccaucggaaagauguucgaggcuaccgcccgaggcgcccggcgcauggccauccugggcgacacagcgugggacuuuggcagcgugggcgguguacucaacagccucggaaagaugguccaccagauuuuugguucagcauauacggcccuguuuuccggcgugagcugggugaugaagaucggcauagggguccuccugacauggaucggucugaacuccaagaacacgucaauguccuucaguuguaucgccaucggcaucaucacccucuaccugggcgcagugguacaagccgacauggggugcgucaucaacuggaagggaaaggaguugaaguguggcucagggaucuucgucacgaacgaggugcauaccuggacugagcaguacaaguuccaagccgacucucccaagcggcucgccaccgccaucgccggcgcaugggagaacgggguuuguggcauccggucaaccacucguauggagaaccugcuguggaagcagaucgccaacgaacucaauuacauccugugggagaacaauauaaaguuaaccguuguggucggggauacaauuggcgugcuagagcaggguaaacgcacgcugacuccccagccgauggaauugaaauacaguuggaagacgugggggaaagccaagaucgugaccgccgagacgcaaaacucuagcuucaucaucgacggacccaacaccccugagugccccucggcgucucgcgccuggaauguaugggagguggaggacuacggguuuggcguguucacuacuaauauauggcucaaacugcgagaggucuauacgcagcugugugaucaccgucugaugagugccgccguaaaggacgagcgggccguacacgccgauaugggguacuggaucgagucccagaaaaacgggagcuggaagcuggagaaagcgagucugauagaggucaagacgugcaccuggcccaagucucacacgcuuugguccaacggcgugcuagagagcgacaugauaauccccaagagcuuagccgggcccaucagccaacacaaccaucgcccgggcuaccauacucagacugcugggcccuggcaccuugggaagcuggagcuggacuucaauuacugcgaggggacgaccgucguuaucaccgagaacugcgguacgcgggggcccucccuccggaccacaaccgugagcgggaagcugauccaugaguggugcugccggucuugcacacuuccaccguugcgcuacaugggcgaggacgggugcugguacggcauggaaaucaggcccaucagugaaaaggaagagaauaugguaaagagccuugugagcgcagguucugguaaaguggauaauuuuacaaugggcguucugugucucgcgauccuguucgaggaggucaugcgcgggaaauuuggcaagaagcacaugauagccggaguguucuucacguucgugcuucuccuuucaggccaaaucacguggcgagacauggcgcauacgcugaucaugaucggcucaagcgcaagcgacaggauggggaugggcgucaccuaccucgcacugauugcgaccuucaaaauacagcccuuccuugcucucggauucuuccuucggaagcugacgucccgcgagaaucucuugcuaggcgucggccuugcgauggcaaccacccugcaacugcccgaggacaucgaacagauggcgaaugguauugcguuaggccugauggcccugaagcucaucacccaauucgagacuuaucagcuuuggacggcucugauaucucugaccugcuccaacaccauguuuacccugacaguagcuuggcggaccgcgacccugauccuggccggggucucacuccuaccggugugccaaucaucuuccaugcggaaaacagauuggcugccuauggccguugccgcgaugggcgucccaccucuuccgcuuuucauuuucagccucaaggacacgcugaagcgccgcuccuggccgcugaacgaggggguaauggcggucggccucgugagcaucuuggccuccagucugcuccgcaacgacguccccauggcaggcccccugguggccgguggccuacucaucgccugcuacgugaucaccgggaccucagcggaccugacuguggagaaggccgcggacaucacgugggaggaggaagcagagcagacagggguuagucacaacuugaugaucaccguugacgaugacgggacgaugcguaucaaggacgaugagaccgagaacauucucacggugcugcugaagaccgcccuccugaucgucuccggagucuucccguacagcauacccgcgacccugcucguuuggcacacauggcagaaacagacgcagcgcucgggcguccuaugggacgucccuagcccgccagagacucagaaagcagagcuagaagagggcguguaucggaucaagcagcagggcaucuucgggaagacccaggucggcgugggugugcagaaggagggggucuuccacacaauguggcacgugacgaggggcgccgugcucaccuacaacgggaagcggcuugagccgaacugggcguccgucaagaaggacuuaaucagcuacggcgggggcuggcgccucucagcgcaguggcaaaagggggaggagguccaagugaucgcugucgagccuggcaagaaccccaaaaacuuccagaccaugccugguaccuuccagacaaccaccggcgagaucggcgccauagcccucgacuucaagccuggaaccagcggcucgcccaucaucaaccgggaggguaaggugguggggcucuacggcaaugggguggugacgaaaaauggcggcuacgucucugguaucgcccagaccaaugcggagccggacggccccaccccagagcucgaggaggaaauguuuaagaagaggaaccuuacuaucauggaccugcaccccgguagcggcaagacgcggaaguaccugccggccauaguuagagaggccaucaagcgcaggcuccggacccugauccuggcacccacucgcgugguggcugcggaaauggaggaggcccucaaggggcugcccauccguuaccagacgacggccacaaaguccgagcacacuggucgggagaucgucgaccugaugugccacgcgaccuucacuaugcggcugcugucacccgugcgcguaccgaauuacaaccugauuaucauggacgaggcccauuucaccgacccugcgaguaucgccgcccgaggguacaucaguacgcgcguagggaugggcgaggccgcggccaucuucaugacggccacaccgcccgggaccgccgaugccuucccucaguccaacgcccccauacaggacgaggagcgcgacauccccgaacggucguggaacucuggcaaugaguggaucacggacuuugccgggaagaccguuugguucguccccagcauaaaggcuggcaacgacaucgccaacugccuacgcaagaacgggaagaaggucauccagcuguccagaaagacguucgacaccgaguaccagaagaccaagcugaacgacugggacuucgucgugacaacagacaucagcgaaaugggcgcaaacuucaaggcagaccgaguuaucgacccgcgucgcugccucaagcccgugaucuugacugauggcccggaacgugugauccucgccgggcccaugccggucaccgcggccuccgccgcucaacgccgcggucgagucgggcggaauccucagaaggagaacgaccaguauaucuucacaggccagccucucaacaaugacgaagaccacgcacauuggaccgaggccaaaaugcugcuggacaacaucaacacccccgagggcauaauuccggcacucuucgagccugagcgggagaaaucugcugcuauugacggcgaguacaggcugaaaggcgagucccgcaaaacauucgucgaguugaugcggcgcggggaccuacccgucuggcuggcgcacaaaguugccagcgagggcauaaaauacacagaucggaaaugguguuucgacggacagcgcaacaaccagauuuuggaggagaacauggacguagagauuuggaccaaggagggugaaaagaagaaacuucggccccgguggcuggacgccagaacguauucggacccguuggcguuaaaggaguucaaagauuucgcggccggccgcaagaguauagcccuggaucuggugaccgagaucgggcgcgugcccagccaccucgcccaccggacccgcaacgcccuggacaaccuggucaugcuccacaccuccgagcacggcgggcgggccuacagacacgcaguggaggagcugcccgagacgauggagacccugcuccugcugggccucaugauccuucugaccgggggcgcuauguuauuccugauaagcggcaagggaaucggcaagaccuccaucggguugaucugcgucaucgccagcagcgggaugcucuggauggcggagaucccgcugcaguggaucgcuagcgccaucguacuggaguuuuucaugauggugcuccuaauccccgagccagaaaagcagcggacuccccaggacaaucagcuugcuuacguggucaucggaaucuuaacccuggccgcgaucaucgccgcuaaugaaaugggccugcucgagacaaccaagcgcgaccugggcauguccaaagaaccaggaguggugucuccgacguccuaccuggacgucgaccuccaccccgccagugcguggacccuguacgcgguggccacaacagugauuacgccgauguuacgucacaccaucgaaaauucuaccgccaacgucagccucgccgcgaucgccaaucaggccguggugcugauggggcuggacaagggcuggccgauauccaagauggaccucggcgucccccugcuggcccucgguugcuacagucaggucaacccccugacgcugacggcugcgguacuccugcugaucacccacuacgccaucaucggccccgggcuacaggccaaggccacccgcgaggcccaaaaacggaccgcggccgggaucaugaagaacccgaccgucgauggcaucaugaccauugaccuggaccccgucauuuacgacuccaaauuugaaaagcaauugggccagguaaugcugcuaguccugugcgcggugcagcucuugcugaugcgcaccagcugggccuuaugugaggcgcugacccucgccacgggccccaucaccacucucugggagggcuccccugggaaguucuggaacaccacaaucgccguaagcauggccaauaucuuucggggcucauaucuggccggggcaggccuggcuuucagcaucaugaaguccgucgguaccgggaagcgcggcaccgggucccagggcgaaacacucggggagaaauggaagaagaaacuuaaccagcucagcagaaaagaguuugaccucuacaaaaaguccgguauuaccgagguggacaggacggaggccaaggaggggcugaaacguggcgaaaucacccaucacgcugucagccgaggcuccgccaagcugcagugguuugucgagcguaauaugguuauaccggaggggcgcgucaucgaccucggcugcggucggggaggguggagcuacuacugcgcgggccucaagaaggucaccgagguacgcggcuacacaaagggcggaccaggacacgaggagcccgugcccaugaguacuuacggcuggaacauugucaaguuaaugagcggcaaagacgucuuuuaucuaccucccgagaagugcgacacgcugcugugcgacaucggcgaguccagccccuccccuaccguggaggaaagcagaacgauccgggucuuaaaaauggucgagccauggcucaagaauaaccaguucuguaucaaagugcugaaccccuauaugccuacggucaucgaacaccucgagcgguugcaaagaaagcauggagggauguugguccggaacccccugucccgaaacuccacgcacgagauguacuggaucuccaacggaaccgggaacaucgucgccagcgucaacauggugagccgccuccugcuaaaccgguuuaccaugacgcaccgccggcccaccauagagaaggacguagaccucggcgccggcacccgccacgucaacgccgagcccgagacccccaacauggacgugauuggcgaacggaucaaacgcauuaaggaggaacauaacagcacguggcauuacgacgacgaaaacccguacaagacuugggccuaccacgguuccuacgaggugaaggcgaccgggucugcaagcaguaugaucaacggcguugugaagcugcugaccaagcccugggaugucguaccuaugguaacgcagauggccaugacagauaccaccccauucgggcagcaacgugucuucaaagagaagguugacacgcgcacaccgcguagcaugccuggcaccagacgggucaugggcaucaccgccgaauggcucuggcgcacccucgggcgaaacaagaagccccgcuugugcaccagagaggaguucaccaagaaaguccggaccaacgcggccaugggugccguguuuacggaggagaaccagugggacagcgccaaggccgcggucgaggacgaggacuucuggaaacucgucgaccgggaaagagagcugcacaaguuagggaagugcggcagcugcguguacaacaugauggggaaacgcgagaagaaacuuggugaguuuggcaaagccaagggguccagagcuaucugguauauguggcugggcgcccgguaccuggaguuugaggccuugggguuccuaaacgaggaccacugguucagccgggaaaauucguacagcggaguggagggggaagggcugcacaaacucggcuacauacuucgcgacaucuccaagaucccgggcggugcgauguacgccgacgacaccgccgguugggacacacggauuaccgaggacgacuuacacaaugaggagaaaauuacgcaacaaauggacccggagcauaggcagcuugccaaugcaauuuucaagcugaccuaucaaaacaaggucgugaaaguucagcggccuaccccaaccggcacugucauggacaucaucucucgaaaggaccagcggggcuccggccagguuggcacauauggccugaacaccuuuacaaacauggaggcgcagcugaucaggcaaauggagggcgaaggagugcucagcaaagccgacuuggagaacccccaucucccggagaagaagauuacccaguggcuggaaacgaagggcgucgagcggcugaagcgcauggccaucucaggcgacgacugcguggugaagccaauagacgaccgguucgccaacgcccuccuggcacugaacgacaugggcaaggugcgcaaggacauuccucaguggcagcccucaaagggcuggcacgacuggcaacagguccccuuuugcucucaucacuuccaugagcuaauuaugaaggaugggaggaagcuggugguccccugccgcccccaagacgagcugaucggucgugcccggaucagccagggggcaggcuggucccuccgugagacugcgugccugggcaaggcguacgcacaaauguggagccugauguacuuccaccgccgcgaccuccgccuggccucgaacgccaucuguagcgcuguccccgugcacuggguaccgacaagccguacaaccuggucuauccacgcgcaccaccaguggaugaccaccgaggacaugcugaccguguggaauagagucuggaucgaggacaaccccuggauggaagauaagacgcccgucacuacuugggagaacgugccauacuuggggaagcgggaagaccaguggugcggcagccucauagggcugacaucccgggcgacgugggcccagaacaucccgacugccauccagcagguucgcucucucaucggcaaugaggaguuccuggauuacaugccguccaugaagcgguuucgcaaggaggaagaauccgagggggcaaucugguag

SEQ ID NO: 26004 - RNA, 9873 nt, Artificial Sequence
  derived and/or modified CDS sequence (opt11) from DENV-3__FJ547084__SS-prME
acuagcuugugucuaaugaugauccugccagccgcgcuagcauuucaccuaacaucgagagauggcgaaccacgaaugauaguaggcaaaaacgaaaggggcaagagcuugcuauucaagacagccucagguauaaacaugugcacacuaauagccauggaucuuggcgaaaugugcgacgacacaguaacauacaagugcccacacauuacagagguggaacccgaagacaucgacugcuggugcaaccucacaagcacuuggguaacauacggcacgugcaaccaggccggagaacaucgcagagauaaacgguccgucgcccuagccccgcaugucggaaugggacuagacacacgcacccagacauggaugagcgcggagggcgcauggcggcaaguggaaaaaguagaaacgugggcacuccgacacccggguuucacgauuuuagccuuguuccuugcgcacuacauugggacgucucucacccagaagguuguaaucuucauacuauugauguuaguaacuccuagcaugaccaugcguugcguaggcgucggcaaccgagacuucguagaaggucugagcggagcaacguggguugacgucguucuagagcacggcggaugcgugacaacgauggccaaaaacaaaccuacacuugacauagaacuucaaaagacagaagccacgcagcuugccacucuacgaaaacuaugcauagaagguaaaauaacaaacaucaccaccgacaguaggugcccaacacagggcgaggcagucuugccagaagaacaggaccagaauuacgugugcaaacacacauauguagaccgaggauggggcaacgguugcggccuauucggcaagggcucccuagucacaugcgcaaaauuccaaugucuagaacccauagaagggaaaguaguucaauaugagaaccuuaaauacacaguaauaauaacgguacacaccggagaccaacaccaaguaggcaacgaaacacaaggaguaacagcugagaucacuccucaggcgucgacuacggaggccauacucccugaauauggaacccuuggacucgaaugcagcccacgaacaggacuagacuucaacgaaaugauccuacuaaccaugaaaaauaaagcguggaugguccauagacaaugguucuuugacuugccacucccguggacaagcggagccacuacagagacaccaacguggaacaggaaagagcucuuaguuacguucaaaaacgcacacgccaaaaagcaggagguagugguacucgggagucaggaaggggcgaugcauaccgcgcugacaggcgcaaccgaaauccagaauagcgggggcacuucaauauuugcgggacaccuaaaaugcaggcuuaaaauggacaagcuagagcugaaaggcaugaguuacgccaugugcacuaauaccuucguacuaaagaaagaaguaucggaaacacagcaugggacaauucuuaucaaaguggaauacaagggagaagacgucccauguaagauacccuucagcacagaggacggacaggguaaggcacacaacgggcgguuaauaacggccaacccggucgugaccaagaaagaagaacccguaaacauagaagcagaaccacccuucggggaaucaaacaucguaauuggaaucggcgacaacgcguugaagauaaacugguacaaacgcggaagcaguaucggcaaaauguucgaggccacagcuagaggcgcucggcgaauggccauccugggagacacugcaugggacuuuggcuccgucggcgggguccugaacucccucggcaaaaugguccaccaaaucuucggcucagcguacacggcgcuguucagcggcguaagcugggucaugaagauaggcaucgggguguuacugacguggauagggcucaacagcaagaacacuagcauguccuucucaugcauagcaauagggauaauaacauuauaccucggagcaguagugcaagccgacaugggcugugugaucaauuggaaaggaaaggaacuaaagugcggcucgggcaucuucguuacaaacgaaguacauaccuggacggaacaauauaaauuccaggcagacucacccaaacgacucgcaacagccauagcaggcgcaugggaaaacggaguguguggcauucggucgaccacccgaauggagaaucugcuauggaaacaaauagcaaacgaacuaaacuauauccuuugggaaaacaauaucaaacucacugugguuguaggggacacgauaggagucuuagagcaggggaagaggacccugacaccgcaaccuauggagcucaaguauaguuggaaaacauggggcaaagcaaaaaucgugaccgcggagacgcaaaauucuucguucaucauugacggcccaaacacccccgagugcccuuccgcuagcagggcauggaacgugugggagguggaagacuacggcuucggcguauucacaaccaacauauggcugaaauugagggaagucuacacccaacugugugaccaccgccuaaugagcgcagcagucaaagacgagagagcaguacacgcggauaugggauacuggaucgagagucaaaagaaugguagcuggaagcucgaaaaggcgagccuaauugaagugaaaacaugcacguggccuaaaucccacacgcuauggagcaacggugugcuagaaagcgacaugauaauaccgaagucucucgcuggucccaucagccagcauaacuaccgacccggauaucacacacagaccgcggggcccuggcaccucggcaaauuagaauuggacuucaacuacugugaggggacaaccgucguuauaacggagaacugugggacucguggcccuucgcuacgcacgacuaccgucuccgggaaauugauacacgagugguguugcaggucgugcacucucccaccucuucgguacaugggggaggacggcugcugguauggcauggagauucgcccgaucucagagaaggaagagaacaugguaaaaaguuuagugagcgcaggcuccgggaagguugacaacuucacaauggggguucuaugccuagccauacuauucgaagaagucaugcgaggaaaguucgggaagaaacauaugaucguaggugucuuuuucaccuucguauuacuacucuccggacaaaucaccuggagagacauggcgcacacgcuuaucaugauaggcagcaaugcaucggaucguauggguaugggagucacauaucucgcacuaauagcgacguucaaaauacagcccuuccuagcucuagguuucuuccuacguaaacugacgucgcgcgaaaaccugcuccucgggguaggauuggcgauggcaacgacccugcaauugccggaagacaucgagcagauggcaaauggaaucgcucucggacucauggcguugaaacucacaacccaauuugaaacuuaucagcucuggaccgcccuuauaagccuaaccugcaguaacaccaucuucaccuuaacaguggccuggcggacggcuacacuaauucucgcgggggugucauuacuaccggucugucaaaguuccagcaugagaaaaacggauuggcucccuaugaccguggcggcgaugggagucccgccccuaccacuuuucauauuuucccucaaagacacccuaaaaagacguuccuggccccuaaacgaaggaguuauggcgguggggcucgugagcauccuugcaagcucccuacuacguaacgauguaccaauggccggaccucugguagcuggaggacugcucauagcgugcuacguaauaacaggcacaagcgcggaccuaaccgucgaaaaagcagcagaugucaccugggaggaagaggccgaacagaccggcguuucacacaaccuaaugaucaccgucgacgacgacggaacgaugcgcauaaaggacgacgaaacagaaaacauacuaaccguacuccucaagacagcgcuucuuauagucagcggaaucuuuccuuacagcauaccggccacccugcucguauggcacacguggcaaaagcaaacgcaaaggagcgggguccucugggauguaccgucaccaccggaaacgcagaaagcagagcucgaagaagggguauaccgaaucaaacagcaggguauauucgguaaaacacaaguuggcgucggcguacagaaagaaggaguuuuccacacgauguggcacgugacacggggugcaguacuaaccuacaacgggaagcgacuagaaccgaacugggcgagcgugaaaaaggaccucauuuccuacggagguggguggcggcucucagcacaguggcaaaagggggaggagguacaggucauugcgguugaacccggcaaaaaccccaaaaacuuccagacuaugccagggaccuuccaaacgaccacgggagagaucggugcaauagcccuggacuucaaacccgggacaagcggcaguccgauaauaaacagagaagggaaagucguggggcuguacgggaauggagucgucacuaaaaacggcggcuacguguccgguauagcgcagacuaacgcggaaccagacgggccaacucccgagcucgaagaagagauguuuaaaaagaggaacuugacuauaauggacuuacacccugguagcgguaaaaccaggaaguaccuucccgcaaucgugcgcgaagcgauaaagcgacggcuccggacccuaauacuugcacccacccgagucgucgcugcugaaauggaagaggccuugaaggggcucccuauuagguaccagacaacugcuacaaaaucugaacacacagggcgcgaaaucguagaccucaugugccacgccacuuucacaaugcgcuuauuaagcccuguacgugucccaaauuacaaucuaaucaucauggacgaagcccacuucaccgaccccgcuucgaucgccgccagaggauacauaaguacgcgcguaggaaugggcgaggcagcugcaaucuucaugaccgcaacaccaccugggacagccgacgcuuucccacaguccaaugccccgauccaagacgaggaacgagauauaccagagcguuccuggaacuccggcaaugaauggaucacagauuucgcgggaaaaacaguaugguucguuccgagcauaaaagcagguaaugacaucgccaauugccuccgaaagaacggcaaaaagguaauucaacugucaaggaaaaccuucgacacagaauaccaaaagaccaaacuuaacgauugggauuucguggugacaaccgacaucucagaaaugggagccaacuucaaagcagaccgaguaaucgacccgagacgcugccuuaagccagugauacuaacggacgguccagaacgcguaauacuugccgggccgaugcccgugacugccgcgucggcggcgcagcgacggggccggguaggccgcaacccccaaaaagaaaaugaccaauacaucuucacaggccaaccccuaaacaacgacgaggaccacgcccacuggacagaagccaaaaugcugcuagacaacaucaacacaccugagggcauaauucccgcacuauuugagccagaacgagagaaaagcgcagcaauagacggagaauacaggcuaaaaggugagucacgaaaaacauuugucgaacucaugcguaggggugaccucccagucuggcucgcccauaagguagccucugaaggaauaaaauacaccgaucggaaguggugcuucgacggccaacguaacaaucaaauacuggaggaaaauauggacguagaaauuuggacgaaagaaggagagaagaagaaacuacgaccccgcuggcuggacgcgcgaacguacagcgacccacucgcccuaaaagaguucaaggauuucgcggcgggccgcaagucuaucgcccuagaccuagucacagagauagggcggguucccagccaccuggcccaucgaacgcgaaacgcacuggauaaucugguaaugcugcacacgucagagcacggagggaaggcauaccgccacgcgguagaggagcuaccggagacgauggagacccuacuccugcucggucuuaugauauuacucaccggcggggccaugcuuuuucuaauaucagggaaaggcauaggaaaaacgaguaucggucuaauuugcgucauagcaagcagcggcaugcuguggauggcugaaaucccacuucaauggaucgcuucugcuaucguauuggaguucuucaugauggugcugcucauuccagagccugaaaagcaaagaacaccccaggacaaccaacuagcauaugugguaauagguauccugacgcucgcugcaauuauagcagccaacgaaaugggacuucuagaaacgaccaaaagagaucuugguauguccaaggagccgggcguaguuagcccaaccagcuaccucgauguggaccuacaccccgcaagugcguggacccucuaugcggucgcaacaacggucauuacaccuaugcuucgccacacaaucgaaaacuccacugccaacgugucacuagccgcaaucgcaaaucaagcgguugucuugaugggauuagacaaaggauggccuauaagcaaaauggaccucggcgucccgcuuuuagcccucggaugcuacucccaaguaaauccccuuacucuaacggcggccgugcuacuauuaauuacccauuacgcaauuauuggcccaggauuacaggcaaaagcaacgcgcgaagcucaaaagaggacggcagcaggcauaaugaaaaacccgacaguggacggaauaaugacaaucgaccuugacccagucaucuacgacagcaaauucgaaaaacaacuaggucaagucaugcuccuaguuuugugcgccguccagcuucugcuaaugaggaccaguugggcucugugcgaagcacucaccuuagcaacaggucccaucacaacucuaugggaaggcucacccggaaaauucuggaacacgacaauagcagugagcauggccaauauauuccguggauccuaucuugccggagccggacuagccuucucaauaaugaaaagcguaggcacggggaagcgcggcacugguucucaaggugaaacauugggugagaaauggaaaaagaaacugaaucaacuaaguagaaaggaguucgaccucuacaagaaaaguggcaucaccgaagucgaccgcaccgaagccaaagaggggcuaaaacgaggcgaaauaacucaccaugcgguuucccgagggagcgccaagcugcaaugguucgucgaaagaaacauggugaucccggaaggccgcgugaucgaccucggaugcgggcggggcggguggucauauuacugugcagggcuaaagaaaguaacagaaguuagaggguauaccaaagggggaccaggccacgaagaacccgugcccaugucaaccuacggcuggaacauagucaaacucaugucgggaaaagacguguucuaccuaccgccggaaaaaugcgacacacucuugugcgacaucggggagucuucacccucccccacagucgaagagucacgcacaauuaggguucugaaaaugguugaaccauggcucaagaacaaccaauucugcaucaaaguucucaacccuuacaugccgacggugaucgaacaucuagagcggcuccaacgaaaacaugggggcaugcucguccgaaacccccugagucgaaacucuacucaugaaauguacuggaucagcaacggcacugguaacaucguagccagcgugaacaugguaagccgccuacucuugaaucgauucacgaugacgcaccgaagaccgacaaucgaaaaagacguugaccucggagcaggcacgaggcacguaaacgccgagccugagacaccgaacauggaugugauaggcgagcgaaucaaacgaauaaaggaagaacacaacagcacauggcauuacgaugaugaaaacccauacaaaacaugggcauaccauggauccuaugaagucaaagcgacaggcucugcuaguagcaugauaaauggcgucguaaaacuacuuacaaagcccugggacgucguaccuaugguaacacagauggcaaugaccgacacgacgccauucggccagcaacgaguauucaaagaaaaagucgacacaagaaccccaaggagcaugcccgguacacggcgcgugaugggaaucacagccgaauggcuuuggcgcacccuaggccgaaacaagaaacccaggcucugcacgcgagaagaguucaccaagaaaguacgcacaaacgcugccaugggcgccguguuuacugaagaaaaccaaugggauagcgcaaaagccgccguagaggacgaggacuucuggaagcuagucgaccgggagcgcgaacugcauaagcucgggaagugcgguucaugcguguacaacaugaugggcaaacgcgagaagaaacugggggaguucggaaaagcaaaaggaucaagagccauaugguauauguggcuaggcgcgcgauaccuggaguucgaagcguuaggcuuccugaacgaggaucacugguucucacgagaaaauucguauucaggaguugagggcgaaggacuccacaaacucggcuacauacuccgggacauaagcaagauuccaggaggggcaauguacgcggacgauaccgcagguugggacacacgcauaaccgaagacgaccugcacaacgaggagaagauaacacaacaaauggacccggagcaccgucaacuugcuaacgcaauauuuaagcucacguaucaaaauaagguaguaaagguacagcgacccaccccgacuggcacagugauggacauuaucagucgaaaggaccaaagggguucaggccaaguagguacauacggguuaaacacauuuacgaauauggaagcacaacuaauucggcagauggaaggugaaggagugcuaucaaaagccgaccucgagaauccacacuuacccgaaaagaaaaucacccaguggcuagaaacaaaagguguugaacgccugaaacgcauggccauaucgggagacgacugcguagucaagcccauagacgaccgcuuugcgaacgcgcugcuagcacucaacgacaugggaaaaguacguaaagacauaccucaguggcaaccaagcaaaggguggcacgacuggcaacaagucccauuuugcucacaccacuuccacgagcucauaaugaaagacggacgcaagcuaguagucccaugucggccucaggacgagcugaucggccgagccagaaucucgcaaggggcggguugguccuugagagagaccgccugccucgggaaagcauacgcgcaaauguggagccugauguacuuccaccgcagagaccucagacuggcgucgaacgccauaugcucagcgguuccgguacauuggguuccgacuagccgaacgacguggagcauacacgcacaccaccaguggaugaccacggaggacaugcuaacaguguggaaucgagucuggauugaagacaaccccuggauggaagacaaaacccccgucacaacaugggaaaacgucccguaucugggaaaaagggaggaccaauggugcgggucccuuauaggacucacgagucgggcgacuugggcccaaaacaucccgacugcgauucaacagguucgaucucugaucggaaacgaagaguuccuggacuacaugcccucgaugaaacgguucagaaaggaggaagaaucagagggagccauaugguaa

SEQ ID NO: 26005 - RNA, 9873 nt, Artificial Sequence
  derived and/or modified CDS sequence (opt11) from DENV-3__FJ478456__SS-prME
accagccucugccucaugaugauccuaccggccgcccuggccuuccacuugaccagcagagacggggagccccgaaugaucguggggaagaacgagaggggcaagagcuuacuguuuaagaccgcgagcgggaucaacaugugcacccucaucgccauggaccuaggcgagaugugcgacgacaccguuacauacaagugcccccacaucgccgagguugagccugaagacauagauugcugguguaaccugaccagcaccugggugaccuacgggaccugcaaccaggccggcgagcacagacgcgauaagaggucgguugcacucgcgccccacgugggcaugggucuugacacgcgcacccagaccuggaugagcgccgagggcgccuggcgccagguggagaaggucgagaccugggcgcugcgccacccgggguucacgauccucgcccucuuccuggcccauuacaucggcaccucccucacucaaaagguggugaucuucauccuucugauguuaguuacccccagcaugaccaugcggugcguggggguggguaacagggacuuugucgaaggccuguccggggccaccugggucgacgugguccuggagcauggcgggugcgugacgaccauggccaagaacaagcccacguuggacauagagcugcagaagaccgaggccacacagcuggccacgcucaggaagcugugcaucgagggcaagaucacgaacauaacaaccgacagccgcugucccacccagggagaggcggugcugccggaggagcaggaccaaaauuacgucugcaagcacacguacguggaucggggguggggcaaugguugcggccucuucgggaaaggcucccuggugaccugugcgaaauuccagugcuuggagcccaucgagggcaagguggugcaguacgagaaccucaaguacaccguaaucaucacuguccauacgggggaccaacaccagguuggcaacgagacucagggugucaccgccgagaucacuccucaggccaguacgaccgaggccauccugcccgaauacggcacccuggggcucgagugcagcccccgcacuggauuggacuucaacgagaugaucuuauugaccaugaagaacaaggcguggauggugcaucggcagugguucuucgaccugccacugcccuggacguccggcgccaccaccgagacccccacguggaacagaaaggagcuccuggugacuuucaaaaacgcucacgcgaagaagcaggaggugguggugcuggggucccaggagggggccaugcacaccgcgcucacuggggccacggagauacagaacagcggcgggaccucgaucuucgccggucaccugaagugccgucugaagauggacaagcucgaguuaaaggguauguccuacgcgaugugcaccaacaccuucguacuuaagaaggagguguccgaaacgcagcacgggaccauccucaucaagguggaguacaagggcgaggacgugccuuguaaaauccccuucagcacggaggacggucaggguaaggcccacaacggccgcuuaaucaccgccaaccccguggucacgaagaaagaggagcccgucaacauagaagccgagccgcccuucggggaaagcaacaucgugaucggcaucggggauaacgcucuaaagauuaacugguacaagaagggaagcucaaucgguaagauguucgaggccaccgccaggggugcuagaagaauggccauccugggggacaccgcaugggacuucggguccgugggugggguccuuaauagccugggcaagaugguccaccagaucuucggguccgccuacaccgcucuguucagcggugugaguugggucaugaagaucggcaucggagugcuccugacguggauuggccugaacagcaagaauaccuccaugucguuuuccuguaucgcaaucgggauuauuacccucuaccucggcgccgugguccaggcggacaccgggugcgugaucaacuggaagggcaaggagcugaagugcggcagcgggaucuucgugacgaaugagguccacaccuggaccgagcaguauaaauuucaagccgacucccccaagcgccucgccaccgccaucgccggugcgugggaaaacggggugugcggcauacgcagcacgacccggauggagaaccugcuguggaagcagaucgccaaugagcucaauuacauucugugggagaacaacaucaagcugacgguggucgugggagacaucaucggcguccucgagcagggcaagcgcacccuaacgccccagccgauggagcugaaguacuccuggaagaccugggggaaggccaagaucgucacagccgagacucagaacagcuccuucaucaucgacggaccuaacacgcccgagugccccagcgcgucccgggcguggaacguaugggagguggaggacuacggguuuggcgucuuuaccaccaacauaugguugaaacugcgugagguuuacacccagcuaugcgaccaucggcugaugagcgccgcagugaaggacgagcgcgcgguccacgcggacaugggcuacuggaucgagagccagaagaauggguccuggaaacuagagaaggccagccucauugaggugaagaccugcacguggccgaagucucacacccuuuggagcaacggcgugcuagaguccgacaugauuauccccaagucucuggccgguccaaucucccagcacaauuaccggccgggcuaucacacccagaccgcgggucccuggcaccuaggcaagcuggagcuggauuucaacuacugcgaggggacaacagucgugaucacagagaauugcgggacccguggcccuucacuccggacuaccacuguguccgggaagcugauacaugaauggugcugccggagcugcacccugcccccgcuuagguacaugggcgaggaugggugcugguacggcauggagauccgccccauauccgagaaggaggagaauauggucaagagccugguuuccgccggcuccgggaagguggacaacuucacgaugggcguccugugccucgcgaucuuauucgaggaggugaugcgggggaaguucggcaagaagcacaugaucgccgggguauuuuucacauucguccuguugcuguccggccagauuacauggcgugauauggcgcauacccugaucaugaucggcucuaacgccuccgaccggauggguaugggcgugacguaccucgcccugaucgcgaccuucaagauccagcccuuccuggccuugggauucuuccugagaaagcuaaccagccgcgaaaaccuccuucugggcgugggccucgccauggccacaacgcugcagcugcccgaggacauagagcagauggcgaacgggaucgcccucggcuugauggcucugaagcucauuacccaguucgagaccuaccaacuguggacagcccugauaagccuaacgugcuccaacaccauauucacuuuaaccgucgccuggcgcacugcgacauugauccucgccggugugagcauucugccggucugccagaguagcagcaugcggaaauccgauuggcugccaaugaccguggccgccaugggcgugccuccccuuccguuauuuaucuucucccuuaaagauacccucaagcgucggucauggccccugaaugaaggcguuauggcggugggucugguguccauauuggcgagcucccugcugcggaacgacguacccauggccgguccucuaguggcuggagggcuguuaaucgcguguuacgugaucacgggcacgagcgccgacuuaaccgucgagaaggcagcggauguuacuugggaggaggaggccgagcagacgggcgugucccacaaccugaugaucaccgucgacgacgacgggacaaugcgcaucaaggacgacgagacagagaacauccugaccguacuccuaaagacggccuuacuuaucguuagcggcauuuucccguacagcauccccgccacacugcuggucuggcacaccuggcagaagcaaacgcgucgcucaggcgugcucugggacgugcccagcccacccgagacgcagaaggcggagcuggaggaaggggucuaccggauuaagcagcaaggcaucuucggaaagacgcaggucggcguggggguccagaaggaggggguguuucauaccauguggcacgugacccgcggagcagucuuaacuuacaacggaaaacggcuugaacccaacugggccucgguaaagaaagaccugaucuccuacggcggaggcuggcgccugagcgcccaguggcagaaaggggaagagguacaggucaucgcgguggaaccugggaagaaccccaagaacuuccaaacuaugcccggaaccuuccagaccacgaccggggagauuggcgccaucgcccucgacuuuaagcccgggaccagcggcucgcccaucaucaacagggaggggaagguggucgggcucuacggcaacgggguggugaccaagaacggaggguaugucagcggcaucgcccagacgaacgcagagccggacggccccacccccgagcuggaggaagaaauguuuaagaagagaaaccugacaaucauggaccuccaccccggauccggcaagacccggaaguaccuaccggccaucgugcgugaagccauuaagcggcguuugcggacgcucauccuggcccccacccgcguggucgccgccgagauggaggaggcgcugaaggggcuccccauccgguaucagaccaccgcaaccaagagcgagcauaccggccgcgagaucguggaccugaugugccaugccaccuucaccaugcggcuccuuucccccgugcgagucccgaacuacaaccugaucauaauggacgaggcccacuucacagaucccgccagcaucgcggcccggggguauaucuccaccagggugggaaugggugaggccgccgcgaucuucaugaccgccacaccacccgggacagccgacgccuucccgcagucgaacgcccccauacaagacgaggagcgagacaucccggagcgguccuggaacagcgguaacgaguggaucaccgacuucgcggggaaaacagugugguucguccccuccaucaaggccgguaacgauauugccaacugccugcgcaagaacgggaagaaggugauccaacucucuaggaagaccuucgacaccgaauaucagaagaccaaacugaacgacugggacuucguggucaccaccgauaucuccgagaugggcgccaacuucaaggccgaccgcguuaucgacccgcggcgcugcuuaaagcccgugauccucacugacggccccgagcgggucauccucgccgggcccaugccggugaccgcagccagcgcagcacaacgccggggccgcguggggagaaauccccagaaggagaacgaccaguauauauucaccggccagccacuuaacaacgacgaggaccaugcgcacuggaccgaggccaagaugcuucuggacaacauuaacacgccugagggcaucauaccggcccuuuuugagcccgagagagagaaauccgccgcgaucgacggcgaguaccgcuugaaaggcgaaagccgcaagacauucgucgaacuaaugcgucgcggggaccugcccguguggcuggcacacaaaguugcgagugagggcaucaaguauaccgaucggaaguggugcuucgacgggcagcgcaacaaccaaauccuggaggaaaauauggacguggaaaucuggaccaaggagggugagaaaaagaagcugcgaccccgguggcuagacgcucggacauauagugacccacuggcauugaaggaguucaaggacuucgcagccgguagaaaguccaucgcccucgaccuggugacggagaucggccgcguccccagccaccucgcacaccgaacccgcaaugcccucgacaaccugguuaugcugcacaccucagagcacggcgggaaggccuaccgacacgcuguggaggaauugccugaaaccauggagacucuguuguugcucggcuugaugauccuccuuaccggaggggccaugcuuuuccucaucuccggcaaagggauaggcaagacgagcaucgggcugaucugcgucaucgccuccuccggcaugcuguggauggccgaaaucccucuccaguggaucgcguccgccaucguacuggaguucuucaugauggugcugcucauccccgagcccgagaagcagcggacgccgcaggacaaccaacuugcauacguugugaucgggauccugacgcucgccgccaucaucgcggccaaugagaugggccugcuggagaccacaaagcgcgaucucggcaugagcaaagagccaggggugguaucacccaccagcuauuuagacguggaccuccaccccgccuccgccuggacgcucuaugcuguggcgaccaccgugaucaccccgaugcugcgccauacgaucgagaacagcacugcaaacgugucccucgcggccaucgcgaaccaggcugugguacucaugggccucgacaagggguggccgauuagcaagauggaccugggggucccccuccuggcauuaggaugcuacagccaggugaauccuuuaacccugacagcagcgguccugcuccugaucacgcacuacgcgaucaucggacccggccugcaggccaaggcgacccgggaggcccagaagcgcaccgcugccgguauaaugaagaacccgaccguggacggcauaaugacuaucgaccucgaccccgugauuuacgacagcaaauuugaaaagcagcuggggcaggucaugcugcucguccugugcgccguccagcugcuccugaugaggaccuccugggcccugugcgaggcauugacccuggcgaccggccccaucacgacucugugggagggaagccccgggaaguucuggaacacuacaaucgcggucagcauggccaacaucuuccguggcagcuaccucgccggggccggucuggcuuuuuccaucaugaaguccguggggacggggaagcggggcaccgggagccaaggagagacccugggagagaaguggaagaagaagcucaaucaacugucccgcaaggaguuugaccuguacaagaagagugggaucaccgagguggaccggaccgaggcuaaggaggggcuuaagcggggagaaaucacgcaucacgccgucucccggggcucggccaagcugcagugguucguggagcgcaacaugguuaucccggaggggcgagucauagacuugggaugcggccgcggcggaugguccuacuacugcgccggccucaagaaggucaccgaggugcggggcuauacaaagggcgggcccgggcacgaggagcccguccccaugucaaccuacggcuggaacaucguaaaacugauguccgggaaggacguguucuaccugccgccagagaaaugcgauacacuccugugcgacauaggcgagagcucccccucacccacugucgaggagucccgcaccaucagagugcugaagaugguggagccguggcugaagaacaaccaguucuguaucaaaguccucaaccccuacaugccgaccgucaucgagcaccuagagcgguuacagagaaagcaugguggcaugcucgugagaaacccccugagucgcaacuccacgcacgagauguacuggaucucaaacggcaccgguaacaucgucgcgagcgugaacaugguaagccggcugcuccugaaccgcuuuaccaugacccaccggcggccgacgaucgagaaggacguugaccucggagccggcacccggcaugugaacgccgagcccgagacccccaacauggacguuaucggugagcgaaucaagcggaucaaggaggagcacaauagcacauggcacuacgacgacgagaacccguacaagacaugggcguaccacggcagcuacgagguaaaggcuaccggguccgcgagcagcaugauaaacggcguggugaagcuccugacaaagccgugggaugucgugcccauggugacccaaauggccaugacggacacgacgccauuugggcagcagcgagucuucaaggaaaagguggacacccggacgccgcguucuaugcccggcacacggcgcgugaugggcaucaccgccgaauggcuguggcggacccucgggcgcaacaagaagccccgccuguguacgcgcgaggaguucaccaagaaggugcgcaccaacgccgccaugggcgccguguuuacggaggaaaaccagugggauucagcuaaggccgcgguugaggacgaggacuucuggaagcugguggaccgggaaagggaacugcacaagcugggcaagugcggcaguugcguguacaacaugauggggaagcgggagaagaaacugggugaguucgggaaggcgaaagggagcagagccaucugguacauguggcucggcgcccgguacuuggaauuugaggcccuuggguuccuaaaugaagaccacugguucuccagagagaacagcuacucaggcgucgaaggggagggccugcacaaacugggcuacauccuccgggacaucagcaagauuccuggcggcgccauguacgcggacgacacggccgggugggauacccgcaucacagaagaugaccugcacaacgaggagaagaucacccagcagauggaucccgagcaccgucaguuggccaaugccaucuucaagcucacguaccagaauaaggugguuaaagugcagcguccgacgccgaccggcaccgugauggacaucaucucccggaaggaucagcguggcagcggccaagugggcacauacggccuuaauacauucaccaacauggaggcccagcucauccggcagauggaaggcgagggggugcuguccaaggcagaucuugagaauccccaccugucugagaagaagaucacgcaguggcucgagaccaagggagucgagcggcucaagcggauggcuaucuccggagacgacugcguggugaaaccgaucgacgaccgauuugccaacgcccugcucgcccugaacgacauggggaagguccguaaagacauuccccaguggcagcccagcaagggcuggcacgacuggcaacagguccccuucugcucccaccauuuucacgagcugaucaugaaggacgggcgcaagcucgucguaccgugucggccccaggacgaguuaaucggccgcgcgcggaucucucagggggccggcuggucccugcgcgagacggccugccugggcaaagccuacgcacagauguggagccugauguacuuccaccgccgggacuugcgcuuggccuccaacgccauaugcagcgcagugccuguucacugggugcccaccucacggacgaccugguccauccaugcccaccaccaguggaugacgacggaggacaugcuuaccguauggaaucgcgucuggaucgaggacaacccguggauggaagacaagacccccgugacuaccugggaaaacgugccauacuuggguaagcgggaggaucagugguguggcucacucauugggcuuaccucccgcgcgaccugggcccagaauaucccgacggccauccaacagguccgaagccugauuggaaacgaggaguuccucgacuacaugccgucgaugaagcgcuuccggaaggaggaggagagcgagggcgccauuugguga

SEQ ID NO: 26006 - RNA, 9873 nt, Artificial Sequence
  derived and/or modified CDS sequence (opt11) from DENV-3__FJ547085__SS-prME
accucccucugccucaugaugauucugccagccgcacuggcguuccaccucaccagccgcgacggcgagccgcggaugaucguggggaagaacgagcggggcaaaucgcugcuguucaaaaccgccucggggaucaacaugugcacccuaaucgccauggaucugggagagaugugcgacgacacugugaccuacaaauguccccacaucaccgagguggagcccgaagacaucgacugcuggugcaacuugaccagcaccuggguaacuuacgggacaugcaaccaggccggcgagcaccggcgcgacaaacguuccguagcucucgcgccccacgugggcauggggcuggacaccagaacgcagaccuggaugagcgccgagggcgccuggcgccaaguagagaagguagagacgugggcgcugcgccacccgggguucaccauucucgcgcuauuucuggcccacuacaucggcaccucccucacccagaaggucgugauuuuuauccuccugauguuggucacgcccagcaugaccaugcggugcgucggcgugggcaaccgugacuucgucgagggccugagcggggccacauggguugacguuguccuggagcacggcgggugcgugaccacgauggcaaagaacaagcccacuuuagacauugagcuucagaagaccgaagccacccagcuggcgacacuccggaagcuaugcaucgagggcaagaucacuaauaucaccaccgauagccgcugcccuacgcagggcgaggccgugcuacccgaagagcaggaccagaauuacgucugcaagcauaccuacguggaccggggguggggcaaugggugcgggcucuuuggaaagggcucacuaguuaccugcgcaaaguuucagugcuuggagcccaucgaaggaaaagucgugcaguaugagaaccucaaguauacugugauaaucaccguccacaccggugaccagcaucaggugggcaacgagacucagggggucaccgccgaaaucacgccccaggccucuaccacggaggcuauccuccccgaauacggcacucuagggcuagaaugcuccccgcgcaccggucuggacuucaacgagaugaucuuacucaccaugaagaauaaggcauggaugguccaucggcagugguucuucgacuugccuuuacccuggacuagcggcgccaccaccgagacacccaccuggaaccgcaaggaacuguuagugaccuucaagaaugcccacgccaaaaagcaagaggucgugguacuugggagucaagagggcgccaugcauaccgcucucacgggggccaccgagauccagaacucgggcggaaccaguaucuuugcgggccaccugaagugccggcugaagauggacaagcuagaguugaaaggcaugagcuaugccaugugcaccaacacuuucguccuuaaaaaggaggucuccgagacccaacacgggaccauccucaucaagguggaguacaaaggagaggacgucccaugcaagauccccuucagcaccgaggacgggcagggcaaagcgcacaacggccgguuaaucacggccaaccccgugguaaccaagaaagaggagcccguaaacauagaagccgagccgcccuucggggagagcaacauagugaucggaaucggggacaacgcacugaagaucaacugguacaagaagggcuccagcaucggcaagauguucgaggccacagcucggggcgcccgccggauggcaauucugggugacaccgccugggacuucgggagcgugggcgguguacucaacucgcuaggcaaaauggugcaccagauauucggaagugcauacacggcucucuucagcggcgucaguugggugaugaagaucggcaucggggugcuccugaccuggauaggucucaacucuaagaacaccuccaugagcuucuccugcaucgccaucggcauuauuacgcucuaccugggagccgugguccaggcagacacggggugcgugaucaacuggaaggggaaagagcugaaaugcggcagcgggaucuucgugaccaacgagguacacaccuggaccgagcaauacaaauuccaggcggacagccccaagcgccuagccacagcaaucgcaggugccugggagaaugggguuuguggcauccgcagcaccacacggauggagaaccuguuauggaagcagaucgcgaacgagcucaacuacauucuaugggagaacaacaucaagcugacaguggucgugggggauaucaucgggguccuggagcagggcaagcggacgcuaacaccucagccgauggagcugaaauacucguggaagacuuggggaaaggcccguaucguuacagccgagacgcagaacucguccuuuaucaucgacggacccaacacacccgaaugccccaacacgaguagagccuggaaugugugggagguggaggacuaugguuucggggucuucaccaccaacauauggcucaagcugagagagguauauacucagcuaugcgaccaccgccuuaugagcgccgccgugaaagacgagcgggccguccacgcggacaugggcuacuggaucgagagccagaagaauggaagcuggaagcuggaaaaggcuuccuugaucgagguuaaaaccugcaccuggcccaagagccauacccucuggaguaacggcgugcuggagagugacaugaucauccccaagucucuggcggggccaaucucacagcacaacuaccgaccgggauaucauacgcagacggcggggcccuggcacuuggggaagcucgaacuggauuucaauuacugcgagggcaccaccguaguuaucacugaaaacugcgggacacggggucccucgcuccgcacuaccacggucagcgggaaacugauucacgaauggugcugccgguccuguacucugcccccgcuccgcuacaugggcgaggacgggugcugguacggcauggagauccggcccauuucugagaaagaggagaacauggucaagucccuggugagcgccggcuccggggagguagacaacuuuaccaugggcguccugugccuggccauccuguucgaggaagucaugcgcggaaaguucgguaaaaagcacaugaucgccggcguguuuuuuaccuucgucuuauuacugagcggccagauaacguggcgggauauggcgcacacuuuaaucaugaucggcagcaacgccacagaucgcaugggcaugggcgugaccuaccucgccuugaucgccaccuuuaagauccagccguuccuugcccucggguuuuuccugcggaagcugaccucucgcgagaaucuccugcuggggguaggcuuagcuauggccaccacacuccagcugcccgaggacaucgaacagauggccaacgggauugcccucggccugauggcccugaagcucaucacgcaguuugagaccuaccaacuguggaccgcccuaaucucccugaccugcucgaacacgaucuucacgcuuacaguagcauggcggaccgccacgcugaucuuagccggagugagccugcucccagucugucagaguagcuccaugcgcaaaacagacuggcuucccaugacuguggcagccaugggcgugcccccccucccgcuguucaucuucagcuugaaggacacccugaagcgccgguccuggccccuuaacgagggugucauggcggugggccuaguuaguauacuggccuccagccuccugcgcaacgacguccccauggccgguccccugguggccggugggcuguuaaucgccugcuacgugaucacugggaccuccgcugaccugaccgucgagaaagccgccgaugugacuugggaggaggaggcggagcagaccggggugagccauaaccugaugaucacggucgacgacgacgggaccaugcggaucaaagacgacgagacggagaauauccucaccgugcugcugaagacggccuuguugaucgugucaggcauuuucccguauagcauccccgcuacucuucucgucuggcacaccuggcagaagcaaacccagcgguccgggguguuaugggacgugcccucaccgcccgagacgcaaaaagcggagcuggaggaagggguauaccgcaucaagcagcaggguaucuucgggaagacccaggugggcgucgggguucagaaggagggcguguuucacacaauguggcaugugaccagaggugccguccucacguacaacggcaaacggcuggagccaaacugggcgucugugaaaaaagaucugaucagcuacggcggaggcuggcggcucuccgcccaguggcagaagggagaggaggugcaggucaucgccguggaacccggcaagaaucccaagaacuuccaaacuaugcccggcacauuccagacuacgacaggggagaucggggcaaucgcguuagacuucaagccugggaccagcggcucgcccaucauaaaccgggaaggcaaggucgucggguuguauggcaacgggguggugaccaaaaacggcgguuacgugagcggcaucgcucagacuaaugccgaaccggacgguccuacaccggagcuagaggaggagauguucaagaagcgcaaccucaccaucauggacuugcaccccggguccggcaagacccguaaguaccuuccagcuaucgugcgcgaggccauuaagcgacgccuccggacguugauucucgcgccuacccgugucguagcggccgagauggaggaagcccucaagggacugccaauccguuaccaaaccaccgcuacaaaguccgagcacacaggccgcgagauuguggaucugaugugccaugcgaccuucaccaugcggcuccuuagcccgguacgcgucccgaacuauaaccuaaucaucauggaugaagcacacuuuacggacccagccuccauagccgcccggggguacaucagcacccgcgugggcaugggcgaggcggccgccauuuucaugacugccacaccgcccgggacugcugaugcauuuccgcaguccaacgcccccauucaggacgaagagcgcgauaucccagagcgcagcuggaacuccggcaaugaauggaucaccgauuuugccgggaagaccgugugguuuguuccauccaucaaggccggaaacgacaucgcaaacugccuccgcaagaacggaaagaaggucauacagcugucccggaagaccuuugacaccgaguaccagaaaacuaagcugaaugacugggacuucguggucaccaccgacaucagcgagaugggcgccaacuucaaggccgaccgcguuauagacccacggcgcugucuaaagcccgugauccugaccgacggccccgaacgggucaucuuagccgggcccaugccggugacggcagcuuccgccgcccaacguaggggccgcguggggcggaacccccagaaagagaacgaccaguacaucuucacaggccagccccucaacaaugacgaggaccaugcacacuggaccgaggccaagauguuacucgacaacauaaacacccccgaagguaucauuccagcauuauucgagccggagcgcgagaaguccgccgccauugacggagaguaccggcugaagggcgaaucccgcaagacguucgucgagcugaugcggagaggugaucuacccguuuggcuggcucacaaggucgcgagcgagggcauuaaauauaccgaucggaaguggugcuucgacgggcaacgcaauaaucagauccuggaggagaauauggacguagagaucuggaccaaggaaggcgagaagaaaaaguuacgcccacgcuggcuggacgcccgcaccuacagugacccguuagcccucaaggaguucaaggacuuugcggccggacgcaagaguaucgcacuggaccugguaacggaaaucgggcgcguccccacccacuuggcccaccgaacccgaaaugcccuugauaaccuagugauguugcauacuuccgagcacggagguaaggccuaccgacacgccguggaggaguugcccgagacgauggaaacccuccuucuacugggccucaugauccugcugacagggggcgcuauguuauuucugauuucaggcaaaggcaucgguaaaacguccaucggcuuaaucugcgucauagccagcagcggcaugcucuggauggccgaaaucccgcugcaauggaucgcguccgcaaucguuuuggaauucuucaugauggugcuucucauccccgagcccgagaagcaacgcacgccccaggauaaccaguuagcguacgucgugauagggauccucacacuggccgcaaucaucgccgccaaugagaugggccugcuagagacaaccaagcgggaccugggcaugaguaaggagccggggguggucagccccacgucguaccuggacguggaccuacaccccgccucugcguggacccuguacgcuguagcgaccaccgucaucacgcccauguuacgacacaccaucgaaaauuccacagcuaaugugucccucgccgccaucgccaaucaggccguugucuuaaugggacuugacaagggauggccgaucagcaaaauggacuuaggcgugccccucuuagcgcucgggugcuauucccaggugaacccccugacccugacagcugccguccugcugcugauaacccauuacgccauuauugggccuggccuucaggccaaagcgacccgcgaagcccaaaaacgcaccgcugccgggauaaugaagaauccgacgguagacggcaucaugaccaucgaccuggaccccgugaucuacgacuccaaguucgagaagcagcuagggcaggucaugcuccuggugcugugcgccgugcagcuccugcugaugcggaccuccugggcgcucugugaagcccugacacuggcuacaggccccaucaccaccuuaugggagggcucucccgguaaguucuggaauacaaccaucgccguaucaauggcuaauauuuuccgcgguagcuacuuggccggggccggccuggccuucucuaucaugaaguccgugggaacgggcaagcggggcaccgggucccaaggcgaaacccuuggcgagaaauggaaaaaaaaacugaaccaacugagccgcaaggaguucgaccucuacaaaaaguccggcaucaccgagguggaccggacugaggccaaggagggacugaagcgcggcgagauaacccaccacgcggucagccguggcaccgccaaguugcagugguucguggagcgcaacauggugaucccggaagggcgggucauagaucucggcugcgggaggggcggguggagcuacuacugcgcuggacugaaaaaggugacagaggugcggggcuacacgaagggcggaccagggcacgaagagcccguccccauguccaccuauggcuggaacaucgugaaguugaugagcggaaaggacguguucuaccugccgcccgagaaaugcgauacccuguuaugcgacaucggcgaguccagcccaucccccaccguugaagagagccgcaccauccgcguauugaaaaugguugagccguggcucaagaacaaccaguucuguaucaagguccugaaccccuacaugcccgcugugauagagcaccuggagcgguugcagcggaagcacggaggaaugcuggugcggaacccccugucccgcaauagcacccacgagauguacuggauuuccaacggcacagggaacaucgucgcgagcguuaacauggugagccggcucuuguuaaaccgcuuuaccaugacucaucggcggccgacuaucgaaaaagacgucgaccucggggcgggcacccggcacguaaacgccgagcccgaaacacccaacauggacgugauuggggaacguaucaaacggauaaaggaggagcacaacucuacguggcacuaugacgacgaaaacccguacaagaccugggcuuaccacggaucguacgaagucaaggccacugguagcgcuuccagcaugaucaacggagugguuaaguuacugacaaagccuugggacgugguaccaauggucacgcaaauggcgaugacggacaccacaccguucgggcagcaacgcguauucaaggagaagguggacacucggaccccucgcuccaugcccggcacacggcgcgucauggaaauuacagccgaguggcucuggcgcacgcugggccgcaauaagaagccgcgucuguguacccgcgaagaguucaccaagaaggugcgcaccaacgccgccaugggugcagucuucacggaagagaaccagugggacagcgccaaggccgcugucgaggacgaggacuuuuggaagcucguggaccgagagcgggagcuucauaagcugggcaaaugcggguccugcguauacaacaugaugggcaagagggagaagaagcucggggaauucggcaaagccaagggcagccgggcgauuugguacauguggcucggggcgcgguaccuggaauucgaggccuuaggauuccucaaugaggaccacugguucucccgcgagaacuccuauagcggggucgagggcgaagggcuucacaagcucggcuacauccugcgggacaucucgaagauucccgguggggccauguacgcagacgauaccgccgggugggacacccgcaucaccgaggacgacuuacauaacgaagagaagauuacccagcagauggacccggagcaccgucagcucgcuaacgcgaucuucaagcugacguaccagaacaaagugguuaaaguccagcggccgacgcccaccggcacaguuauggacaucauuagccggaaggaucagcgcggcucgggccagguagggacguauggcuuaaacacguucaccaauauggaggcucagcucauacggcagauggaaggggagggcguccugagcaaagccgaccuugagaauccucacuugccggaaaagaagaucacccaguggcuggagacgaaaggcguggaacgccuuaagcggauggcgaucuccggggacgacugcguggucaagcccaucgacgaucgcuucgccaacgcgcuccuggcccugaacgacaugggcaagguucggaaggacaucccccaauggcagcccagcaaaggguggcacgacuggcagcaggucccguucugcucgcaccacuuucacgagcucaucaugaaggacggccggaagcuugucguacccugucggccccaggacgagcugaucgggcgcgccaggaucagccagggcgcgggguggucccuccgcgagaccgccugccugggcaaggcuuaugcgcagauguggagucugauguacuuccaucgccgggaccugcgccuugcuuccaacgccaucugcagcgccguucccgugcauugggugccaaccucgcguaccacguggucuauccacgcgcaucaccaauggaugaccacggaggacauguuaaccguguggaaccgaguuuggaucgaggauaacccuuggauggaggacaagacgccggugaccaccugggaaaacgugcccuaccucgguaagcgggaggaucaguggugcgggucucuuaucggccugacgagccgggcuacgugggcgcagaacauaccgaccgccauccagcagguccggucccucaucgggaacgaagaguuccuggacuacaugcccagcaugaagcgcuuccgcaaagaggaggagagugagggagccaucugguga

SEQ ID NO: 26007 - RNA, 9873 nt, Artificial Sequence
  derived and/or modified CDS sequence (opt11) from DENV-3__EU482595__SS-prME
acgagcuuaugucugaugaugaugcugcccgcugcuuuggcguuucacuuaaccagccgggauggggagccgcggaugaucgucgggaagaaugagcgggggaagagccugcuguucaagacggccagcgggaucaauauguguacccucaucgccauggaccugggcgagaugugcgacgacaccgugacuuauaaguguccccacaucacugagguggagcccgaagacauugacugcuggugcaaccugaccucuaccuggguuaccuacgggacgugcaaucaggccggugagcaccggcgagacaagcgguccguggcgcucgcaccccaugugggcaugggccuugacacccgcacacagaccuggaugagcgccgagggagcguggaggcaaguagagaaggucgagacgugggccuugcgccauccgggguuuaccauacuggcguuguuccuggcccacuauguaggcacuucccugacccaaaagguggucaucuucauauuacugaugcucguuacgcccagcaugacgaugcggugcguggggguugguaauagggacuucguugagggccuuuccggggccaccuggguagacguuguguuggagcauggcgggugcgugaccacgauggccaagaauaagcccaccuuggacaucgagcugcaaaagaccgaggccacccaguuagcaacgcuccggaagcuaugcaucgagggcaaaaucaccaacaucaccaccgacagccgcuguccgacgcagggggaggccguccugccggaagagcaggaucagaauuacguguguaagcacaccuacguugaccgaggguggggaaauggguguggccucuucgggaaaggcucccuggugaccugugcaaaguuccagugccuggagcccaucgagggcaaaguggugcaguacgagaaccuuaaauacaccgucaucaucaccgugcacaccggagaccagcaccagguuggaaacgaaacacagggggugacugccgagaucacaccacaagccucuaccaccgaggcgauccuuccagaguacgguacccuggggcucgaaugcuccccgcguacaggacucgacuucaacgagaugauacugcugacgaugaaaaacaaagccuggaugguccaccgccaaugguucuuugacuuaccacuacccuggaccagcggugccaccaccgagacucccaccuggaaccgcaaggagcuccuggucacauucaagaacgcccaugccaaaaagcaggaaguugugguccucgggucucaagaaggcgcaaugcauaccgcccucacaggggccaccgagauccagaauagcggcgggaccuccaucuuugccggucaccugaaaugccggcugaagauggacaaguuggagcugaagggcaugucauaugccaugugcacuaacacguucguguugaagaaggaggucuccgagacccagcacgggaccaucuugauaaaggucgaguacaagggcgaggacgugccaugcaaggugcccuucucuaccgaagacgggcaaggcaaggcucacaacgggagacugaucacggcuaaccccgucguuaccaaaaaggaggagccaguaaacaucgaggccgagccucccuucggggagucuaacaucgucauagguaucggggacaacgcccugaagaucaacugguacaagaaagguucaagcaucgggaagauguucgaggcgaccgcccggggagcacgccggauggccauacucggggacaccgccugggacuucgggagcgugggcggggugcucaacagccugggcaagaugguccaccagaucuuuggguccgcguacacggcccuguucuccgggguguccugggugaugaagaucggcaucgggguccuacugaccuggaucgggcugaacucgaagaacaccucuaugagcuuuucaugcaucgugaucgggaucaucacccucuaccucggcgccguuguccaagcagauauggggugcgugaucaacuggaagggaaaggaacugaagugcggcucagggaucuuugugaccaacgagguccacaccuggacggagcaguacaaauuucaggcggauuccccaaagcgacucgcaaccgccauagccggggccugggaaaacggggugugcggaaucaggaguacgaccaggauggagaaccugcuguggaagcaaaucgcuaacgaguugaacuacauccugugggaaaacaacaucaaacugacuguagucgugggggauaucaucggcguguuagaacagggcaagcgcauccugacuccccagccuauggagcugaaguauaguuggaagacguggggcaaggcgaagauagucaccgccgagacccagaauuccucuuucaucaucgacggcccuaacacccccgagugcccaagcgccuccagggccuggaacguaugggaaguagaggauuacggguucggcgucuucuccacuaacaucuggcucaaacugcgggagguauacacucagcugugcgaccaccggcucaugagugcggcugugaaggacgaacgcgccguccacgccgacaugggcuauuggaucgagucccagaagaacgguagcuggaagcuggagaaggcgucccugaucgaggugaagacgugcacguggccaaaaucccacacccuuuggucaaacggcguacuggaaagugacaugaucauccccaagucccuggcugggccgaucucacagcacaacuaucggccgggcuaccacacccagacggccgggcccuggcaccuaggcaagcuugagcuggacuucaacuacugcgaagguaccaccgugguaaucacggagaacugcgggacccgagggccuuccuugcggaccacgacggugagugggaagcugauccacgaguggugcugccgguccugcacucugccuccgcuccgguacaugggcgaggaugggugcugguacggcauggagauccgcccaaucagcgaaaaagaagagaacauggucaagucccuagugucggcgggcagcgggaagguggacaauuuuacaaugggcgucuugugccucgccauccuguuugaagaggugaugcgggguaaguucggcaagaagcauaugaucgccggggucuucuuuacauuuguccuguuauugagcggccaaaucacguggcgcgacauggcacacacccugauaaugauaggcucgaaugccagcgaucggauggguaugggagucaccuacuuggcccuaaucgcgaccuucaagauccagcccuuccuggccuuaggguucuuccugcgcaagcucacgagccgcgagaaucuccugcuggggguuggacucgcgauggccaccaccuugcagcugccugaggauaucgagcagauggcuaacggcauagcccucgggcugauggcgcugaagcucauaacgcaguucgagacguaccaacuauggaccgcccugaucagucucacaugcagcaacaccauuuucacucugaccguggccuggcguaccgcaacccuuauccucgcuggggugucccugcuuccggucugccagagcaguaguaugcggaagacagacugguugccuaugaccguggcggcaaugggcgugccgccgcucccccuguuuaucuucucccucaaggacacccugaagcgccgcucuuggccccugaacgaggggguaauggccgugggccucgugucaauccuggccagcagccuuuugagaaaugauguccccauggccgguccacugguggccggcgggcugcucaucgccugcuacgugaucaccgggaccucagcggacuugaccguagagaaggcggccgacgugaccugggaggaggaggcggagcaaaccggcguaucucacaaccugaugaucacggucgacgacgacgggaccaugcgcaucaaagacgacgagaccgaaaacauccucaccgugcugcugaagaccgcccuccugaucgugagcggcauuuucccguacuccauccccgccacgcugcucgucuggcauaccuggcaaaaacagacgcagcggagcggcgugcugugggaugugccaagcccgcccgagacucagaaagccgagcuggaggagggaguguaccgcaucaagcagcagggcaucuuugggaagacgcaagugggagugggcguucagaaggaaggcgucuuccauaccauguggcacgugacccgcggcgcaguccucacguacaacgggaaacgacucgagcccaauugggcgaguguuaagaaagaccugaucuccuacggcgggggguggcgacugagcgcccaguggcaaaaaggggaggaggugcaagucaucgccguagaaccaggcaagaacccgaaaaauuuccagacaaugcccggcaccuuucagaccacuacgggcgagaucggagccauugcacuggacuucaaacccgggaccagcgggagucccauuaucaaccgcgagggcaagguggucgggcuguacggcaacggggugguuaccaagaauggcgguuacgucagcgguauagcccagaccaaugcugagccggacggcccugcccccgagcuggaggaggagauguuuaagaagagaaacuuaacuaucauggaucugcacccugggucuggcaaaacccgcaaguacuuaccggcuauugugcgagaggcgaucaaacgccgucucagaacccugauacuggcacccacccgggucgucgcugcagagauggaggaagcgcucaaaggccugcccauacgcuaccaaaccaccgccaccaagagcgaacacacgggccgggagaucguggaccugaugugucaugccacguucaccaugcgccucuuaucccccgugcgggucccgaacuacaaucugauaaucauggaugaggcccauuucaccgaccccgccuccaucgccgcucgcggguacauuagcacccggguggggaugggugaggcagcugccaucuucaugacggcgacgccgccagggacggcggacgccuuuccgcagagcaacgcucccauucaggacgaggaaagggacaucccggagagguccuggaacagcggcaacgaauggaucaccgacuucgccggcaagaccgucugguucgucccauccaucaaggcggguaacgauauugccaacugucuccggaagaacgggaagaaaguuauucagcuuagccgcaagacguuugacaccgaauaccagaagaccaagcugaacgauugggacuucguggucaccaccgacaucuccgaaaugggggccaauuucaaagccgacagagugauugacccucgccggugcuugaagcccguuaucuuaaccgauggccccgagcgcgucauacuggcgggcccuaugccggugaccgccgccagcgcagcucagcggcguggucgagucgggcgcaauccccagaaggagaacgaucaguauauuuuuacaggccaaccgcucaauaacgaugaagaccacgcccauuggaccgaggcgaagaugcugcuggacaacaucaauacccccgagggcauuaucccggcccucuucgagccugaaagggagaagagcgccgcaauagauggggaguaccgccugaagggcgagagccgcaagaccuucguggagcugaugcgcaggggggaccuacccguguggcuggcgcacaagguagcguccgagggcaucaaguacaccgaucgcaaguggugcuucgacgggcagcggaacaaccagauccuggaggagaacauggacguggagaucuggaccaaggagggcgaaaagaagaagcuucgcccccgguggcuggaugcccgcaccuauagcgacccgcuggcucucaaggaguuuaaagacuucgccgcuggacgcaaguccaucgccuuagaucuggugacugagaucgggcggguuccaucccaccuagcccaccgcacccguaaugcccuggacaaccuggugaugcuccauacaagcgagcauggcggaaaggccuaucgucacgcgguggaagaacugcccgagaccauggagacccuguuacugcugggccugaugauacuucugaccgggggagccaugcuguuccuaauuaguggcaagggaaucggcaagacgucgaucgggcugauaugcgucaucgcuagcagcggaaugcuauggauggccgagauaccgcugcaauggaucgccuccgcgaucguguuggaguucuucaugauggugcuccugauccccgagcccgaaaagcagcggacaccccaggauaaucagcucgccuacgucgugaucgguauccucacccuggccgcgaucauugcugcgaacgagaugggccugcucgagaccacgaagcgagacuugggcaugagcaaagagccgggaguuguaucucccaccucuuaccuggacguggacuugcaccccgccuccgccuggacucuuuaugccguggcgacgacggucauuacgccuaugcugcggcauaccauagaaaauagcacagccaacgugucgcucgcugccauagcgaaccaggcaguaguuuugaugggacuggacaagggcuggccaaucagcaagauggaccucggcgugccucugcuagcacuggggugcuacucccagguaaauccccugacccugaccgccgccguccucuugcugauuacccacuacgccaucaucggccccggccuucaggcuaaggcuacgcgcgaggcccagaagcgaacggccgcagggaucaugaagaacccgaccguggacggaaucaugaccaucgaccuggacccuguaauauacgacagcaaguucgagaagcaacuggggcaggucauguugcugguucugugcgcgguucaacuccugcuaaugcggaccaguugggcgcucugcgaggcucugacguuagccaccggcccaauuaccacgcucugggagggcagccccgggaaguucuggaacacuacaaucgccgucuccauggcgaacaucuuucggggcucauaccuggcgggggccggccuggcguucucaaucaugaagagcguggggaccggcaaacgcgggacugggagccagggagagacccugggggagaaguggaaaaagaaacugaaccagcugucccguaaggaguucgaccucuacaagaaauccggcauuaccgaaguggaccggaccgaggcuaaagagggguuaaaacggggcgagaucacccaucaugccgucucccgcgguagcgccaagcugcaaugguucguagagcggaacaugguuaucccggaggggcgcgugauugaccuuggcugugggcgggggggguggucuuauuacugcgcaggccuaaagaaggugaccgaggugcgcggcuacacgaaaggcggaccagggcaugaggagcccgucccgauguccacauacggguggaauaucgugaagcugauguccgggaaagauguuuuuuaccuaccgcccgaaaagugcgacacccuccugugcgacaucggcgaaagcucccccucgcccaccgucgaggaguccaggacgauacgcgugcuuaagauggucgaaccguggcugaagaacaaucaguucugcaucaaaguccucaauccuuacaugcccaccguuaucgagcaccuggagaggcuccagcgcaagcacggcggaaugcuggugcgcaacccccugucccggaacuccacccaugagauguauuggauaagcaacggaacuggcaauaucguagccuccgugaacauggugucacggcuccuguuaaaccguuucacgaugacccacaggcgaccgaccaucgagaaggaugucgaccucggcgcgggcacccgacacguaaacgccgagcccgagacgcccaacauggacgucaucggggagcggaucaaacgcaucaaggaggagcacaauuccaccuggcacuacgacgacgagaacccuuacaaaaccugggcuuaccaugggagcuacgaggugaaggcaacuggguccgcauccagcaugaucaauggugucgucaagcuauugacgaagcccugggacguggugcccauggucacccagauggccaugaccgacacuacgcccuucggacagcagcggguguucaaggagaagguugacacccgcaccccgcggagcaugccaggcacccgcagagucaugggcaucacggccgaguggcucuggcgcacccuugggagaaacaagaagccccgccugugcaccagagaggaguucacuaagaaggugcgcacgaaugccgccaugggcgcugucuucaccgaggaaaaccagugggacucagccaaggccgccgucgaggacgaggauuucuggaucuuaguggaccgcgagcgggagcugcacaaauugggaaaguguggcuccugcgucuacaauaugaugggaaagcgcgaaaagaaacucggugaguucggaaaggcuaaggggucccgggcgaucugguacauguggcugggugcccgguaccuggaauucgaagcuuugggcuuccugaacgaggaccacugguucucccgggagaacaguuacuccggggucgagggugagggccugcacaagcuaggcuacauuuugcgcgacaucuccaagauccccgggggugccauguacgcggaugacacugcagggugggacacucggaucacggaggaugaccugcacaacgaggagaagaucacccaacagauggaccccgaacaccggcagcucgcuaacgccaucuucaaguugaccuaccagaacaagguggugaagguacagcggcccacccccacgggcaccgugauggacauaaucagccgcaaggaucagcggggcagcggccagguaggcaccuacgggcuuaacaccuucaccaacauggaggcccagcucauucgccagauggagggagaggggguacuguccaaggccgaccuagaaaacccccaccucccagagaagaagaucacgcaguggcuggagaccaaggggguugagcguuuaaaacggauggcgaucagcggcgacgacugcguggugaagcccaucgacgacagauucgccaacgcccuccuggcucugaacgauauggggaagguccgcaaggacaucccccaguggcagcccucuaagggcuggcacgacuggcagcaggucccguuuuguagccaccacuuucaugagcucaucaugaaagacggccggaagcugguaguccccugccgcccacaggacgagcugauuggccgggcccguaucucccagggggcaggcuggagccuccgggaaaccgccugccugggcaaagccuaugcccagauguggucccugauguacuuccaccgcagagaucuccggcuggcgucgaacgccaucuguagcgccgugcccguacacugggugccuaccagccgcacgacguggagcauucacgcccaucaccaguggaugaccacugaggacaugcuuacgguauggaaccgggucuggaucgaggacaacccuuggauggaagacaagaccccuguuaccacuugggaaaaugugccuuaccucgggaagcgcgaggaccaguggugcggcucccugaucgggcugacgagccgggcuaccugggcacagaacaucccaacagcaauacagcagguccgcagccucaucggcaaugaggaguucuuagacuacaugcccagcaugaagagguuccgcaaggaggaggaguccgagggggcaauuugguga

SEQ ID NO: 26008 - RNA, 9873 nt, Artificial Sequence
  derived and/or modified CDS sequence (opt11) from DENV-3__EU482596__SS-prME
accagcuuaugccucaugaugauucugcccgccgccuuggccuuccacuugaccucacgggauggagagccccggaugauagugggcaagaacgagcgggggaaaagccugcuguuuaaaacggccuccgggaucaacaugugcacccucaucgccauggauuuaggcgagaugugcgacgacacaguaaccuacaaaugcccccauaucacugaggucgagcccgaagacaucgauugcuggugcaaccuuaccagcaccugggugacuuacgggacuuguaaccaagccggagagcacagacgcgauaagcgauccgucgcccucgcuccucacguugguauggggcucgacacucguacccagaccuggaugucggccgagggcgcguggcgccagguggagaagguugagacgugggcccugcgccacccagguuucaccauccucgcucuguuccuggcccacuacaucgggaccucccugacccagaagguugugaucuucauucuguugauguuggucacccccagcaugaccaugcggugcguugggguggggaaccgugacuucgucgagggccuaagcggggcuacguggguggacgugguccuggagcacggcgguugugugacgacuauggccaaaaauaagcccacccucgacauugagcuacagaagaccgaggccacccagcuggcgacgcucaggaagcuguguaucgaaggcaagaucaccaacauaaccaccgauagccggugccccacacagggcgaagcggugcugccggaagagcaagaucagaacuacgucugcaagcacacauacguggaucgaggaugggguaauggguguggucucuuugggaagggcucguuaguaaccugugcuaaguuucaaugccuggagccgaucgagggcaaggucgugcaguaugagaacuugaaguacacuguaaucaucacgguacacacuggggaucagcaccaggugggcaacgaaacacaggggguaaccgccgagaucacgccccaggccuccaccaccgaggcgauccugcccgaauacggcacucuugggcuugaauguuccccgcgcaccggcuuagacuucaacgagaugauccuucucacaaugaagaacaaggccuggaugguacaccggcagugguucuucgaccugccguugcccuggaccagcggcgcgacaaccgagacgcccaccuggaaccgcaaagagcuacugguaaccuucaagaacgcccacgccaagaagcaggaggucguugugcuggggucccaggaaggcgcgaugcacaccgcucugacgggggcaaccgaaauccagaauagcggcggcaccuccaucuucgccgggcaucugaaaugccggcugaaaauggacaaacucgaauuaaagggcaugagcuacgccauguguacgaacacguucguccugaagaaggaaguguccgagacccagcacgggacuauccucaucaagguugaguacaagggcgaggaugugccgugcaagauuccuuucagcacagaggacgggcaggggaaggcgcacaacggacgucugaucacggccaaucccguggugacgaagaaggaggagcccgucaacaucgaggcggaaccucccuucggagagagcaacaucgugaucgggaucggugacaacgcacugaaaaucaacugguacaaaaagggcuccagcaucgggaagauguucgaggcgaccgcccggggcgcccgccggauggcaauccugggcgauaccgcaugggacuucgggucagugggcgggguccucaacucacugggcaagauggugcaccagaucuucgggagcgccuacacagcccuguuuagcggcguguccugggucaugaagaucggcaucggggugcuccugaccuggauaggccugaacagcaagaacaccagcaugagcuucucaugcaucgccaucgggaucaucacccuauaucuaggcgccgucguccaggccgauauggggugcgugaucaauuggaaaggcaaggagcugaaaugcgggagcgggaucuucgugaccaacgaggugcauaccuggaccgagcaguacaaauuccaagccgacagccccaagcgacucgccacggcgauugcaggggccugggaaaacggggucugcggcauaagaucuacgacucggauggaaaaccuguuguggaagcagauagcgaacgagcucaauuacaucuuaugggagaacaacaucaagcugaccguaguagugggggacaucauaggcguguuagagcagggcaagcgcacccugacgccccagccgauggagcugaaguacuccuggaagacuugggggaaggccaaaauugucaccgcagagacccaaaauuccuccuucaucauugacggccccaacacgccugagugcccgagcgccuccagagcguggaacgugugggaaguggaggacuacgguuucggcguauuuaccaccaacaucugguuaaaguuacgcgagguguauacgcaacugugcgaccaucggcucaugagcgccgcggucaaggacgagagggcuguccacgccgacaugggcuauuggauagagagccagaagaacgggucguggaaacuggagaaagcgagccuuauugaggucaagacaugcacguggccgaagucccacacccucuggucaaacggagugcucgagagcgacaugaucauucccaagagccucgccgggcccaucucccaacacaacuaccggccgggcuaccacacccagaccgcggggcccuggcaccucggcaagcucgagcuggacuuuaacuacugcgaggggacaacgguggugauuaccgagaauugcgggacgcgcggccccagccuacggacgacgacaguguccggcaagcugauccacgagugguguugccgcagcuguacccugccuccgcuccgguacaugggcgaggacgggugcugguacggcauggagauucgcccgaucuccgagaaggaggaaaacauggucaagagucugguguccgcaggcuccgguaaggucgacaacuucacgaugggcguccucugcuuggccauacuguucgaggaggugaugagagggaaguucgguaagaagcacaugaucgcggggguauuuuucaccuucguccugcuccuauccgggcagaucaccuggcgcgauauggcccacacucucaucaugaucggaagcaacgccuccgaccggauggggaugggcgucacguaccucgcccugaucgcuaccuucaagauccagcccuuucuagcguuaggauucuuucugcgcaaguuaacgagccgugagaauuuacugcugggcguaggccucgcuauggccacuacgcugcagcugcccgaggacaucgagcagauggccaacggcaucgcgcucggccugauggccuugaagcucaucacccaauucgagaccuaccagcuguggaccgcccugaucagccuuacaugcuccaauaccauauucacccugacagucgcauggcgcacugccacccugauccucgcuggugugagccugcugccggucugccaguccucauccaugcguaagaccgacuggcuccccaugacgguagcugcuaugggcgugccgcccuugccgcucuucaucuucagccucaaggacacguugaagcggcgcuccuggccacugaacgaggggguuauggccgugggccucgugucaauccuggccucaagccugcuccggaacgacgugcccauggcgggccccuugguggcgggaggccugcucaucgcaugcuacguaaucaccggaaccuccgccgaccugaccgucgagaaggccgcagacgugacuugggaggaggaggccgagcaaacuggcgugagccacaaccuaaugaucaccguugacgacgacggaacgaugcgcaucaaggacgacgagaccgagaacauacuaacuguucugcugaagaccgcguuacugaucguuuccggcaucuuccccuauaguauaccggcaacccugcuagucuggcauacguggcagaaacagacccagcgguccggcguguugugggaugugcccagcccgcccgagacccaaaaggccgagcuugaggaggggguuuaccgcaucaagcaacagggaauauucgggaagacucaagucggagucggaguacaaaaggagggaguuuuccacaccauguggcacgugacgcgcggcgcgguacucaccuacaacggaaagcgccuagaacccaauugggccuccguuaaaaaggaccugauaagcuacgggggaggcuggcggcucuccgcccaguggcagaaaggggaggagguucaagucauugccgucgagcccggcaaaaaccccaagaacuuucagaccaugcccggcaccuuccagacaaccacuggggagaucggcgcgaucgcauuagacuucaagcccgguaccucaggcagccccauaaucaaccgcgaaggcaaaguugucgggcuguauggcaacgggguggugacaaagaauggcggcuacguauccggcaucgcccagaccaacgccgagccagacggccccacccccgagcuggaggaggagauguucaagaagcggaacuugaccaucauggaucugcaccccgggagcgggaagacacgcaaauaccugccggccaucguacgggaggcaaucaaacgccggcuccgcacucuaauccuggccccaacgcgaguggucgcagccgagauggaggaggccuuaaagggguuacccauucgcuaccagaccacggcgacgaaguccgagcauaccggacgcgagaucguggaccugaugugccaugccaccuuuacgaugcggcuccugagccccguccggguaccgaacuacaaccugaucaucauggacgaggcacacuucaccgauccggcauccauagccgcgcgcggauacauaucgacccggguggggaugggcgaggccgcggcuauuuucaugaccgcgacaccgcccgggaccgccgaugccuucccgcagucuaaugcgccgauccaggacgaggagcgugacaucccugagaggagcuggaacuccggcaaugaguggaucacggacuucgcggggaagaccgugugguucgugcccagcaucaaggcgggcaacgacaucgccaacugccuccggaagaacgguaagaagguuauccagcucucccgcaagacguucgacacugaguaccaaaagaccaagcucaacgacugggacuucguggucacgacggauauuagcgagaugggcgcuaacuucaaggcugaccguguaauugacccccgccggugcuuaaagccagugauacuaaccgauggccccgagcgcgucauccuggccggucccaugccgguuaccgcggccuccgccgcccaacggcgcgguaggguggggcggaacccacagaaggagaacgaccaguacaucuucaccgggcagccccucaacaaugaugaagaccaugcccacuggaccgaggcgaagaugcuguuagacaacaucaacacgcccgaggguauuaucccggccuuauucgaaccugagcgggagaaaucugccgccauagacggcgaauaccgccuuaagggugaguccagaaagacguuuguugaacugaugcgccguggcgaccuccccgucuggcuggcgcacaagguagcaagcgagggaaucaaguauaccgaccgcaaguggugcuucgacggucaacggaacaaccaaauccuggaggagaacauggacguggagaucuggaccaaagagggcgagaagaagaagcuccgcccccgguggcuggacgccaggacuuacuccgauccgcuggcgcucaaggaguucaaagacuucgcugcgggcagaaagagcaucgcgcuugaucuggugaccgagauagggcggguaccgucacaccucgcacaccggacccggaaugcucuugauaaucuugugaugcuccacaccagugagcauggugggaaagcuuaucggcacgcgguggaggaacugccggagacgauggagacccuguuacugcucggccucaugauccugcugacugggggcgccaugcucuuccugaucagcggcaaggggaucggcaagaccuccaucggguugaucugcguuauugccucguccggcauguuguggauggcggagauuccgcugcaguggaucgccagcgcuaucgugcucgaguucuucaugauggugcuccuaauccccgagcccgagaagcagcguacgccccaagacaaccagcuggcauacgucgugaucgggauacucacccucgcugcuaucaucgcagcaaacgagaugggccuguuagagaccaccaaacgcgaccugggcauguccaaggagccggggguggucagccccacaucauaucuggaugucgaccuccauccagccagcgccuggacccucuaugccguggccaccaccgugauuacgccgaugcugagacacaccauugaaaauuccaccgcaaacguaagcuuagcggccaucgccaaccaggcgguuguucugauggguuuggauaagggguggccgaucuccaagauggaccuugguguaccccugcucgcccucggcugcuacagccaggugaauccuuuaacccuaacggccgccguccucuugcugauaacccacuacgccaucaucggaccuggucuccaggcgaaagccacucgcgaggcccagaagcggaccgccgccgggauaaugaagaacccaacugucgacggcaucaugacaaucgaucuggaucccgucaucuacgacucaaaguucgagaagcaauuagggcagguuaugcuccuggugcugugcgcugugcagcucuugcuaaugcgcaccucaugggcgcucugugaggcuuugacccuggcuacgggccccaucaccacccucugggagggcucccccgggaaguucuggaacacuacgaucgcagucaguauggccaacaucuucagagguaguuaucuggccggcgcuggcuuagccuucagcaucaugaaguccguggggaccggcaaacgcggcaccgggagucagggcgagacccugggggagaaguggaaaaagaagcuuaaccagcugucccggaaggaauucgaucuuuauaagaaauccggcaucaccgaggucgaccggacggaggcgaaggagggacugaagcgaggcgagauuacccaccacgccgucagccgcgggucagccaaguugcagugguucguggagcggaacauggugauaccggagggucgcgugaucgauuuagggugcgggcgcggcggguggaguuauuacugcgccggucugaagaaggugaccgaggugcgcggcuacacuaaaggugggcccggccacgaggagcccguccccaugaguacguacggcuggaacaucgugaaacugaugagcgggaaggacguguuuuaccuuccgcccgagaagugcgacacccucuugugcgacaucggugaguccagccccuccccgaccgucgaggagagccguaccauccgcgugcucaagaugguggagccguggcucaagaacaaccaguucugcaucaagguccuaaaccccuacaugcccacggucaucgagcaccuugagagacuccagcguaagcacggcgggauguuaguccgcaacccccugucccgcaauucgacucacgagauguauuggaucuccaacggaacgggaaauaucguggcaucagugaacauggugucccgccuccuucugaaccgguuuaccaugacgcaccgccggccuacaauagagaaggacgucgaccucggcgcaggcacucgccaugugaacgccgagcccgagacccccaauauggacgugauuggggagcggaucaagcgaaucaaggaggagcacaauagcacguggcacuacgacgacgagaacccguauaagacuugggcguaccacggcuccuacgaggugaaggcaaccggaagcgccucgagcaugauaaacggcguugucaaacugcugaccaagcccugggauguagugcccauggucacacagauggcuaugaccgacacgacccccuuugggcagcagcggguauucaaggagaagguggacacgcgcacaccccggagcaugccuggcacgaggcgcgucaugggcauuaccgccgaguggcuguggcgcacgcugggacggaacaagaagccccgucuguguacccgggaggaguucaccaagaaaguacgcaccaacgccgcaaugggcgcgguguucacggaggagaaccagugggacucggccaaggcggccgucgaggacgaagacuucuggaaacucguugaccgcgagcgggagcuucacaaacuggguaaauguggcagcugcgucuacaacaugauggggaaacgcgagaagaaguuaggcgaguucggcaaggccaaggggucucgagcgauuugguacauguggcuaggcgcacgcuaccuggaauuugaggccuugggguuucugaacgaggaucacugguucagccgggagaacuccuacagcggcgucgagggggagggccugcauaagcucggcuacauccugagggacaucuccaaaauucccggaggugcuauguacgccgacgacacugcagggugggacacccggaucaccgaggacgaucugcacaacgaggagaaaauaacgcagcaaauggacccggagcaccgccagcucgcaaacgccaucuucaaacugaccuaucagaacaaaguggugaaaguacagaggccuaccccaacaggcacagugauggauaucauaagccgcaaagaccagcgcgguuccggccaagugggcacguacggucugaacacauucaccaauauggaggcgcagcucauccgacagauggagggcgaagggguccugucgaaggccgaccuggagaacccacaccuaccggagaagaagaucacacaguggcuggagacgaaaggugucgagcguuugaagcgcauggcgauuucgggagacgacugcguggucaagcccaucgacgaccgguuugccaacgcccuccuagcgcugaacgauauggggaaagugcgcaaggacaucccccaauggcagcccucuaagggcuggcacgacuggcaacagguccccuuuugcucucaccacuuccacgaacucaucaugaaggacggcaggaaacuggucgugcccugccgcccacaggacgagcugauaggccgagcccgcaucagccagggggcgggauggaguuugcgggaaacggcuugccugggcaaagccuacgcccaaauguggagccugauguacuuccaucgccgugaccuucguuuagcguccaacgcgauuugcagcgcugugccuguccacuggguuccgaccucccgcaccacauggucaauccacgcacaccaccaguggaugaccaccgaggacaugcucaccguguggaaucggguguggaucgaagacaacccuuggauggaggacaagacgccggugaccaccugggagaacgugcccuaccuagggaaacgcgaggaccaauggugcggcucacugaucgggcugaccagccgggcgacgugggcccaaaauaucccaaccgccauccagcagguccgcagccucaucggcaaugaagaguuccuagacuacaugccaucgaugaagcgguuccgcaaggaggaggagucugaaggggccaucugguga

SEQ ID NO: 26009 - RNA, 9873 nt, Artificial Sequence
  derived and/or modified CDS sequence (opt11) from DENV-3__JQ922554__SS-prME
accagcuugugccugaugaugaugcugcccgccacccuggccuuccaccucaccucccgcgacggcgagccccggaugauaguggggaaaaaugaacgcggcaagagccugcuguucaagaccgcgucugggaucaacaugugcaccuugaucgccauggaccugggcgagaugugcgacgacaccgucaccuacaaaugcccccacaucaccgaacuggagccugaggacaucgacugcugguguaaccucaccuccaccugggugacguacgggacguguaaccaggcgggcgagcaccggcgcgacaagcggucuguggcucuggcaccccacgugggcaugggucuggauacccgcacccagacguggaugucugcggagggcgccuggagacagguggagaaaguggagaccugggcgcuccgacacccaggguuuacgauacuggcccuguucuuagcgcacuacaucggcaccucuuuaacgcaaaagguggugauuuucauccugcucaugcucgugacccccagcaugaccaugcgguguguuggggugggcaaccgcgacuucguggaaggccuguccggcgccaccugggucgacguggugcucgagcacggcgggugcguaaccaccauggccaagaauaagccuacccucgauaucgagcugcagaagaccgaggcgacgcagcucgcaacccugcggaagcucugcaucgagggcaagauaaccaacauuaccacugauuccaggugcccuacccaaggcgaagcgauccucccggaggagcaggaccaaaacuacgugugcaagcacaccuacguugaccgcgggugggggaacgggugcggucuguuugggaaggggagccugguaaccugcgcuaaguuccagugccuagagagcaucgagggcaaggugguacagcacgagaaccugaaguacaccgugaucaucacgguucacacuggugaccagcaccaaguggggaaugagacacagggcguaacggcggagaucaccagucaggcuagcaccgcugaggcgauacuaccggaguacggcacccugggguuggagugcuccccucggaccgggcuugacuucaacgagaugauccuccugacgaugaagaacaaggccuggauggugcaccggcagugguucuuugaucugccccucccguggaccagcggcgccaccaccaaaacgcccaccuggaaccgcaaggagcugcuggucaccuucaagaacgcccacgccaaaaagcaggaaguaguaguccucgggucccaagagggugcuaugcacacggcucugacgggugcgaccgaaauccagacgagcggagggaccucuauauucgccggccaccugaagugccggcucaagauggacaagcuggaacugaagggcaugucauacgccaugugccucaacacguucgugcugaagaaggagguuagcgagacccagcacgguaccauccuuaucaagguagaguacaaaggcgaggacgcgcccuguaagaucccguuuuccacugaggaugggcagggcaaggcucacaacggccgccuuaucacggcaaacccgguggugaccaagaaggaagaacccgucaacaucgaggccgagcccccguucggggaguccaacauaguuauugggaucggggacaaggcucucaagaucaacugguaccggaagggcucgagcaucggaaagauguucgaggcaaccgcccguggugcccggcgcauggcuauacugggagacaccgcaugggacuucggguccgucggcggggucuuaaacucacucgguaagaugguacaccaaaucuuuggguccgcuuacacugcacuguucagcggagugucguggauuaugaagauuggcaucgggguccuucucaccuggaucggguugaauagcaagaacacuuccauggcauucuccugcaucgccaucggcaucauaacccuguacgugggcgugguggugcaggcggacauggggugcgugauuaacuggaagggcaaggagcucaagugcggcuccgggaucuucgugacgaacgagguacauacauggaccgagcaguacaaguuccaggccgacagcccgaagcgccuugccaccgccaucgccggagcgugggagaacgguguguguggcauucgguccacgacccgcauggagaacuugcucuggaagcagaucgcuaacgagcugaacuacauccucugggagaacaauaucaaguugacagucgugguuggggacaucacgggcgugcuagagcagggcgaacggacgcugacaccccagcccauggaguugaaguacucguggaaaaccugggggaaggcgaagaucgugaccgcggagacccagaacucauccuucaucauagacggcccauccaccccggagugccccucugcuagccgagccuggaacgugugggaagucgaggacuacggguucggcguguuuaccaccaacaucuggcugaagcugcgcgagguauauacccagcucugcgaccaccgccugauguccgcugccgucaaggaugaaagggccgugcacgccgacaugggcuacuggaucgagagccagaagaacggguccuggaaacuggagaaggccucccucauagaggugaagacgugcaccuggccuaagucucacacgcugugguccaacggcguacuggagucggacaugaucauccccaagucgcucgccgggccgaucucccagcacaaccaccgccccggcuaccacacccaaacagccggccccuggcaccuagguaaacuggagcucgacuuuaacuauugcgagggcacgaccguggugaucuccgagaacugcgguacccgggggccgucccugcgcacgaccaccguuagcgguaaguuaauccacgaguggugcugucgguccugcacgcugccaccccugcgcuacaugggcgaggacgguugcugguauggcauggagaucaggcccaucaacgagaaggaggagaacauggugaaaucacuggccucggcgggaagcgggaagguagacaacuucaccaugggaguccucugccucgccauacuguucgaggaggugaugcgcggaaaguuccguaagaagcacaugauagccgguguccuguucaccuucgugcugcuacucuccgggcagaucaccuggcgcgacauggcccauacccucaucaugauuggcagcaaugccagcgaccggauggggaugggggugacguaccuggcgcucauugcuaccuucaaaauacaaccguuccuggcccuuggauucuuccuccgaaagcugaccucccgggagaaccuguugcugggagucggccuggccauggcggccacccuccgccugcccgaagacaucgaacagauggccaauggcauugcccuugggcucauggcccugaaacugaucacccaguucgagaccuaccagcucuggaccgcccuggucucucugaccuguuccaacacuauauucacccucaccguggccuggcgcacggcuacgcugauacuggcagggauaagccuccugcccgugugccaguccaguuccaugcggaagaccgacuggcugcccaugacaguagccgcgaugggggugccuccccucccccuguucauauucagccugaaagacacccucaagcgaaggucuuggccccugaacgagggaguaauggcaguugggcugguuagcauacucgccuccagccugcugcgcaacgacgugccaauggccgggccccucguagccggcggccuacugauugcgugcuacgugauuacuggcaccuccgcggaccucaccgucgagaaggcagccgacgugaccugggaagaggaggcugagcagacgggggugagccacaaccugaugaucaccguugacgacgacgggaccaugcggaucaaggaugacgaaaccgagaauauccugaccgugcuccugaagacggcgcuucucaucguguccgggaucuuccccuacagcauccccgccacacuacugguuuggcacaccuggcagaagcagacacagcgcuccggggugcugugggaugucccgucgcccccggagacgcagaaagccgagcuggaggagggcgucuaccgcauaaagcagcaggggaucuucggcaaaacccaggugggggugggcgugcagaaggagggggucuuccacacaauguggcacgucacucgcggcgccguccugacgcacaacgguaaacgucucgagccaaauugggcgagcgugaagaaggaccugaucagcuaugggggagguuggcgccugagcgcccaaugggccaaagggggagaaacccaggugauugccgucgagccuggcaagaaccccaagaacuuucaaacaaugcccggcaucuuccagaccacgaccggggagaucggcgcgaucgcccuugacuucaagcccgguacauccggcagcccgauaauaaaccgcgagggcaaggugguagggcucuacggcaacggggucgugaccaagaacggcggguacguguccggcaucgcccagacgaacgcggagcuggacggccccacccccgagcuggaggaggagauguuuaagaagcgcaaccucaccaucauggaucugcacccggggagcgguaagacccggaaauaccugcccgccauuguccgagaggccaucaagaggcgccuccgcacgcugauccuggcccccacccgaguggucgccgccgagauggaggaggcccuuaaggggcugcccauccgcuaccagaccaccgccacaaagucagagcacaccggccgcgaaaucgucgaccugaugugccaugcgaccuucacgaugaggcuccugucaccggugcgcgggucgaacuacaaccugaucauaauggacgaggcccauuucacugaccccgccagcaucgccgcgaucggcuacauuuccacccgcguaggcaugggcgaagccgccgcgaucuucaugaccgccacacccccggggacggucgacgcuuucccgcagagcaucccacccauccaggacgaagaacgggauaucccggagcgcuccuggaacagcggaaaugaguggaucacugacuucguaggcaagaccguuugguucgucccguccaucaaggccgggaacgacauugccaacugccuccggaagaacggcaaaaaggugauccaacugagccgcaaaacguucgacacagaguaucagaagaccaagcugaacgacugggacuucguggucaccaccgacaucuccgagaugggcgcgaacuucaaggcagaccgugugaucuacuugagaaggugccugaaaccagugauccugacaaacgggcccgagcgcgucauccucgcgggccccaugccggugaccguggcaucagccgcccagcggagggggcgggucggccgaaauccccagaaggagaaugaccaguacauuuuuauggggcaaccccugaacaacgacgaggaucacgcccacuggaccgaggcgaaaaugcugcuggacaauaucaacacccccgaggguaucaucccagcacucuucgagccagaacgggagaaguccgccgccaucgacggcgaguaccgcuugaagggggagagcagaaagaccuucguggaacucaugcgccgaggugaccuuccaguuuggcuagcgcacaaggucgccuccgaagggaucaaguacacggaucgcaaaugguguuuugacggcgagcggaauaaucagauccuugaggagaacauggacguggaaauauggaccaaggagggugagaagaagaacuggcgcccgcgguggcuggacgcccggaccuauagcgauccguuggcccucaaggaguucaaggacuuugcugcggggaggaaaagcaucgcacuggacuuggucaccgagaucggccgaguucccucccaccucgcccauaccgugcgcaacgcccuugacaaccuggugauguugcacaccagcgagcacgguggccgggccuaucgccaugcgguggaggaacuccccgaaaccauggagaccuuacuccugcugggccucaugauccugcugaccgggggagccauguuauucuugauuuccgggaaaggcauaggcaaaaccagcaucggccugaucugcgugaucgccucgagcgggaugcucuggauggccgaugucccccuccaguggaucgccuccgccaucgugcuggaguucuucaugaugguucuccugaucccggagcccgagaaacagcggacaccccaggacaaccaacuggccuaugucgugauaggcauacucacgcuggccgcgaucguugccgcgaacgagauggggcugcucgagacgaccaagcgcgaccuggggaugucuaaggagccuggcgucguuucccccaccagcuaccuggacguggaucuccaccccgccuccgccuggacccuguacgcggucgcaacgccugugauuacaccgauguuacggcacaccaucgagaacagcaccgccaacgugucgcuggcagcgaucgccaaccaggcggucguacugauggggcuggacaagggcuggcccauuaguaaaauggaccucggugugccccugcucgcccugggcuguuacucccaagucaacccccugacccuagccgccgcuguccuccugcuggugacccauuacgcgaucaucggcccuggucuccaagccaaggcaacccgugaggcgcagaagcgaaccgcggcgggcauaaugaagaaucccaccguagaugguaucaugaccaucgaucuggaccccgugauuuaugacagcaaauucgagaaacagcugggccaggugaugcugcuggucuugugcgcggugcagcuccuguuaaugcgcaccaguuggccccucugcgaggugcuugcccuggccaccgguccgauaacgacacucugggaggggagccccggcaaauucuggaacaccacgaucgcugucuccauggccaauaucuuccgggggaguuaucuggccggugcuggacuggccuucagcauuaugaaguccguggguacgggaaagcgcgggaccggcagccagggggagacucucggcgaaaaguggaagaagaagcuaaaccaguuaucccggaaggaguuugaucucuacaaaaagagcgggaucacggagguggaccggacggaagcgaaggagggccugaaacggggcgaaaucacccaccacgccguaucccgcgggagcgccaaguugcagugguucguggagcggaacaugguguuuccggagggccgcgucauugacuuagggugcggcagaggugggugguccuacuacugcgccgggcugaagaagguaaccgaggugcgcggguacaccaagggcgguccuggacacgaggagccuguccccaugagcaccuacggcuggaacauagugaagcugauguccggcaaggacguguuuuaccugcccccugagaaaugcgacacucuccugugcgacaucggcgagagcuccccgagccccaccgucgaggaaucccgcacuauccgggugcugaagaugguggagcccugggucaagaacaaccaguucugcaucaaggugcucaaccccuacaugccgucggugaucgagcaccuggagaaucugcaacgcaagcauggggguauccuuguccggaacccccugucccgcaacagcacccacgagauguacuggauuuccaacgggacuggcaacaucgugaguuccgugaacauggugagccggcugcuccucaaccgcuucacaaugacccaucggcgacccaccauugagaaggauguagaccuuggcgccggaacgcggcacgucaacgccgagcccgagacaccgaacauggaugugauuggcgagcgcauaaaaagaaucaaggaagaacacagcuccaccuggcacuacgacgacgagaaccccuacaagaccugggccuaucaugggagcuacgaggugaaggccacgggcucggcgaguuccaugaucaacgggguagugaaacuccugaccaagcccugggacguugucccgauggugacccagauggcaaugaccgauacgaccccauucgggcagcagcgcguguucaaggagaagguagacacccggacaccccgcccaaugccuggcacgcggaaggugauggagauaaccgccgaaugguuguggcgcacccuggggcggaacaagcgcccccgucuuuguacucgggaggaguucacaaagaaagugcguaccaacgccgcgaugggcgccgucuuuaccgaggagaaccagugggacagcgcgcgggccgccguggaggacgaggaguuuuggaagcugguggaucgcgagcgggagcuucacaagcuggggaagugcggcuccugcguauacaacaugauggggaagcgcgagaaaaagcugggcgaguucggcaaggccaaggacagccgggccaucugguauauguggcucggggcgcgcuacuuggaguucgaggcccuuggcuucuuaaacgaggaucacugguucucccgagaaaauucuuacagugggguggagggcgaggggcugcacaagcugggcuauaucuugcgcgacaucagcaagaucccgggcggggccauguacgccgaugacaccgccggcugggauacacggaucaccgaggaugaucugcacaacgaggagaaaaucacccagcagauggcgcgcgagcaccgccagcuggcgaacgcaaucuucaagcucaccuaccaaaacaagguggucaaggugcagcgcccaacgccaaagggcaccgugauggacauuauaucccgaaaggaucaacgcggcaguggacaggucgggaccuacgggcugaacaccuucacgaacauggaggcccagcuaauccggcaaauggagggggaaggcguucucucaaaagcagaccucgagaauccccacccgcuggagaagaagaucacccaguggcucgagaccaagggaguggaacgccugaagcggauggcgaucagcggcgacgauugugucgugaagcccauagacgaccguuuugccaacgcccugcucgcccugaaugacaugggcaaggugcggaaggacaucccgcaguggcagccauccaagggguggcacgacuggcagcaagucccuuucuguagccaucacuuccaugagcuuaucaugaaagacggccggaagcuaguggugcccugucggccgcaggacgagcugcuggggaaggccaggauaucccagggcgcuggguggagcuuaagagaaaccgcgugccucggcaaggccuacgcccagauguggacccugauguauuuccaccggcgugacuugcgguuagcgaguaacgcgauuugcuccgccguacccgugcacuggguccccacuucucgcaccaccuggagcauccaugcccaccaucaauggaugaccacagaggauaugcugacggucuggaaccgaguauggaucgaggacaaucccuggauggaggauaagacaccgguaacgacgugggaggacguccccuaccucggcaaacgcgaggaccaguggugcgggucgcugaucggacucacuucccgagccaccugggcgcagaacauccucacggccauccaacaggugcgcagccugauugguaacgaggaguuucuggacuacaugcccuccaugaagcgguuccgcaaggaggaagagagcgagggcgcaaucugguag

SEQ ID NO: 26010 - RNA, 9873 nt, Artificial Sequence
  derived and/or modified CDS sequence (opt11) from DENV-3__EU529683__SS-prME
accucgcuuugccuaaugaugauacucccggccgcccuggcguuucaccuuaccucacgggauggggaaccgagaaugauugugggcaaaaacgaacgcggaaaaagccuucuguucaaaacugccagcggaauaaacaugugcacccucauagccauggaucugggugaaaugugcgacgacacgguaacauacaaauguccccacauaaccgaaguggaacccgaagacaucgacugcugguguaaccugacauccacuugggucacguacggaacgugcaaccaagcaggagaacaucgaagagacaagcggagcguggcccucgcaccccaugucggaaugggacuagacacccgcacgcaaacguggaugagcgcggaaggagcguggaggcaaguagaaaagguugagacuugggcccuccgccaccccggcuucacuauauuggcucuauuuuuggcacacuauauaggaacaucccuaacccaaaaggucguaauauucauacuacuaaugcuagucacgccaucaaugacaaugcgaugcguaggggugggaaacagagacuucguggaggggcugaguggagcgacguggguugacguggugcuggagcacggaggaugcgucaccacaauggccaaaaacaaaccgacauuagauauagaacuccagaaaaccgaggcaacacaacuagcgacacuucggaagcugugcaucgaggggaagaucacaaacauaacaacagacucacgaugcccuacacaaggcgaagcagugcuacccgaagaacaagaccaaaauuaugucugcaaacauacguauguagaccgagggugggggaaugggugcggacuguuuggcaagggcagccuaguaacgugcgcgaaguuucaaugucuagagccgaucgaagggaaggugguccaauaugaaaaucucaaauacacagucauaaucaccguccacacaggcgaccaacaucaaguagggaaugaaacccaaggaguaacagcggagaucacuccacaagcgagcacaaccgaggcaauacuccccgaauauggaaccuuaggacuagagugcucaccgaggacaggauuggacuuuaacgaaaugauacuacuaacaaugaaaaacaaggccuggaugguacaccgacaaugguuuuucgacuuaccacugccguggaccuccggagcgacaaccgaaacgccgacguggaaucgaaaagaauuacuggucacauuuaagaaugcgcacgcgaagaagcaagagguggugguccugggcagccaagaaggcgcaaugcacaccgccuuaacaggagcaacagaaauccagaauagcggaggaacgaguauauucgccggccaccuuaaaugccgacucaaaauggauaaacuggaacugaagggaaugagcuacgcuaugugcacaaacacuuucguauugaagaaagaagucagcgagacucaacacggaaccauucuuaucaaagucgaauauaagggagaagacguccccugcaagauuccauuuaguaccgaggacggacaaggcaaggcacacaacggcagacuaauaacugcaaaccccgucguaacaaagaaggaagaacccgucaacaucgaagccgaaccaccauuuggugaaaguaacauugugaucggaauuggcgacaaugccuuaaaaaucaauugguacaagaaaggcucgucgauaggcaagauguucgaggccacagcacggggagcacgccggauggcaauacugggagacacugcgugggacuuuggauccguaggagggguacuaaauagucuaggaaaaauggugcaucagauuuuuggcagcgcguauacagcccucuucuccggcguaucaugggucaugaaaauaggcaucggaguucugcucaccuggauaggacucaacagcaagaacacuagcauguccuucaguugcaucgcaauaggaauuaucacacuguaccucggggccguuguccaagcugacacgggaugcgugaucaacuggaaagggaaagaauugaaaugcggaucgggcauauucgucacuaacgaggugcacacguggacagaacaauacaaguuccaagcggauucaccaaagaggcuagccacagcaaucgcuggagcaugggaaaacgggguaugcgguaucaggagcacgacucgcauggaaaaccuccucuggaaacagauagccaaugaacuuaacuauaucuuaugggagaacaacauuaaacuaacaguuguaguaggcgacaucaucggcguacuagaacaaggaaaaaggacgcucacgccucagcccauggaacucaaguauucauggaaaaccuggggaaaagcaaggauuguaacagcagagacccaaaacaguuccuucaucaucgacggccccaacacacccgaaugcccaaacaccagcagggcauggaauguaugggaaguggaagacuauggguuugggguguucacaacaaacauauggcugaaacuucgcgagguguacacgcagcugugugaccaccgguuaaugagugcagcagucaaagaugaacgugcagugcaugcggacaugggauacuggauagagucccagaaaaacggcagcuggaagcucgaaaaagcgucccugauagagguaaaaaccuguaccuggccaaaaucacauacccucuggagcaacgguguacuggaaucugacaugaucaucccuaaaagccuagcuggaccgaucagccaacacaacuaccggcccggguaccacacucagacagcgggaccguggcaucuaggcaaacuagaguuggauuucaacuacugcgaggguaccacaguugugauaacagaaaacugcggcacacgggguccgagccuacgaacgacuaccguuagcggcaaauugauccacgaguggugcugccgcagcugcacacuaccaccccugagauacaugggagaagacggcugcugguacggcauggaaauacgccccauauccgagaaagaagagaauauggugaagucauugguaucagccggaaguggagagguagacaauuuuaccauggggguacugugccuagccaucuuauucgaagaagucaugcgagggaaauucggcaagaagcauaugauagcaggagucuucuucacauucguacugcuacuuagcggccaaauaacguggcgcgacauggcgcacacccucauaaugauaggguccaacgcaaccgaccgaaugggcaugggggugacguacuuggcacuaauagcgaccuuuaaaauucaaccguuccuggcacuuggguucuuucuaagaaaacuaacguccagggaaaacuuacuccuaggaguuggacuagcaauggccaccacucuccaacucccagaagacauagaacaaauggcgaacggaauagcccucggauuaauggcccucaagcucaucacacaauucgaaaccuaccaacuguggaccgcgcucauaucauuaacauguagcaacacgauuuuuacacuaacgguagccuggaggacagcgacuuugauccuagcaggcguaucgcuccuaccaguaugccaaucguccaguaugcgcaaaacugacuggcuuccuaugacaguggcagccauggggguuccaccccuaccucuuuucauauucucgcuaaaggacacccugaaaagacgcaguuggccccucaacgaggggguaauggcgguaggccucguaagcauccucgcuucaucgcuccuccgcaacgaugucccaauggcaggcccccugguagcugguggccuauuaaucgcaugcuacgucauaacuggcacuucggcggacuuaacggucgagaaagcagcagacgucacgugggaagaagaagcagaacaaacgggugucagucacaaucugaugaucaccguggacgaugacgggacgaugcggauaaaagacgacgaaaccgagaacauccucacggugcuacuuaagacggcccuucucauaguuucagggaucuuccccuacagcaucccagcaacacuccugguguggcacacauggcaaaagcaaacccagaggucgggcguacuuugggacguccccucaccgccagagacgcaaaaggccgaacuggaggagggcgucuaccgcaucaaacaacagggaaucuuuggcaagacgcaggucggcgugggcguacaaaaggaaggcgucuuucacaccauguggcacgucacaagaggugcgguacucacguacaacggaaaacgauuagaacccaacugggcaagcgucaaaaaggaccugaucuccuauggaggugguuggagacuuuccgcgcaguggcagaaaggagaagaaguccaagucauugcaguggaaccggggaaaaaucccaaaaacuuucaaacaaugccgggcacguuccagacgacgacgggcgaaaucggcgcuauagcccuggacuuuaaaccggggacuagcggaucaccuauuaucaacagagaggggaaaguggugggacuguacggcaacgguguggugaccaagaacgggggauacguuuccgggauugcccaaacaaacgccgagccggauggcccgacgccggagcucgaagaggagauguuuaagaaacgcaaccuaacaaucauggaucuucacccagggucgggaaaaacccguaaguacuuaccagcuaucgugagggaggcaauaaaacgccgguuacggacacuaauauuagccccgacaagggucguagcagccgagauggaggaagcauuaaagggacuaccaauucgcuaccaaacaacggcuaccaaaucagaacacacaggccgggaaaucguggaccuuaugugccacgccaccuuuaccaugcgauuacugagccccgugcgcgucccaaacuauaaucugauaaucauggacgaggcccacuucaccgauccagcaucaaucgccgcccgcggauacaucuccacgagaguuggaaugggagaagcggcggcaauauucaugaccgcaacgccacccgguacggcagacgcguuuccacaguccaacgcaccgauacaagacgaagagagggacauaccagagcgcagcuggaacuccggaaacgaguggaucacagauuuugcgggaaagacaguaugguucguacccagcaucaaggccggcaacgauauugcgaacugccuacggaagaauggaaagaagguuauccagcugagcagaaagacuuucgacacagaauaccagaaaaccaagcuaaacgacugggauuucguagugacgacggauaucucagaaaugggagcaaauuucaaagccgaccgagugaucgacccgcggaggugccugaaacccguaauccuuacggacggacccgaacguguaauccucgccgggccaaugccagucacggccgcaucggcggcgcagcggcgggggaggguaggaaggaacccgcaaaaagaaaacgaccaguauauauuuacgggacaaccacucaacaacgacgaggaucaugcacacuggacagaggccaaaaugcuauuggauaacaucaacacacccgaaggaauaauaccggcccucuucgagcccgagagagaaaagucagcagcaaucgauggggaauaccgccugaaaggagagagucgcaaaaccuucgucgaauugaugagaagaggagaccuuccaguauggcuggcucacaagguggcuuccgaaggcauaaaauacaccgaccggaaguggugcuucgacggacaaagaaacaaccagauucuagaggaaaauauggauguagaaauauggacaaaagagggagagaaaaagaaacuuagaccacgguggcuggacgccaggaccuacucagauccacucgcccucaaagaguuuaaagauuuugcagcaggucgaaaaagcaucgcacucgaccuagucacggaaaucgggcgagucccaacccaucuagcgcaucgcacccgcaacgcccucgacaaccugguaaugcuccacaccagcgagcacggaggcaaggccuaccgccacgcaguggaagaacuaccagagaccauggaaacccuccuacuucugggguuaaugauacuacucacagggggagcaauguuguuucuaauaucuggaaagggaauaggcaaaaccucaauagguuuaaucugcguaauagcguccagcggcaugcucuggauggcagaaauuccacuccaauggauugcgagcgcgauaguacucgaguucuucaugaugguacuacucauaccggagccggagaagcaaagaacaccccaagacaaccaauuggcuuaugugguuaucgggauucugacauuagcugccauaaucgccgcuaaugaaauggggcuacucgagacgacaaagcgcgaccucggcaugucuaaggaacccggggugguuaguccaacaagcuaucucgacguagaccuccacccggcgucagcauggacauuguacgcaguagcuacuacugucaucacgccaaugcucagacacaccauagagaacucaacugcaaacguaucccuagcggcgauugcaaaucaagccguaguccucaugggucuagauaaaggcuggccgaucaguaaaauggaccucggugugccacuucuggcgcucggaugcuauucgcaagucaacccucugacguuaacagcagcaguacuguuguuaaucacucacuaugcaauaaucggccccggcuugcaagcgaaggcaacucgcgaggcacagaagcgcacggcagcaggcauaaugaagaaucccaccguagacgggauaaugacuaucgacuuagaucccguuauauacgauagcaaguuugaaaaacaacucggacaggucaugcuacugguuuuaugcgcgguccaacugcuccuaaugaggacgagcugggcacuaugugaagcacuaacacuggcaacggggccgaucaccacgcucugggaaggaagcccggguaaauucuggaacacgacuaucgcggugucgauggcaaacauauuccgaggcaguuaucuugcaggcgcagggcucgcguucucaauaaugaaaaguguaggcaccgggaaacgcggaacggggucccaaggcgagacccucggagaaaaauggaagaagaaacucaaucagcuuucccgcaaggaguucgaccuuuauaagaaaagugguauaacagaaguggaccggacagaagccaaggagggccuaaagcgaggagagauuacccaccaugccguuagcagaggcucggcgaagcuacaaugguuuguagaacgcaacaugguuaucccggaaggcagagugauagacuugggaugcgggaggggcggguggucguauuacugcgcgggccuuaaaaaggucacggaaguccggggauacacaaagggcggaccugggcacgaggaaccugucccuaugucgacguacgguuggaacauagugaagcuaaugucgggcaaagacgucuucuaucugccaccagagaagugcgacacucugcucugcgauauaggcgagagcagcccuucgccaacggucgaagaaagccgcacaauacgcguucuaaagaugguugagccauggcucaaaaauaaccaauuuuguauuaagguucuaaaucccuacaugccggccgucaucgagcaccucgagagacugcaacggaagcacgggggcaugcucguucgcaaucccuugagucgcaacuccacccacgaaauguacuggauaagcaacgggacagguaacaucguugcaagcgucaacauggugucaaggcuacuuuugaaccgcuucacuaugacucacaggaggccaacgauagaaaaggacguggaccugggggcuggcacaagacacguaaacgcggagccggagaccccgaacauggauguaauuggcgaacguaucaagcgcaucaaagaagaacauaacagcaccuggcacuacgacgacgaaaauccguacaaaacgugggccuaccacggaucguaugaagucaaagcgacugguagugcuucaucuaugaucaacgggguagugaaauugcuaacuaagccgugggacgugguaccgaugguaacgcaaauggcaaugacggacacaaccccguucgggcagcagcgcguauucaaagagaaaguagacacccgaaccccgcgaucaaugcccggaaccaggcgcgucauggaaauaaccgcugaauggcuguggcggacccucggcaggaauaagaaaccgaggcuauguacgagggaagaguucacgaaaaagguuagaacgaacgccgcaaugggcgcagucuucacggaagaaaaccagugggauucggcuaaggcagccgucgaagacgaagacuuuuggaaacuuguugaccgggagcgggaguugcacaaauuggggaaaugcgggucaugcguuuacaacaugaugggcaagcgugagaagaaacugggagaauuuggcaaagccaagggaucacgagccauaugguauauguggcucggagccagauacuuggaguucgaagcacugggguuccuaaacgaagaccauugguucucacgagaaaacucuuacuccgggguagaaggugaaggccuacauaaauugggauauauccucagggauauaagcaaaauaccgggaggcgccauguacgcagacgacacggccgggugggacacccgcauaacggaagacgaccuccacaacgaggagaaaaucacccaacaaauggaccccgagcaucggcaacuagcaaacgcgauauucaaacugaccuaccaaaacaaagugguaaagguacaacggccuacgccuaccggaacaguaauggacauaaucucccgcaaagaccaacguggaagcggccaaguuggaacauacggacuaaauacauucaccaauauggaggcccaacuaauaagacagauggagggagagggagugcugaguaaagcagaucucgagaacccccauuuacccgaaaagaaaauaacccaauggcucgaaaccaaaggagucgaaaggcucaaaaggauggcaauaucaggcgacgacugugucgucaaaccaaucgacgaccgguucgcgaaugcccugcuugcgcugaacgacaugggaaaggugcgaaaagacauaccccaguggcagcccuccaaaggcuggcacgauuggcagcaaguaccguuuuguagccaccauuuccacgaacuaaucaugaaagacgggcgaaagcuaguaguacccugccggccccaagaugaguuaauaggucgugccagaauaucccaaggggcggguuggagccuccgggagacggcgugcuuaggaaaggccuacgcccaaauguggucccugauguauuuccacaggagagaucuacgccuugcaagcaacgcaauuugcagugcaguaccuguucacugggugccuaccagcagaaccacgugguccauacacgcccaccaccaguggaugacuacagaggacaugcucacgguguggaaccgaguuuggaucgaggacaaccccuggauggaggacaagaccccagugaccacaugggaaaaugucccauaccuaggaaagcgggaggaccaguggugugggucacugaucggacuuaccucgagagcaacaugggcccagaacauccccacugcaauccagcaagugcgcucguuaaucgggaacgaagaguuccuagauuacaugcccucgaugaaacgguuccgaaaagaggaagaaagugaaggggccaucugguga

SEQ ID NO: 26011 - RNA, 9873 nt, Artificial Sequence
  derived and/or modified CDS sequence (opt11) from DENV-3__EU529684__SS-prME
accagccugugccugaugaugauccugcccgccgcccuggcguuccaccucaccucccgggacggggagccccggaugaucguggggaagaacgagcgcggcaagagccugcuguucaaaaccgccagcgggauaaacauguguaccuugauagcaauggaccugggugagaugugcgacgacacggugaccuacaagugcccccacaucacggagguagagcccgaggacaucgacugcuggugcaaucugaccagcacuugggugaccuacgggacgugcaaccaggccggagagcaccggcgcgacaagaggagcguggcccucgcgccgcacgugggcauggggcuggacacccgcacgcagaccuggaugagcgccgagggugccuggcgccagguggaaaaggucgagaccugggcccugcgccacccggguuucaccauccucgcgcuguuccuugcccacuacaucggcaccucccucacccagaaggugguaauuuucauccugcugaugcucgucacgcccagcaugaccaugcggugugugggggugggcaaccgcgacuucgucgagggucuguccggggcaaccuggguggacgugguccuggaacacggcgggugcgugacuacaauggccaagaacaagcccacccucgacaucgagcugcagaagaccgaggccacccaacuggcgacacuccggaaacugugcaucgaaggcaagauuaccaacaucaccacggacagccgcugccccacccagggcgaggccgugcugccggaggaacaggaccagaacuaugucugcaagcacacauacguggacagaggguggggcaacggauguggccucuucgggaagggcucccuggugacaugcgccaaguuccagugucuggagcccaucgagggcaagguugugcaguacgagaaccucaaguauaccgugaucaucaccguccauaccggggaccaacaccagguggggaaugagacccagggggucacggccgagaucacgccccaggccagcaccaccgaggcgauccugcccgaguacgguacccuggggcucgagugcuccccgcgcaccgggcuggacuuuaacgagaugauccugcucacgaugaagaacaaggccuggauggugcaccggcagugguucuucgaccugccccugcccuggacuagcggugccaccaccgagacgcccacuuggaacagaaaggagcuccugguuacauucaagaacgcccacgccaagaaacaggaggucguggugcuggggucccaggagggcgcgaugcauaccgcccucacgggagccacagagauccagaauagcggggggaccuccauuuucgcaggccaccucaagugcaggcugaagauggacaagcucgagcugaagggcaugucauacgccaugugcaccaacacuuucgucuugaagaaggagguguccgagacccagcacgggaccauacucaucaagguggaguacaagggcgaggacgucccgugcaagauccccuucagcaccgaggauggucaggggaaggcgcacaacgggcgccugaucacggcgaaccccguggugaccaagaaagaggagcccgucaacaucgaggcggagccacccuuuggggaaagcaacaucgugauugguaucggggacaacgcccugaagaucaacugguauaagaagggcuccagcauugggaagauguucgaggccaccgcccggggagcucgacggauggccauccugggcgacaccgcgugggacuucgggagcgugggcgggguacuaaacagccuuggcaagauggugcaccagaucuucggguccgcguacacggcccuguucagcggcgucuccugggucaugaagaucggcaucggggugcuccugaccuggaucggucugaacagcaagaacaccuccaugagcuucuccugcaucgccaucgggaucauuacccucuaccugggcgcagugguccaggccgacauggguugcgugauaaacuggaagggcaaggagcuuaagugcggcagcgggaucuucgugacgaacgagguacacaccuggaccgagcaguacaaguuccaagcggacucccccaagaagcucgcaaccgccaucgccggcgcgugggagaacggaguguguggcauacgcagcacgacccgaauggagaaccugcuguggaagcagaucgcgaacgaauuaaacuacauccugugggagaauaacauaaagcugacaguggucgugggggauaucauuggggugcucgagcagggaaagcggacccugacaccccagccgauggagcucaaguacuccuggaagaccugggggaaggcaaagaucguaaccgccgagacccagaacagcuccuuuaucaucgacgggcccaacacgcccgagugucccagcgccagccgagcguggaacgugugggagguggaggacuacggcuucggcgucuucaccaccaacaucugguugaaguugagggagguguacacccagcugugcgaccaccgcuuaaugagcgcugccgugaaggacgagcgggccguccacgccgacaugggcuacuggaucgagagccagaagaacggguccuggaagcuggagaaggcaagccugaucgaggugaagaccugcacguggcccaagucccacacgcucuggagcaacggcgugcuggaguccgacaugaucaucccuaagagccuggccgggcccaucucccagcacaacuaccgccccggauaccauacccagacugcggggcccuggcaccucggcaagcucgagcuggacuucaacuacugcgagggcacgaccgucgugaucacggagaacugcgggaccaggggcccuucgcuccgcacgacuacgguguccgggaagcuuauccacgaguggugcugccggagcugcacccugcccccgcuucgcuacaugggcgaggacggcugcugguacggcauggagaucaggcccauauccgagaaagaggagaacauggucaagagccugguuuccgccggauccggggagguggacaacuucaccaugggcgucuuaugucucgccauacuguucgaggaggugaugcgcgggaaauucggcaagaagcacaugauugcggggguguucuucaccuucguccugcuccuguccggccagaucaccuggcgggacauggcccacacccugaucaugaucggaagcaacgccucugacagaauggggaugggcgugacguaccucgcccugaucgccaccuuuaagauccagcccuucuuggcgcucggguucuuccuacgcaagcugaccagccgcgagaaccuccugcuuggcgugggccucgccauggccacuacgcugcaacugcccgaggacaucgagcagauggccaacgggaucgccuugggccugauggcccugaagcucaucacccaauucgagaccuaccagcuguggaccgcgcuaaucagcuuaacgugcucuaacaccauauucacccuuaccgucgccuggcgcacggcgacccugauccucgcaggggugagccugcugccggucugccaguccagcuccaugcgcaagacagacuggcuccccaugaccguggccgccaugggagugccgccgcucccgcuguucaucuucagccucaaggacacacuuaagcggcgcuccuggccccugaacgagggagucauggcgguuggcuuggugagcauucuggccuccagcuugcucagaaacgacguccccauggcgggcccccugguggccgggggccugcucaucgcgugcuacgugaucaccgggacauccgccgaccugaccgucgagaaagccgcggacgugacgugggaggaggaggccgagcagacaggcguuucccauaaccugaugauaaccgucgacgacgacggcaccaugcggaucaaggacgacgagaccgagaacauccucacggugcugcugaaaaccgcccuccugauuguguccggcaucuucccguacagcaucccagccacccugcucgucuggcauaccuggcagaagcagacccagcgcucgggcgugcuuugggacgugcccuccccgcccgagacccagaaggccgaguuagaggagggagucuaccggaucaagcagcagggcaucuucgggaagacccaggugggcguggggguccagaaggagggcguguuccacaccauguggcacgugacgcgcggcgcaguccucaccuacaacgggaagcggcuggagcccaacugggcaucuguaaagaaggaccugaucagcuauggcgggggguggcgcuuaucggcccaguggcagaagggggaggaggugcaagucaucgccguugagcccggcaagaaccccaagaacuuccagacuaugccuggcacuuuccagacgaccaccggggagaucggagcgaucgcacuggacuucaagcccgggaccaguggaucacccaucauuaaucgggaaggcaagaucguugggcuguacggcaacggcgucgugacgaagaacggcggguacguauccggcaucgcccaaaccaaugccgagccggacggccccaccccagagcuggaggaagagauguucaagaaacgcaaccucaccaucauggaccugcaccccgggagcggcaagacacgaaaauaccugccggccaucgucagggaggcgaucaaacggcgacuccggacccuuauccuggccccaacccgcgugguggccgccgagauggaggaggcccucaaggggcugcccauccgguaccagaccacagcgacgaaguccgagcauaccggucgcgagauugucgaccugaugugccacgccacuuucacgaugcgccuccugagccccgugcgcgugccaaacuacaaccuuaucaucauggacgaggcccacuucaccgaccccgccuccaucgccgcgcggggguacauauccacccgcgucggcaugggcgaggccgccgccaucuuuaugacugcgacgccgcccgggaccgccgacgccuucccgcaguccaacgcccccauccaggacgaggagcgggacauccccgaacgcucuuggaacuccggcaacgaauggauuaccgacuucgccggaaagaccguuugguucgugccgagcaucaaggcaggcaacgacaucgccaacugccuccgcaagaacgggaagaaggucauccaguuguccagaaagacguucgacaccgaguaccagaagacgaagcugaacgacugggacuucguggugaccacagauaucagcgagaugggcgccaacuucaaggccgaccgagucaucgacccgcggcgcugccucaagcccgugauccuuaccgacggucccgagcgggugauucuggcggggcccaugccggucaccgcggccuccgccgcccagcgccggggccgcgugggucggaacccccagaaggaaaacgaccaauacaucuucaccggccagccccucaacaacgacgaagaccacgcccacuggaccgaggcgaagaugcugcuggacaacaucaacacgcccgaagggaucaucccggccuuauucgagcccgagcgagagaagucugccgcaaucgacggcgaguaccggcugaagggcgagucccgcaagaccuucguggaguuaaugcggcgcggggacuuacccgucuggcucgcgcacaagguugccagcgagggcauaaaguauaccgaccggaagugguguuucgacgggcagcgcaacaaccaaauccuggaggagaacauggacgucgaaaucuggaccaaggagggcgagaagaagaaacuccggccccgcuggcuggaugcacggacuuacuccgaccccuuagcacucaaggaguucaaggacuuugcggcgggccgcaagucaaucgcccuggaccuggucaccgaaaucgggcgcgugcccacccaucucgcccaccggacccgcacggcucuggacaaccuggucaugcuacacaccuccgagcacggcgggaaggccuaccgacacgccguggaggagcugcccgaaaccauggaaacccugcuccugcugggccucaugauccugcugacagguggggccaugcuguuccugaucagcgggaaggggaucggcaaaaccucaaucggacuuaucugcgugaucgccucgagcggcaugcucuggauggccgaaauaccgcugcaauggaucgccuccgcgaucguccuggaguucuucaugaugguucuccugauccccgagcccgaaaagcagcgcacgccccaggacaaccagcuggccuacguggucaucgggauccucacccuggcagccaucauugccgcgaacgagaugggccugcucgagacgaccaagcgcgaccucggcaugagcaaagagccggguguggugucccccaccagcuaccuggacgucgaccuccaccccgcgucggcuuggaccuuauacgccguggcgacgaccgugaucaccccuaugcugaggcacaccaucgagaacagcacggccaacgucucccucgccgcaauagcgaaucaggcugugguuuugaugggucuggacaagggguggcccaucagcaagauggaccucggaguuccccugcuggcacucgggugcuacucccaggugaacccccugacucugaccgccgccgugcugcugcugauuacucauuacgccaucauaggcccuggcuuacaagcgaaggccacgcgugaggcccagaagcgcaccgccgcagggaucaugaagaacccaaccgucgauggcaucaugacuaucgaucuggaucccguaaucuaugacagcaaguucgagaagcagcugggccaggugaugcuccuggucuuaugcgcgguacagcuccugcugaugagaacguccugggccuuaugcgaggcccugacccuggccaccggccccaucaccacgcucugggaaggaagccccgggaaguuuuggaacacuaccaucgcgguguccauggccaauaucuuccgcggcagcuaccuggccggggccggccuugcuuucucuaucaugaaguccgucggcaccggcaagcguggcaccgggucccagggcgagacgcucggggagaaguggaaaaagaagcuaaaccagcugucucgcaaggaguucgaucucuauaagaaaaguggcaucaccgagguggaccggaccgaggcgaaggaagggcugaagcgcggcgagaucacccaccacgccgugucccggggcagcgccaagcugcagugguucguggagcgcaacauggugaucccggaggggcgggugaucgaccuaggcugcggacgcggcgguugguccuacuauugcgcuggccugaaaaaggucacggaggugagaggcuauaccaagggcgggcccgggcaugaggagcccgugcccaugagcacguacggcuggaacaucgucaagcuuauguccgggaaggacguguucuaucucccgcccgagaagugcgacacccugcugugcgacaucggggagagcucccccagccccacgguugaggaaagccgcaccauacggguccugaagaugguggaaccgugguugaagaacaaccaguucugcaucaaggugcugaaccccuacaugcccacggucaucgagcaccuggagaggcuccagcgcaagcacggugggaugcuggugaggaacccccugagccgcaacuccacccacgagauguacuggaucagcaacggcacggguaauaucguggcguccgucaacauggugagccgacucuuguugaaccgcuucacgaugacccaccggcgcccgaccaucgaaaaggacguggaucucggcgcgggcacgcggcacguuaacgccgagcccgagacccccaacauggacgugauaggggaaaggaucaagcggaucaaggaugagcacaacuccaccuggcacuacgacgacgaaaacccguacaaaaccugggccuaccauggcagcuacgagguaaaggccacgggguccgccagcagcaugaucaacggcgucgugaagcugcugaccaaacccugggacgucguucccaugguaacccagauggcgaugaccgacacgacccccuuugggcagcagcgcguauucaaggagaagguggacaccagaaccccgcgcagcaugcccggcacgagacgggugaugggcaucaccgcugaauggcucuggagaacccuggggcgaaacaagaagccucggcugugcacccgcgaggaguucacgaagaagguccggaccaacgccgcuaugggcgccguguucaccgaggaaaaccagugggacuccgccaaggcggccguggaggacgaggacuucuggaagcucgucgacagagagcgcgaacugcacaaacuuggaaagugcggcuccugcguguacaacaugauggggaagcgggagaagaagcuaggcgaguucggcaaggccaagggaagccgcgcgauuugguacauguggcugggggccagauaccucgaguucgaggcacucggauuccugaacgaggaccacugguucucccgcgagaacaguuacuccggcguagagggggaaggcuugcacaagcugggcuauauccugcgggacaucagcaagaucccugggggcgccauguacgccgacgacaccgccgggugggacacccgcaucacggaggacgaccugcacaacgaggagaagaucacccagcagauggacccggaacaccggcagcuugccaacgccaucuucaagcugacguaccagaacaaggucgugaaagugcaacgccccacucccacgggcaccgucauggacaucaucucccggaaggaccagcgcggcucgggccaggugggcaccuaugggcugaauacguucacuaacauggaagcgcagcucauccggcagauggagggcgagggggugcuguccaaggccgaucuggagaauccccaccucccagagaagaagauuacccaguggcuggagaccaagggcgucgagcgccugaagcggauggcgaucagcggcgacgacugcguggugaagcccaucgacgaccgauucgccaacgcccuccuggcccugaaugacauggggaagguccggaaggacaucccccaguggcagccauccaagggcuggcacgacuggcaacaggucccguucuguagccaccacuuccacgagcucaucaugaaggacgggcgcaagcugguagucccgugccggccccaggacgagcugaucggccgcgcccgcauuucccagggggcgggcuggagcuuacgcgagaccgccugccugggcaaggccuacgcccagauguggucccucauguacuuccaucgccgcgaccuccgcuuggcgagcaacgcgaucugcucugccgugcccgugcacugggucccaacuucgcggaccacaugguccauccacgcccaccaucaauggaugacuacagaggacaugcuuaccguguggaaucgcguguggaucgaggacaaccccuggauggaggauaagacgccggucaccacgugggagaacgugcccuaccucgggaagcgggaggaccaguggugcggcagccugauagggcugaccagccgcgccaccugggcgcagaacauaccgaccgccauccagcaaguccggucccucaucgguaacgaggaguuccuggacuacaugcccucgaugaaaagguuccggaaggaggaggaguccgagggugcuaucugguga

SEQ ID NO: 26012 - RNA, 9873 nt, Artificial Sequence
  derived and/or modified CDS sequence (opt11) from DENV-3__FJ182015__SS-prME
acgucacucugccugaugaugauccugccggccgcccuggcuuuucaccuuacaagucgggacggcgaaccccggaugauuguggggaaaaaugaacggggcaagucccuacuuuucaaaaccgcuagcgggaucaauauguguacauugaucgccauggaccuaggcgaaaugugcgacgacacgguuacguauaagugcccccacaucacugagguugagccagaggacaucgauugcuggugcaaccugacgucaaccuggguaacuuaugggacaugcaaucaagccggcgagcaccggcgcgauaagcggucgguagcgcuugcgccgcacguaggcaugggucuggauacccgcacgcagacauggaugucggcugaaggcgcguggcgccaaguagagaagguagagaccugggcccugagacacccgggguucacaauccucgcgcuguuccucgcccacuacauagggaccagucuaacccagaaaguagugaucuucauacugcugaugcuugucacgccgagcaugacuaugagaugcgugggcguuggaaacagggacuucguggagggccugagcggagccaccuggguugacgugguacuggagcacggggguugcgugacaaccauggccaagaacaagccgacucuugacauagagcugcagaagaccgaagccacacagcuugcgacgcucaggaagcugugcauagaaggaaaaaucacuaacauaacgaccgauucucgcugcccuacccagggggaggccgugcucccggaggaacaagaccagaauuacguauguaagcauacauacguggaccggggguggggaaacgggugcggcuuauucgguaagggcucgcucgugaccugcgcgaaauuccaaugccucgaacccaucgaaggcaaaguaguccaauacgaaaauuugaaguacaccgugauaauaacgguccacacaggggaccagcaucaggugggcaaugaaacccagggggucaccgcggagaucacaccccaagccaguacgaccgaggcgauccucccggaauacggaacccuaggguuggaguguuccccacgcaccggcuuggauuucaacgagaugauccugcuuacgaugaagaacaaagccuggauggugcaccggcagugguucuucgaccuaccccugccguggacgagcggcgccacaacugagacgccaacguggaacagaaaggaacuccuggugacauucaagaacgcccaugccaagaagcaagaggucguggugcuggggucacaggaaggcgcgaugcacacugcccucacuggggcgacugagauucagaacagcgggggcacgucgauauuugccggacaccugaagugccguuuaaagauggacaagcucgagcucaagggcauguccuacgccaugugcacgaacacguuuguacucaagaaggaggucuccgaaacccagcacggcaccauauuaaucaagguggaauacaagggcgaggaugugccgugcaaaauccccuucucaaccgaagaugggcagggaaaggcccauaaugguagauuaauuacggccaacccggugguaaccaagaaggaagaaccagucaacaucgaggccgagccuccuuucggggagucgaauaucgugaucgggauuggggauaacgcauuaaaaauuaacugguacaaaaagggcagcaguaucggcaagauguucgaagcgaccgcuagaggagcgcgccggauggcaauccugggcgacacagcuugggacuucggguccguuggaggcguccucaauagccugggcaagauggugcaucagauauuuggguccgcguauacggcguuguucagcggcguguccugggucaugaagaucggcauuggugugcuauuaaccuggaucggccucaacagcaagaacaccaguaugucguucuccugcaucgccaucgguaucaucacccuauaccugggcgccgucgugcaggccgacauggggugcgucaucaacuggaaagggaaggagcugaaguguggcagcgggauauuugugacgaacgaaguccacaccuggaccgaacaguacaaguuccaggcggacucacccaaacgccucgcuacugcaaucgccggggccugggagaacggggugugcgguaucaggagcacgacccggauggagaaccuucuauggaagcaaaucgcaaaugagcucaauuauauucugugggagaacaacauaaaguuaaccguaguuguuggugauauaauuggcgucuuggagcagggcaagcgaacucucacgccccagccgauggaacugaaguauuccuggaagaccugggggaaggcgaagaucgucaccgcugaaacccagaacucuucguucaucauagacggacccaacacgcccgaguguccuagcgccagccgggcguggaauguaugggaaguagaagacuacgguuucggggucuuuacaaccaacaucuggcuaaagcugcgcgagguguacacccaacucugcgaccaccggcugaugagcgcagccgucaaggacgagcgcgccgugcaugcggacaugggcuacuggaucgaaucccaaaagaacgggagcuggaagcuggagaaggcgagccugaucgagguuaagaccugcacauggccgaagucccacacccuguggaguaauggcguccuggagucagauaugauuauaccgaaaagccuggccgggccaaucucccagcauaacuaucgaccuggauaccauacacagaccgccgggcccuggcaccuaggaaaacuggaacuggacuucaacuacugcgaggggacgacagucgugaucacagagaacugcggaacacgcggaccaucgcuccgcacgaccaccgugaguggaaaacucauucacgagugguguugcagaucauguaccuugcccccguugagauacaugggcgaagaugggugcugguacgggauggagauucgccccaucucugagaaggaggagaacauggucaaaucgcuugugagugccggcucaggggaagucgauaacuucaccaugggcguccugugccucgccauacuguucgaggagguaaugcgggggaaauucggcaaaaagcacaugauugccgggguguucuucaccuucguccuucuucuauccggccagauaaccuggcgcgacauggcccacacccugaucaugaucgguuccaacgcguccgaccggaugggaaugggcgugaccuauuuggcccugaucgccaccuuuaagauacagccauuccuggcgcuuggguucuuccugcgcaagcuaaccagccgugagaaccuccugcuuggcgucggccuggccauggccacgacauuacagcuacccgaggacaucgaacagauggccaacgggauagcgcucggccugauggcauugaagcucauaacccaguuugagaccuaccagcuguggaccgcccuaauuucgcuaacgugcagcaacaccaucuuuacccugacugucgccuggcgcacggccaccuuaauccuggcgggggugucgcuccugcccgucugccagucgucuuccaugcgcaagacagacuggcucccaaugaccguggccgccaugggcgugccgccccuuccacuguucauauuuucccuuaaagacacacugaagagacgguccuggccccucaaugaggggguaauggcgguaggucuaguaagcauccuggccucaagccugcugcgcaaugacguccccauggcaggcccgcuuguggccggcggccuucucauagcgugcuacgugaucacugggaccuccgccgaccuuaccgucgagaaggccgcagacgugacaugggaggaggaggcugagcagaccgggguuagucacaaucugaugaucaccgucgacgacgacggcaccaugaggaucaaggacgacgaaaccgaaaacauucucaccgugcuucugaagaccgcucuccuuaucgugucaggaauuuucccguacagcaucccugcgacacuguuggucuggcacaccuggcagaagcaaacccaaagaucaggcguacugugggacguacccuccccgccugagacacagaaagcggagcuagaggaagguguguaccgcaucaagcagcaaggcaucuucggaaagacgcaaguaggcgucgggguccagaaggaaggcguauuccacaccauguggcaugucacgcguggugccguccucacauacaacgggaagagacucgagccuaauugggcguccgugaagaaggacuuaaucuccuauggcgggggcuggaggcucagugcucaguggcagaagggggaggaggugcaggucauagccguagagccaggaaagaaucccaagaauuuccaaaccaugcccggcaccuuccagaccaccaccggggagaucggcgccaucgcccucgacuucaagccagggacgucugguagccccauuaucaaccgcgagggcaaggugguaggguuauaugguaacggugugguuacgaaaaacgguggguacgucuccggcauugcgcagacaaacgccgagcccgauggcccgacgccagaguuagaggaagaaauguuuaagaagcggaaccucaccaucauggaucugcaccccgggagcggaaaaacgcgcaaguaccuuccggccauuguacgugaggcaaucaaacggcggcugagaacucugauccuagcgcccacccgcgugguagccgcggagauggaggaagcccucaaaggauugcccauccgcuaucaaacaacugcuacuaaguccgaacacaccggccgggaaaucguggaccugaugugccacgcaaccuucacgaugcgucuccugucccccguacgggugccgaauuacaaccugaucaucauggacgaggcccauuucaccgaccccgccuccaucgccgcgaggggguauauaucaacacggguggguaugggcgaggcggccgccaucuucaugaccgcgacgccaccggggacggcagacgcauuuccacaguccaacgcccccauccaggaugaagaacgggacaucccugaacgcucguggaacucgggcaacgaguggauuacugacuucgccgggaagacagugugguuugugcccucuauuaaggcaggcaacgacauugccaacugucuccggaaaaacgggaagaaggugauccaauuaucucgcaagacguuugauacagaguaccagaaaaccaaacugaacgacugggacuucguagucaccaccgauauaagugaaaugggagccaauuucaaggccgaucgggucaucgacccgcgccggugccucaagcccgucauccugacugacggccccgaacgcgucauccuggccggccccaugccggugacagcagccucagccgcccagcggcgcggucgggugggacgcaauccgcagaaggagaaugaccaauacauuuucacuggccagccccuaaauaacgacgaggaccaugcacacuggacagaggcgaaaaugcuucuggacaacauaaauacgcccgagggaaucauaccggcacucuucgagccugagcgggagaaguccgccgccaucgauggcgaguaucggcugaaaggagaauccaggaagacuuucguugagcugaugcgucgcggagaccuuccuguguggcuagcgcauaaggucgccagcgagggaauaaaguacaccgaccgaaaguggugcuuugacgggcagcgcaauaaccagauccuagaagaaaacauggacguggagauuuggacaaaagagggcgagaagaagaaguugcggccccgcuggcuggacgcucgaacuuauagcgacccgcuugcacucaaggaauuuaaggacuuugcugcgggacgcaaaaguaucgcucuggaucuuguaacggaaaucggacggguccccacccacuuagcccaucgcacucggaacgcccuggacaaccuaguuaugcuccauacgagugagcacggggguaaggcuuaccggcaugccgucgaggaguuaccugagaccauggagacucuguuauugcugggccucaugauucugcucacagggggcgcuaugcuauucuugaucagcggcaaagguaucggcaagaccagcauagggcucauuugcguaaucgccuccagcggaauguuauggauggccgagauuccgcugcaguggaucgccuccgcgaucgugcuggaguucuuuaugauggugcuguuaauacccgagccugagaagcaacggacuccacaggauaaucaacucgccuauguaguaaucgggauccucacccuggcggccaucauagcagcgaaugagaugggccugcucgaaacgacgaagcgugaccugggcaugagcaaagagccaggggugguguccccgacgucuuaccucgauguugaccuacacccagcauccgccuggaccuuauacgccgucgccacgacgguuaucacccccaugcuacggcauaccaucgaaaauagcaccgccaacgucagcuuggccgccaucgccaaucaggccgugguucucaugggccuggacaagggguggccgaucagcaagauggaccucggcgugccccugcuggcucugggauguuacucacaaguaaacccgcugacucucacagccgccgugcugcugcucaucacccacuacgccaucauaggaccugggcuccaggcuaaggccacgcgagaggcucaaaagcggacugccgcagggaucaugaaaaacccuaccguagacggcaucaugaccaucgacuuggaccccgugauauacgauucuaaauucgagaaacagcuggggcagguuaugcuccuggugcugugcgcugugcaacuccugcugaugcgcacauccugggcccugugugaagcguugacguuggcuaccggacccauuacuacauuaugggagggcuccccggggaaguucuggaacacgacuaucgccgucucaauggcaaacaucuuccgcggaagcuaccuggccggggcaggccuggccuuuagcaucaugaaguccgucggaacugguaagaggggaaccggaagccagggagaaaccuugggggaaaaguggaagaagaaacuuaaccagcucucgcggaaagaguucgaccucuacaagaagucgggcaucacggaaguggaccgcacugaggccaaggaggggcugaaaaggggcgagaucacccaccacgcgguaagucgcggcagugccaaguugcagugguucguggaacggaacauggugaucccagagggaaggguuaucgaucuaggcugugggcggggcgggugguccuauuacugugccggcuuaaagaaagugaccgaaguccggggcuacacuaagggcggaccugggcaugaggaaccgguccccaugagcacuuacgguuggaacaucgugaagcucaugucagggaaggauguguucuacuuaccacccgaaaagugcgacacccugcuaugugacaucggcgagagcucacccucccccacagucgaagagucccggaccauccgagucuugaagaugguggagccgugguuaaagaauaaccaguucugcauuaagguacugaacccuuacaugcccaccgugaucgagcaccuggagcggcuccagcguaagcacggcgggaugcuggugcgcaacccucugucgcgaaacuccacccacgagauguauuggaucagcaauggaacagggaacaucgucgcuuccgugaacauggucagccgguuacugcuaaaccguuucaccaugacccaccgccggccaacaaucgagaaagaugucgaccucggcgcggggaccagacacgugaacgccgagccagagacucccaacauggacguuauaggggagcgaauaaagcgcauuaaggaggagcacaacucaacguggcauuacgaugacgagaacccguacaagacgugggcuuaccacggcucauaugaggucaaggccacugggagugcaucauccaugaucaacggaguggucaaacuguugacgaaacccugggacguuguccccauggucacacagauggcgaugacugacaccacgcccuucggccagcagcggguauuuaaggagaagguggacaccagaacaccccguagcaugccaggcaccaggcgcguuauggguauuaccgcggaaugguuguggcgcacccuggggaggaacaagaagccucguuuaugcacccgugaggaguucaccaaaaagguucgaacgaacgccgccaugggcgcgguguucacggaggaaaaccagugggacucugcgaaagcugccgucgaagacgaggacuucuggaagcucguugaccgcgagagagagcugcacaagcuggggaagugcggcaguugcgucuauaacaugaugggcaaacgcgagaaaaagcugggcgaguucggcaaagccaaagguucacgugcgauaugguacauguggcucggagcacgcuaccuggaguucgaggcccucggcuucuugaaugaggaccacugguucagucgggaaaauagcuacuccgggguagaaggggagggcuugcauaaauuaggcuauauccuucgcgacaucagcaagauucccgggggugccauguacgccgacgacaccgcggguugggacacccggauuacggaagacgaucuucacaacgaagagaagauuacccagcagauggauccggaacacagacaacucgcgaaugccauauucaagcucaccuaccagaacaagguugugaagguccagcggcccacgccgaccggcacggugauggauaucaucucaagaaaggaccaacguggaagcggacaggugggcaccuacggucugaauaccuucaccaacauggaggcucagcuaauacgccagauggaaggcgagggcguccuguccaaggccgaccuggagaacccucaucugccggagaagaagaucacgcaauggcuggaaaccaagggugucgaacgucugaaacgcauggcgaucucaggggacgacugcgucgugaaacccaucgaugaccgauucgcgaacgcccuccuugcccuaaacgacaugggcaaaguacgcaaggacauuccgcaguggcagcccuccaagggcuggcaugacuggcagcagguaccauucuguucacaccacuuucaugagcucauaaugaaagacgggagaaaacuggucgugcccugucguccgcaggaugagcucaucggccgggcacgaauaucgcagggggcuggcuggagccugagagagacugcaugucugggcaaggccuaugcccagaugugguccuugauguacuuucauaggagggaucucaggcuggcaucaaacgccauauguuccgccguuccggugcacugggugccaacuucacggacuaccugguccauccacgcucaucaccaguggaugacgaccgaggacauguugacaguguggaaucgggucuggauagaagacaacccuuggauggaggauaaaacgccagugaccacaugggaaaacgugccauaccucggcaaacgcgaggaccaauggugcggcagcuuaauagggcuaacgagccgugcuaccugggcucagaauauuccgacagccauccagcagguccgcucacuaaucggaaacgaagaguuccuggacuacaugcccaguaugaagcgcuuucgcaaagaggaggaguccgagggcgcaaucugguag

SEQ ID NO: 26013 - RNA, 9873 nt, Artificial Sequence
  derived and/or modified CDS sequence (opt11) from DENV-3__EU569688__SS-prME
accagcuugugucucaugaugauccugcccgccgcucuggccuuccaccucaccagccgagacggggaaccccggaugaucguggggaagaaugaacguggaaagagccugcuguuuaagaccgcaucugggauaaacauguguaccuuaauagccauggaccugggagagaugugcgacgacacgguuacauacaaaugcccacacaucaccgaggcugaacccgaggacaucgacugcugguguaacuugaccaguaccugggugaccuacgggacgugcaaccaagcgggagagcaccggcgcgacaagcggucggucgcccucgcaccccacgugggcauggggcuggacacgcgcacccagacguggaugucagcugagggcgccuggaggcaggucgagaaaguggagacgugggcgcugcgccauccagguuucaccauucucgcccuguuccuggcacacuauaucggcaccucccuaacccagaaggucgugauauuuauccugcugauguuagugacgcccaguaugacgaugcguugcgugggggugggcaaccgugauuuuguggagggccugagcggggccaccuggguagacgugguccuggagcacggcgggugcgucaccacgauggcgaagaacaagcccacccuagauauagagcuacagaagacggaagcgacccagcuagccacgcuccgcaagcuguguauagagggaaaaauaacaaacauaaccaccgacucucgcuguccgacgcagggcgaggcugugcuaccggaggagcaagaccagaacuacgugugcaagcacaccuacguagaccggggguggggcaacgguugcggccucuucgggaagggaucguuggugaccugcgcaaaauuccaaugucucgagccuauugagggcaaggugguccaguaugagaaccucaaauacaccgugaucaucacugugcacacuggggaccagcaccaggucgguaacgagacucaagggguaaccgcugagaucacuccccaggcauccaccaccgaggcuauccugcccgaguauggcacccugggccucgagugcuccccgcgcaccggacuggacuucaaugagaugauccuguuaacgaugaagaacaaggccuggaugguacacagacagugguucuuugaucuuccgcuucccuggaccuccggcgccaccacagagacgccaacguggaaccgcaaggagcuacuggugaccuucaagaacgcccacgcgaagaagcaggaagugguaguguuggguucccaggagggggcgaugcacacggcgcuaacgggggccacugaaauccagaacagcggcgggaccuccaucuuugcaggccaccucaagugcaggcugaaaauggacaagcucgaacugaagggcaugaguuacgcgaugugcaccaacacguucgugcuuaagaaggaggucuccgagacccagcaugggaccauacucaucaagguggaguauaagggugaggacgugccgugcaagaucccuuucagcacugaagacggccagggcaaggcgcacaacggccgccugaucaccgccaaccccgucgugaccaagaaggaagaacccgugaauaucgaggcggagccgccauucggugaaucuaacaucgucaucggcauuggggacaaugcccugaagaucaauugguacaagaagggcuccagcaucgggaagauguucgaggccaccgccaggggcgccagacggauggcuauccugggcgacaccgcgugggacuucggauccgugggcggggugcucaacagccuuggcaagaugguccaucagaucuucggcuccgccuacacggcgcuguucagcggcguguccugggugaugaagaucgggaucggaguccuccugaccuggauaggccugaacaguaaaaacaccuccaugagcuucuccugcaucgcgauugggauuauaacccucuaccugggcgccguggugcaggcggacauggguugcgucauaaacuggaagggcaaggagcugaagugcgguagcgggaucuucguaacgaacgaggugcacaccuggaccgagcaguacaaguuccaggccgacuccccuaaacgauuagcaaccgcgauugccggugccugggagaacggagucuguggcauucgcucaacgacuagaauggagaacuugcuauggaagcagaucgccaacgagcucaacuacaucuugugggagaauaauaucaagcugacugugguggucggugacaccauaggcguccuggagcaggguaagcguacucugacgccccagccgauggaacugaaguacuccuggaaaacgugggggaaggccaaaaucgugacggccgagacgcaaaacagcuccuucauaaucgacggcccaaacaccccagagugccccuccgcgucccgggcguggaaugucugggaaguugaggauuacggguucggcguguucaccaccaacaucugguuaaagcugcgcgaggucuacacacaacugugcgaccaucggcucauguccgcggccgugaaggaugagcgcgccguccacgcggauaugggcuacuggaucgagagccagaaaaacggcagcuggaagcuggagaaagccagccugauugaggucaagacguguacauggccgaagucccacacacucuggucgaacggggugcuggagucugauaugaucauacccaagagccuggccggacccauaucccagcauaauuaccggccggguuaccauacucagacggccggucccuggcaucucggcaaacucgagcuggacuuuaacuacugugagggcaccaccguggucauaaccgagaauugcgggacgcgcggcccuagccuccggaccaccaccguguccgggaagcugauacacgaauggugcugccggagcuguacgcugccgccgcucagguacaugggcgaggacggcugcugguaugguauggaaauccgucccauuagugagaaggaggaaaacaugguaaagagccuggucuccgccgguagcggggaaguggacaacuucaccaugggagugcucugccucgccauucuguucgaggagguaaugagaggaaaguuuggaaagaagcacaugauagccgggguguucuucaccuucguguugcuccuaucgggacagaucaccuggcgcgauauggcccacacgcucaucaugaucgguagcaacgccuccgaccggauggggaugggcgucacauaccucgcccucauugccaccuucaaaauccaaccguuccuugccuuaggguucuuccugcggaagcugacgagccgggagaaccuccuucuggguguuggucucgcaauggccacgacgcuacagcuccccgaagacaucgaacagauggcgaacgggauugcccucggccugauggcccuuaagcucauaacccaauucgagaccuaccagcuguggacggcccugaucagccugacgugcuccaacacuaucuucaccuuaacgguugccuggcgcacugcaacccugauuuuggccggggucagucugcugcccgugugccaguccagcaguaugcgcaaaaccgacuggcugcccaugacggucgcagccaugggggugccgccccucccacuguucaucuucagccucaaggauacguuaaaacgccggagcuggcccuuaaacgagggggucauggcgguuggccuugugucgauacuggcguccagccugcuccggaacgacgugccuauggccggccccuuaguggccggaggacuguugauagcguguuaugugaucaccgggacuuccgccgaccuuacgguggagaaggcggccgacgucaccugggaggaggaggccgaacagaccggcgugagccauaaccugaugaucaccguggacgacgacgggacgaugagaaucaaggaugacgagacggagaauauccucacgguucuccuaaagaccgccuugcugauaguguccggcaucuucccguacagcauccccgccacccuacucguguggcacacguggcaaaagcagacccagcgguccggcguccugugggacgugcccuccccgcccgagacacagaaggcggagcuggaagaggguguguaucggaucaagcagcagggcaucuuugggaagacgcaagucggcgugggggugcagaaggagggcgucuuccacacgauguggcaugugacgaggggcgccgugcucaccuacaacgggaagaggcuggagccgaacugggccuccgucaagaaagaccugaucucuuacggcggaggguggcggcuguccgcgcaguggcagaaaggugaggagguccaggucauagcggucgagcccggcaaaaaccccaaaaauuuucagaccaugcccggcacguuccagacuacaaccggugagaucggugcuauugccuuagacuucaagccagggacgagcgggucacccauuaucaaccgcgaagggaagguggucggguuguauggcaacggggugguuaccaagaacggcgguuacguguccggcaucgcccagacaaacgccgagccugacggcccaacccccgagcuagaggaggaaauguucaagaaacggaaucucacuauaauggaccuccaccccgggagcggcaagacccgcaaguacuugccggcgauaguucgggaggccauaaagcgccggcuccgcacgcugauacuggcucccacccgggucguggccgccgagauggaggaggcgcucaagggucugcccauucgcuaccagacgaccgccaccaaguccgagcauaccggccgggagaucgucgaccucaugugccacgcaacguucacgaugcgccuccugucgcccgugagagugccgaacuauaaccugaucaucauggacgaggcucauuuuacagaccccgccuccaucgcggcacgcggguauauuuccacccgggugggcaugggcgaggccgccgcgaucuucaugacagccacaccgccagggaccgccgacgccuucccgcagucgaacgcccccauacaggacgaggagcgcgacauuccagagcggucauggaacucuggcaacgaguggauaacggacuucgccgggaagacaguaugguuugugcccuccauuaaggccggcaacgacauagcaaacugccuccggaaaaauggcaagaaaguaauucaacugucccgcaaaaccuucgacacugaguaccagaagaccaaguugaaugacugggauuuuguggucacgaccgacaucagcgagaugggcgccaauuucaaggccgaccgggucauugacccacgccgcugccucaagcccgugauccucaccgacggccccgagcgcgugauccuggcgggcccuaugccggugacugccgccucugccgcccaacggcguggccggguggggcgcaacccccaaaaggaaaaugaccaauacaucuucaccggccagccacucaauaacgacgaggaccaugcgcauuggacggaggccaaaaugcugcuggacaacaucaacacccccgaagggaucauaccggcucucuuugagcccgaacgagaaaagagcgccgcuaucgacggcgaguaccgccuuaagggcgagucccggaagaccuuuguggagcugaugcgccgcggggaccuccccgucuggcuggcccacaaagucgccagcgagggcauaaaguacaccgaccgcaaguggugcuucgacgggcagcggaacaaccagauccuggaggagaacauggauguggagauuuggaccaaggagggcgagaagaaaaagcuccgccccagguggcuggacgcccgaacguacucggacccccuggcucugaaggaguuuaaggacuuugcggccggcagaaagagcauugcacuggaccugguuaccgagauagggcggguucccacacaccucgcccaccgcacgcggaaugcacuggacaaccuggucaugcuccacaccagugagcacggaggaaaggcguaccgccacgccguagaggagcugccggagaccauggagacgcuguuacuguuggguuugaugauccugcugaccggcggggcaaugcucuuucugauuagcggaaaggggauaggcaaaacgagcaucgggcugaucugcgugauugccuccagcggcaugcucuggauggcagagaucccgcugcaguggaucgcguccgccauuguccuggaguucuucaugaugguucucuuaauucccgagcccgagaagcagcguacgccgcaggacaaccagcuugcauacguugucaucgggauccucacucuggcagccauuaucgcggcuaacgagauggggcuguuagagacgaccaaacgcgaccugggcaugagcaaggaaccggguguggucuccccgacgucguaccucgacguugaccuacaccccgccuccgcuuggacccuguacgcggucgcaacgaccgugaucacuccuaugcugcggcacaccauagagaacagcacagccaacgucucccuagccgccaucgcgaaccaggccguuguacugauggggcuggacaagggauggccgaucagcaaaauggacuugggcgucccccugcuggcccucgggugcuacucccaaguaaauccccugacccucaccgcagccguguuacugcugauuacccacuaugcgaucauuggacccggccuccaggcaaaggccacacgcgaggcccagaaacggaccgcagcggggaucaugaaaaacccgaccgucgacgguauaaugaccaucgaccuagaucccguuauuuacgacaguaaguucgagaaacagcugggccagguuaugcuccugguccugugcgcagugcagcugcugcugaugcgcaccuccugggcccucugcgaggcgcuaacccucgcgaccggccccauaacgacccucugggaggguagcccggggaaguuuuggaacaccacuaucgcugucuccauggccaacaucuuccggggcaguuaccuggcgggggccggccucgcguucucuaucaugaaguccguggggaccgggaagcgaggcaccgggucccagggugagacgcugggugaaaaguggaagaagaaacugaaccagcugucccguaaggaguucgaucuguacaagaaaucgggcaucacggagguggaccgaaccgaggcaaaggaggggcugaagcggggugaaaucacccaccacgccgugucccguggcucggcaaagcugcagugguucgucgagcgaaauauggucauaccggaggggcgugugauugaccucggcugcggccggggcgggugguccuacuacugcgccggccucaagaagguaacggaggugcgcggguacaccaagggugggcccgggcaugaagaacccgugccgaugagcaccuauggcuggaacaucgucaagcugauguccggcaaggacguguuuuaccucccgccugaacggugcgacacgcugcugugcgacaucggcgaaagcuccccaucacccacgguggaggagucccggaccauacguguccugaaaaugguggagccguggcucaagaauaaccaauucuguaucaaggugcuaaaccccuacaugcccaccgucaucgaacaccuggagaggcuccaacggaaacauggcgggaugcucgugcgaaacccccucagcagaaacuccacgcacgagauguacuggaucagcaacggcacggggaauaucguggcgagugucaacaugguuagccggcugcugcugaaccgcuucaccaugacccaccggcgcccgacuaucgagaaagacguggacuuaggcgccggcacgcggcaugucaacgccgagcccgagacccccaacauggacguuaucggggagcgcauaaagcggaucaaagaagaacauaacuccaccuggcacuacgacgacgagaacccguacaaaacgugggccuaucacggcagcuaugagguuaaggcaacgggguccgcgagcuccaugaucaacggcgucgugaagcugcugacaaaaccaugggacguagugcccaugguaacccagauggcgaugaccgacacgacaccguucgggcagcagcgugucuucaaggagaagguggacacccgcaccccgcgcucaaugcccggcacgcggcgcgugauggguaucaccgccgaguggcucuggcggacccugggacgcaacaagaaaccacggcucugcacccgcgaggaguuuaccaagaaaguccgcacuaacgccgcaaugggcgccguguuuaccgaggagaaccagugggauagcgccaaggccgccguggaggacgaagacuucuggaagcucguggaccgggagcgugaauuacauaaacuggggaagugcggcuccugcguguacaacaugauggggaaacgggagaagaagcucggcgaguucggcaaggcgaagggcucgagagccaucugguauauguggcugggcgcgcgguaccuugaguucgaggcccucggguucuuaaacgaggaucacugguuuagucgcgaaaacaguuacuccgggguggaaggcgaaggccugcauaaguuaggcuacauccugcgggacauuagcaagauccccggcggggccauguacgcggaugacacggcaggcugggacacgagaaucacugaggaugaccugcacaacgaggaaaagaucacccagcagauggauccggaacacagacagcucgccaacgccaucuucaagcugaccuaucagaauaaagucgugaagguacagcgucccaccccgacgggcacagucauggacaucauauccaggaaggaccagcgcggcagcggccagguuggcaccuauggccugaacaccuucacgaacauggaggcccagcuuauccggcagauggagggcgagggggucuuguccaaggcggaccuagagaacccucaccucccugaaaagaagauaacacaauggcuggagacuaagggcgucgaacgccugaagaggauggccaucagcggcgacgacugcguuguuaaacccauugaugaccguuuugccaacgcucuccucgccuuaaacgauauggggaagguccggaaggacaucccccaguggcagcccucaaagggcuggcaugacuggcagcaggucccguuuugcagccaccacuuucacgaacucaucaugaaggacgggcgcaaacuggugguccccugcaggccccaggaugagcugaucggacgcgcacggaucucccagggggccggcuggagccucagggagaccgcaugccuuggcaaggccuaugcccagauguggucccugauguacuuccaccgccgcgaucuccgccuggccagcaaugccaucugcucagccgugcccguacacugggucccgacgagcagaaccacauggaguauacacgcccaccaccaguggaugacgacugaagacaugcugaccguguggaaucgcgucuggaucgaagacaaccccuggauggaagacaaaacacccgucacgacgugggagaacguacccuaccuugggaaacgggaagaucaguggugcgguucccugaucggguugaccagcagggcgaccugggcacagaacaucccgaccgccauccagcagguacggucccucaucggcaacgaagaauuucuggacuacaugcccagcaugaagcgauuccggaaggaggaggaguccgaaggugccaucugguag

SEQ ID NO: 26014 - RNA, 9873 nt, Artificial Sequence
  derived and/or modified CDS sequence (opt11) from DENV-3__EU529686__SS-prME
acaagccugugucuaaugaugauccugcccgcggccuuagcguuccaccucaccagccgggauggugagccgcggaugaucgugggcaagaacgagcgcgguaaaagccuguuauucaagaccgcgagcgggauaaacauguguacucucauugcaauggaccucggcgaaaugugcgacgacaccgugaccuacaaaugcccccacaucacugaggucgagccagaagacaucgacugcuggugcaaccuaaccucaaccugggucacguauggaacgugcaaccaggcuggcgagcacagacgcgauaagcggagcgucgcacuagcaccccacgucgguaugggacuggacacccgcacccaaacguggaugagugcagagggcgccuggcgucagguggagaaggucgagacgugggcccugcgccacccgggguucaccauccucgcgcuguuccuggcccacuacauaggaaccucccugacgcagaaaguggugaucuucauccuacugaugcuagucacgcccucaaugacaaugagaugugucggggucggcaaucgagacuucgucgagggucugucuggugccaccuggguggacgucguccuggagcauggcgguugcgugaccacgauggccaagaacaaacccacccucgacaucgaacuacagaagaccgaagccacacagcuggcgacccuccggaagcugugcauugagggcaaaaucacaaacaucaccaccgacagccgcugccccacucaaggcgaggcagugcugccggaggagcaggaccaaaacuaugucugcaagcacacuuacguggaccgggggugggguaacgggugcggccucuuugguaagggcucgcucgugaccugcgccaaguuccagugccuggagcccaucgaaggcaagguugugcaauacgagaaccucaaguacaccgugaucaucacaguccacaccggggaccagcaccaggucggcaaugagacgcagggugucaccgccgagaucacgccucaggcuucgaccacggaggcgauccugccugaguacggcacucuugggcucgagugcaguccacguacaggccuggacuucaaugagaugauacuccucacgaugaagaacaaagccuggaugguccaccgucagugguucuuugaccuuccccugcccuggaccucuggcgccaccacagagacgccaacauggaaccgcaaagagcuucuggugaccuucaaaaacgcccacgcgaagaagcaggagguuguggugcuggguucccaggagggagcgaugcacacggcucucacgggugcuaccgagauccagaacagcggcgggacgagcaucuucgcuggccaucugaagugccggcugaagauggacaagcucgagcugaagggcaugucguacgccauguguacaaacaccuuuguccugaagaaggagguguccgaaacccaacacgggaccauacuaaucaagguggaauacaagggugaggacgucccguguaagauccccuucagcacagaggacggccaaggcaaggcgcacaacggccgucugauaacugccaaccccguggugacuaaaaaagaggagcccguuaacauugaagccgagccgcccuucggggaaaguaacaucgugaucgguaucggggauaacgcccucaagauaaacugguacaaaaagggauccagcauaggcaagauguuugaagcgaccgcucgaggagcacgccggauggccauucugggcgacaccgccugggacuucgguuccguagguggagucuuaaacagcuuaggaaaaaugguacaccagaucuucggguccgcguacaccgcccuguucuccggcgucucuuggguuaugaaaauuggcaucgggguccucuugaccuggaucgguuugaacuccaagaacaccuccaugucguucuccugcauugcuaucgggauuaucacgcuauaccugggcgccguuguccaggccgacauggggugcguaaucaauuggaagggcaaggaacugaagugcgggagcgguauuuucgugacgaacgaaguccacaccuggaccgagcaguacaaauuccaggcugacucucccaagcgccucgccaccgccaucgccggggcuugggagaauggggugugcggcauccgcucuacuacccggauggaaaaccuucuauggaagcagauagcgaacgagcucaacuauauccugugggagaacaacaucaagcugaccguggucguuggggacaucauuggggugcuugaacagggcaagcgaacccugacuccgcagccgauggaacugaaguauuccuggaagaccuggggaaaagcaaagaucgucaccgccgagacccaaaacagcuccuucaucaucgauggaccgaacacgcccgaaugccccucugccucccgugcauggaacgucugggaaguggaggacuacgguuucggcguauucaccaccaacaucuggcucaagcugcgcgagguguacacucaguugugcgaccacaggcucaugagcgccgcagucaaagaugagcgggccguucaugcggacaugggcuacuggaucgagagccagaaaaacgggucauggaaguuagagaaagcgagccugaucgaggugaagaccugcacguggccgaagucucacacacucuggucgaacggaguguuggagucagauaugauaaucccuaagagccuggccgggcccaucucccagcacaacuaccggccugguuaccacacucagaccgcggggcccuggcaccucggcaagcuggagcuggauuuuaacuacugcgagggcacgacaguugugaucaccgaaaacugcgggacgcgcgggcccagccuccggacgacgaccguuuccgggaaacugauccaugaguggugcugccgcagcugcacccugccuccgcucagguacaugggugaagacgggugcugguacggcauggagaucagaccaauuuccgagaaggaggagaauauggucaaaagccugguguccgcuggguccggggagguggacaacuuuacaaugggcguccuaugccuggccauccuauucgaggagguaaugagggggaaguucgguaagaagcacaugaucgccggggucuucuucacauuuguccugcuccuguccgggcagaucaccuggcgcgauauggcccauacgcugaucaugaucggcucaaacgcuuccgaccggauggggaugggcgugacguaccucgcgcugauagcgaccuucaagauccaacccuuccuagcgcucggguucuucuuacgcaaguuaacaagccgggagaaccuccugcugggcgucggccucgcuauggcuacgacgcugcagcugccggaggauaucgagcagauggccaacgggaucgcguugggacugauggcccuaaaacugaucacccaguuugaaaccuaccaacuguggaccgcccugauuagccucacguguuccaacaccaucuucacccugacugucgccuggcggacagccacccucaucuuagccggcguuuccuuguuaccggucugccaauccagcuccaugcggaagaccgacuggcucccaaugacgguggccgccaugggggugccgccucucccacuguuuauauucagccucaaggacacgcugaagcgccgcucuuggccgcugaacgagggagucauggccguugggcuagugagcauacuggccuccagccugcuucggaacgacguccccauggcaggcccccuggucgccgguggccuacucaucgcgugcuacgugaucaccgggacguccgccgaccugaccgucgagaaagccgccgacgugacgugggaggaggaagccgagcagaccggcgucagccacaaccugaugaucaccgucgacgacgacggcaccaugaggaucaaggaugacgagaccgagaacauccucacugugcugcugaagaccgcucuccugauugugaguggcaucuucccuuacagcauccccgcuacacugcucguguggcacaccuggcagaagcagacgcagcgguccggcgugcucugggacguucccagcccccccgagacccaaaaagcagaacuggaagagggggucuaucgcauuaagcagcaaggcaucuuuggaaagacccagguaggcgugggaguucaaaaggagggcguguuccauaccauguggcacguaacccggggagcgguccucacuuacaacggcaaaagacucgagcccaacugggccagugugaagaaggaucugauaucguacgggggcggcuggcggcucuccgcccaguggcagaaaggggaggagguacaggugaucgccguggaaccaggcaaaaacccgaagaauuuucagaccaugcccgggacuuuccagacgaccaccggggaaaucggggcgaucgcccuggacuuuaaaccggggaccucuggaagccccaucaucaaccgcgagggcaagguggucgggcuguacgggaaugggguggugacaaagaacggcggguacgugagcggcaucgcccagaccaacgccgagccggacggccccacccccgagcuggaggaagaaauguucaagaagcggaaccucacgaucauggacuuacauccugggagcggcaaaacgcguaaauaccugccggcuaucgugagggaggcgaucaagcgccggcuccguacucugauccuggccccaacucgugugguugccgcugagauggaggaagcccucaagggguuacccauccgguaccagacaacggcgaccaagucggaacacacaggcagggaaaucguugaccugaugugucacgccaccuucacgaugcgcuugcugagcccggugcgggucccgaacuacaaccugaucauaauggacgaggcccacuucaccgaccccgccuccauugccgcucgugguuacaucagcacaaggguuggaaugggcgaggccgccgccauuuucaugacugcuacgccgcccgggaccgcugacgccuucccgcaauccaacgcgcccauccaggacgaggaaagggauaucccggagcgcagcuggaacuccggcaacgaguggaucaccgacuuugccgggaagaccgugugguucguccccagcaucaaggcgggcaaugacauugcaaacugccuccggaaaaaugggaagaaagugauccagcuuucccgcaagacguucgauacugaguaccaaaagacaaaguugaacgacugggacuuuguggucaccacggauaucagcgagaugggcgcgaacuucaaggccgaucgggugauugacccucgccggugccucaagcccgugauccucacugacggccccgaacgcgucauacuugccggccccaugccgguuacagcggccuccgcagcccagcggagaggcagaguugggcgcaacccccagaaggagaacgaccaguauaucuucacaggccagccccucaacaacgacgaggaccacgcccauuggaccgaagcaaagaugcugcuggacaacaucaauacgcccgaggggaucaucccggcccucuucgagcccgagcgggagaaguccgccgcuaucgacggcgaauaccgccugaaaggcgaaucacgaaagacauucguugagcugaugcgccgcggcgacuugcccguguggcuggcccacaaggucgccucagagggcaucaaguacaccgaccgcaaauggugcuucgauggccagcggaauaaccagauccuggaggagaacauggauguagagaucuggaccaaggaaggugagaagaaaaagcuccgccccagauggcuagacgcccgcacguacuccgacccgcuggcgcucaaagaguuuaaagacuucgccgcaggccguaagaguaucgcccucgaccugguuaccgagauugggcgaguaccaacccaccuugcccaccgaaccagaaacgcccuggacaaccuuguaaugcugcauacgucagagcacggcgggaaagcuuaccgccacgcgguggaggagcugcccgagaccauggaaacccugcuccugcugggcuugaugauccuguugaccgguggcgccaugcuuuuucugauaagcggcaaggggaucggcaagacgagcauuggacugauuugcgucaucgccuccuccggcaugcuguggauggcggagaucccucugcaguggaucgccucagcgaucgugcuugaguucuucaugaugguucuccugaucccagagcccgagaagcagcgaacgccccaagacaaccaacuggccuacguagucaucgggauccucacccucgcggccauuauagccgcgaaugagaugggccugcucgaaacuacgaaacgcgaucugggcaugagcaaggagcccggggucgucuccccaacgaguuaccuagacguggaccuccauccagccucagccuggaccuuguacgccguagcaaccacggucauuacccccaugcugcgacacaccauugagaacucgaccgccaacgugucucuugcugcgaucgccaaccaggccgucguccugaugggccucgacaagggguggcccauuagcaaaauggaccuuggugugccccugcuggcccucggguguuacucccaggugaacccccuaacuuuaaccgccgcaguucuacuccugauuacccacuacgcuaucaucggccccggccuccaggcgaaggccacuagagaggcccagaagcggacggccgccgggaucaugaagaacccgacgguggauggcaucaugaccaucgaccuggacccagugaucuacgacagcaaauucgagaaacagcuggggcaagucaugcuccugguccugugcgcggugcaacucuugcugaugcgcacguccugggcacucugcgaggcacucacguuggccacagguccgaucaccacccucugggagggcagccccgggaaguucuggaacacgaccauugcaguuuccauggcgaacauauucagagggagcuaccuggccggggcuggcuuggcguucuccaucaugaaguccguggggaccggcaagcgcggcacugggagucagggcgagacccucggugagaaguggaagaaaaagcugaaccaacugucgcggaaggaauucgacuuauacaagaagucuggcaucacggagguggaccgcacugaggcgaaagaaggguugaagcggggagagaucacccaucacgcggucucccgcggcagcgccaagcugcagugguuugucgaacggaacaugguaauaccggagggcagagucaucgaccucgggugugggagaggcgggugguccuacuacugcgccggccugaagaaggugaccgaggugcgggguuacacgaagggggggccuggucacgaagagcccguucccaugucuaccuacggcuggaauaucguaaagcucaugagugggaaggacguguuuuaccucccgcccgaaaagugcgacacccugcugugugauauaggcgagagcucccccagccccaccgucgaggagucacggacaauacguguccugaagaugguugagccgugguugaagaacaaucaguucuguauuaagguccugaaccccuacaugcccaccgugaucgagcaccuggagcgcuugcagcggaaacacggugggaugcugguacgcaauccucugucacggaacuccacucacgaaauguacuggaucucuaacgggacggggaacaucgucgcauccgugaacauggugucgcgccuccugcugaaccgcuucacgaugacccaccgccggccgacaaucgagaaagacgucgaccucggcgcggguaccagacacguaaacgcugagcccgagacccccaacauggacgugaucggcgaacggauaaagcgcaucaaggaagagcacaauucaaccuggcacuacgaugacgaaaacccuuauaagaccugggccuaccacggcucguaugaggucaaggccacagggucagccucaucaaugauuaacggugucguaaagcuccugacaaaacccugggacguggugccaaugguuacccaaauggcaaugaccgauaccacgccauucggacagcagcggguguucaaggaaaagguggacacccgcaccccgcggucgaugcccggcacaaggcgugucaugggcaucacggccgaguggcucuggcgcacccuggggcggaacaagaagcccagacuguguaccagggaggaauuuacgaagaaggugcgcacgaacgccgcuaugggcgcuguguucaccgaggagaaucaaugggacagcgccaaagcugccgucgaggacgagaauuucuggaagcugguggaucgcgagcgagaguuacacaagcuggggaaguguggcucuugcguguacaacaugauggggaaacgagagaagaagcucggcgaguucggcaaggccaaggguagccgggcgauaugguacauguggcucggcgcccgcuaccuggaguucgaggcucucggguuccugaacgaggaccacugguuuucccgcgagaacucuuacuccggggucgagggggagggcuugcacaagcucggcuacauucugcgcgacaucuccaagauacccgggggugccauguaugccgacgauaccgcuggaugggacacccggauuacggaggacgaccugcacaacgaggagaagaucacucagcagauggacccggagcaucgucagcucgcaaacgcaaucuuuaaacugaccuaccagaacaagguggugaagguccagcggccaacccccaccggcacugugauggacauuaucucccgcaaggaccaaagagguuccggccaggucggcaccuauggacuaaacaccuucacuaacauggaggcgcagcucauccgccagauggaaggcgagggcguucuguccaaggccgaccuggagaacagccaucuacccgagaaaaagaucacccaguggcuggaaaccaagggcguggagcggcuaaagcguauggcgaucucuggagacgacugcguagucaagccuaucgacgacagauuugccaacgcauuacucgcucuaaacgacauggggaaggugcgcaaggacauuccccaguggcagcccagcaaggguuggcacgacuggcagcaggucccguuuuguucccaucacuuccacgagcucaucaugaaagacggccgcaagcugguggugccgugucgcccucaggaugaacugaucggcagagccagaaucagccaaggggcgggcuggucccucagagagaccgccugccugggcaaggccuacgcccaaauguggagcuugauguacuuccaccgccgcgaccuccggcuagcguccaacgcaaucugcagcgcagugcccguccacugggugcccacuucccgcacgaccuggagcauucaugcccaccaccaguggaugacuaccgaggacaugcugaccguguggaaccgggucuggauugaggacaacccauggauggaggacaagacacccgugaccaccugggagaacgugcccuauuuggggaaaagagaggaccaguggugcggaagcuuaauagggcugacgagucgggccaccugggcgcaaaacaucccaaccgcuauccagcagguccgcagccucaucggcaacgaagaguuccuggacuauaugccgucuaugaagcgauuccgcaaggaggaggaaagcgaaggcgccauaugguga

SEQ ID NO: 26015 - RNA, 9873 nt, Artificial Sequence
  derived and/or modified CDS sequence (opt11) from DENV-3__EU529687__SS-prME
accucauuaugccucaugaugauacuucccgccgcgcuggcguuccaccuuaccagucgugacggggagccccggaugaucguggggaaaaacgagcgcgguaagagccuguuauuuaagacggccuccgggaucaauaugugcacccucaucgccauggaccugggcgaaaugugcgacgacacuguaaccuacaagugcccccacauuaccgagguggaacccgaggacaucgacugcugguguaaccugaccagcacaugggugacauacgggacguguaaccaagccggcgagcaccgccgcgauaagcgguccgucgcccucgcgccccacguuggcauggggcuggacacacgcacccagacuuggaugagcgccgagggggccuggcgccaggucgagaaggucgagacuugggcacugcgccacccgggguucaccauccucgcgcuguuccuggcgcacuacauagggacuuccuugacccaaaaagugguaauauucauccuguuaaugcucguuacgcccagcaugacaaugcggugcgugggggugggcaaccgcgacuuugucgagggucugucgggggcgacuuggguggacgugguccuggagcacggagggugcguuaccacgauggccaagaacaagccgacucucgacaucgagcugcaaaagacugaggccacgcagcuggcgacgcuccguaaguuauguauagagggcaagauuaccaacauaaccaccgacagccgcugucccacgcagggcgaggcagugcugcccgaggaacaggaccagaacuacgugugcaaacacaccuacguggaucggggcugggggaacggguguggccucuucgggaaggggagccuaguaaccugcgcuaaguuccagugucuugagcccaucgaggguaaggucguacaguacgaaaacuugaaauauacggucaucauuacgguccacaccggggaccagcaccaggugggcaacgagacccagggggucacugccgagauuacuccccaggcuagcaccaccgaagcgauacugccggaguacggaacccugggguuagaaugcuccccgcggaccggccuggacuucaacgagaugauucugcucacgaugaaaaacaaggcuuggauggugcaccggcagugguucuucgauuuacccuugcccuggaccagcggugccacuaccgaaacacccaccuggaaccgcaaggaacuccuggugaccuuuaagaacgcccaugccaagaagcaggaaguuguaguacuggggucccaggagggcgcgaugcacaccgcgcucacaggcgcgaccgagauccagaacagcggcgggacauccauuuucgccggccaccugaagugucgucugaaaauggauaagcuagagcugaagggcauguccuacgccaugugcaccaacacguucguccuaaagaaggagguguccgaaacccaacacgggaccauucugaucaaaguggaguacaagggcgaggacgucccgugcaaaaucccuuuuagcacagaggaugggcagggaaaggcgcacaacggccgccugaucacggccaaccccguggugaccaagaaggaagaacccgucaacaucgaggccgagccgcccuucggagagagcaacaucgugaucggcauaggagacaacgcccuuaagaucaacugguacaagaagggcuccagcauugggaagauguucgaggcgaccgccaggggugcccgccggauggcgauccugggcgacaccgccugggacuuuggguccgugggugggguucuuaauagccugggaaagauggugcaccagaucuucgggagugcguacacugcccucuucagcggcguauccugggucaugaagaucggcaucggugugcuacugacuuggauuggucugaacagcaagaacaccuccaugagcuucuccugcaucgccaucgggaucauaacccuuuaccugggugccgugguacaggccgacauggggugugugaucaacuggaagggcaaggaacucaagugcggcagcgguaucuuugugacgaacgagguccacaccuggaccgagcaguacaaauuccaggccgauucccccaagcgccuggccaccgccauugccggcgccugggagaacggugugugcgguauccgcagcacgacccggauggagaaccuguuguggaaacagaucgcaaacgaacucaacuacauucuaugggagaacaacaucaaguugaccguggucgugggggacaucaucggcgugcucgaacaggggaagcguacccugacgccccagcccauggaacugaaauauuccuggaagaccuggggcaaggcgaagauagucaccgccgaaacccaaaauucauccuuuaucaucgauggccccaacacgcccgagugccccagcgccucccgggcguggaacgugugggagguggaggacuacggauucggggucuucaccaccaacauauggcucaagcugcgcgagguguacacucagcugugcgaccaccggcucaugagcgcagccguuaaggaugagagggcuguccacgccgacaugggguacuggauugagagccagaagaacggguccuggaagcuggaaaaggcgagccuuaucgagguuaagaccuguacguggccgaagucgcacacccucuggagcaacggcgugcuggagagugacaugauuaucccuaagagccuugccgggccuaucucucaacacaauuaccggccuggcuaccacacccaaacugcagggcccuggcaccucgguaaacuugagcuggacuuuaacuacugcgaaggcacgaccgucgugauuaccgagaacugcgggacccgcggcccgagccucagaacgaccaccguguccggaaaacugauccacgaaugguguugccgcuccuguacccugccuccgcugcgcuauaugggggaggacgggugcugguacggaauggagauccgccccauauccgaaaaagaggagaacauggucaagagccuaguuuccgccggcucgggggaggucgacaacuucacaaugggggucuuaugucuggcaauucuguucgaggaggugaugcgggggaaguucggcaagaaacacaugaucgcgggcguauucuucacguucguccuguuauuauccggccagaucaccuggcgcgacauggcccacacacugaucaugauaggcagcaaugccucagaccgaauggguaugggagugacguaccucgcccugaucgccaccuucaaaauacaaccguuccucgcgcucgguuucuuccuccgcaagcugaccagccgggagaaccuccugcuuggcguuggccucgccauggccacuacgcugcagcugccagaagacaucgagcaaauggccaacgggaucgcauuggggcugauggcccugaaacuuaucacccaauucgagaccuaccaauuauggaccgcccugaucucccucacuugcuccaacaccaucuucacccucaccguagcguggcggacggccacccugauauuggcgggggugagcuuacuuccgguaugccaguccagcuccaugcgaaagaccgauuggcuucccaugaccguggccgcuaugggugugccuccccuuccccuguucaucuucagccucaaggacacguugaagcggcgcuccuggccucugaacgagggggucauggccguaggccucgugagcaucuuagcgucuagccugcuacguaacgacguucccauggcgggcccucuggucgcaggagggcucuuaaucgccuguuacgugaucaccgggaccuccgccgaccucaccgucgaaaaggccgcggacgugacgugggaggaagaggcugagcagaccggggugucccauaaucugaugauaaccgucgacgacgacgggacgaugcgcaucaaggacgacgagaccgagaacauccucacggugcugcucaagacggcacucuuaauagucagcggcaucuucccguacagcaucccagccacgcugcucgucuggcacaccuggcagaagcaaacgcagcgauccggcgugcugugggacgugcccagcccacccgagacccagaaagccgagcuggaggaaggugucuaccgcauaaagcagcaaggaauuuucgggaagacgcaaguaggaguggggguccagaaggagggcguguuccacacaauguggcacgugaccagaggcgcgguccucaccuacaaugguaagcgccuggagccgaacugggcuuccgugaaaaaggaccucauaaguuaugguggaggcuggcgacucuccgcucaguggcagaaaggcgaagaggugcaggucaucgccguagagcccggcaagaaccccaagaacuuccaaacaaugcccgguacauuccagaccaccaccggggagaucggagcgaucgcgcuggacuuuaagcccgguaccucuggcucgcccaucaucaaccgcgagggcaagguggucgggcuguacggcaacgggguggugacgaaaaacggcggcuacguuaguggcaucgcacagaccaacgccgaaccggacggccccacaccugaacuggaggaggagauguucaagaagcggaauuugaccaucauggaucugcaccccgguucuggcaagacccggaaguaccugccggcuaucguacgggaggccaucaagcgucggcuccggacccucauucuggcuccaacucgggugguagccgcagagauggaggaggcccucaaagggcugccgaucagguaccagaccacggcgaccaagucggaacacaccggccgggagaucguggaccugaugugccacgccaccuucacgaugcgccuccugagccccgugcgcgucccgaauuauaacuuaaucaucauggacgaggcgcacuucaccgaccccgcuucaaucgccgcgcgcggguacaucagcacccgggucggcaugggugaagcggccgccauauucaugaccgcgacgccgcccgggaccgccgacgcguucccgcaaagcaacgcccccauccaggacgaggagaaggacaucccggaacgcaguuggaacaguggcaacgaguggaucaccgacuucgcuggcaagaccguuugguucguccccucgauuaaggccggcaaugacaucgccaacugcuuacgcaagaauggaaagaaggugauucagcugagucgcaagacuuucgauacagaguaccagaaaaccaagcugaacgacugggacuucguggucaccacggacauaagcgaaaugggcgccaacuucaaggcagacagggugaucgacccgcggcgcugccugaagccagugauccuuaccgacggcccugagagggucauccucgccgggcccaugccgguuacagcagccucagcugcacagcgccggggccgcgucgggcggaacccccagaaggaaaacgaccaauacaucuucaccggccaaccccucaacaacgacgaggaccacgcccacuggaccgaggccaagaugcugcuggacaauaucaacacucccgaggggaucaucccggcccucuucgaacccgagcgggagaagucugccgcuaucgacggcgaguaccggcugaaaggcgagucccgcaagaccuucgucgagcugaugcggcguggggaccuccccgugugguuagcgcacaaggucgccagcgagggaaucaaguacaccgaccggaagugguguuuugacgggcagcgcaacaaucagauccuggaggagaacauggacguggagauauggacuaaggagggcgagaagaagaaauugcggccccgcugguuagacgcacggacguacuccgacccgcuggcccucaaggaguucaaagacuucgccgcgggacgcaagagcaucgcccuggacuuggugaccgagauaggccguguacccucccaccucgcccaccggaccagaaacgcucuugacaaucuggugaugcuccacacuagcgaacacggagggaaggccuaccggcaugcggucgaggagcugcccgaaacgauggagacacugcuccugcugggcuuaaugauccugcugaccggcggcgccaugcuguuccugaucagcggcaaggguaucggcaagacuuccaucgggcugaucugcgucaucgcgagcuccggcauguuguggauggcugagaucccgcugcaauggaucgccagcgcaaucguucuagaguucuucaugauggugcuccugauccccgaacccgaaaagcagcguacgccccaagacaaccagcucgccuacguugugaucgggaucuuaacccucgccgccaucaucgcugcgaacgaaaugggccugcucgagaccaccaagcgggaccuggggauguccaaagaaccuggggugguaucucccacgaguuaucuagacguggaccuacaccccgccagcgcauggacccuguaugcaguggcgaccacugucaucacacccaugcugcgccacacaaucgagaacuccaccgcgaacgugagccucgccgccaucgccaaccaggcgguggugcugaugggccuggacaaaggguggccgaucuccaaaauggacuuaggcgugccccugcuggcacuaggcugcuauucccagguuaacccccucacauugacggccgcuguacuacuucugauuacgcauuaugcaaucauaggcccaggacuccaggcgaaggccacacgggaggcucagaagcgcaccgcagcuggaaucaugaagaauccgacaguugacggaaucaugaccauugacuuggaccccgugaucuacgacuccaaguucgaaaagcagcuggggcaaguuaugcucuuagugcugugcgcggugcagcugcugcugaugcggaccuccugggcccucugugaggcccugacccuugcgacgggccccaucacuaccuuaugggagggauccccggggaaguuuuggaacaccacgaucgcggucagcauggcgaacaucuucaggggauccuaccuggccggcgccggccuggccuucaguaucaugaaauccguggggaccggcaagaggggcacugggagccagggugagacgcucggugaaaaauggaagaagaagcugaaccagcugagccgcaaggaguucgaccucuacaagaaguccggcauaaccgagguggaccggacggaagcuaaggagggccugaagcgcggcgagaucacgcaccacgccgucagccgaggcuccgcgaagcugcagugguucgucgagcgaaauauggugaucccugagggacgggucauagaccucggcugugggcgcggaggguggagcuacuacugcgccggccugaagaaggucacagaggugcgcggcuacacuaagggcgggcccgggcacgaggagcccguccccauguccacguauggcuggaauaucguuaagcugaugagcgggaaggacguguuuuaccuaccacccgaaaagugcgacacgcugcugugugauaucggcgaguccagcccauccccuaccgucgaggagagccgcaccauccggguacugaagaugguggaacccuggcucaagaacaaucaauuuugcaucaagguucuuaaccccuacaugcccacgguuaucgagcaccuggaacgccuacagaggaagcacgguggcauguugguccgcaacccccucucccgcaacagcacccacgagauguacuggaucuccaacggcacgggcaacaucgucgccagcguaaacauggugucccggcucuuacugaaccgcuucaccaugacgcaccgucgcccaacgaucgagaaggacgucgaucuaggcgcgggcacccgacacguuaaugcagagcccgaaacccccaacauggacgugauuggggagagaauuaagcggauaaaggaggagcacaacagcacguggcacuacgacgacgagaaccccuacaaaaccugggccuaccauggcucauacgaggucaaggcuacagggagcgcgagcagcaugaucaauggagucgucaagcugcugaccaagcccugggaugugguaccuauggucacccagauggccaugaccgacaccaccccauucggccagcaacgcguguucaaggagaaaguugacacccggacuccuaggagcaugccaggcaccagacgcgucauggguaucaccgccgagugguuauggcgaacgcuggggcguaacaagaagccccggcuauguacccgcgaggaguucaccaagaagguucggacgaacgccgccaugggagcaguauucacggaggagaaccagugggacagugccaaggccgccgucgaggacgaggacuuuuggaagcucguugaccgggagcgcgagcugcacaagcuggggaaaugcggcagcugcgucuacaacaugaugggaaagcgggagaaaaaguuaggcgaguucggcaaggccaaggggucccgcgcgaucugguauauguggcugggcgcccgguaccuggaguucgaggcccuuggcuuccugaaugaggaccacugguucagccgcgaaaacuccuacagcggcgucgagggagagggccugcacaaacucggcuacauucugcgggacaucuccaagaucccuggaggcgccauguacgcggaugacaccgcgggcugggacacuaggaucaccgaggacgaccugcacaacgaagagaagaucacgcagcagauggacccggagcaccggcagcucgccaaugccaucuucaaacugaccuaucaaaacaaaguggugaaaguacagcgaccgacccccacaggcaccgugauggacaucaucagccggaaggaccaaaggggauccggucaggugggaacguaugggcugaacaccuucaccaacauggaggcccagcucauacggcagauggagggcgaagggguguuaucgaaagccgaccuggagaacccccaccuuccggagaagaagaucacccaguggcuggagaccaaggggguggagagacuuaagcggauggcgaucuccggcgacgauuguguggucaagcccaucgacgaccgcuucgccaaugcccuacuggcccugaacgacauggggaagguacggaaggacauaccucaguggcagcccuccaaaggguggcacgacuggcagcaggucccauucugcagucaccacuuccacgagcucaucaugaaagaugggagaaaacuggucgugcccugccggccccaggacgaguuaaucgggcgcgcccggaucagccagggggccggcuggucccuccgcgagaccgccugccuaggaaaggccuacgcacagauguggagccugauguacuuccaccggcgggaccuccgccuggccucuaacgcgaucugcagcgccgugcccguucacugggugccgaccagucggaccacguggagcauccacgcccaccaccaguggaugacaacugaagacaugcugaccguguggaacagggucuggauugaggacaacccguggauggaggacaagacgcccguuacgaccugggagaacgugccauaccuugggaagagggaggaucaauggugcgguagucugauaggguuaacaagccgcgccaccugggcgcaaaacauuccgaccgccauccagcagguucggagccucaucggcaacgaggaguuccuggacuacaugcccagcaugaaacgcuuucggaaggaggaggaaagcgaaggggccauaugguga

SEQ ID NO: 26016 - RNA, 9873 nt, Artificial Sequence
  derived and/or modified CDS sequence (opt11) from DENV-3__KF955449__SS-prME
accagcuugugccugaugaugauccugcccgcugcccuggcguuccaccucaccucccgggacggugagccgcggaugaucguggggaagaaugagcgcggaaagagccuguuguucaagacggccuccgggauaaauauguguacgcucaucgcuauggaccugggggaaaugugcgacgacaccgugacuuacaaguguccccacaucacggaaguugagccggaggacauugacuguuggugcaaccugaccagcaccugggugacuuacggaacguguaaucaggccggagaacaccggcgcgacaagcgguccgucgcccucgcgccccacgugggcauggggcuggauaccagaacccaaaccuggauguccgccgagggggcauggcggcaggucgagaaggucgagacuugggcccugcgccacccgggauuuaccauuuuagcgcuguuucuggcccauuacaucggcaccucccucacgcagaaggugguuaucuucguccugcugaugcucgugacucccagcaugaccaugcggugcguagggguggggaaccgcgacuucguggaggggcuguccggggcuaccuggguagauguugugcuagaacacggugggugcgucaccacgauggcgaagaacaagccaacucucgacaucgaacugcagaagaccgaggccacccagcuggcgacgcuucgaaaacugugcaucgagggcaagaucaccaacauaaccaccgacucacgcugccccacgcagggcgaggccguguugccggaggagcaggaccagaacuacgugugcaagcacacuuacguggaccgggguugggggaacggcugcggacucuucgggaagggcuccuuggugaccugcgcuaaguuccagugccuggagcccaucgaggguaagguggugcaguaugagaaccucaaauacaccgucaucauaacagugcacaccggggaccagcaccaagucggcaacgagacccagggggucaccgccgagaucacgccgcaggccucgaccaccgaggcuauccugccagaguacggcacccuggggcucgaguguagcccgcgcaccggccucgacuucaacgaaaugauccuuuugacgaugaagaacaaagccuggauggugcaccggcagugguucuucgaccugccgcugcccuggaccucuggugccaccaccgagacgcccaccuggaaccgcaaagaguuguuagucacuuucaagaacgcccacgccaagaaacaggagguggugguccucggcucccaggagggcgcaaugcacaccgcucuuacgggggcuaccgagauccagaacagcggcgggaccuccauauucgcgggccaccugaagugucggcugaaaauggacaaacucgaguugaaagggaugagcuaugccaugugcacgaacacguucguuuuaaagaaggagguguccgagacccagcaugggaccauucucaucaaggucgaguacaagggcgaggacgugccgugcaagaucccuuucagcacagaggacgggcagggaaaggcgcacaacggccgccugaucaccgcuaaccccguggucacaaagaaagaggagcccguuaacaucgaagcugagccgcccuucggggagucaaacaucgugaucggcaucggggacaacgcucugaagaucaacugguacaaaaagggcucuagcaucgggaaaauguucgaggcgaccgcgaggggcgccagacgaauggccauccugggcgacacagccugggacuucggcuccgugggaggagugcuuaauagucuggguaaaauggugcaccagauuuucggaagcgcauacacggcccuguucagcggcgucuccugggucaugaaaauugggaucgggguucuuuugaccuggauaggacucaauucgaagaacacuuccaugagcuucuccugcaucgccaucggcaucaucacgcucuaccugggcgccgucgugcaagcggacauggggugcgugaucaacuggaagggcaaggaauuaaaguguggcagcgggauauucguuacgaaugaggugcacacguggaccgagcaguacaaauuccaagcggauucucccaagcgucucgccaccgccaucgccggcgcgugggagaacggggugugcgguauccgcagcacgacccguauggagaaccugcuguggaagcagaucgcgaacgagcucaacuacauccugugggagaacaacaucaaacugaccgucguggucggggacaucaucgggguacucgagcagggcaagcgcacgcugacgccgcagccgauggaacuaaaauacuccuggaagaccugggggaaggccaagaucgugaccgcggagacccagaacagcuccuucaucaucgacggccccaacacgcccgagugccccucagccucaagggcguggaacgugugggaggucgaagacuacggguucggcguguuuacgaccaacauuuggcuuaagcugcgcgaggucuacacccagcugugcgaucaccgguugaugagcgccgccgugaaagacgaacgggcuguucacgcggacaugggcuauuggauagaaucucagaaaaaugggucguggaagcucgagaaggcgucgcugauagaagugaagacguguacauggccgaagucacauacccucuggagcaacggcgugcuggaauccgacaugaucauuccuaagagccuggccggccccaucucccagcacaacuaccggccgggcuaccauacccaaacagccgggccguggcaccucggcaaguuggaacuggacuucaacuacugcgagggcacuaccguagugaucaccgagaacugcgguacacgcggccccagccugcggacgacuaccgucucggggaagcugauucacgaguggugcugccgcagcuguacucugcccccacuccgguacaugggcgaagacgggugcugguacgguauggagauucgcccuauauccgagaaagaagagaauauggucaagagccuaguguccgcuggaucuggggaggucgacaacuucacaaugggcguuuugugccucgcaaucuuauucgaggaggugaugcgggggaaguucggaaagaaacacaugaucgcgggggucuucuucaccuucguacugcuccugucaggccaaaucaccuggcgagauauggcacauacacugaucaugauaggcagcaacgccagugaccggauggguaugggcgugacguaccuagcccugaucgccacguucaagauccagcccuuucuggcgcucggcuucuuccugcgcaaacugaccagccgggagaacuuguugcugggcgucggccucgcaauggccaccacgcugcagcugcccgaggauaucgagcagauggcgaacgggaucgcacucgggcugauggcgcuuaaacuuaucacccaguuugagaccuaccagcuguggaccgcgcuaaucagcuuaacgugcucgaacaccaucuuuacccugacuguggccuggcgcacggccacgcugaucuuggcugggguaagccuguugccagugugccaguccuccuccaugcggaagaccgauuggcuccccaugaccgucgcugccaugggcgugccgccccucccgcuuuucaucuucucauugaaagacacgcuaaagcgccgcuccuggccccucaacgaaggggucauggcugugggccuagugagcauccuagcuuccagcuugcuccggaacgacgugcccauggcuggcccccugguggccgggggacuccucauagccugcuacgugaucacugggacuucagccgaccuuacuguggaaaaagcagcagacgugacgugggaggaggaggcggagcagacuggggucagccacaacuugaugaucacgguggacgacgacgggaccaugagaaucaaggacgacgagaccgagaacauccucacgguucugcugaaaaccgcucuccugaucgucucuggcauuuucccguacagcauccccgcgacccuguuaguguggcacacuuggcagaagcagacgcagcgguccggugugcugugggacguccccagcccgcccgagacccagaaggccgaguuggaggaggggguguaccguaucaagcaacagggcaucuucgguaagacccaggugggcgucgggguucagaaggagggcguuuuucacaccauguggcacgucacgaggggcgcgguacucacauacaacgggaagcgccuggagcccaacugggccucggugaaaaaggaccugaucagcuacggagguggcuggcgacuuuccgcccaguggcagaagggggaagagguccagguaaucgccguggagcccggcaagaaccccaagaacuuccagaccaugcccggcaccuuccagaccaccacaggggagaucggugcgaucgcccuggacuucaagcccgggaccuccggcucaccaaucaucaaucgugagggaaaggucguggggcuguacgguaacgggguggucacuaagaacggcggguaugucuccggcauagcccagaccaacgccgaaccggauggccccacccccgagcuggaggaggaaauguucaagaagcggaaccucaccaucauggaccuucaccccgggagcggcaaaacgcgcaaauaccugccggccauugugcgggaggcgaucaagcgcagacuccggacccugauccuggcccccaccagagugguugcagcugagauggaggaggcccucaagggguuacccauccgcuaccagaccacggcgaccaagagugagcacacaggcagggagaucguggaccucaugugccaugccacauucacgaugcgcuugcucagccccguccgggugccaaauuacaaccugauuaucauggacgaggcccacuuuacggacccugccucgaucgccgcgcgcgguuacaucagcacgcgcgugggcaugggagaggccgcagccaucuuuaugaccgcgacuccgcccgggacagcugacgccuucccucaauccaacgcgcccauccaggaugaggagcgugacaucccagaaaggaguuggaacuccggcaacgaguggaucacggacuuugccgggaagaccgucugguucgugccaagcaucaaggcgggcaacgacaucgccaacugucuccggaaaaacggaaagaaggugauucaguugucccgcaaaacguucgauaccgaguaccaaaagaccaagcugaacgauugggauuucgucguaaccacugacauuagcgagaugggcgccaauuucaaagccgaccggguuauagacccgcgccguugccucaagccggucauauuaacugauggccccgagcgcgugaucuuggccgggccgaugccuguuacagcggcuuccgcggcccagcggcgcgggcgggugggccgcaacccccagaaggagaacgaccaguacauauuuaccggccagcccuuaaacaacgacgaggaucacgcccauuggaccgaagcgaagaugcugcuggacaauaucaacacgccggagggaaucaucccggcccucuucgaaccggagcgggaaaaaucugccgccaucgauggcgaguaccggcugaaaggcgagucccggaagaccuucguggagcugaugcgccgcggcgaccuccccgucuggcuggcgcacaaaguggccucagaaggaaucaaguacaccgaccgcaagugguguuucgacgggcagcguaacaaccagauccuagaagagaacauggacgucgagauauggaccaaggagggagagaagaagaagcuccgccccaggugguuagacgcccgcacauacuccgauccacuggcccucaaggaguucaaggacuucgccgcgggaagaaaaagcaucgcucuggaccuggucacagaaaucgggcggguacccucacaccucgcgcaucgcacccggaacgcccuggauaaccuggugaugcuccacacgagcgagcauggagggaaagcauaccgccacgccgucgaggagcugcccgaaacgauggagacccugcuccuccugggccucaugauccugcugacugguggcgcuaugcuauuccuuaucagcggcaaggggaucggcaagaccuccaucgggcugaucugcgucaucgccagcuccggaaugcucuggauggccgagaucccgcuucaguggaucgccagcgcgauugugcucgaguucuuuaugaugguacuccugauccccgagcccgaaaagcagcggacgccccaggacaaccagcucgcauacgugguuaucggcaucuuaacccuggccgccaucauugccgcaaacgagauggggcugcucgaaacgacuaagcgcgaccugggcauguccaaggagccgggugucgugagccccacguccuaccuggacgucgaccuccauccugcgagcgcauggacgcuguacgccgucgcgaccacggugauuacgcccauguuacggcacaccauugagaacuccacagccaacguaagccucgccgccaucgcaaaccaagcggucgugcugaugggccuggacaagggguggccgaucagcaagauggaccucggugucccgcugcuggccuuagguugcuauagccaggucaacccccugacguuaacagccgccgugcugcugcugaucacccauuacgccauaauaggaccaggcuuacaagcgaaggccacacgcgaggcccagaagcguaccgccgccgggauuaugaagaacccgacuguggacggcaucaugaccaucgacuuggaucccgucauauacgacuccaaguuugagaagcaguuaggccaggugaugcuccuggugcugugcgcgguccagcuccuacugaugcgcaccagcugggcauugugcgaggcccugacgcucgccacgggccccaucaccacccucugggaaggcucccccgggaaguuuuggaacaccacgauagcggugagcauggccaacaucuuucgaggauccuaucuggccggggccggccuggcguucucaaucaugaaguccgucgggaccggcaagcgcggcaccggaucgcagggagagacgcucggugagaaguggaaaaagaagcugaaucagcugagccggaaggaguuugaccucuacaagaaguccgguaucaccgaggucgaccguacggaggcgaaggaagggcugaagcggggagagauuacccaccacgccguaagccgcggcuccgccaaacuacagugguucguggagcggaacauggucaucccggaggggcgcgugauagaccucggcugcgggaggggcgggugguccuacuauugcgccggccugaagaaggugaccgagguaagagguuacaccaagggcgggcccgggcacgaggaacccguucccauguccacguacggcuggaacauagucaagcugaugagcgggaaggacgucuucuacuuaccgcccgaaaagugcgacacccugcugugugacaucggggaguccagucccuccccgaccguggaggagagccggaccauccgcguguugaaaauggucgagccauggcuuaagaacaaccaguucugcaucaaggugcucaacccauauaugccuacggugaucgaacaccuggagcgccuccaacggaagcacggcgguauguuaguccgcaacccccugucucgcaacagcacccacgagauguacuggaucucaaacgggaccgggaacauagucgcgagcgugaauauggugucccgccucuuacugaaucgguucacaaugacgcaccgccggccuaccaucgaaaaggacgucgaccucggcgcgggcacccgccacguuaacgcggagcccgagacucccaacauggauguaaucggggaacggauuaagcgcaucaaggaggaacacaacagcacguggcauuaugacgacgagaauccguacaaaaccugggccuaucacggcuccuacgaggugaaggccaccgggagcgcuucauccaugauaaauggggucgugaagcuacuuaccaagcccugggacguggucccaauggugacgcagauggcaaugaccgacacaaccccuuucgggcaacagcggguguucaaggaaaagguggacacgcggacacccaggucgaugcccggcacccgccgggugaugggcaucaccgccgaguggcucuggcgcacgcugggccggaacaaaaagccccgccucugcacgcgggaggaguucacgaagaagguucgcaccaaugccgcaaugggcgcgguauucacggaggaaaaccagugggacuccgcgaaggcagccguagaggacgaagauuuuuggaagcucgucgaccgcgagagagagcuucacaagcuggggaagugcggaagcuguguuuauaauaugaugggcaaacgcgagaagaagcucggcgaguucggcaaggccaaggggucgcgggcgaucugguauauguggcugggcgcccgauaccuggaguucgaggcucucggguuucugaacgaggaccauugguuuagucgagaaaacuccuacagcggcguugagggggagggccugcacaaauugggcuacauccugcgcgacaucuccaagauucccggcggcgccauguacgccgacgacaccgcggggugggacacccggauuaccgaggacgaccugcacaacgaggagaagaucacccagcaaauggacccggagcaucgccagcucgccaacgccaucuucaaacugaccuaccagaacaaaguggucaaagugcagcgacccacccccaccggcaccgucauggacaucaucagccgcaaggaucagcguggcuccgggcaggucgguacuuacgggcuuaauaccuucaccaacauggaagcccaacuaaucagacagauggagggcgagggggugcuuaguaaggccgaccuggagaacccccaccucccugagaaaaagaucacccaguggcucgagacgaagggggucgagcgccugaaacguauggcgauauccggcgacgacuguguaguaaagcccaucgacgaccgguucgccaacgcucuccuggcgcugaacgauauggggaagguucgcaaggacaucccccaguggcagcccuccaagggcuggcacgauuggcagcaggucccuuucugcucgcaccacuuccacgagcucaucaugaaggacgggcgcaagcugguggugcccugccgcccccaagacgaguugaucgggagagcccgaauaagccaaggagcggguugguccuugcgggagaccgccugucugggcaaagccuacgcccagauguggagccugauguacuuccaccgccgcgaccuccgacuggcgaguaacgccauuugcagcgccguuccugugcacugggugccgacuucccgcaccacguggagcauacaugcccaccaucaguggaugaccacggaggacaugcugaccguuuggaaccgaguguggaucgaggacaacccauggauggaggacaagacgcccguuaccaccugggagaacguccccuaccuagguaaacgcgaggaccaguggugcggcagccuuauagggcugacgucccgagcgacuugggcgcagaacaucccgaccgcuauccagcagguccgcagccucaucggcaacgaagaguuccuggacuauaugccauccaugaagagauuccgcaaggaggaggagucggaaggggccaucugguga

SEQ ID NO: 26017 - RNA, 9873 nt, Artificial Sequence
  derived and/or modified CDS sequence (opt11) from DENV-3__FJ373303__SS-prME
acuagccugugccuaaugaugauccugcccgcagcguuggcguuccaccucaccagcagggauggggagccgcggaugaucguagguaagaacgagcgcgggaagagccugcuguucaagacugccuccgggauuaacaugugcacccucaucgccauggaccuuggggagaugugcgacgacaccgucaccuacaagugcccccacaucacggaaguagagccagaggacaucgacugcuggugcaaccugaccagcaccuggguuaccuacgggacuugcaaucaggccggcgagcaccggagagacaagcgguccgucgcccucgccccccacgugggcaugggguuggauacccguacccagaccuggaugagcgccgagggcgccuggcggcagguugagaagguggaaacgugggcccugcggcacccuggguucacuauucucgcgcuguuccuggcccacuacaucggcaccucccucacacagaaaguggugauauucaucuugcugaugcucgucacgccuaguaugaccaugcgguguguggggguggguaaccgcgacuucgucgagggucugaguggggccacauggguggacgugguccuggagcacggcggaugcgugacgacgauggccaagaacaaacccacgcucgacauugagcugcaaaagaccgaggccacccagcuggcgacgcuccggaagcugugcaucgagggcaagaucaccaacauaaccacggacucccgcugucccacccagggcgaggccgugcugcccgaggaacaggaccaaaacuaugucugcaagcacaccuacguggaccggggguggggaaacgggugcggcuuguuuggcaagggcucccuggugacuugcgccaaguuccagugccuggagcccaucgagggaaaggucgugcaguacgagaacuuaaaguacacagugaucaucacgguccacaccggggaucagcaccaagugggcaacgagacgcaaggggucaccgccgagaucacgccccaggccagcaccacagaggcuauccugcccgaguacggcacgcugggacuggagugcuccccgcgaaccggccuggacuucaaugaaaugauccuguuaacgaugaagaacaaggcguggaugguucaccggcaaugguuuuucgaccugccgcugcccuggacgagcggagccacuaccgagacacccacuuggaaccgcaaggagcuccuagugacauuuaagaacgcgcacgccaagaagcaggaggucguuguacuggggucucaggagggcgcgaugcacaccgcccucacgggggccacugagauccagaacagcggggggacauccauauucgcaggccaccugaagugccggcugaagauggacaaacucgagcugaagggcaugagcuacgccaugugcaccaacacguucgucuuaaagaaggaggugucugagacacagcauggcacgauccucauuaagguggaguacaaaggcgaggacgucccgugcaagauccccuucagcacagaggacgggcagggcaaggcgcacaauggccgccugaucaccgccaaccccgucgucaccaagaaagaggaacccgucaacaucgaggccgagccgcccuucggggagagcaacauugugaucgggaucggggacaacgcgcugaaaaucaacugguauaagaagggcuccuccaucgguaagauguucgaggccacugcucggggcgcccgaaggauggccauccugggggacaccgccugggacuucggguccgugggaggaguccucaacagcuuggguaaaauggugcaucagaucuuuggguccgcguacacugcccuguucucaggcguguccugggucaugaaaaucggcauagggguccuacugaccuggaucggccugaacuccaagaacaccuccaugagcuuuuccugcaucgcaaucgggaucaucaccuuauaccugggcgccgugguccaggcagacauggggugcgugaucaacuggaagggcaaggagcugaagugcggcuccgggaucuucgugacgaacgagguucacaccuggaccgagcaguacaaguuccaggcggacucccccaagcgucucgcaaccgccaucgccggcgccugggagaacggugucugcggaaucagaagcacgacccggauggagaaucugcuguggaagcagauagcgaacgagcucaacuacauccugugggagaacaacgugaagcuaacagugguggugggagacaucauaggcguacucgagcagggcaagcgcacacugacgccgcagccgauggagcugaaguacuccuggaagaccugggggaaggcgaagaucguaaccgccgagacucagaauagcuccuuuauaaucgacggccccaacacgcccgagugccccagcgccucacgggcguggaaugugugggaggucgaggacuacggguucgggguguucaccaccaacaucuggcucaaacugcgcgaaguauacacucagcuaugugaccaccggcucaugagcgccgccgucaaggacgaacgugccgugcacgccgauaugggcuacuggaucgagagccagaaaaacggguccuggaaguuagagaaggcuagccugaucgaggugaagaccugcacguggccgaagucccacacacucuggagcaacggcguccuggaguccgacaugaucauacccaaaagcuuagccggacccaucagucagcacaacuaccgcccgggcuaucauacccagaccgccgggccauggcaccucgguaagcuggagcuggauuucaacuacugugaggguacgaccguggugaucaccgagaacugcggcacccgcggcccaagccuccggacgaccacggucuccgggaaguugauccacgaguggugcugccgcagcugcacccugcccccgcuccgguacaugggcgaagacggguguugguacggaauggaaauccgacccaucuccgagaaggaggagaacauggucaagagccuggucucagccggcaguggggaagucgacaacuucacgaugggcgugcugugccucgccauucuauucgaagaagugaugcggggaaaguucggcaagaagcacaugauugcaggagucuucuuuacuuucgugcugcucuuaucuggccagauuaccuggagagacauggcccacaccuuaaucaugaucggcagcaacgccucggaccggauggguaugggcgugacguaccuggcccugauagccacuuucaagauccagcccuuccuugcgcucggguucuuccugcgcaagcugaccucccgggagaaccuccugcugggggucggcuuggccauggcgaccacccugcagcugcccgaggauaucgagcaaauggccaaugggaucgcgcuugggcugauggcacugaagcucaucacccaguucgagacuuaccagcuguggaccgcccugaucucucucaccugcuccaacaccauuuucacccugacaguggccuggcgcacggccacucugauccucgcgggugucagccugcugccgguuugccaguccaguaguaugcggaagacagacuggcuccccaugaccguggccgccaugggcguaccgccacucccgcuguucaucuucagccucaaggacaccuuaaaacgccggagcuggccccugaacgagggggugauggccgugggccuagucucgauccuggccuccagccugcuucggaacgacguaccuauggcuggcccccugguggcggggggccugcucaucgccuguuacguaauuacugggaccucagccgacuuaaccguggagaaggccgcagaugugacgugggaggaggaggcggagcagaccggcgucagccacaaccuuaugaucaccguggacgacgacgggaccaugcgcaucaaggacgaugagaccgagaacauccucacggugcugcugaagaccgcccuguugauaguauccggcaucuuccccuacagcauccccgccacccugcucguguggcacaccuggcagaagcagacucaacggucuggugugcuuugggacguccccagcccgcccgaaacgcagaaggccgaacuggaggagggcguauacagaaucaagcagcaggggaucuuugggaagacccaaguuggagucggggugcagaaggaaggcguguuccacacuauguggcacguaacgcguggcgcggugcuaaccuauaacgguaagcgccuggagccgaacugggccuccgugaagaaggaccugaucaguuauggcggggguuggcggcucuccgcccaguggcagaagggggaggagguccaggugaucgccguggaacccgggaagaacccaaagaacuuccagacuaugcccggcacguuccaaacgaccacuggggagaucggugcgaucgcccuggacuucaagcccgggaccagcggcucacccauaaucaaccgcgaaggcaaggucguggggcuguacggcaacgggguggucacgaagaacggcggguacgugucuggcaucgcccagaccaacgccgagccggacggccccacccccgagcuggaagaggagauguucaagaagcggaaccucaccaucauggaccugcacccggggagcggaaagacucguaaguaccugccggccauagugcgugaggcuaucaagaggcgguuacgcacccugauccuggcccccaccagagucguggccgccgagauggaggaggcccucaaggggcuucccauccgcuaccagaccacggcgaccaagucggagcacaccggcagggaaaucguggaccugaugugucacgccaccuucacgaugcgccugcugagccccguaagggugccaaacuauaaccugaucaucauggacgaggcccacuucaccgaccccgcuaguauugccgcgcgcggguacauaagcacucggguugggaugggcgaggccgcggccauauucaugaccgcgacgccgcccggaaccgccgacgccuucccgcaguccaacgcccccauccaggacgaggaacgggacaucccggagcgcagcuggaacuccggcaaugaguggaucaccgacuucgccgggaagaccgucugguuugugcccuccauaaaggcgggcaacgacaucgcgaauugccuccggaagaacgggaagaaggugauucagcuguccaggaaaacguucgacaccgaauaucagaagaccaagcugaacgacugggauuuugucgugaccacggacaucagcgagaugggcgccaacuucaaggccgaccgggugaucgacccccgccggugcuuaaagcccgucauccugaccgacggcccggagcgcgucauucuggcggggcccaugccggugaccgcugcguccgccgcccagcggcgcggccgggucgggagaaacccacagaaggagaacgaucaguauaucuucacaggucagccauuaaacaacgacgaggaccacgcccacuggaccgaggcgaaaaugcuucuggauaacauuaacacgccugaggggaucaucccggcccucuuugagcccgagcgggagaagucugccgccauugacggcgaguaucgccuuaagggggagucgcggaagacguucguggagcugaugcgccgcggggacuuacccgucugguuggcgcacaagguggccagcgaggggaucaaguauacggaccgcaaguggugcuucgacgggcagcggaacaaccagauccucgaggaaaacauggacguggagaucuggaccaaggagggcgagaagaaaaaacuccgcccacgguggcuggacgcccgaacauacuccgacccgcuggcucucaaggaguucaaggacuucgccgcuggacggaagagcaucgccuuggaccuggucacggaaaucgggcgggugcccucccaccucgcccaccgcacccggaacgcgcuggacaaccuggugaugcuccacaccagcgagcauggcgggaaggccuaccgacacgcggucgaagagcugcccgaaacgauggagacccugcucuuacuggggcucaugauccugcucaccggcggagccauguuauuccugauaagcggcaaggggaucgguaagacguccaucgggcugaucugugugaucgccagcuccggaaugcucuggauggcggaaaucccccugcaauggaucgccucagcgaucguacuggaguucuucaugaugguccuccugauacccgagcccgagaagcagagaacgccccaagauaaccagcuggcuuacguggugaucgggauacugacccuggccgccaucaucgccgcgaacgaaaugggccuacucgagaccaccaagcgcgaccugggcauguccaaggagccgggggucgugucucccacaagcuaucuggauguggacuuacacccugccucugccuggacccuguacgccgucgcgaccacugugauuacgcccaugcugcggcacaccaucgagaacuccaccgccaauguaucgcuggccgccaucgccaaccaggcggucgugcugaugggacuggacaagggguggccgaucucgaagauggaucucggcgugccccugcuggcccucgggugcuacagccaggucaacccccugacccugacugccgccgugcuccugcugaucacccacuacgccaucaucggcccuggccuccaagcgaaggcaacccgugaggcccaaaagcggaccgccgcuggaaucaugaagaauccgacgguugacggcaucaugaccaucgaucuggaucccguaaucuacgacuccaaguucgagaaacaacugggccagguaaugcuccuggugcugugcgcgguccagcuccugcugaugcgcaccagcugggcccucugcgaagcccugacccucgccacggguccaaucaccacccugugggagggcuccccaggaaaguucuggaacacaacgaucgcugugagcauggccaacauauuccggggcuccuaccuagccggugccggucuggccuucagcaucaugaagucaguggggacgggcaagcgcggcaccgggagccagggcgagacucucggggagaaguggaaaaagaaacugaaccagcugagcagaaaggaguuugaccucuacaaaaaguccggcaucaccgagguggaccguacggaagcgaaggaagggcugaaaaggggcgagaucacacaccacgccgugagccgcggcuccgccaagcugcagugguuuguggaacggaacauggucaucccagagggccgcguuaucgaccuuggcugcggacggggcggguggucuuacuacugugccggacugaagaaaguaaccgaaguacgcggcuacaccaagggcgggcccgggcacgaggagcccgugcccauguccacuuacggcuggaacguggucaagcugaugagcgggaaagacguguucuaucucccgccugagaagugugacacccugcugugcgacaucggugaguccucgcccucccccaccguugaagagagcaggaccauccgcguccugaaaaugguggagccguggcucaagaacaaccaguucugcauuaaagugcugaaucccuacaugcccacggucaucgagcaucuggagcgcuugcagagaaagcacggcgggaugcugguaaggaacccccugagucggaacagcacccacgagauguacuggaucuccaacggcaccgguaacaucguggccagcgucaacauggugucccgccugcugcugaaccgguucaccaugacucaucgacggccgaccaucgagaaggacgucgaccucggcgcuggaaccagacacgucaacgccgagcccgagacccccaacauggacgugaucggggagagaaucaaacgcauaaaggaggagcacaauuccacguggcacuacgaugaugaaaauccguacaagaccugggccuaccacgguuccuacgaggucaaggccaccgggagcgccuccagcaugaucaauggcguugugaagcuguuaaccaagcccugggaugucgugccaauggugacgcagauggcaaugaccgacaccacacccuucgggcagcagcgggucuucaaagagaagguggacacgcggaccccgcggucgaugcccggcacccgccgggugaugggcaucacagccgaguggcuguggcgcacgcuuggccggaacaagaagccccgccugugcacucgggaggaguucaccaaaaagguccgcaccaacgcagcgaugggcgccgucuuuacggaggagaaccagugggacuccgcaaaagccgccguggaggaugaggauuucuggaagcuggucgaccgagagcgggagcuccacaagcuggggaagugcggcagcugcguguacaacaugauggggaagcgcgaaaagaagcucggugaauucggcaaggccaaaggguccagagcgaucugguacauguggcugggcgcccgcuaccuggaguucgaggcccuggguuuucugaacgaggaucacugguucagccgggaaaacuccuacagcggcguggaaggggaggggcugcacaagcucggauacauccugcgcgacaucuccaagauucccgggggcgcgauguacgccgacgacaccgcugggugggauacccggauaaccgaggacgacuuacacaaugaggaaaagaucacgcagcagauggauccggagcaccgccagcucgccaacgccauuuucaagcugacuuaccagaacaaggucgugaaggugcagcggcccacccccaccggcaccgucauggacauaauuagccgcaaagaccagaggggcaguggccaggugggaacguacggguuaaacaccuucaccaauauggaggcccagcucauccgccaaauggagggcgaaggggugcucucaaaggcagaucuggagaacccccaucucccggaaaagaagaucacccaguggcuggagaccaagggcgucgagcggcugaagcgcauggcgaucuccggcgacgacugcguagugaaacccaucgaugaccgguucgccaacgcucuacuggccuuaaacgacauggggaagguccgcaaggacauuccccaguggcagcccuccaaaggcuggcacgacuggcaacaggucccguucugcucccaccacuuccacgagcucaucaugaaagaugggcggaaacugguggucccuugucgcccucaggacgaacugauaggccgggcccgcauuucccaaggggccgguuggucccuccgggagaccgccugccuggggaaggcuuacgcucaaauguggucccugauguacuuucaccgcagggacuuacggcuagcguccaacgccaucugcagcgccgugccggugcacuggguacccaccagccgcaccacguggagcauccacgcccaccaccaguggaugaccaccgaggacaugcugaccguguggaaccggguguggaucgaggacaaccccuggauggaggacaagacuccaguaaccacaugggagaacguccccuaccucgguaagcgcgaggaccaguggugcggcagccugaucgggcugaccagccgggccacgugggcccagaacauacccacugccauccagcagguacgcagccuaaucggcaacgaggaguuucuugauuacaugcccuccaugaagcgguuccgcaaggaggaggagagcgagggggccaucugguga

SEQ ID NO: 26018 - RNA, 9873 nt, Artificial Sequence
  derived and/or modified CDS sequence (opt11) from DENV-3__KF955451__SS-prME
accucucugugccucaugaugauucugccagcggcgcuagcguuccaccucaccucacgggacggcgagccgcggaugaucguagggaaaaacgagcggggcaagagccugcuguucaagaccgccagcgggaucaacaugugcacccucaucgccauggaccugggcgagaugugcgacgacaccgucaccuacaagugcccccacaucacagaaguggagccugaggacaucgacuguuggugcaaccugacuagcacauggguaacuuacggcacgugcaaucaggcgggggagcaucggagagauaaacgguccguggcccucgccccacacgucggcauggggcuggacacccguacccagaccuggauguccgccgaaggugccuggcgccagguggagaaggucgagaccugggcccuacgccacccgggauucacgauucucgcgcuuuuccuggcgcacuacaucggaaccucucucacucagaagguggugaucuucaucuuacugaugcuagucacgcccagcaugaccaugcggugcgugggggugggcaaccgcgacuucguugagggccuguccggggccaccuggguagacgugguucuggagcacggcggaugcgugaccacgauggccaagaacaagcccacccucgacaucgaacugcagaagacugaggccacgcaacuggcgacgcuccggaagcugugcauagaaggcaagaucacaaacauaaccaccgacagccgcugcccgacucagggcgaggccgugcugcccgaggagcaggaucagaauuacguuugcaagcauaccuacguugaccggggcuggggcaaugggugcggucuuuucgggaaaggcucucuggugacuugcgccaaguuccagugccuggagcccaucgaaggcaaggucgugcaguacgagaaccucaaguacaccgugaucaucacgguccacacuggggaccagcaccaggugggcaacgagacccagggggugacugccgagaucacgccccaagccagcaccacagaggccauucucccugaguacggcaccuuagggcucgaguguuccccgcgcaccggccuggacuucaacgagaugauccugcucacgaugaagaacaaggccuggauggugcaccggcaaugguuuuucgaccugccgcugccauggaccagcggcgccacgaccgagacccccaccuggaacaggaaggagcuccuggugaccuucaagaacgcccacgccaagaagcaggaggucgugguucuggggucccaggaaggggcgaugcauaccgcccucacgggggccaccgagauucaaaacagcggcggaaccuccaucuuugccggccaccugaagugccggcugaagauggacaagcuugagcugaagggcaugagcuacgccauguguaccaacacguuuguccugaagaaagagguuuccgagacccagcacgggaccaucuugaucaagguggaauacaagggugaagacgucccgugcaagauaccguuuagcaccgaagacgggcagggcaaagcacacaacggucgccugaucacggccaaucccguggugacuaagaaggaggaacccguaaacaucgaagccgagccgcccuuuggggagagcaauaucguaaucggcgugggggacaacgcucugaaaaucaacugguauaaaaagggcuccaguauagggaagauguuugaggcgaccgcccggggcgcccgccgcauggccauccugggcgacaccgccugggacuucggguccgucggcggggugcucaacucucugggaaagauggugcaccaaaucuuuggguccgcguacacagcccuguucuccggggucagcugggugaugaagauuggcaucgguguccuccucaccuggaucggccugaacucuaagaacaccuccauguccuuuucuugcaucgccaucgggauuaucacccucuaccugggcgucguggugcaggccgacauggggugugucauaaacuggaagggcaaggaguuaaagugcgggagcggcaucuucgugacgaacgaggugcacaccuggaccgagcaguacaaauuccaggccgacucccccaaacgccucgcgacugccaucgccggcgccugggagaacggggucugcggcauucgaagcacgacccggauggagaaccugcuuuggaagcagauagccaaugaacucaacuacauccugugggagaacaacauaaagcugaccgugguuguaggggauaucaucggcguguuagagcaggguaagcgcacccugacgccccagccuauggagcugaaguacuccuggaagaccugggguaaggcgaagauuguuaccgccgagacccagaacagcucauucauaaucgacggcccgaacacgccggagugccccagcgccagucgcgccuggaacguaugggagguagaggacuacggguucggcguguucaccaccaacauauggcucaagcugcgcgaagucuacacucaacugugcgaccaccgguugaugagugcggccgugaaggaugagcgcgccgugcacgccgacaugggcuacuggaucgagucucagaagaacgggaguuggaaacuggagaaggccucguugauagaggucaagaccugcacguggccgaagucacauacccuuugguccaacggcgugcuggaaucugacaugaucauccccaagagccuggcggggcccaucucucagcacaacuaucggcccggcuaccacacccagaccgccggacccuggcaccucggcaaacuggagcuagauuuuaacuacugugagggcacgaccguggucaucacggagaacugcgggacccgcggccccagccuccggaccacuaccguuagcgggaagcucauccacgaguggugcugccgcagcugcacccugcccccgcuccgcuacaugggcgaggacgggugcugguauggcauggagauucgccccaucuccgagaaggaagagaauauggucaagucucuggucucagcgggcagcggcgagguggacaacuucacgaugggagugcugugccucgccauccuguucgaggagguuaugcgggggaaguucggcaagaaacacaugaucgccgguguuuucuucacuuucgugcugcuccuuaguggccagaucaccuggagggauauggcgcacacgcugauaaugaucggcagcaacgcguccgaccggauggggaugggcguuacguaccucgcacugaucgccaccuucaaaauccagccuuuucuggcccucggcuucuuccuccggaagcugacuagccgggagaaccuccugcugggcgugggccucgcgauggccacaacacugcagcuacccgaggacgucgagcagauggccaacgggaucgcccucgggcugauggcccugaagcucaucacccaauucgagaccuaucagcuguggaccgccuugaucagccucacgugcuccaauaccaucuucacccugaccguggccuggcgcacugccacccugauccucgccggggugagccugcugccggucugccaguccagcuccaugcggaagaccgauuggcuccccaugacuguggcggccauggggguaccuccucuaccauuauucauuuucagccucaaggacacgcugaagcgccgcuccuggccacugaacgagggggugauggccgugggccuagugucgauccuggccagcagucuguugcggaacgacguucccauggccggcccccugguggccgggggccugcucaucgccugcuacgugaucaccgggacaucagccgaccugaccguggagaaggccgccgaugugacaugggaagaggaggcugagcagaccggggugucucacaaccuuaugaucaccgucgacgacgacgggaccaugcgcauaaaggacgacgagaccgagaacauccucacggugcugcugaagaccgcccuccugaucguguccggcaucuucccguauagcaucccagcgacccugcucgucuggcacaccuggcagaagcagacacagaggagcggcgugcugugggaugugccaagcccgcccgagacccagaaagccgagcuggaggagggggucuaccgaauuaaacaacagggcaucuucgggaagacccaggugggcguggggguacagaaggagggcguguuccacaccauguggcaugugacgcggggugccgucuugaccuauaacgggaagcgccuggagcccaacugggcguccgugaagaaggaccugaucucuuacggcggcggauggcggcucaacgcgcaguggcagaagggggaggaggugcaggucaucgccguggagccgggcaagaaccccaagaacuuccagacaaugccaggcaccuuccagacuaccaccggagagaucggcgccauugcgcuggacuucaagcccggcaccuccggcucccccaucauaaaccgcgaggggaaagugguugggcuguacggcaacgguguugugacgaagaauggcggguacgucagcggcauugcccagaccaacgccgagccggacgguccgacccccgaacuggaggaggagauguucaagaagcggaaucucacgaucauggaccugcaccccggguccgguaagacccgcaaauaccugcccgccaucgugcgcgaagccaucaaacggcgccuccgcacccuaauccuggcgcccacccggguggucgccgccgagauggaggaggcacucaaggggcugcccauccgguaccaaaccacagcuaccaagagcgagcacacuggccgggaaaucguggaucugaugugccacgcgaccuucacgaugagacuccugucccccgugcgggucccgaauuacaaucugauuaucauggacgaggcacacuucacggaccccgccagcaucgccgcgcgcggguacaucuccacgcggguggggaugggggaggccgccgccaucuucaugaccgccacgccgcccgguacggcggacgccuucccgcagagcaacgcccccauucaagacgaggaacgcgauauccccgagcgcuccuggaacagcggcaacgaguggauaacagauuucgccgggaagacgguaugguucguuccuuccaucaaagccgguaacgacaucgcgaacugcuugcguaagaacgggaagaaaguaauccagcugucacgcaagaccuucgacaccgaguaccagaagaccaagcugaacgauugggauuucguggucacgacggacaucuccgagaugggcgccaauuucaaggcggaccgggugaucgauccucgccguugccugaagcccgugauucugaccgacggacccgagagagucauccuggccggacccaugccggugaccgccgcgagcgccgcucagcgccgcggaagaguugggcgcaacccccagaaggagaaugaccaguacaucuuuacuggccagccucucaacaacgacgaggaccacgcccacuggaccgaagccaagaugcugcuggacaacauaaauacgcccgaaggaaucaucccggcccuguucgagcccgagcgggagaagucggccgccaucgacggugaguaccgacuaaagggcgagagccggaagaccuuuguggaacugaugcggcgcggggaccuacccguguggcuggcccacaaggucgcaagcgaggggaucaaguacaccgaucgcaagugguguuucgacggacagcgaaacaaccagauccuggaggagaauauggacguggagaucuggaccaaggaaggagagaaaaagaaacuacgcccucgguggcuggacgcccgcacauacagcgacccguuggcccucaaggaguucaaagacuucgcagcaggccgcaaguccaucgcgcuggaccuggugaccgagaucgggagagugcccacccaccucgcucaccgcacucguagcgcccuggauaaucuggugauguugcacacgucggagcacggcgguaaggccuaccgccacgccguggaggagcugcccgagaccauggagacgcuacuccuacugggccucaugauccugcugaccgggggcgcaaugcuguuccugaucagcggcaagggcaucggcaagacaagcaucgggcugaucugcgucaucgccuccagcgggaugcucuggauggccgagaucccauuacaguggauugccuccgccaucgugcuggaguucuucaugauggugcuccugaucccggagccagagaagcagcggacgccccaggacaaccagcuggcuuacgucgugaucgggauucucacccuggccgccaucaucgccgccaacgaaaugggacugcuggagacuacgaagcgcgacuugggcaugagcaaggagccggggguggucuccccgacaagcuaccuggacguggaucuccauccagcauccgcguggacccuguacgccguggcuaccacggucauuacccccaugcugcgccacacgauugagaacagcaccgcaaauguaucccuagccgccaucgccaaucaggcagugguccugaugggccuggacaagggguggccgaucagcaagauggaccucggugugccccuucuggcgcucgggugcuacucccagguuaacccccugacgcugacagcggccguuuuacugcuuaucacccacuacgccaucaucggccccggccuccaggcuaaggcgacccgcgaggcccagaagaggacggccgccggcaucaugaagaacccuaccguggauggcaucaugaccaucgaccuggaccccgugaucuacgacucgaaguuugaaaaacagcuggggcagguaaugcuccuuguucuaugcgccguccagcuucuucugaugcgcaccuccugggcguuaugugaggcccugacgcuggccaccgggcccaucaccacccucugggagggaagccccgggaaguucuggaauacgaccaucgccguguccauggcgaacaucuuccgggggaguuaccuggccggggcgggccuggcauucucgaucaugaaguccguggggaccgggaagcgcggcacugggucccagggcgagacccucggugaaaaguggaagagaaagcuuaaccagcugagccgcaaggaguucgaccucuacaagaaguccggcaucacggagguggaccgaacagaggccaaggagggccugaagcggggggagaucacccaccacgcggucucccggggcucggcaaagcuucaaugguucguagagcggaacauggugauuccggaggggcgggucaucgaccucgguugcgggcggggcggguggagcuacuacugcgccggccugaagaagguuaccgagguccggggauacacgaagggcgggcccgggcacgaggagcccgugcccaugagcacguacggcuggaacaucgugaaacugauguccgggaaagacguguucuaucucccgcccgagaagugcgacaccuuacuuugcgacaucggagagagcucccccagccccacggucgaggagucccgcacgauccgcgugcugaagaugguggagccguggcucaagaacaaccaguucugcaucaagguccugaaccccuauaugccuacugugauagagcaucuggagcggcuccagaggaagcacgggggaaugcuggugaggaacccccugagccgcaacagcacccacgagauguacuggaucagcaacggcaccgggaauaucgucgccuccgugaacauggugagccggcuccuguuaaaccguuucacgaugacccaccgccgcccgacuaucgagaaagacgucgaccuaggcgccggcacccgucacgugaacgccgagccggagacgcccaacauggacgucauaggggagcgaaucaagcguauaaaagaggagcacaacuccaccuggcacuacgacgaugagaauccguauaagaccugggccuaucacggaagcuacgaggugaaggccacgggauccgcaagcuccaugaucaacggugucgucaagcugcugacgaagcccugggacgugguccccauggucacccagauggccaugaccgacaccacccccuuuggccagcagcguguguuuaaagagaagguugacacccggaccccgcguccaaugccgggaacucggcgcgucaugggcaucacggcggaguggcucuggcggacccuggggcgcaacaagaaaccgcggcugugcacccgcgaggaguucaccaagaaaguacgaacgaaugcugccaugggcgcuguauucacagaagagaaccagugggacuccgcgaaggccgccgucgaggaugaggacuuuuggaagcucguggaccgggagcgcgagcugcacaagcugggaaagugcggcagcugcguguacaacaugauggggaagcgggagaagaagcucggcgaguuuggcaaagcuaaggggucgagagccaucugguacaugugguuaggcgcgcgguaccuggaguucgaggcccuuggguuccugaacgaggaccacugguucagccgcgagaacuccuauucuggugucgagggggagggccugcauaagcucggcuacauacugcgggauaucuccaagaucccugggggcgcaauguacgccgacgauaccgcaggcugggauacacgcaucacggaggaugaucugcacaacgaggagaaaaucacccagcagauggacccggagcaccggcagcucgcgaaugccaucuucaaguugaccuaccaaaacaagguggugaagguccagcgcccaacacccaccgggacugugauggauaucaucuccagaaaagaccaacgcggcuccggccaggucgguaccuaugggcugaacaccuuuacaaacauggaggcccagcuuauccggcagauggagggcgaggggguucugagcaaggccgaucuggagaacccgcaccucuccgagaagaagauaacgcaguggcuggagacuaagggcguggaacgcuugaaacggauggccauuagcggcgacgacugcguggucaagccaauugacgaccgcuucgcgaacgcucuccuugcgcugaacgacauggggaaggugcggaaggacaucccgcaauggcagcccucgaagggcuggcacgacuggcaacaggugccguucugcagccaccacuuccacgaacucauaaugaaggacggccgcaagcugguagugcccugccggccccaggacgaacugauuggcagggcacggaucucccaaggggcaggcuggucccuccgcgagaccgccuguuuaggaaaggccuacgcccaaaugugguccuuaauguauuuccacagacgggaccuccgccuggcuucgaacgccauuugcuccgccguccccguucacugggugccgaccagccggacgaccugguccauacacgcccaucaccaauggaugaccaccgaggacaugcugacgguauggaaccgcguauggaucgaggacaacccuuggauggaggacaagacccccgugacgaccugggagaacguccccuacuuggggaagagggaggaccaguggugcggcucuuuaauuggucugacuagccgcgcgacaugggcccagaacaucccgaccgcgauccagcagguccggucccucaucggcaacgaggaguuccuggacuacaugcccagcaugaagcgguucaggaaagaggaggaauccgaaggggcuaucugguga

SEQ ID NO: 26019 - RNA, 9873 nt, Artificial Sequence
  derived and/or modified CDS sequence (opt11) from DENV-3__KF955453__SS-prME
accucucugugucuaaugaugauucuccccgcgacccuggccuuccaccucaccagccgggacggggaaccgcggaugaucguagggaagaacgagcguggcaagagccugcuguucaagaccgcguccgggaucaacauguguacccucaucgccauggaccugggcgagaugugcgacgacaccgugaccuacaaguguccccauaucaccgaaguggagccagaggacaucgacugcuggugcaaccugacguccaccugggugaccuacgggacguguaaccaggcaggcgagcaucggcgcgacaaacgguccguggcacucgcgccccacgugggcauggggcuugacacccgcacccagaccuggaugagcgcggagggugccuggcgccagguggaaaaggucgaaaccugggcgcuccgccaccccggguuuacaauccucgcccuguuccuggcgcacuacaucgggacaucccuaacgcagaagguggugaucuuuauccuacugauguuaguuacccccaguaugaccaugcggugcgugggugugggaaaucgcgacuucgucgagggccuguccggagcgaccuggguggacgugguccucgaacauggaggaugcgugacgaccauggccaagaacaagcccacccucgauaucgaauugcaaaagaccgaagccacucagcuggcuacccuccggaaacuguguauagaggguaagaucaccaacaucaccaccgacagccgcugcccuacccagggcgaggcugugcugcccgaagagcaggaucaaaauuacgucugcaagcacaccuacguggacaggggcuggggcaacggguguggccucuucgggaagggcuccuugguaacaugcgcaaaguuccagugccuggagcccaucgagggaaagguggugcaguaugagaaccucaaguacacggugaucaucaccguccacaccggggaucagcaccagguggguaaugagacacagggaguaacagccgagaucacuccccaggccagcaccaccgaggccacccugcccgaguacgguacgcuggggcucgaauguuccccucgcaccggucuggacuucaacgaaaugauucuccuuacgaugaaaaacaaggcguggaugguacaucggcagugguucuucgaccugccuuuacccuggaccagcggcgccacgacagagacccccaccuggaaccgcaaagagcuccuggugacauucaaaaacgcccacgcaaaaaagcaggaggucguagugcugggcagucaggaaggcgccaugcauacggcgcucaccggggcgacugagauccagaacucuggagggacguccauauuugcuggccaccugaagugccggcugaagauggacaagcuagagcucaaaggcaugagcuacgcaaugugcaccaacacguucguccugaaaaaggaggugagugagacucagcacgggacgauccugaucaagguggaauauaagggcgaggacguaccgugcaagauuccuuuuagcaccgaagacggccagggcaaggcucacaauggccgccuaaucaccgcgaaccccguagugacaaagaaggaggagcccgucaacauagaggccgagccgcccuucggggagagcaauaucgugauaggcaucggggacaaugcccugaaaaucaauugguauaagaaagguuccuccaucgggaagauguucgaggccacggcgcgaggagcccgccgaauggccauccugggcgacaccgcuugggacuucggguccgugggaggaguauuaaauagccugggcaagauggugcaccagaucuucggguccgccuacacagcgcuguuuagcgggguauccugggucaugaagaucggcaucggggugcuccugacauggaucggacugaacuccaagaacacguccaugagcuucuccugcaucgcaaucgggauaaucaccuuguacuugggcgccguuguccaagccgacauggggugcguuaucaacuggaaggggaaggagcuaaaaugcgggagcgggaucuucgugaccaacgagguccacaccuggacggagcaguacaaguuccaagccgacucccccaaacgccucgcgaccgcgaucgcuggugcgugggagaacgggguuuguggcauacguucuaccacucggauggagaaccuucuuuggaaacaaaucgccaacgaacucaacuauauccugugggagaacaacauaaagcugacgguggucguaggcgacaucaucggcguccucgagcagggcaagcggacucugacgccccagccuauggagcugaaguacagcuggaagaccugggggaaggcgaagauagucacggcugaaacccagaacagcuccuucaucauagacggccccaacacccccgagugucccagcgccagccgggccuggaacguuugggagguggaggacuacggguucggggucuuuacaaccaacaucuggcucaagcuuagagagguguacacgcagcuuugcgaucaccgacucaugagugcugcggugaaagacgagcgggccguccacgccgacauggguuacuggauagaaucucagaagaacggauccuggaagcuggagaaggccagccugaucgaggugaagacuugcaccuggccgaagucccauacacucuggucaaacggcgugcuggagucugauaugauaauacccaagagccuggcaggucccauuucucagcacaacuaccguccgggcuaccacacgcagaccgcugggccguggcaccucggcaagcuagagcuggauuucaauuacugcgagggcaccaccgucguaaucacggagaacugcgggacucgcggccccagccuucguacaaccacuguguccggaaagcugauccacgaguggugcugccgcagcugcacccugccgccgcuccgguacaugggcgaagacgggugcugguacggcauggagauccgccccaucagugagaaggaagagaacauggucaagucccugguguccgccggaucuggggagguggacaacuucaccaugggcguucugugccucgccauacuguucgaggaggugaugcgggggaaguucggcaagaagcacaugaucgccgggguguucuuuaccuucgugcugcuucuguccggccagauaacguggcgcgacauggcgcacacccugaucaugauagguucaaacgccagugacaggauggggaugggcguuaccuaccuugcccugauagcgaccuucaaaauccaacccuuccuggcccucggguucuuccuucgcaagcugacgagccgcgagaacuuguugcucgguguuggccucgcaauggccaccacccugcagcugcccgaggacaucgagcagauggcgaacgggaucgcccugggccugauggcgcugaagcucaucacccaguucgagacguaccagcuguggaccgcucugaucagccucaccugcuccaacaccauuuucacuuuaaccguugcguggcgcaccgccacccugauccucgcaggaguuagcuuacugccggucugccaguccagcuccaugcggaagaccgauuggcuccccaugaccguugcggccaugggcgugccuccccucccguuguucauauuuaauuugaaggacacucugaaacguaggagcuggccccugaacgagggagucauggccgucggccucguuuccauccuggccucuucccugcuucgcaacgaugugcccauggcuggcccucugguggccggcgggcugcucaucgcaugcuacguuaucaccggaacgagugcggaccugacuguggagaaggccgccgacgugaccugggaggaagaagcggagcaaaccggggugucccacaaccugaugaucacuguggacgacgacggaacgaugcgaauuaaggacgacgaaaccgagaacauucucaccguucugcugaagaccgcccucuugaucgucuccggcauauucccguacuccauccccgccacacuucucgucuggcacaccuggcaaaagcaaacucagagaagcggcgugcugugggacgugcccucuccgcccgagacacaaaaagccgagcuagaggagggagucuaccgcaucaagcagcagggcauauucgggaagacccagguuggcguggggguccagaaggaggggguguuucacaccauguggcacgugacccgaggcgccguccucaccuauaacgggaagagauuggagcccaauugggcgagcgugaagaaggacuugaucaguuacggcgggggguggaggcugagcgcucaguggcaaaagggcgaggaggugcaggucauugcaguugagcccggcaagaacccuaagaacuuccagaccaugccgggcaccuuucaaaccaccacgggggagaucggcgccaucgcgcuggacuucaagccugggaccuccgguagcccaaucaucaaccgcgagggcaagauuguagggcuguacggcaacggagucgugaccaagaacgguggauacgucucagggauugcacagaccaacgccgagccggauggacccacaccugagcuagaagaggagauguucaaaaaacggaaccuaacaauuauggaccuccaccccggguccgggaagacccgcaaauacuugccggccaucguccgggaagcuaucaagagaagauugcgcacccugauucuggcgcccacgcgugugguggccgccgagauggaggaggcccucaagggucugcccauccgcuaccagacuaccgccaccaagagcgagcacacgggccgggaaauuguagaccugaugugccacgcgaccuucaccaugcgccuccuguccccggugcgcgugccgaauuacaaccuuaucauaauggaugaggcccacuucaccgacccagccagcaucgccgcgcggggguacauuagcacgcgggucggcaugggugaggcggccgccaucuucaugacagccacgccgccgggaacggccgacgccuucccgcagucuaacgcccccauccaggaugaagagcgcgacauacccgagcgcuccuggaacaguggaaacgaguggaucacggacuucgccgggaagaccgugugguuugugcccuccauuaaggccgguaacgacaucgcgaacugucuccggaagaacgggaagaaggucauucagcuaucccgcaagaccuucgauaccgaguaccagaagacgaaacugaaugacugggacuucgucguaaccaccgacaucuccgagaugggcgcgaauuucaaggcggaccgggugaucgacccccgccggugccucaagccggugauccucaccgacggccccgaacgagugauccucgccggaccgaugccggucaccgccgcgucugcagcccagcggcguggccgggugggcaggaacccccagaaggagaaugaccaguacaucuucacuggacagccccucaauaacgacgaagaccacgcccauuggacggaggccaagaugcugcuggauaacaucaauacccccgaggguaucaucccggcccuguuugagccagaacgcgagaagagcgccgccaucgacggcgaguaucgccugaaaggcgagagccggaaaaccuucguggagcugaugagacgcggggaccuccccguguggcuggcccacaagguggcguccgaggguaucaaguacacagaccgcaaguggugcuucgaugggcagcggaacaaccagauauuggaggagaacauggacgucgagaucuggacgaaggagggcgagaagaagaagcuccguccccggugguuggacgcccguaccuacagcgacccucuggcucucaaggaguucaaagacuucgccgccggccgcaaguccaucgcgcuggaccuggugaccgagaucgggcgggugccuacgcaccuagcacaucgcacccggaaugcccuggacaacuuagucaugcuacacaccagcgagcacggcggaaaagccuaccgccacgcaguggaggagcugccagaaaccauggagacguuacuccuucuggggcucaugaucucccugacggggggggcgaugcucuuccucaucucaggcaaggggaucggcaagaccaguaucgggcucaucugcgugauagccuccucgggcaugcuguggauggccgagaucccgcuacaguggaucgcuucugccaucguccuggaguucuucaugaugguccugcucaucccagagcccgagaagcagcguaccccucaggacaaccaacuggcuuacguggucauugggaucuugacgcuugcagcuaucauugccgccaacgagaugggccugcuggagacuaccaaacgcgaccucggcaugucgaaggaaccagggguggucucccccaccagcuaccuggacgucgaccugcaccccgccuccgccuggacccucuacgccguggcgacaaccgugaucacccccaugcugcggcauacaauugagaacucgaccgcgaacgucucccuggcagcaauagcgaaccaggccgucgugcucaugggcuuagacaaaggguggcccaucagcaagauggaccugggcgucccccuccuggcgcuggguugcuauucccaggugaacccccuuacacugaccgccgccgugcugcuucuaaucacgcacuacgcaaucaucggcccuggcuuacaggcuaaggcuacccgcgaggcacagaagcgaacagccgccgggaucaugaagaacccgaccguggacggcauuaugacgaucgacuuggaucccguuauuuacgacagcaaguucgagaaacagcuaggccaagugauguuacucguccugugcgccguucagcugcuucugaugcgcaccuccugggcucugugcgaggcccucacgcuggccacugguccaauaacgaccuugugggaaggcucgcccgggaaguucuggaacaccaccaucgccguguccauggcgaacaucuuccgaggcagcuaccucgccggggcgggcuuggccuucuccauaaugaaaucugucggaacuggcaagcgcggcacggguucccagggugagacccugggggagaaguggaagaaaaagcucaaucagcugucccguaaggaguuugacuuauauaagaaguccggaaucaccgagguggacagaaccgaggccaaggaggggcucaaaaggggcgagaucacccaccaugcggucucccgcggcagcgccaagcuacagugguuuguagagcggaacauggugaucccggaggggcgcgugauagaucuggggugugggcggggcgggugguccuacuacugcgcaggacucaaaaagguuaccgaggugagggguuacaccaagggugggccggggcacgaggaacccgugcccaugagcaccuacggguggaacaucgucaagcuaauguccggaaaggacguguucuaccugccaccugagaagugcgacacgcuccuuugcgacaucggcgaaucuucgcccagcccaacaguggaggaaucucggaccaucagaguccugaagaugguggagccguggcucaagaacaaccaguucugcaucaaggugcucaaccccuauaugcccacugucaucgagcaccuggaaaggcugcaaaggaagcacggcgggaugcucgugcgcaacccccugagccggaacagcacgcaugagauguacuggauaagcaacggcacugggaacauugucgccuccguaaacauggugagccgccuacuccuuaaccgcuucaccaugacccaccggagaccgacgaucgaaaaggacguggacuuaggugccggaacucgccaugucaaugcggagcccgaaacccccaacauggacgugaucggggaacggaucaagcgcaucaaggaggagcacaacucgacuuggcacuacgacgacgagaacccguacaagacgugggcuuaccacggcagcuaugagguuaaggccaccgggucagcuagcuccaugaucaacggcgucgucaagcucuuaacuaaacccugggacguagugcccauggugacgcaaauggccaugacggacaccacccccuucggacagcagagagucuucaaagagaagguggacacccguacuccgcgaagcaugcccggcacccgacgggugauggggaucacugcggaauggcuguggcggacccucggucggaacaagaagccccggcugugcacacgggaggaguucaccaagaagguccgcacaaacgccgccaugggggccguguuuaccgaggagaaucaaugggauagcgcgaaagccgccguggaggacgaggauuucuggaaacuggucgaccgcgagcgggagcuccacaaguuggggaagugcggcuccugugucuacaacaugaugggaaagcgugaaaagaaguugggcgaauucggcaaggccaaagggagcagagccaucugguacauguggcucggggcgcgcuaccuagaguucgaggcacugggguuccucaacgaagaccacugguuuucacgggagaacaguuacaguggcguugagggugagggccugcauaagcugggcuauauccuccgcgacaucuccaagauacccgggggugccauguacgccgaugacacggccggaugggacacccggauuacagaggacgaccuucacaacgaggagaagaucacgcagcagauggacccggagcaccgccagcuggcgaacgcgaucuucaagcucaccuaccagaacaaggucgucaagguccagcgacccacgcccacgggcacugucauggacauuaucucccgcaaggaccaacggggcagcggccagguggggaccuacgggcugaacacauuuaccaacauggaagcccagcugauccgacaaauggagggggagggggugcucuccaaggccgacuuggagaauccacaccuccccgagaagaaaauaacacaauggcuggagaccaagggaguggagcggcugaagcgcauggccaucaguggcgacgacugcguugugaagcccauugacgaccgguucgcaaacgcgcugcucgcccuaaacgacauggggaaaguccgaaaggacaucccacaguggcaacccucaaaaggcuggcaugacuggcagcagguaccauucugcagccaccacuuccaugagcugaucaugaaggacggucggaaguugguggugcccugccgcccccaagacgagcugaucggccgggcccgcaucagucaaggggcuggcuggagccugcgggaaacggccugccucggcaaggccuacgcccagauguggucccugauguacuuccaccgcagagaccugcggcucgccagcaacgcuaucugcuccgccguucccgugcacuggguccccaccagccggaccaccugguccauacaugcacaccaccaguggaugacgaccgaagauaugcugaccguguggaaccggguguggaucgaggacaaccccuggauggaggacaagacccccguuacaaccugggagaaugugcccuacuuaggaaagcgcgaggaccagugguguggcagccucauugggcugaccagccgggccacaugggcccagaacaucccgacggccauccagcaagucagaucccugaucggcaacgaggaguucuuggacuacaugccuucaaugaagcgguuucggaaggaggaggagucagagggggcaaucugguga

SEQ ID NO: 26020 - RNA, 9873 nt, Artificial Sequence
  derived and/or modified CDS sequence (opt11) from DENV-3__FJ373304__SS-prME
accagccucugccuaaugaugauccugccugccgcccucgcguuccauuugaccucccgggacggcgaaccacggaugaucguggggaaaaacgagcgcggcaagagccuguuguucaagaccgccagcgggauaaacaugugcaccuuaauagccauggaccugggggagaugugcgacgacacggugaccuacaaaugcccacacauaaccgagguagagccugaagacaucgauugcugguguaaucucacaucuacaugggucaccuacgguacgugcaaucaggcgggcgagcaccgccgcgacaagcggucggucgcccuggcgccccacguaggcaugggccuggauacccgcacccaaaccuggaugucggccgagggcgccuggcgucaggucgagaaaguugaaacgugggcgcugcgccacccgggguucaccaucuuagcguuauucuuagcccauuauauaggcaccuccuuaacacagaagguggugaucuucauccuucuaaugcuugucacgcccucgaugacuaugcggugugugggugucggaaaccgcgacuucgucgagggucugucgggagcgaccuggguggacgugguacuggaacauggcgggugcgucaccacgauggccaagaacaagcccaccuuagacaucgaguugcagaagaccgaggccacccagcuggccacgcuccgaaaacuaugcauagagggaaagauuaccaacauaaccaccgauagccgcugucccacucagggcgaggcugugcugccagaggaacaagaccagaacuacgucuguaagcacaccuacguggaccgcggcuggggcaacgguugcggccucuucggaaagggcagucuggugaccugcgccaaguuccagugccuugaacccaucgaaggcaaagucgugcaguaugaaaaccucaaguacaccgugauuaucacgguccacaccggggaucagcaucaagugggaaaugaaacccaggggguaacugccgagaucacgccccaggcaaguaccaccgaagcgauacuucccgaauauggcacccugggucucgagugcuccccgcgcaccggacuagacuucaaugagaugauucugcucacaaugaagaacaaggccuggauggugcacagacagugguuuuucgaccugccacugcccuggaccagcggcgcuaccaccgagacgcccacuuggaacaggaaggaguuacuuguuaccuucaagaacgcacacgcaaaaaagcaggaggucgucguucugggcucacaggaaggggcgaugcacacggccuugacgggugcaaccgagauucagaacagcggcgggaccuccaucuucgcaggucaccucaagugccgacuaaagauggauaaacucgaacugaagggcaugagcuacgccaugugcacgaacacauucgugcugaagaaggaggugucagagacccagcacgggaccauucuaaucaaggucgaguacaagggcgaggaugucccuugcaagauacccuucucgaccgaggacgggcagggaaaagcccacaacgggcgccuaaucacggcuaaccccgucgugaccaagaaggaggagcccgucaacaucgaggcagaaccgccauucggagagagcaauaucgugaucggcaucggggacaacgcucugaagauaaacugguacaagaagggcucuagcaucgggaagauguucgaggcgacagcgcggggcgcucgccggauggccauccucggcgacaccgcgugggauuuugguuccgugggaggugucuugaauagucuggggaagguagugcaccaaauuuucggauccgcguacaccgccuuauucucaggcguaaguugggugaugaagaucggcaucggagugcuauuaacuuggaucggacuuaacuccaaaaacacuuccaugagcuucaguuguaucgccauugggaucauuaccuuauacuugggugcagucguucaggccgauauggguugcgugaucaacuggaagggcaaagaguuaaaaugcggcagugggaucuucgucacgaacgagguacacaccuggacagagcaauacaaauuccaggcggacucccccaagcgccucgccaccgcuauagccggagccugggagaacggggugugcggcauccguuccacgacccggauggagaaucuccuguggaagcaaaucgcgaacgaacucaacuacauccugugggagaauaacaucaagcugaccgucguggugggggacaccauuggcgugcucgaacaggguaagcgcacccugacgccgcagcccauggagcuaaaguauucguggaagacgugggguaaagccaagaucgugaccgccgagacgcaaaacagcuccuucaucaucgauggcccaaacacccccgagugcccgagcgccucgcgggcuuggaacguaugggagguggaggacuauggguuuggcgucuucaccaccaauaucuggcucaagcugcgagagguguacacucaguugugcgaucaccgguuaaugucggccgcuguaaaggacgagcgcgccgugcaugcugacaugggcuacuggaucgaaagccagaaaaacggguccuggaaacuggaaaaggcgagccucauugaggugaaaacguguacguggccgaagagccacaccuuguggagcaacggcguccuggaguccgacaugaucauacccaagagucucgccgggcccaucucucaacacaauuaccggccuggauaccauacucagacggccgggcccuggcaucuuggcaagcuggagcuggacuucaacuacugcgagggcacgaccgucgugaucaccgagaacuguggcacgcgcggcccuagccuccguaccacgaccgucuccgggaagcugauacacgagugguguugccgcucaugcacgcugccgccgcugagguacaugggugaggacggcugcugguacggcauggagauccgccccauauccgaaaaagaggagaacauggucaagagcuuaguguccgcuggcucgggagagguagauaacuucaccaugggcgugcuguguuuagccauucuuuucgaggagguaaugcggggcaaguucggcaaaaaacacaugauagcgggggucuucuucacauucgugcuacuccuguccggccagaucaccuggcgggacauggcccacaccuugaucaugauaggcagcaacgccuccgaccgaauggggaugggaguaacguaccuugcgcugaucgccaccuucaagauccagccuuuccuggcauuaggguucuuucugcgaaagcugacaucuagggagaacuugcugcugggcguaggccucgcaauggccacgaccuuacagcuaccggaggacaucgaacagauggcaaaugggaucgcgcucggcuugauggcccugaagcuaaucacccaauuugaaaccuaucagcuguggacggcccuaauuagcuugacguguuccaauacaaucuucacacugacgguggccuggcggaccgccacguuaauccuugcgggggucagccugcugccugucugccagucaaguucaaugcggaagaccgauugguugccgaugacgguggcggccaugggcgugccgccccucccucucuuuaucuucagccucaaagacacccucaaaaggcgauccuggccacugaacgaaggugugauggcgguaggccucgugagcauccucgcuuccucacuguuaaggaaugacguuccuauggcgggcccucugguagccggagggcuacuaaucgcaugcuacguaaucaccgggaccuccgccgaccugaccguugagaaggccgcggacgugaccugggaggaggaggccgaacaaaccggcgucagccacaaccucaugaucacaguggacgacgacgggaccaugcgcaucaaggaugacgagacagaaaauauccucaccgugcugcuaaagaccgcccuccugauaguuagcggcaucuucccguacagcaucccagccacccuacuuguguggcauaccuggcaaaagcagacgcagcggaguggcgugcugugggauguccccagcccuccggagacccaaaaagcugagcuggaggaagggguguaccguaucaagcaacagggcauauuugggaagacccagguuggggucggcgugcagaaagaaggcgucuuucacacgauguggcacgucacccgcggcgcggugcuuaccuauaacgggaagcgccuggaaccaaacugggcuuccgugaagaaggauuugauuagcuauggcggcggcuggcggcuuuccgcacaauggcagaaaggcgaggagguccaggugaucgcaguggaacccggcaagaacccaaagaacuuccagaccaugcccggcacguuccagacuacgacaggggagaucggggcaaucgcccucgacuucaagcccgggaccuccggaagccccaucaucaaccgcgagggcaaggucguggggcuguacgggaacgggguggucacgaagaacggaggguacgucuccgguaucgcccagacaaacgccgagccggacggccccacaccagagcuggaggaggagauguucaagaagagaaacuugacaauuauggaccugcaccccggcagcgggaagacccgcaaauaccuuccagccauaguccgcgaagcgaucaagcgccggcuccguacccugauccuagcccccacccgggucguagccgccgagauggaggaggcccucaaggggcugcccauccgguaucagacaaccgcgaccaaguccgagcacacaggucgggagauaguugaucucaugugucacgccacuuucaccaugcgccucuuaagccccguccgagugccuaacuacaaccuaauuaucauggacgaagcccacuucaccgacccggccagcaucgccgcccgcggguauaucaguacccggguggggaugggcgaggccgcugcgaucuucaugacggcaacgccuccugggacggcagacgcauuuccacagagcaacgccccaauucaggacgaagagcgcgacauucccgagaggagcuggaacuccgguaaugaguggaucaccgacuucgccgggaagacggucugguucguacccagcaucaaggcaggcaacgacaucgccaacugcuuaagaaagaauggaaagaagguuauucagcucagucgaaagaccuuugauaccgaguaucagaaaaccaaguuaaaugacugggacuuugucgugacgaccgauauaucggaaaugggcgccaacuucaaggccgaccgggugaucgacccccgccggugccucaagccaguaauccugacagacggccccgagcgcguaauacuggccgggcccaugccggucacggcggccucggccgcucagcggcgcgggcgggucgggcgcaacccccagaaggaaaacgaccaguacaucuucacgggccagccccucaacaaugacgaggaccacgcacacuggacggaggcgaagaugcugcuugacaacaucaauacccccgaggggaucaucccggcacucuucgagcccgagcgugagaaaucagccgccaucgacggagaguaucgccugaagggcgaguccaggaagacguuuguggagcugaugcgccgcggugaccuacccguguggcuggcgcacaagguagccagcgagggcaucaaguauaccgaccgcaagugguguuucgacggccagcggaacaaccagauccuggaagagaauauggacguggagaucuggaccaaagagggggagaagaaaaagcuccguccgcgguggcuagaugcacgaaccuacagcgacccucuggcacugaaggaguucaaggacuuugccgcgggccgcaaaagcaucgcccuggaccugguaacagagauaggucggguacccacccaucuugcccaccgcacccggaacgcgcuggacaacuuggugaugcuacacaccuccgagcacggcgggaaggccuaccgccacgcggucgaggagcugcccgaaaccauggagaccuuauuacucuuaggacucaugauccuacugacuggcggggccaugcuguuccugaucagugggaaagggaucgguaaaacaagcaucgggcugaucugcgugaucgcguccagcggcaugcuuuggauggccgaaaucccucuacaguggauagccagcgcaauuauucuugaauucuucaugaugguguuacugauccccgagccggagaagcaaagaacuccccaggauaaccaacuggccuacgucgugaucgggauucucacucuagcggccauuaucgcggcgaacgaaaugggccugcucgagaccaccaagagggaccuaggcaugagcaaagagccggggguagucuccccgaccucguaucuagacgucgauuugcaccccgccucagcguggacacuauaugccgucgcgacgacggucaucaccccaaugcuccggcacaccauagagaacaguaccgccaacgugucccucgcagcgaucgcgaaucaggccguaguccugaugggccuggacaagggguggccaaucuccaaaauggaccucggugugccucugcuggcccucgggugcuacucacagguaaacccccugacccugacagcagccguucuccugcucaucacccacuacgccaucauuggccccgggcuccaggcgaaagcgacgcgcgaggcucagaagcggaccgcagccggcaucaugaagaacccuaccguggaugguaucaugacgaucgaccuggaucccgugaucuacgacagcaaauucgagaagcagcuggggcagguuaugcuccuaguguugugcgcuguucaguuacuguuaaugcgaacguccugggcacucugcgaggcucuaacgcuggcuacaggccccaucaccacccucugggaaggcagccccgguaaguucuggaacaccaccauugcggucuccauggcaaacaucuuucggggaagcuaccuggccggggccggccuggcauuuucgaucaugaaguccguagggaccggcaagcgagguaccgggagccaaggcgagacauugggggagaaguggaagaagaagcuuaaccagcugucgcgaaaggaguucgaucucuauaagaagucgggcaucacugaaguggaucggacggaggcuaaggagggacuaaaacgcggagaaaucacacaccacgcggucucccggggcagcgcuaagcuacagugguucguagagcggaauauggugaucccagagggucgcgucaucgaccuuggcuguggacggggcggcugguccuacuauugcgccgggcuaaagaaagugacugaagugagaggcuacacaaagggcgggcccggacaugaagagccuguccccaugucgaccuacggguggaacauagugaagcugaugucugggaaagauguauucuaccucccaccagagaagugcgauacccugcugugcgacaucggugagaguucccccagccccacgguggaggagucacggacuauccgagugcugaaaaugguagagccguggcucaagaacaaccaguucugcaucaaagucuuaaaccccuauaugcccaccgucauagaacaccuagagaggcuccagcggaagcacggcgggaugcuggugcgcaacccauugucacggaacuccacucacgaaauguauuggaucagcaauggaacggguaacaucgucgccagcgugaauaugguaagccgccugcuauugaaccgguucacaaugacccaccgccggccuacuauugagaaagacgucgaccucggcgcgggcacgcgccacguaaacgcugagcccgagaccccaaacauggacguuauaggugagcgcauaaagagaauaaaggaagagcacaacuccacuuggcacuaugacgacgagaacccguacaagaccugggcuuaccacggcucuuacgaagucaaggcgacugguucagccucaucgaugauuaacgggguggugaaguuguugaccaaacccugggacguagugccuauggucacccaaauggcgaugacugauacuacccccuucggccagcagcguguuuucaaggaaaagguggauaccagaacaccgcguagcaugcccggcacgcgccggguuaugggcaucaccgccgaguggcucuggcgaacccuggggcggaacaagaagccuagacugugcacccgggaggaguuuacgaagaaggugcgcacaaacgccgcaaugggagcggucuuuaccgaagagaaucagugggacuccgcaaaggccgccgucgaagaugaggauuuuuggaagcucguagaccgugagcgagaacugcacaaacugggaaaauguggcaguugcguguacaacaugauggggaagagagagaaaaagcucggcgaguuuggaaaggcgaaagggucucgggccaucugguacauguggcugggugcgagguaucuggaguucgaggcccuaggcuuccugaacgaagaccacugguucagucgggagaacagcuauuccggggucgagggagagggccugcauaagcugggcuauaucuuaagagacauuucaaagauccccgggggugccauguacgccgacgacacugcugggugggacacgcggauuaccgaggaugaccuccacaacgaggagaaaaucacccagcagauggacccugaacacaggcagcucgccaacgccaucuucaagcugaccuaccagaacaaagugguuaagguccagaggcccacuccgacggggaccgugauggacaucaucagucgaaaggaccagaggggcagcggacagguagguacauacgggcugaacaccuucacgaacauggaggcccaacucauccgccagauggagggcgaggguguccuguccaaagccgaucuggagaauccacaucuuccugagaagaagauaacucaguggcucgagaccaagggcguggagcggcugaagcgaauggcgaucaguggcgacgacugcguggucaagcccaucgacgaucgguucgccaacgcccuacuggcccuuaacgacaugggcaagguacguaaggauauuccccaguggcagccguccaaaggcuggcacgacuggcaacaagucccuuucuguagccaucacuuccacgaguuaauaaugaaggaugggcggaagcuggucguucccuguagaccccaagacgaacugaucggacgggccaggaucucccaaggggcaggcuggagccuccgggaaaccgcgugucuaggcaaggccuacgcgcagauguggucccugauguacuuccaucgcagagaccuccgacuugcuaguaacgcgauauguagcgccgugcccguacauugggugccuacgucgcgcacuaccugguccauccaugcucaccaccaauggaugaccacggaagauaugcugaccguuuggaacagaguuuggaucgaggacaauccguggauggaggacaaaacccccgugaccacgugggaaaacguccccuauuuggggaagagggaagaccagugguguggcagccugauaggcuuaacuagccgggccacgugggcgcagaacaucccgacggcgauccagcagguacgaucccucaucggcaaugaagaguucuuagauuauaugccguccaugaagcgauuccgcaaggaggaggaguccgagggcgccauaugguag

SEQ ID NO: 26021 - RNA, 9873 nt, Artificial Sequence
  derived and/or modified CDS sequence (opt11) from DENV-3__EU854291__SS-prME
accagccucugcuugaugaugauccugcccgccgcccuggcauuccacuugaccuccagagacggcgagccgcggaugauuguugggaagaaugagaggggcaagucucugcuuuucaagacugccuccgggaucaacaugugcacccucaucgcuauggaucugggagaaaugugcgacgacacuaucaccuacaagugcccccacaucaccgagguggagcccgaggacaucgauugcuggugcaaccugaccaguacaugggugaccuacgggaccugcaaccaggccggcgagcaccggcgcgacaagcgguccguagccuuggcuccccacgucggcauggggcuugacacccgcacccagaccuggaugagcgccgagggggccuggcgccagguggagaagguggagacuugggcucugcggcacccgggguucaccaucuuagcgcuguuuuuagcccacuacauaggcaccucccucacccaaaaggucgugaucuucauucugcugaugcucgugacuccguccaugacaaugcggugcgucggggugggcaaccgcgacuucguggaaggccuguccggggccaccugggucgacguagugcucgagcauggcgggugcgucaccacaauggccaagaacaagccaacccucgacaucgagcugcagaagacagaagccacccagcuggcgacgcuccggaaguugugcauagagggcaagaucacgaacaucacgacggacucgcguugccccacgcagggcgaggccgugcuuccggaggagcaggaccagaacuacgugugcaagcacaccuacgucgaucgggggugggggaacgggugcgggcuuuuugggaagggcucccuaguuaccugugcgaaguuccagugccuggaacccaucgagggaaaggugguccaguacgaaaaccucaaguacaccgugaucaucacggugcacaccggggaccagcaccagguggggaacgagacccagggggugaccgccgagaucacuccgcaggcgagcacaaccgaagcgauccugcccgaguauggcacacuugggcuagagugcuccccgcgcaccggccuggacuuuaacgagaugauccugcucacgaugaaaaauaaggccuggaugguccaccgucagugguucuucgaccuaccucugccuuggaccagcggcgcaaccaccgagacgcccacauggaaccgcaaggagcuccugguuacauucaagaacgcccacgccaaaaagcaagagguggucgugcuggggucccaggagggcgcgaugcauacagcccucacgggagcaaccgagauccaaaacuccggcggcaccuccaucuucgccggccaccuaaagugccgacugaagauggacaaguuagagcugaagggcauguccuacgccaugugcaccaacacauucguccugaagaaggaggucuccgagacccagcacgggaccauccucaucaaaguugaguacaagggcgaggaugugccgugcaagaucccauucucgaccgaggacggccagggcaaggcgcauaaugguaggcucaucacagccaaucccguggucacgaaaaaggaggagcccgugaacauugaagccgagccgcccuucggggaguccaacauagucaucggcaucggagauaaugcccugaaaaucaacugguauaagaaaggcucuagcaucgggaagauguucgaagcuacagcccggggcgcccgccggauggccauccugggcgacaccgccugggacuucggcuccgugggcggggugcucaacagcuuagggaagaugguccaccagaucuucggcagugcguacacggcucuguuuucgggcguguccugggugaugaagaucggcaucgggguccuccugaccuggaucggcuuaaacagcaagaacaccuccaugagcuucuccugcaucgccaucggaaucauuacacuguacuuaggcgcuguggugcaggccgacaugggguguguaaucaacuggaagggcaaggagcugaagugcgguagcgggaucuucgugacgaacgagguucacaccuggaccgagcaguacaaguuccaggcggacucccccaagaggcuugccaccgccaucgcaggcgccugggagaacgggguuugcggcaucagaagcacgacccggauggagaaccugcuguggaagcagauugcgaacgagcucaacuacauccugugggagaauaauaucaagcugaccguaguggucggggacaccaucggcgugcuggagcagggcaagcgcacgcuaacgccccagccgauggagcugaaauacagcuggaagaccugggggaaggcaaagaucgugaccgcagaaacgcagaacucguccuuuaucaucgauggccccaacacccccgagugucccagcgccagccgggcguggaacguaugggagguagaggacuacggguucggcguguuuaccaccaacaucuggcucaagcugcgcgaggucuacacccagcugugugaccaccggcuaaugagcgccgcagucaaggaugagcgcgccguccacgccgacaugggauacuggaucgagagccagaagaacggguccuggaagcuggagaaggcgagccugauugaggucaagaccugcacguggccgaagucccacacccucuggucuaacggcgugcuggaguccgacaugaucaucccaaagagccuggccgggccgaucucccagcacaacuaccggccaggcuaccauacccagacggccgggccguggcaccucggcaagcuggagcuggacuucaacuacugcgagggcaccaccguagucaucaccgagaacugcgggacgcgcggccccucccuccggaccaccacgguguccgggaagcugauccacgaguggugcugccgcagcugcacucugcccccucuccgguauaugggcgaagacggguguugguacggcauggagauacgcccugugagcgaaaaggaggagaacauggucaagagcuugguguccgcaggaagcggcgagguggauaauuuuaccaugggcguccugugccucgcaauccuguucgaggaggucaugcgggggaaauuuggcaaaaagcacaugaucgcgggugucuucuuuaccuucguacugcuccuguccggccagaucaccuggcgcgacauggcccacacgcugaucaugaucggcagcaacgccuccgaccggauggggaugggcguuacauaccucgcucugaucgccaccuucaagauccaacccuuccuggcgcucgguuucuuucuccgcaagcugaccucucgggaaaaccuccuguugggcgugggauuggcuauggccacgacccugcagcugcccgaggacaucgagcagauggcgaacgggauagcccugggccugauggcccugaaacucaucacccaguucgagaccuaccagcuguggacggcccugaucagccugaccugcuccaacaccaucuucacccugacggucgccuggcgcaccgcgacccucauccucgcgggggugagcuuacugccagugugccaguccuccucgaugcggaagaccgacuggcuccccaugacgguugccgccaugggcgugccgccccucccgcuguucaucuucagccucaaggacacccugaagcgccgcuccuggccacuuaacgaaggggucauggccgugggccuugugagcauccuggcuagcagccuguuacggaaugacguccccauggccggcccccugguggccgggggccuccucaucgccugcuacgugaucacagggaccuccgccgaccugacgguggagaaggccgcagacgugacgugggaagaggaggcggagcagaccggcgugagccauaaccugaugaucaccguagacgacgacgggaccaugcguaucaaagaugaugagacggagaacauucucacggugcugcuuaagaccgcccuccugaucguguccggaaucuuuccguacuccauccccgccacccugcucgucuggcacacguggcagaagcagacccaacggagcggggugcuuugggacgucccgagcccgcccgagacccagaaggccgagcuggaggagggggucuacaggaucaagcagcagggcaucuuugggaagacccaagugggcguggggguccagaaggaggguguauuccacacuauguggcacgugacccggggcgcgguccugaccuacaacggcaagcgccuagagccuaauugggcauccgugaagaaggaccuaaucagcuacggcgggggcuggcgguuaucugcccaguggcagaagggagaggagguacaggucaucgccguggagcccggcaagaacccaaagaacuuccagaccaugcccggcacguuccagaccacuacuggggagaucggugcgaucgcccuggacuucaagccggggacguccggcagccccaucauuaaccgcgagggcaaaguagucgggcuguauggcaacgggguggugaccaagaauggcggauaugucuccggcaucgcccagaccaacgccgagccggacgguccgacccccgagcuggaagaggagauguuuaagaagcggaaccuuacgaucauggaccugcauccuggguccggcaagacccggaaguaucugccggccaucgugcgggaggccauuaagcgccgacuccgcacucugauccuggcccccacucggguggucgccgccgagauggaggaggccuugaaggggcugcccaucagguaccagaccacagcgaccaaguccgagcacacaggccgcgagaucguggacuuaaugugccacgccacguucacgaugcgccuccugagccccgugcgggucccgaauuacaaccuaaucauaauggacgaggcccacuucaccgaccccgccuccaucgcugcgcgcggguacaucagcacgcggguggggaugggcgaagccgcggcgaucuucaugacggcgacaccgcccggaaccgcggacgccuucccgcaguccaacgcacccauccaggacgaggagagggacauccccgagagaagcuggaacuccggcaaugaguggaucacugacuucgcggggaagacggugugguucgucccuagcaucaaggcgggcaacgacaucgcaaauugucuccggaaaaacgggaagaaggugauccagcuuucaagaaagacguucgacaccgaguaucagaagaccaagcugaacgauugggacuucguugucacgaccgauaucagcgagaugggcgccaauuucaaggcggaccggguaaucgacccgagacggugccucaagcccgugauucugaccgacggcuccgagcgcgucauacuggcggggcccaugcccgugaccgcagccucagcagcgcagcggaggggccggguggggcgcaacccgcaaaaggagaacgaccaguauauuuucaccggccaaccauugaauaacgacgaggaccacgcccauuggacggaggcgaagaugcuuuuggacaauauuaauacccccgaggggaucauccccgcccucuucgagccggagcgggagaaguccgccgccaucgacggagaguaccgcuugaagggugagucccggaagaccuucgucgaacugaugcgccgcggagaccuccccguguggcuggcgcauaaggucgcguccgagggcauuaaguacacagaccgcaaguggugcuucgaugggcagcggaacaaccagauccuggaagagaacauggauguggagaucuggacgaaggagggugagaagaagaagcuucgcccccguuggcuggacgcccgcaccuacagcgacccccuggcccucaaggaguucaaggacuuugccgcgggccgcaaaagcaucgcccucgaucuuguuacugagaucgggcgggugccgacgcaucucgcccaucgcacucggaacgcccuggacaaccuggugaugcuccacaccuccgagcacgguggaaaggcauaucgccacgcgguggaagaacugcccgagaccauggagacccugcuccuccuggggcucaugauccugcugaccggcggugccaugcuguuccugaucagcgggaaggggaucggaaagaccuccaucggccuuaucugugucaucgcaagcucuggcaugcucuggauggccgaaaucccucuucaguggaucgccagcgcgaucguccuggaguuuuucaugaugguacuccugaucccggagcccgagaagcagaggacgccgcaggacaaccagcucgccuacgucgugaucgggauucucacucuagcugccacgauugccgccaaugagaugggccugcuggagaccaccaagcgcgaccugggcauguccaaagagcccgguguggucagcccgaccucauaccuggacguggaccuccacccugccucggcguggacgcuguacgccguggcaaccaccgucaucacccccaugcugcggcacacgaucgagaacuccaccgccaacgugagccucgccgccaucgccaaccaggcggugguccugaugggcuuggacaagggguggcccaucaguaaaauggacuugggcgugccgcugcuggcccucgggugcuacagccaggugaacccccugacccugaccgcggccgugcuucuguugaucacgcacuacgccaucaucggccccggccuccaggcgaaggccaccagagaggcccagaagaggaccgccgccggaaucaugaagaaccccaccguggacggcaucaugacaaucgaccuugacccggugaucuacgacuccaaguucgagaagcagcuggggcagguaaugcuacugguucuaugcgcgguacagcuucugcugaugcgcaccagcugggcccucugcgaagcucugacccuggccaccggccccaucacgacccuuugggagggcuccccggguaaguucuggaacaccaccaucgcgguaagcauggccaacaucuuccggggauccuaccucgccggcgcaggccuagcauucagcaucaugaagucuguggggaccggaaaaagaggcacggggagccagggcgaaaccuugggggagaaauggaagaagaaacucaaccaacugagcagaaaggaguucgaccucuacaagaaguccggcaucaccgagguggaucgcaccgaggcgaaggagggacugaagcgcggcgagaucacgcaccacgccgucagccgcggguccgccaaacugcagugguucguagagagaaacauggucauccccgaggggcgcgucauagaccucggcugcgggcggggcggguggagcuacuauugugccggccuaaagaaggugacugaggugcguggcuacacgaagggcggcccggggcacgaggagcccgucccuauguccaccuacggcuggaacaucguaaaacugaugagcggaaaggacgucuucuaccucccccccgagaagugcgacacguugcugugcgacaucggagaaucaagcccuucccccaccguagaggagagccggacaauacgugugcugaagaugguggagcccuggcucaagaacaaccaauucugcaucaagguccuaaaccccuauaugcccaccgugaucgaacaccuggagcgguugcagcggaaacauggcgggaugcugguacgcaacccacugucccggaacucgacucaugagauguacuggaucuccaacgguaccgggaacaucgucgccucugugaacauggugucgcgccuccuguuaaacagauucaccaugacgcaccgcagacccacgaucgagaaggacgucgaccucggagcgggcacccgccacgugaacgccgagccggagacccccaacauggacgugaucggagagcggauaaagcgcaucaaagaggagcacaacagcaccuggcacuacgacgaugaaaacccguacaagacgugggccuaccacggcuccuaugaagucaaagccaccgggucagccucuagcaugauaaacggcguggucaagcugcugaccaagccgugggacguggugcccauggugacccagauggcgaugacggacaccacgcccuucgggcagcaacggguguucaaggagaaaguggacacacgcacgccccggccgaugccuggaacccguagagucaugggcauaaccgccgaguggcucuggcgcacgcuggggcggaacaaaaagccccgacugugcacgcgggaggaauucaccaagaagguccgcacaaaugccgccaugggcgcgguguucacagaagagaaucagugggacagcgccaaagcagccgucgaggacgaggacuucuggaaacucguggacagagaacgggagcugcacaagcuugguaaguguggcuccugcguguauaacaugauggggaagcgcgagaagaagcucggcgaguucgguaaggcaaaagggagccgggcgaucugguacauguggcugggcgcccgcuaccuggaguucgaggcacuuggguuucugaacgaggaccacugguuuucacgggagaacucuuacuccggagucgaaggggagggacugcacaagcucggcuacauccugcgcgacaucagcaagaucccugggggcgccauguacgccgacgacacggcggggugggacacucgaaucaccgaagacgaccugcacaacgaggagaagaucacccagcagauggacccggagcacaggcagcuagccaaugcgaucuucaaauuaaccuaccagaacaagguggugaagguccagcggcccacgccuaccggcacggugauggacaucaucucccgcaaggaccagcggggcuccggccagguggguacuuacgggcugaacacauuuaccaacauggaggcccagcucauccgccagauggagggggaggggguccuguccaaggccgaccuagagaacccccaccucccggagaaaaagauuacucaauggcuggaaaccaagggcguggagaggcugaagcgcauggcgaucagcggcgacgacugcguggucaagcccaucgacgaucgauucgcuaacgcccuccucgcccugaacgacauggggaaagugcgcaaggacauaccccaguggcagcccucaaagggcuggcacgacuggcagcaggucccguucugcagccaucacuuucacgaacucaucaugaaggacggucggaaauuagucgugccuugccgaccccaagaugagcuaaucggccgggcccgcaucucccagggggcgggcuggagccuccgggagacggcgugccuggggaaagccuacgcccagauguggucccugauguacuuccaccgcagagaucuccggcuagcgagcaacgccaucugcucggccguuccugugcacugggugccgaccucucgcacgaccugguccauacacgcccaccaccaguggaugacgaccgaagacaugcugaccguguggaaccgggucuggaucgaggauaaccccuggauggaggacaaaacccccgugacgaccugggaaaacguacccuaccucgggaagcgcgaggaucaguggugcggcagccuuauaggguugaccucgcgggcgaccugggcgcagaacaucccgacggccauccagcaaguccgcucccuaaucggcaacgaggaguuccuggacuacaugccaagcaugaagcgguuccgcaaggaagaggaauccgagggggccauuugguga

SEQ ID NO: 26022 - RNA, 9873 nt, Artificial Sequence
  derived and/or modified CDS sequence (opt11) from DENV-3__KF955454__SS-prME
accagccugugccucaugaugauucugcccgccgcccuggcguuccacuuaaccagccgggacggcgagcccaggaugauuguggggaagaacgagcgaggcaagagccugcuauucaagacagccagcgggauaaacaugugcacccugaucgcuauggaccugggcgaaaugugcgaugauaccgugacuuacaagugcccccacaucacggagguggagcccgaggacaucgacugcuggugcaacuugaccagcacaugggugacauacgggacguguaaccaggcaggcgagcaucggcgugacaagcgguccguggcccucgcuccccacguggggauggggcuggauaccagaacccagaccuggaugucugcugagggcgccuggcgccaggucgaaaaggucgagacuugggcccugcgucaccccggguucaccaucuuagcccuguuccuggcgcacuauaucggcacaagcuugacgcagaagguggugauuuucaucuugcugaugcucgucacgcccuccaugacaaugagaugcguuggcguaggaaacagggacuucguggagggauugagcggggcuaccuggguggacgugguacuggagcacggcgggugcguaacuacgauggccaagaauaaaccaacccucgacaucgagcugcagaagaccgaggccacccaacuggcuacacuccggaaacuuuguaucgagggcaagauuaccaauauaaccacugacagccggugcccaacgcagggcgaagcagugcuaccggaggagcaggaccagaacuaugucugcaagcacacauacguugaucggggguggggcaacgguugcggccucuucgggaagggcucccuuguuaccugcgccaaauuccagugccuggagcccaucgaggggaaggucgugcaguacgaaaaccucaaguacaccgugaucauaacuguccauaccggugaccagcaccaagugggcaaugagacucaaggggucaccgccgagauuacgccucaggcuagcaccacggaggcaauucugccggaguacggcacauugggacucgagugcuccccgagaacgggccuagauuucaaugagaugauucuguugacgaugaaaaacaaggccuggaugguccaccggcaaugguucuucgaccugccacugcccuggacgucgggcgccacgaccgagacgcccacguggaaccgcaaggagcucuuagugaccuucaagaacgcccaugccaagaaacaggaggucguggugcuggggagccaggagggcgcgaugcacaccgcgcucaccggggccaccgaaauucagaacagcggcgggaccucaaucuucgccggacaccugaagugccggcugaagauggacaagcuagagcucaaaggcaugagcuacgccaugugcaccaacacuuucgucuugaagaaggagguauccgagacccagcaugggaccauccucaucaaaguggaguacaaaggcgaggaugucccgugcaagauccccuucagcacagaagaugggcagggcaaggcgcacaacggccgcuugaucacagccaaccccgucgugaccaagaaggaggagccggucaauauagaggccgagcccccguuuggggagagcaacaucgugauuggcaucggggauaacgcccugaagaucaacugguacaagaagggcuccucaaucgggaagauguucgaggcgaccgcccgcggcgccaggcggauggccauuuuaggcgacaccgccugggauuucggguccguggggggggucuugaacagccugggcaagauggugcaccaaaucuucggguccgcauauacagcgcuguucagcggcguauccugggucaugaaaauaggcaucggaguccuccugaccuggaucggccugaacagcaaaaauaccuccaugagcuucaguugcaucgccaucgggauuaucacucucuaucugggcgccgugguacaggccgauauggggugugugaucaauuggaaaggcaaggagcugaaguguggcagcgggaucuucguaacgaacgagguccacaccuggacugagcaguacaaguuucaggcggauucccccaagcgcuuggccaccgccaucgccggcgccugggagaacggggucugcggcauccgcuccacuacccgcauggagaaccuucuguggaaacagaucgccaaugagcucaacuacauccugugggagaacaacaucaagcugaccguagucgugggagacaucaucggcgugcuugagcagggcaagagaacccugaccccgcagcccauggaguugaaguauucguggaagaccugggggaaggccaagaucgucaccgccgagacccagaauuccucauucauuaucgacggccccaauacgccugagugucccagcgccagucgggcauggaacgugugggagguggaagauuacggguucggggucuuuaccaccaacaucugguugaagcugagagaggucuacacccagcugugugaucacagacugaugucagccgccguaaaggacgagagggccguacacgcagacauggguuacuggaucgagagccaaaagaacggcuccuggaaacuggaaaaggcuagccuaaucgaagugaagaccugcacguggccgaagucccauacccucuggagcaacggcgugcuggagggugauaugaucauccccaagagccuggcuggucccaucagccagcacaacuaccguccgggguaccacacccagacggcuggccccuggcaccuaggaaagcuugaguuggauuucaacuacugugaggggacaaccgucgugaucaccgagaacugcggcacccgcgggcccucccucagaacgaccacuguaagcggcaagcugauucacgagugguguugucgcuccugcacccugccgccgcuccgauauaugggcgaggaugguugcugguauggcauggagaucagaccaauuagcgagaaggaggagaauauggucaaguccuuggugagcgccggguccggcgagguggauaacuucacaauggggguuuuaugucucgccauccuuuucgaggaggugaugcggggcaaguuugggaaaaagcacaugaucgcggggguguucuucacauucgugcugcuccuuagcggccaaaucaccuggagggauauggcccacacacucaucaugaucgggagcaaugcaagcgaccggaugggcaugggggugacguaccuugcacugaucgccaccuucaagauccaacccuuccuggcguuaggcuucuucuugcgcaagcugacgucccgcgagaaccuucuccugggcguggggcucgccauggccaccacacugcaguugcccgaagacaucgagcagauggccaacggcauugcccucgggcuaauggcacugaagcucauaacgcaauuugagaccuaccagcuguggaccgcuuuaaucucccucacgugcagcaacacgauuuuuacccugacuguggccuggcgcacggccacccugauccucgcgggcgugucccugcugccggucugucaguccuccagcaugcgcaaaaccgacuggcugccgaugaccguagcagccaugggggugccgccccugccgcuguucaucuucucccucaaagauacgcucaagcgccgaagcuggcccuugaacgagggcguaauggccgugggccucguguccauccuggccagcucccugcuacgcaacgacguccccauggcggggccccuggucgccggggggcugcucauagccugcuacgugauuaccggcacuagcgccgaccugaccgucgagaaggccgcagacgugacgugggaggaggaggcagaacagaccggggugucccacaaccugaugaucaccguagacgaugacggcacgaugcgaaucaaggacgacgagaccgagaauauccucaccgucuuacugaaaaccgcccuucugauugugagcggcauauucccuuauucaaucccugccacccugcucgucuggcacaccuggcagaagcagacgcagcgaagcggggugcugugggaugugcccagcccgccugaaacccagaaggcagagcuggaggagggaguauaccggaucaaacaacaggggaucuucggcaagacccagguggguguuggcguccagaaggaaggcguguuccacacuauguggcacgugacgcgcggugcggugcucaccuacaacggcaaacgccuggagcccaauugggcuagcgugaagaaggaucucauauccuacgggggggguuggcgccuaucggcccaguggcagaaaggcgaggaagugcagguuauugccguggagccugggaagaaucccaagaacuuccagaccaugcccggcaccuuccagacgaccacuggcgaaaucggggcaauagcccucgacuucaagcccgguaccucagguagcccuaucaucaaccgcgaggggaaagucgucggccuguacggcaacggcguggugacgaagaacggaggcuacgucagcggcaucgcccaaacuaacgccgagccggaugggcccacccccgaacucgaggaggagauguucaagaagcggaaccucacgauaauggaccugcaucccggauccgggaaaacgcgaaaguaucugccggccaucgugcgggaggcgaucaagcgccguuugcgcacccugauacuggccccaacgcguguggucgccgccgagauggaggaagcauugaagggacugcccauucguuaccagacgacggcgaccaagagcgagcacaccgggcgggaaaucguggacuugaugugucacgccaccuucacgaugcgucuccugucucccgucaggguuccgaacuacaaucugaucaucauggacgaggcucauuuuacugaccccgcaagcaucgccgcgcgaggguacaucuccacccgaguaggcaugggggaagccgccgcgaucuucaugaccgcgacuccaccgggcaccgcagaugccuucccucagucaaacgcccccauccaggacgaagagcgcgacaucccugagcguuccuggaacagcgggaacgaguggaucaccgauuuugcgggcaagaccgugugguucguccccuccauuaaggcggggaacgacaucgccaacugccucagaaagaacggcaagaaagugauccagcuuagccguaaaacguucgacaccgaguaccagaaaaccaagcugaacgauugggacuucgucgucaccacagacaucuccgagaugggcgccaacuucaaggcggaucgggugaucgacccacgccggugccucaagcccgugaucuugaccgacgggcccgaacgcgucaucuuagccggcccaaugccggugacugcagcuucagccgcccaacggcgcgggcggguaggccgcaauccccagaaagagaaugaucaguacauauucacugggcagcccuuaaacaacgacgaggaccaugcgcauuggaccgaggcuaaaaugcugcuggacaacaucaacacgcccgagggcaucaucccugcccucuucgagcccgagcgugagaaguccgccgccaucgacggcgaguaccgccuaaagggggagucccggaagaccuuucuggaguugaugcgcaggggcgaucuacccguuuggcuggcguauaaaguggccuccgaggggaucaaguacacugaccggaaguggugcuucgacggccagcggaacaaccagauuuuagaagagaacauggacgucgagaucuggacuaaggagggcgagaagaagaagcugcgcccgcgguggcuugacgcccgcacguauagcgacccgcuugcucugaaggaguuuaaggacuucgcugcggggcgcaaguccaucgcccuggaucucguaaccgagaucggccgggugcccacucaccuggcccaucgcacccggaacgcccuggauaaccucgucaugcuucauacaagcgagcauggcggcaaggccuaccgccaugcgguggaggagcugcccgagaccauggagacccugcugcuguuagggcuaaugauccuacuuacugguggcgcuaugcuauuccuuaucuccgggaagggcaucggaaaaacgucgaucggccucauaugcgugauugcuagcuccgguauguuguggauggcggagauuccgcuacaguggaucgcaagcgcgauaguccucgaguucuucaugauggugcugcugaucccugagcccgagaagcaacggaccccccaagacaaccagcucgccuacguggucaucgguauccuuacccuggccgcuaucauugcagcgaacgagaugggauugcuagagaccacgaaacgcgaccuggggaugucaaaggagccgggcguggugucgccaaccuccuacuuagacgucgaccugcaccccgccagcgccuggacccuguacgccguugcgacaacggucauaacccccaugcuuagacacaccaucgagaacucaacugcuaacgucagucuggccgcgaucgcuaaccaggccgucguucugaugggguuagacaagggcuggccgaucuccaagauggaccugggggugccacuccuggccuugggcugcuacucgcagguaaacccccugacgcucaccgcggccguacugcugcucaucacucacuacgccaucaucggacccgggcuucaagcgaaagccacucgagaggcacagaagcguacggcagccggaaucaugaagaaccccaccgucgacgggauuaugacaaucgaccuggauccggugaucuacgacuccaaguucgagaaacagcucggccaggugaugcuacugguccucugcgcgguacagcugcugcugaugcgcacuucuugggccuuaugcgaagcccucacacucgcuacgggacccauaaccacccugugggaagggucccccggcaaguucuggaacacgaccaucgcgguaaguauggcgaacaucuuucggggguccuaccuugccggcgccgggcucgcuuucucuaucaugaaauccgucggcaccggaaagcgcgggaccggcagccagggagagacccucggcgagaaguggaagaagaagcuaaaucaacucucccgaaaggaguucgaccuguauaagaagucggggaucacggagguggacagggcggaggcuaaggagggucugaagcggggcgaaaucacccaccacgcggugagccggggguccgccaaacuccaaugguucguagagcggaacauggugaucccugagggcagaguuaucgaccuagggugcggcagggggggcuggagcuacuacugcgccggcuuaaagaaggucaccgaggugcgaggauacaccaagggcggucccggccacgaggagccagugccgauguccacuuacggguggaacauuguaaaguuaaugagcggcaaagacgucuucuaucugccccccgagaaaugcgacaccuugcugugcgacaucggggagucaagcccaucgcccaccguggaggagagccggacaauucggguccucaagaugguugagccguggcuaaagaacaaccaguucugcauuaaggugcugaaucccuacaugccgacggucauugagcacuuggagcgacugcagcggaaacacgggggcaugcuggugcgaaaccccuuaucacguaacagcacgcacgaaauguacuggauuagcaacggcaccggcaacaucguggcgucagucaacauggugucucgguuacugcucaaccgguuuacaaugacgcaucgccgaccgacgaucgagaaagacgucgaucugggcgccgggacccgccacgucaacgccgaacccgagacucccaacauggacgugaucggcgaacgaauaaaacgcaucaaggaggagcacaacagcaccuggcacuacgacgacgagaaccccuauaagaccugggccuaccauggcuccuacgaggugaaggcuaccggcucagcgucuuccaugauuaauggugucgugaaacugcucacgaagcccugggacguaguccccaugguuacgcagauggccaugaccgauaccacccccuuuggccaacaacgagucuucaaggaaaagguagauacacgcacaccucgguccaugccagguacccgccggguuauggggaucaccgcugaguggcuguggaggacgcugggcaggaacaagaagccccgccucugcacacgggaggaauucaccaaaaaggugcgcaccaacgcugcgaugggggccguauucacggaggagaaccaaugggacagcgccaaggccgccguggaggacgaggauuucuggaagcuggucgaucgcgaacgggagcugcacaagcucggcaagugcggcuccuguguguacaacaugauggguaaaagggaaaagaagcugggcgaguucgggaaggcgaaaggcucccgugccaucugguacauguggcuuggggcgcgcuacuuggaguucgaggcccugggguucuuaaaugaggaccacugguuuagccgggaaaauuccuacucuggaguggagggcgagggccuucacaagcugggauacauccugcgcgacaucuccaagauccccggaggggccauguacgcggacgauaccgccggcugggacacccguauuaccgaggaugacuugcacaacgaggagaagauaacgcagcaaauggacccggagcaccggcaguuggccaaugcaaucuucaaguugaccuaccagaacaaggucgucaaaguucagcggccuacccccacugggaccgucauggacauaauaucacgcaaggaucagagaggguccggacagguggggacuuacggacuuaacaccuucaccaacauggaggcccagcuuauccgccagauggagggugaaggagugcuuagcaaggcggaccucgagaacccgcacccgccagagaagaagauaacucaguggcuggagaccaagggcgucgaacggcugaagcgcauggccaucuccggggacgacuguguaguaaagcccaucgacgaucgguucgccaacgcccuccuggcccugaacgacauggguaagguccgcaaggacauuccccaguggcagccaagcaagggguggcacgauuggcagcagguccccuucugcucccaccacuuccacgaacucauuaugaaagacggcaggaagcuggugguacccugccgcccucaagacgagcugaucggacgggcgcgcaucagccagggcgccggaugguccuugcgugaaacugccugccuugggaaagccuacgcccaaauguggucccugauguacuuucaccgucgugaccuccggcuagccuccaacgccaucuguagugccgucccugugcauugggucccuaccucccggaccacguggagcauccacgcucaccaccaguggaugaccacugaggauaugcugaccguguggaaucggguauggaucgaagacaaccccuggauggaggacaagacgcccgucaccaccugggagaacgugcccuaccucggcaaacgagaagaucaauggugugggucccugaucgggcugaccagccgggccacgugggcccagaacauccccacugccauccaacaggucaggucacucauugggaaugaagaguucuuggacuacaugcccagcaugaagcgguuccgcaaagaggaggagagcgagggcgccauuugguaa

SEQ ID NO: 26023 - RNA, 9873 nt, Artificial Sequence
  derived and/or modified CDS sequence (opt11) from DENV-3__EU854292__SS-prME
accucucugugccuaaugaugauccugcccgcagcacuggccuuccaccucaccucacgugauggggagccgcggaugaucgugggcaaaaacgaacgcggcaagagccugcuguucaagaccgccagcgguauuaacauguguacucucaucgccauggaccugggcgaaaugugcgacgacacggugaccuacaaaugcccccacaucaccgagguagagccugaggacaucgauugcuggugcaaccugaccagcacgugggugaccuacggaacgugcaaucaggccggcgagcacaggagagacaagcgcuccguugcccucgcgccccacguuggcaugggacuggacacccgcacccagacuuggaugagcgccgaaggcgcguggcggcaggucgagaagguggaaacgugggcccucaggcauccggguuuuaccaucuuggcgcuguuccuagcccacuacaucggcaccucccucacccagaagguggugaucuucauccugcugaugcucgucacgcccagcaugaccaugcguugcguggggaucggcaacagggauuucguggagggcuuguccggggccacuugggucgacguggugcuagagcacggcgggugcgucaccacgauggccaagaacaagcccacccuugacauagagcugcaaaagacugaggccacccagcuggccacacuccguaaacugugcauugagggcaagaucaccaacaucaccaccgacagccgcugccccacgcagggcgaagccgccuuaccugaggagcaggaccagaacuacgucugcaaacacaccuacguggacagaggguggggcaauggaugcggccuauucgggaaggggucccugguuacaugcgccaaguuccagugccuggagcccaucgagggcaagguggugcagcacgaaaaccucaaguacaccgucaucaucacggugcauacgggcgaccagcaccagguugggaacgagacccagggugucacugccgagaucacgccccaggcgagcaccaccgaggcgauccugcccgaguacggcacacugggucuugaauguuccccgcgaaccggccuggacuucaacgagaugauccugcucacgaugaagaacaaggccuggaugguucaccggcagugguucuucgaucugccccugcccuggacgagcggcgccacgacugagacgcccaccuggaaccgcaaggagcuccuggucaccuucaagaacgcccacgcgaaaaagcaggagguggugguccuggggucgcaggagggggcuaugcacaccgcccugacgggggccaccgaaauacaaaacagcggcgggaccuccaucuucgccgggcaucugaaaugccgucugaagauggacaagcucgaacugaagggcaugagcuacgcgaugugcaccaauacguucguucugaagaaggaggugucugagacacagcacgggaccauacucaucaagguggaguacaagggcgaggacgccccgugcaagauucccuucaguaccgaagacgggcaggggaaggcccacaacggucgccugauaacggccaaucccguggugaccaagaaggaggagccgguuaacauagaggcggagccccccuucggagagagcaacauuguuaucggcaucggugacaacgcccucaaaauaaauugguauaagaagggauccagcaucgggaagauguucgaggccaccgcccgaggcgcccgccggauggcgauccugggcgacacggccugggacuucggguccgugggcggagucuugaacagccugggcaagauggugcaccagaucuucggaagcgccuacacggcucuguucuccgggguguccugggucaugaagaucggcauaggggugcuccugaccuggauagggcugaacagcaaaaacaccuccaugagcuuuucuugcaucgccaucgggaucaucacccucuaccugggagccguaguccaggccgacauggggugcgugaucaacuggaagggcaaggagcugaagugugguagcgggauuuuugugacgaacgaggugcacacguggaccgagcaauacaaauuucaggccgacucccccaagcgccucgccaccgcgaucgcgggggccugggagaauggagugugcggcauccgcagcaccacccgcauggagaaccuuuuauggaagcagaucgccaacgagcucaacuacauccugugggagaacaacaucaagcugaccgugguagugggggacaucauuggcguacucgagcagggcaagcgaacccuuacgccccagccgauggagcugaaguauuccuggaagaccugggggaaagccaaaaucgucaccgcggagacucagaauagcucguuuaucaucgacggccccaauacaccagaauguccaagcgccgcucgggccuggaacgugugggagguggaggacuacggguuuggcguuuucaccaccaacaucuggcuuaagcugcgcgagguguauacgcagcugugcgaccaccgguugauguccgcagcggugaaggacgagcgcgccguccacgccgacaugggcuacuggauugagagccagaagaauggguccuggaagcuggaaaaggcaucccugaucgaggugaagaccugcacguggcccaagucacacacccucuggagcaacggcgugcuggaaagcgacaugaucauccccaagucgcuggccgggcccaucagccaacacaaccaccgcccgggcuaccacacccagacggcggggccauggcaccucgggaaacuggaguuggacuuuaacuacugcgaaggcacgaccgucgugaucaccgagaacugcgggaccaggggccccucccuccgcacgacaaccgugucggggaagcugauccacgaguggugcugccgcucgugcacccugccaccgcuccgguacaugggcgaagacgggugcugguacggcauggagaucagacccaucagcgagaaggaggagaacauggucaaguccuugguuagcgccgggagcgggaaaguggacaacuucacgaugggcguccugugcuuggccauccuguucgaggaggugaugcgggggaaguucgguaagaagcauaugauugccggggucuucuucaccuucguccugcuccugagcggccagaucaccuggcgcgacauggcccauacccugaucaugauugggucuaaugcgucugaucggauggggaugggcgugacguacuuggcccugaucgccaccuucaagauccagcccuucuuagcgcucggguucuuccuacgcaagcugaccagucgagagaaucuccuccugggagucggccucgcuauggcaaccacgcuacagcugccugaggacaucgagcagauggcuaacggaauagcucucggcuuaauggcccugaagcucaucacccaguucgagaccuaccaacuguggaccgcgcugauaagccucacgugcagcaauaccaucuucaccuugaccgucgccuggcgaacggccaccuuaaucuuagcgggagucucccugcugccggugugccaaaguuccagcaugcggaagacagacuggcuccccauggccgucgcggccaugggcgugccgcccuuaccgcuguuuaucuucugccucaaggacacccugaagcgccgcucuuggccccugaacgaggggguaauggccgugggccucgugagcauccuggcauccagucugcuccggaacgacguccccauggccggcccccugguggccggggggcugcugauugccugcuacguuaucacggggaccagugcugaccuaacagucgagaaggccgccgacauuacaugggaggaggaggcggagcagacgggggugagccacaaccugaugaucaccguggaugacgacgggaccaugaggaucaaggacgacgagaccgaaaauauccucaccguccugcugaagacggcacuccuuaucguguccggcaucuuccccuacagcauccccgccacccuucucguguggcacacguggcaaaagcagacccagcgguccggcguccugugggacguucccagcccgcccgagacgcagaaggccgaacuagaggagggggucuaccgcaucaagcagcagggcaucuucgggaagacccaggucggcgugggggugcagaaggagggcgucuuccacaccauguggcacgugacccggggcgcgguguugacguacaacgggaaacgccuggagcccaacugggccuccgucaagaaggaccugauuuccuacggggggggcuggcggcucuccgcgcaguggcagaaaggggaggagguccaggugaucgccgucgagcccggaaagaaccccaagaauuuccagacaaugccuggcaccuuccagaccacaaccggggagaucggcgccaucgcgcuggacuucaagcccgggacuucuggcucccccaucaucaaccgcgagggcaagguggugggguuguacggcaacggggucgugaccaaaaacggcggauacguguccggcaucgcccaaacgaacgccgagccggauggccccaccccugagcuggaggaggaaauguucaagaagcggaaccucaccaucauggaccugcaccccggaagcggcaagacccgcaaguaccugccagcgaucguccgggaggcuauaaagcggaggcuucgaacguuaauccuggcccccacccgggugguggccgccgagauggaggaggcccucaagggucugcccauaagguaucagaccacugccacgaaguccgagcauaccggacgggaaaucgucgaccugaugugccacgcgaccuucacgaugcgccugcucucgccggugagagugccaaacuauaaccuaaucaucauggacgaagcccacuucacagacccugccagcauagccgcgcgcggguacaucagcacacgggucggcaugggggaggccgccgccauauucaugacugcuacaccaccggggacugcugacgccuucccacagucuaacgcccccauacaggacgaagaacgcgacauaccugagcgcucauggaacuccgguaacgaguggaucaccgauuuugccgggaaaacugugugguucguucccagcaucaaggccgggaacgauaucgcgaacugccuccggaagaacgggaaaaaggucauccagcuaucccgcaaaaccuucgacacggaauaccagaagaccaagcugaacgacugggacuuugucgugaccaccgacaucagcgagaugggcgcuaacuucaaggccgaucgggucaucgacccgcgccggugucucaagcccgucauccugacggacggccccgagcgcgugauccuggccgggcccaugccgguaaccgccgcguccgccgcccagcgucgaggacgggugggccgcaacccgcauaaggagaacgaucaauauauauucacaggccaaccacucaacaaugacgaggaccacgcccacuggaccgaggcgaagaugcugcuggacaacaucaacacccccgaggggaucauaccugcccucuucgagcccgagcgugagaaguccgccgccaucgacggcgaauaccgccugaagggcgagagucggaagacauuuguggaacucaugcgucgcggggaccugcccgucuggcuggcccauaaaguggcgagcgagggcaucaaauauaccgaccgcaaguggugcuucgaugggcagcguaacaaccagauccuggaagagaacauggacguggagaucuggaccaaggagggcgagaagaagaagcuccgcccgcgguggcucgacgcccgcacauacuccgacccucuggcacucaaagaguucaaggacuuugccgccggccgcaagagcaucgcccuggacuuggugacggagaucgggcggguuccgucgcaccucgcccaccgaacucggaacgcccuggacaaucuggugaugcuucacaccagcgaacacggcgggcgggccuaccgacaugcgguggaggagcugcccgaaaccauggaaacgcugcuccugcugggucucaugauucugcugaccgggggggcgaugcuguuucugaucuccggcaagggaaucggcaagaccagcaucggccugaucugcguuaucgccagcucgggcaugcucuggauggccgagaucccgcugcaauggaucgccagcgccaucguccuagaguuuuucaugauggugcuccuaauucccgagccggagaagcagcgcacgccccaagauaaccagcuggcguacgugguuaucgggauccugacgcuagcggccaucaucgccgccaaugaaaugggacugcucgagaccaccaagcgggaccugggcauguccaaggaaccaggaguggugagcccgaccuccuaccuggacgucgaccuacaccccgcuagcgccuggacgcuauacgccguugcaaccacggugaucacccccaugcugcgacacacgaucgagaacuccaccgcgaacgucucucucgccgccaucgcgaaccaggccguggugcucauggguuuagauaagggauggccuauuuccaagauggauuugggcguaccccugcuggcgcuugggugcuauagccaggugaacccccugacgcugaccgccgccgugcuccuguuaauaacgcacuacgccaucaucgggcccggucuccaggcgaaggcgacccgggaggcccaaaagcguaccgccgccggcaucaugaagaacccgaccgucgacgguaucaugacgauagaccuggaccccgugaucuacgauuccaaguucgagaagcagcugggccaagugaugcuccucguccugugcgcggugcagcuccugcugaugcggaccagcugggcccugugugaagcccuaacccuggccacuggcccuaucacuacucugugggaggguucccccgggaaguucuggaacaccaccauugccgugagcauggcgaauaucuuccgcggcuccuaccuggccggggcuggucuggccuucagcaucaugaaguccguaggcacugguaaaaggggcaccgggagccagggcgagacgcucggagagaaguggaaaaagaagcugaaccagcugucccgcaaggaguucgaccucuacaagaagucgggcauuaccgagguggaucggaccgaggccaaggaggggcugaagaggggcgagaucacgcaccaugcggugagccggggcucugccaaacuucagugguucguagagcgcaacauggugaucccggaggggcgggugaucgauuugggcugcggccgcggcggauggucguacuacugcgcugggcugaagaagguuaccgaggucagaggcuacaccaaaggcgggcccgggcacgaggagcccguacccaugucgaccuacggcuggaacaucgucaagcugaugagcggcaaggauguguucuaccucccaccggagaaaugcgauacccugcugugcgauauaggcgaguccagccccagcccaaccguggaggagagccgcaccauccgcguccuuaaaaugguggaaccguggcucaagaacaaccaguucugcaucaaggugcugaacccguacaugcccaccguaaucgaacaccuggagcgacuccaacgcaagcauggcgggaugcugguucggaauccccugucccgcaacagcacucacgagauguauuggaucuccaacggcaccgguaauauaguagcgagcgucaacauggugucccggcuccuguugaaccgcuucaccaugacccaccggcgcccgacgaucgagaaggacguggaccucggugccgggacccggcaugucaacgcggagcccgagacccccaacauggacgugaucggggagcgcaucaaacggaucaaggaggagcauaauagcaccuggcacuacgacgacgaaaacccguauaagacgugggccuaccauggcuccuacgaggugaaagccaccgggagcgccucaagcaugaucaacggcgucgugaaacugcugaccaagcccugggaugugguccccauggugacccagauggcgaugacggacacuacccccuucggacagcagcgggucuucaaggaaaaaguagacacccggacgccgcgcuccaugcccggaaccagacgcgugauggguaucacggccgaguggcucuggcggaccuuggggcgcaacaagaagcccaggcucugcacgcgcgaggaguucaccaagaagguccgcaccaacgccgccaugggcgcaguguucaccgaggagaaccagugggauagcgcaaaggccgccguggaagacgaggacuucuggaaacucgucgacagggagcgcgaacuacacaagcuggggaaaugcggaagcugcguguacaacaugauggggaagcgggaaaagaagcucggagaguucgggaaggcuaaggggagucgcgccaucugguacauguggcugggcgcacgguaccuggaguucgaggcccucggguuucugaacgaggaccacugguucagccgcgagaacucguacagcggcguggagggggaggguuuacacaagcucggcuacauucugcgcgacauauccaagauccccgggggcgccauguacgccgacgauacggccgggugggacacccgcaucacagaggacgaccugcacaacgaggagaagaucacccagcagauggacccggagcaccgccaacucgcaaacgccaucuucaagcugacguaccagaacaagguagugaaggugcagagacccacccccaccgggaccgucauggacaucaucagccggaaggaccagcgcggcuccggacaggugggcacauacgggcugaacacuuuuaccaacauggaggcccagcucauccggcagauggaaggcgagggggugcucagcaaggccgaucuggagaacccccaccucccggagaagaagauuacccaguggcuggagaccaagggcguggagaggcuuaagcggauggccaucuccggcgacgacugcguggugaagcccaucgacgaccgcuucgccaacgcccuccucgcccugaacgacauggggaagguccgaaaggacaucccccaauggcagccuagcaaaggcuggcacgauuggcagcaggucccguucuguagucaccauuuccacgagcugaucaugaaggacgggcgcaagcuggugguccccugucggccccaggacgaacugaucggccgcgcgcggaucucucagggagcuggcuggucccuuaaggagacggccugccugggcaaggccuacgcccaaauguggagccugauguacuuccaccgccgcgacuuacggcuggcauccaacgcgaucugcagcgccgugcccgugcacuggguccccaccucccgcacuaccuggagcauccaugcccaccaccaauggaugacuaccgaggacaugcuuaccguuuggaaccggguguggaucgaggacaaccccuggauggaggacaaaacccccgucacgacaugggagaacgugccguaccucgggaagcgcgaggaccaauggugcggcuccuugaucgggcuaaccagccgggccaccugggcgcagaacaucccgacggcgauccagcaggugcgcagucucauuggcaacgaggaguuucuggauuacaugcccaguaugaagcgcuucagaaaggaggaggagucagagggggccauaugguga

SEQ ID NO: 26024 - RNA, 9873 nt, Artificial Sequence
  derived and/or modified CDS sequence (opt11) from DENV-3__FJ639746__SS-prME
accucacugugccucaugaugauccugcccgccgcacuggcauuccacuuaaccagcagggauggcgagccacggaugaucgucggcaaaaacgaacgggguaagagcuugcucuuuaagaccgccuccggaauuaacaugugcacccucauugcuauggaucugggggagaugugugacgacaccguaaccuauaagugcccucacaucaccgagguggaacccgaggacaucgauuguuggugcaaccuuacgagcacuugggucaccuaugguacuugcaaccaggcaggggagcaccgccgugauaaacggucaguagcccuugcaccccacgucggcauggggcuggacacccgcacccaaaccuggaugagcgccgagggcgcauggcgccaggucgagaaggucgaaacgugggcucuccgacaucccggguucaccauccuugcgcuuuuccuagcacacuauaucggcaccagucucacccagaaagucguaaucuucaucuuauuaaugcucguaacaccgagcaugaccaugcggugcguagggguuggcaaccgcgacuucguggagggccuuuccggggcuaccuggguggacgugguccuggagcacggcgggugcgugacuacgauggcgaagaacaagcccacccucgacaucgagcugcaaaagacagaggccacacagcuggcgacguugcggaaacucugcaucgagggcaagaucaccaacauuaccaccgacucgcgcugcccgacgcagggcgaggcugugcugccggaggagcaggaucagaacuacguaugcaaacacacauacguggacaggggcugggguaacgggugcggccucuucgggaaggguucacuggugaccugcgccaaguuccagugcuuagagcccauugagggcaagguugugcaguacgaaaacuuaaaguacaccgugauaauuacgguccacaccggggaccagcaccagguuggcaacgaaacccagggggugacugcagagaucacgccccaggccagcaccaccgaggcgauacugccggaguacggcacccucggacucgagugcucaccacgcaccggcuuagacuucaacgagaugauccuccucacuaugaagaacaaggccuggauggugcaccggcagugguuuuucgaucugccccugcccuggacguccggugccaccacggagacgccgaccuggaaccgcaaggaauuacuugugaccuucaaaaaugcccacgccaagaagcaggagguuguggugcuggggucccaggagggggcgaugcacacagcauuaacgggggccaccgagauacagaacagcggugggaccucaaucuucgccggccaccucaaaugccgacugaaaauggacaaacucgagcugaagggcaugagcuacgcgaugugcaccaauacguucguacugaagaaggagguguccgagacucaacaugggaccauucuaaucaaaguggaguacaaaggagaagacguuccgugcaagaucccauucagcaccgaggaugggcaaggcaaagcgcacaacggcagacugauuacggcaaaucccguaguaacuaagaaagaagaacccguaaacaucgaggccgagccccccuucggggagagcaauauugugaucggcaucggcgacaacgcccugaagaucaauugguacaagaaggggucaucgauugggaagauguucgaggcgacagcccggggcgcgcgcagaauggccauccucggugacacugcuugggacuucggguccgugggcggggugcucaacucacucggaaagaugguccaucagauuuuugggagugcuuacacagcacuguucucugggguaucuugggugaugaaaaucggcaucggugucuuguugacguggaucggccuuaacagcaaaaacaccuccaugagcuucucaugcaucgccauagguauuaucaccuuguaccugggcgcugugguccaggccgacauggggugcguuauaaacuggaaaggcaaggagcugaagugcggcagcgggaucuuugugacuaacgaaguccacaccuggaccgaacaguacaaguuccaggcugacucacccaagaggcucgccaccgcgauagccggcgcaugggagaauggcgugugcggcauucgcagcacgacgcggauggagaaccuacucuggaagcagauugcgaacgagcucaacuauauccucugggaaaacaauauuaaacuaaccguggucguaggagacaucaucggaguucucgagcaaggcaagcgcaccuugaccccccagccgauggagcugaaguacuccuggaaaaccugggggaaggccaagauugucacagccgaaacccagaacagcucuuucaucaucgacgggcccaacacaccggagugucccagcgccucccgggcauggaacgugugggagguggaggacuacgguuucggcgucuuuaccaccaacaucuggcugaagcuucgcgagguguacacccaacugugcgaucaucgguugaugagugcugccgugaaggacgaacgcgccguccaugccgacaugggcuacuggaucgagagccagaaaaauggguccuggaagcuugagaaggcgucacugauagagguuaaaaccugcacguggccgaagucccauacccucuggagcaacggcgugcuagaguccgacaugaucauucccaagagccuggcagggcccauuucccagcacaacuaccggccgggcuaccacacccagacggccgggcccuggcacuuaggcaagcucgagcuggacuucaacuacugcgagggcaccaccguagucaucacugagaauugcgggacgcggggaccaucauuacggaccacaacugucuccgggaagcugauccacgagugguguugcagaagcugcaccuugccaccguugcgguauaugggcgaggacgguugcugguacggcauggagauacggcccaucuccgagaaagaggagaacauggugaagagccuggugucugccggcagcggggagguggauaauuucacgaugggcguccugugccuggccauacuguuugaagagguaaugagagggaaauucgggaagaaacacaugaucgcggggguguucuuuaccuucgucuugcuccuguccggucaaaucaccuggagggacauggcccacacccuuaucaugaucggcagcaaugccucggauaggauggggaugggcgugacguacuuagcccugaucgcuacauucaagauccaaccauuucuggcccucggguuuuucuuacgcaagcucacgagccgagagaauuugcugcugggcguggguuuagcaauggccaccacgcugcagcugcccgaggacaucgagcaaauggcuaacggcaucgcguuaggccuuauggcccucaagcucauuacccaauucgagaccuaucaacuguggacagcccugaucagccugacgugcuccaacacuauauucacccugaccguagccuggcgcacugcuacccugauccuagcagggguguccuuacuaccgguaugccaguccagcuccaugagaaagacagauuggcucccaaugaccguggcggcgaugggcgugccgccgcucccuuuguuuaucuucagccucaaagacacgcugaagcgccgcuccuggccccuuaaugagggggucauggcugugggccuuguuucaauucuggcgucaagccugcuccggaacgauguccccauggccggcccccuaguggcagggggccugcucaucgccuguuauguaaucaccgggaccuccgccgaucugaccgucgagaaggccgcugauguaaccugggaggaggaggccgagcagacaggcgugucgcacaaccuaaugauuacugucgacgacgacggcacgaugcgcaucaaggaugacgagaccgagaacauacucaccgugcugcugaagaccgcccuccuuauagugucagguaucuucccguacucuauccccgcuacacuguuggucuggcacaccuggcagaagcaaacacagcgguccggcguccugugggacguuccgagcccgcccgaaacccagaaggcagagcuggaggaaggggucuaucguaucaagcagcagggcauuuucgggaagacgcagguuggcgugggggugcagaaagagggcguauuccacacgauguggcacgugacgagaggcgcgguccucaccuacaacggaaaacgccuggagccuaacugggcguccgucaaaaaggaccugaucaguuacgggggcggcuggcggcucuccgcccaguggcagaaaggagaggaagugcaggucaucgccguagagccaggaaagaaccccaagaacuuccagaccaugcccggcaccuuccagaccacuaccggggaaaucggugcgaucgcccuggacuuuaagccagggaccagcggcucccccaucauuaaccgcgagggaaaggucgucgggcucuacggcaacggugucgugaccaagaacggcggguacgucucggggauugcccagaccaacgccgagcccgacggucccacccccgagcuggaggaggagauguucaaaaagcggaaccucaccauuauggacuugcacccagguagcgguaagacucgcaaguaccugccggccaucgugcgggaggcgaucaagcgccggcuccgcaccuuaaucuuagccccuacccgaguggucgccgcagagauggaggaagcuuuaaaggggcugcccauccgauaccagacuacggcgacgaaguccgaacacaccggccgggagauagucgaccugaugugccacgcuaccuucaccaugcgccugcugucacccguucggguuccgaacuacaaccugaucaucauggacgaggcccauuucaccgaccccgccucgaucgcugcacgcggguacauaagcacccgugugggcaugggcgaggccgcagccaucuucaugaccgcgacgccaccagguaccgccgacgccuuuccgcaguccaacgcccccauccaagacgaggaacgcgacauccccgaacgcagcuggaacuccggcaacgaguggauaaccgauuucgcugggaagaccguuugguuuguccccagcaucaaggcgggcaacgacaucgcuaacugucucaggaagaaugggaaaaagguuauccagcucucccgcaagacguucgauaccgaguaccaaaaaacuaagcugaacgacugggauuucgugguuacaacggacaucucagagaugggugccaacuucaaggccgaccguguaaucgacccucgucggugccucaaaccagugauacuuacggacgggcccgagcguguaauccuggccgggcccaugcccgugacugcggccagcgccgcgcagcggcgcggccggguaggaagaaacccccaaaaggagaacgaccaguacauauucaccggccaaccccucaacaacgaugaggaucaugcccacuggaccgaggcgaagaugcugcuagacaacaucaacacgcccgaggguaucauccccgcccucuuugagcccgagcgggagaaguccgccgccaucgacggagaguaccgacuaaagggcgagagcagaaagacuuuugucgagcucaugagacgcggggacuuaccggucuggcuggcucacaaaguagccagcgagggcauaaaguacacggaccguaaguggugcuucgacggucagaggaauaaccagaucuuggaggagaauauggacguggagaucuggaccaaggagggcgagaagaagaaacucagaccacguuggcuggacgccagaacguacagcgacccacuggcucugaaggaguucaaggacuucgcagccggcaggaagagcaucgccuuagaucuggugaccgagaucggccggguccccagucauuuggcccaccggacccgaaacgcccuggauaaccuagugaugcugcacacaagcgagcauggagggaaagcguaucggcacgccguggaggaacugccagagacgauggagacccugcugcugcuggguuuaaugauccugcugaccgguggcgccaugcucuuccugaucagcggaaagggaaucggcaagacaucaauuggauuaaucugcgucauugcuagcaguggcaugcuguggauggccgagauuccccugcaauggaucgccagcgcuaucgugcuugaauuuuucaugaugguguuauugauccccgagcccgagaagcagcggacgccucaggauaaccaacuggccuacguuguaaucggaaucuugacccuggcggccaucaucgcugccaacgagaugggcuuacucgagaccacaaagcgcgauuuaggcaugaguaaggagccugggguggucagcccaaccucguaccuggacguugacuuacacccugcgucggcauggacacuguacgccguggcgaccaccgucaucacgccaaugcugcggcacacaauugagaacuccaccgccaaugugucuuuagccgcuaucgcgaaccaggcgguaguccucaugggccuggacaaaggguggccaauaucgaaaauggaccucggggugcccuugcuggcccuggggugcuacucgcaagugaacccccugaccuugaccgcagccguacuccugcugaucacccauuacgcuauuaucggcccgggucuucaggcaaaggcaacgcgcgaggcccaaaagcggaccgccgcugguaucaugaaaaacccgaccguggacgggaucaugaccaucgaccuggaucccgugaucuaugacuccaaauucgagaagcagcugggccaaguaaugcuccuggugcugugugcggugcaacucuugcuaaugcgcaccucaugggcccucugcgaggcguugacccuggccaccggacccaucacgacccucugggaaggcuccccugguaaguucuggaacaccacuaucgcggucucuauggccaacaucuuucgaggcuccuaccuggccggggcaggacuggcauucagcaucaugaaguccguggggaccggcaagcguggcacugggagccagggcgagacgcucggggaaaaguggaaaaagaaguuaaaccaacugagccggaaggaguuugaccucuacaagaaauccggcaucaccgaaguggaccguacggaggcgaaggaaggauuaaagcggggcgagaucacgcaccaugccgucucucgcggcuccgcuaaguuacaaugguuuguggaacggaacauggugaucccggaggggcgagucaucgaccucgggugcgguagaggggguuggagcuauuacugcgcaggccugaaaaagguuaccgaggugcgcggguacacgaagggagggccagggcaugaggagcccguccccauguccacguacggguggaacauugugaagcucaugagcgggaaggacguguuuuaccucccgccugaaaagugcgacacucugcugugcgacaucggggagaguucuccgagccccaccgucgaggagagucggacuauacgcgugcuuaagaugguagagcccuggcucaaaaacaaccaguucugcaucaaaguccuuaaccccuacaugcccacggugguggagcaccucgaaaggcuccagaggaagcacggggggaugcugguccgcaacccccugagccgaaauucgacccacgaaauguauuggauauccaacggcacgggaaacaucguugccagcgugaauauggucagccgccucuuacugaauagguucacgaugacgcaucgacggccaaccauugaaaaggauguugaccugggugcugguacccgccacgugaacgccgagcccgagacucccaacauggacguaaucggggaaagaauaaagcgcaucaaggaggagcacaacucuaccuggcauuaugacgacgagaauccuuacaaaaccugggccuaccacggauccuaugaggugaaagccacagggagcgccuccucgaugaucaacggugucgugaagcugcugacuaaaccgugggauguaguacccauggugacgcagauggcgaugaccgacacuacacccuuugggcaacaacgggucuucaaggagaagguagacacgcgcaccccgcggagcaugcccggcacccgacgcgugaugggcaucaccgcggaguggcucuggcggacgcuggggcggaacaagaaaccccgccugugcaccagagaggaguucacaaaaaagguaagaacaaacgccgccaugggggcggucuucaccgaggagaaccaaugggauagugcgaaagcggccguggaagacgaagacuuuuggaagcuagucgaccgcgaacgugagcuccacaagcuaggaaaaugcggcucgugcgucuacaacaugauggggaaacgggaaaagaaguuaggagaauucggcaaagccaaggggucucgggccauaugguacauguggcugggugcacgcuaccuggaguucgaggcccuagguuuuuugaacgaggaccauugguucagccgcgagaacucguacagcggcguggagggggagggccugcacaaguuaggcuacauccugcgggacauauccaaaauccccgggggagcuauguacgccgaugacacugcggguugggacacgcgaaucaccgaggaugaccugcacaacgaggagaagaucacucagcagauggauccggagcaucggcagcucgcgaacgccaucuucaagcuuacuuaccagaacaagguggucaaagugcagcggcccaccccgacaggcaccguaauggacaucaucagccggaaggaccagcgaggcuccgggcagguaggcacuuacggccugaauaccuuuaccaauauggaggcccagcucauccgucagauggaaggggagggcguacuuucuaaggcugaccuggagaacccacgccuucccgagaagaagauuacccaauggcuugagacgaagggcguugagcgcuugaaacggauggcgauuuccggcgacgacugcguugugaaacccauagacgaccguuucgccaacgcauuacucgcccugaacgacauggggaagguccguaaggacaucccacaauggcagccaagcaagggguggcacgacuggcagcagguuccguucuguucccaccacuuccacgaacuaaucaugaaggacggacgcaagcugguggugccuugccggccacaggacgagcugaucgggcgcgcccggaucagccagggcgccggguggucacuccgcgagaccgcaugccucgggaaggcguaugcccagauguggagccuaauguacuuucaccgccgggaccuccgccuggcgagcaacgcaauuugcagugccgucccgguccauugggugccgaccucacggaccacuuggagcauccacgcucaccaccaguggaugaccaccgaggacaugcuaaccgucuggaaccgcguguggauugaggacaauccuuggauggaggacaagacccccaucaccaccugggagaacgugcccuaucucgguaagcgggaggaccaguggugcgguucacugaucggguuaaccucccgcgccacgugggcgcaaaacauuccgaccgccauccagcaggucagaagccucaucggcaacgaagaauucuuagacuacaugcccucuaugaagcgcuuccgcaaggaagaggagucggaaggugcaaucugguga

SEQ ID NO: 26025 - RNA, 9873 nt, Artificial Sequence
  derived and/or modified CDS sequence (opt11) from DENV-3__FJ639750__SS-prME
accagccugugccucaugaugauccugcccgccgcccuggcuuuccaucucaccucucgagacggggaacccagaaugaucgugggcaaaaacgaacggggcaaaagccuacuguucaagaccgccuccgggaucaacaugugcacccuaaucgccauggaucugggagagaugugugacgacacagugacguacaagugcccccacaucacggagguggagcccgaggacaucgacugcuggugcaaccugaccagcaccugggugaccuacgggacgugcaaccaggccggggaacaccggcgagacaagcgguccgucgcacucgcgccccacguggggauggggcuggacacccgcacccagaccuggaugagcgccgagggggccuggcgccagguggagaaaguagagacgugggcccugcgccacccgggauucaccauauuagcgcuguucuuggcccacuacaucggcaccuccuugacacagaagguggucaucuuuauccugcuuaugcucgucacucccagcaugaccaugcggugcgugggggugggcaaccgcgacuucgucgagggccugagcggggccacauggguggacguugucuuagagcacggcgguugcgugaccacuauggcuaagaacaagccaacccucgacaucgagcugcagaagacugaggccacccagcuggcgacucuccggaaacugugcauagaggguaagaucacuaacaucaccacugacagccgcugccccacgcagggugaggcugugcugccggaggagcaggaccagaacuaugucugcaagcacaccuacguggaccggggguggggcaacgggugcggcuuguucgggaagggcuccuuggugaccugcgccaaguuccagugcuuggagcccauugagggcaagguagugcaguacgagaaccucaaguacaccgucaucauaacgguccacaccggggaccagcaccagguaggcaacgagacacagggggugaccgccgagaucacgccccaagccagcaccaccgaggcgauccuucccgaguacggcacccuggggcucgagugcuccccgcgcaccggccuggacuuuaacgagaugauccugcucacgaugaagaacaaggccuggauggugcaccgacagugguucuucgaucugcccuugcccuggaccucaggcgccaccaccgagacgcccaccuggaaccgcaaggagcuccuggugaccuucaagaacgcgcacgccaagaaacaggaggucguaguccugggcucccaggagggcgccaugcauaccgcccugacgggggccaccgagauccagaacagcggcgggaccuccaucuuugccggucaccugaagugccgccugaagauggauaagcucgagcugaagggcaugagcuaugcuauguguaccaacacguucguccugaagaaggagguauccgagacccagcacgggacaauccucaucaagguagaguacaaaggcgaggacgucccgugcaagauccccuucagcaccgaagauggacagggcaaggcucacaacggacgccugaucacggccaaccccguggugaccaaaaaggaggagcccgucaacaucgaggcugagccgcccuuuggggagagcaacaucgugaucggcaucggggacaacgcccugaaaaucaacugguacaagaaaggaagcagcaucgggaagauguucgaagcgacugcccggggcgcacgccggauggccauccugggcgacaccgccugggacuucggguccgugggcgggguccucaacucacuaggcaagaugguucaccagaucuuugguuccgccuacacggcccuguucagcggcguguccugggucaugaaaaucggcaucgggguucuccugacauggaucggacugaacaguaaaaacaccagcaugaguuucucuugcaucgccaucggcaucaucacccucuaccugggcgccgugguccaggccgacauggggugcgugaucaauuggaaggggaaggagcugaagugcggcucagggaucuucgugacgaacgagguccacaccuggaccgagcaguauaaguuccaagcggauucucccaagcgccucgccaccgcgaucgcaggcgcgugggagaacggugugugcggcauccgcagcacgacccguauggagaaccugcuguggaagcagaucgcuaacgagcucaacuauauccucugggaaaacaacaucaagcugaccguggucguuggugacaucauagguguguuagagcaaggcaagcgcacccugacgccgcagccgauggaacugaaguacucauggaagacaugggggaaggccaagaucguuacggccgagacccagaacagcagcuucaucaucgacggccccaacacgcccgagugucccucugccucccgggcguggaauguuugggagguggaggacuacggguucggcgucuucaccaccaacaucuggcucaagcugcgcgagguguacacccaacucugugaccaccggcucaugagcgccgccgugaaggacgagcgcgccguccacgccgauaugggcuacuggauugagagccaaaagaaugggucuuggaagcuggagaaagcuagccuaauugaggugaagaccugcacguggccgaagucccacacccucuggucgaacggcgugcuggaguccgacaugaucauccccaagagccuagccgggccuaucucgcagcacaauuaccgaccggguuaccacacucagaccgcuggcccauggcaccucggcaagcuggaguuagacuucaacuacugcgagggcacgaccgucgugaucaccgagaacugcgggacccguggccccagccuccggacgaccaccguguccgggaaacuuauccacgaguggugcugccgcagcugcacccugccucccuuaagguacaugggcgaagacgggugcugguacgggauggagauucgcccgaucuccgagaaggaagagaacaugguuaagagcuuaguuuccgccgggucaggggagguggacaacuucacgaugggcguccucugccucgccauccuguucgaggaggugaugcgggggaaguucggcaagaagcacaugauagcggggguguucuucaccuucguccugcuccuuuccggccaaaucaccuggcgcgauauggcccauacucugaucaugaucggcagcaacgccuccgaccggauggggaugggggugacguacuuggcucuuaucgccaccuucaagauccagcccuuccuggcgcucggguucuuccugcgcaagcugaccucccgggagaaucuccugcugggcguaggccucgccauggccacaacgcugcagcugcccgaggacaucgagcagauggccaaugggaucgcgcucggccugauggcgcugaagcucaucacgcaauucgagaccuaccaguuguggacagcccuaauuagccuuacgugcuccaacaccaucuucaccuugaccgucgccuggcgcacugcgacccugauucucgcaggcgugagcuugcugccggucugccaguccagcuccaugcgcaagaccgauuggcuccccaugaccguggccgcuaugggugugccgccacucccccuguucaucuucagccucaaagauacucugaagcgccgcagcuggcccuugaacgagggggucauggcugugggccucgugagcauccuggccuccagccugcuccggaacgaugugcccauggcgggcccccugguagccgggggacugcucaucgccugcuacgugauuaccgguaccucggcugaucucaccgucgagaaggccgcggaugugacgugggaggaggaagccgagcagaccggcgugagccacaaccugaugauaaccguugacgacgacggcacuaugcgcaucaaagacgacgagaccgaaaacauccucacggugcugcugaagaccgcccuccugauaguguccggcaucuucccguacucgauccccgcuacacugcucgucuggcacacauggcaaaagcagacgcagcgcaguggagugcuuugggacgugcccaguccacccgagacacagaaggccgagcuggaggagggggucuaucgcaucaagcagcagggcaucuucggaaagacccaggugggcguggggguccagaaggagggcguguuccacacuauguggcacguaacgcggggcgcgguccucaccuauaacgggaagcgccuggagcccaauugggcguccgugaagaaagaccugaucagcuacggagguggauggcggcucuccgcacaguggcagaagggugaggaggugcaggucaucgccguugagccaggcaaaaaccccaagaauuuccagaccaugcccggcaccuuccagacgaccacaggugagaucggcgcaaucgcacuagauuucaagcccgggacuagcggcagccccaucaucaaccgggaggguaagguggucggguuguacggcaacgggguggugacgaaaaauggcggguaugucucaggaaucgcccagacaaacgcugagccggacgggcccacccccgaacuggaggaggagauguucaagaagcggaacuugaccaucauggaccugcaccccggcucagggaagacgcgcaaguaucuacccgccaucgugcgugaagcuaucaagcgccggcuccgcacacugauccuagcuccaacccggguggucgcugccgagauggaggaggcccucaaggggcugcccauccgcuaccagacaacggcaaccaaguccgagcacaccggccgggagaucguggaccugaugugccacgccaccuucacgaugcgccuccucagccccgugcggguuccgaauuacaaucugaucaucauggacgaagcccacuucaccgacccugccagcauagccgcgcgcggauauaucagcacaagagugggcaugggcgaggccgccgccaucuucaugaccgcgacgccucccgggaccgccgacgccuucccgcaguccaacgcacccauccaggacgaggagcgcgacauccccgagcgcucauggaacuccggaaacgaguggaucacggacuucgcagggaagaccgugugguucguaccuagcaucaaggcaggcaacgacaucgccaauugccucaggaagaaugggaagaaagugauccagcugucccggaagacuuucgacaccgaguaccagaagaccaaacugaacgacugggauuucguggucaccacggacauaagcgagaugggcgccaacuucaaggccgacagagugauugauccgcgccggugccucaagccugugauucugacugacggccccgagcgugugaucuuagccgggcccaugccgguuacggcggccuccgccgcccagcgucgcggccggguggggcgcaacccccaaaaggagaacgaccaguacaucuucaccggccagccccucaacaacgacgaggaccacgcccacuggaccgaggcgaagaugcugcuggacaacaucaacacgcccgaggggaucauuccagcccucuucgagcccgaacgggaaaaguccgccgcgaucgacggagaguaccgccugaagggcgagucccggaagacuuucguggagcuaaugcgccgcggggaccuccccguauggcuggcacacaaggucgccuccgagggcaucaaguauaccgaccgcaaguggugcuucgaugggcagagaaacaaccagauccuggaggagaacauggacguggagauuuggaccaaggagggggagaaaaagaaacuccgcccacgguggcuggaugcccgcacguacucagacccucuggccuugaaggaguucaaggauuucgccgcgggccgcaagagcaucgcucuggauuuggugaccgagauagggcgggugcccucccaucucgcccaucgaacccggaacgcucuggacaaccuuguuaugcugcacaccagcgaacauggagguaaggccuaccgccaugcgguggaggagcugccggagacgauggagacccuacuccuacugggccucaugauccugcugaccggaggugcgaugcuguuccugauaagcggcaagggaaucggcaagaccuccaucgggcucauuugcgucauagccuccuccggcaugcucuggauggccgagaucccgcugcaguggaucgccagcgccaucguccuagaguuuuucaugaugguguuacugauccccgagccagagaagcagcggacgccccaggacaaccaguuagccuacguggugaucgggauccucacacuugccgccaucaucgccgcgaacgagaugggccugcucgagaccaccaaaagagaccuggguauguccaaagagccggggguggucagcccgacgagcuaucuggacgucgaccuccaccccgccagcgccuggacccuguacgccguggcgacaacgguaaucacgcccaugcugcggcacaccaucgagaacucuaccgccaacgugagccuagccgccaucgcuaaccaggccguggucuuaaugggccuggauaagggguggccgaucucgaagauggaccucggcgugccccuacuagcgcuugggugcuacucccaagugaauccccugacccugacagccgcaguccuccuacugaucacccacuaugcaauaaucggaccuggccuccaggcgaaggccacgcgcgaggcccagaagcgcaccgccgccgggaucaugaagaacccgacgguggacggcauuaugaccaucgaccuggaccccgugaucuacgacuccaaguucgagaagcagcuggggcagguuaugcuccuggugcuaugcgcggugcagcuccugcucaugcgcacgagcugggcccucugcgaggcccugaccuuagccacgggccccaucaccacgcuuugggaggguucaccaggcaaguucuggaacaccacgauagcggucagcauggccaacaucuuccgaggcaguuaucuggccggggcuggccuggccuucagcaucaugaaguccguugguaccggcaagcgcggcaccggaucccagggcgaaaccuuaggcgaaaaguggaagaaaaagcugaaccagcugagccggaaggaguucgaucuuuacaaaaaguccggcaucacugaaguggaccgcacagaggcgaaggagggguugaagcggggagagaucacccaccacgccgucucccggggcuccgccaagcugcagugguuugucgagcggaacauggugauaccugagggucgggucaucgaccucggcugcgggcgcggcggcuggagcuacuacugcgccggccugaagaaggugacggaaguucgcggguauacaaagggaggacccgggcacgaggaacccguccccaugagcacguacggcuggaauaucgugaaacugaugagcgguaaggacgucuucuaccucccacccgagaagugugacacacugcugugcgacaucggugaguccagccccuccccuaccgucgaggagagccggaccauccgcgugcugaagaugguggagccauggcucaagaauaaccaguucuguaucaaaguccugaaucccuauaugcccacggugaucgagcaccuggagcgccuccagcggaagcacggagggaugcugguccgcaacccgcugagccggaacagcacccaugagauguacuggaucuccaacgguaccgggaacaucguagccagcgugaacauggugucacgccuacugcugaaccgguucaccaugacgcaccgccggccgaccaucgagaaggacgucgaccucggcgcgggcacccgccacgugaacgccgaaccagagaccccaaacauggacgugauuggggagcggaucaagcgcauaaaggaggagcacaacagcacguggcacuaugacgacgagaauccguacaagacgugggccuaccacggguccuacgaggucaaggcaaccgggagcgcuuccagcaugaucaacggaguggucaagcuauuaaccaagccuugggacguggugccaauggucacgcagauggcgaugacugacacgacccccuuugggcagcagcggguguucaaggagaaaguggacacacgcaccccgcggagcaugcccggcacccgccgcguuaugggcaucaccgcugaguggcucuggcgcacgcuggggagaaacaagaaaccacgccugugcacccgggaggaguucaccaaaaaggucaggacaaacgcggccaugggcgcgguauuuacggaggagaaucagugggacucggccaaggccgcaguggaggacgaggacuuuuggaaacucguggaccgcgagcgggagcugcacaaguuagggaagugcggcucguguguguacaacaugauggggaagcgcgagaagaaguugggcgaguucggcaaagccaaagggucccgagcgaucugguacauguggcugggcgcccgcuaccuggaguucgaagcccucggguuccuuaacgaggaccacugguucagccgagagaacuccuauagcggugucgagggggagggccugcacaagcucggguacauccugcgcgacauauccaagauccccggaggcgcuauguacgccgacgacaccgcggggugggacacccggaucaccgaagacgaccugcacaacgaggagaagaucacgcagcagauggauccggagcauagacagcucgcgaacgccaucuucaagcugaccuaucagaacaaggugguaaagguucagcggcccacccccaccggcaccgugauggacaucauaucgcguaaggaccagcggggcuccggccaggugggcacguacggccugaacaccuucaccaacauggaggcccagcucauccgccagauggagggcgaggggguacugagcaaggccgaccuggagaacccccaccucccggaaaagaagaucacccaguggcuggagacgaagggcguagagcggcugaaacgcauggccaucuccggagacgacugcguugucaagcccaucgacgaucgguucgccaacgcccuccuugcccuaaacgacauggggaagguacgcaaggauaucccccaguggcagccgucuaagggcuggcacgacuggcagcaggucccguucuguucccaccacuuccacgagcucauuaugaaagacgggcggaaacugguugugcccugccgcccccaggaugagcugaucggacgggcgagaaucagccaaggggcgggcuggagccuccgagagaccgccugccugggaaaggccuacgcccagauguggagccucauguacuuccaccgccgcgaccuccggcuggcgucgaacgcuauuuguuccgcugugcccguccacuggguuccgaccucccgcaccaccuggagcauucacgcccaccaccaguggaugaccaccgaagacaugcugaccguuuggaaucgggucuggauagaggacaaccccuggauggaggacaagacgcccgugacuaccugggaaaaugugccuuacuuggggaagagggaggaccagugguguggcagccuuaucgggcugaccucccgggccacuugggcgcaaaacauuccgaccgccauccaacaggugcgcucacugaucggcaacgaggaguuccuggacuacaugcccucaaugaaacgcuuccgcaaggaggaggagagcgaaggggcuaucugguga

SEQ ID NO: 26026 - RNA, 9873 nt, Artificial Sequence
  derived and/or modified CDS sequence (opt11) from DENV-3__FJ639754__SS-prME
accagccugugccucaugaugauuuugcccgccgcccuagcguuccaccucaccucgcgcgacggugaaccacggaugaucguggguaagaacgaacggggcaagagccugcuguucaagacggccagcgggaucaacaugugcacccucaucgccauggaccuaggggagaugugcgacgacaccgugaccuacaagugcccucacaucacggagguggagccugaggauaucgauugcuggugcaaccugaccagcaccugggugaccuacgggacgugcaaccaggccggcgagcaucggcgcgacaagcgguccgucgcccucgcgccgcacgugggcauggggcuagacacccgcacccaaacauggaugagcgccgagggcgccuggcgccagguggagaaggucgagacgugggcccugcgccacccgggguucaccauccucgcgcuguuccuggcucacuauaucgguaccagccucacccagaagguugugaucuucauccugcugaugcucgucacucccagcaugaccaugaggugcgugggggugggcaaccgcgacuucgucgagggucuguccggggccaccuggguggacgugguccuggaacacggcgggugcgugacgacgauggcaaagaacaagcccacccucgacaucgagcugcagaagacugaggccacgcaacuggcgacccuccggaaguuaugcauugaggggaagaucaccaacaucaccaccgacagccgcugcccgacccagggcgaggccgugcucccggaagaacaggaccagaacuauguuugcaagcacaccuacguggaccggggguggggcaacgggugcggacucuucgggaaggggucucuggugacuugcgccaaguuccagugccuggaacccaucgagggcaagguagugcaguaugagaaccuaaaguacacugugauaaucacgguccacacuggggaccagcaccaggucggcaacgagacccaaggggucaccgcggagaucacuccccaagccagcaccacagaagcgauccugcccgaauacggcacccuggggcucgagugcaguccucgcaccggccuggacuuuaaugagaugauccugcucacgaugaaaaacaaagccuggaugguacaccggcagugguucuucgaccuuccauugcccuggaccuccggugccaccaccgagacgcccacguggaaccgcaaggagcuccuugugacuuucaaaaacgcccacgccaagaagcaggaagucguugugcuggggagucaggagggcgcgaugcacaccgcccugacgggggccaccgagauucaaaacagcggcggcaccuccaucuucgccggccaccugaagugccgguugaagauggauaagcucgaacugaagggaaugagcuacgccaugugcaccaacacguucguccugaagaaggaggucuccgagacccagcacgggaccaucuuaauaaaggucgaguacaagggcgaggacguccccugcaagauccccuucagcaccgaggacgggcagggcaaggcgcacaacggccgccugaucacggcgaaucccguggucaccaagaaggaggagccugucaacaucgaggccgagccgcccuucggcgagagcaacauugugaucggcaucggcgacaacgcccugaaaaucaacugguacaagaagggguccucaaucgguaaaauguucgaagcgaccgcacguggagcccgccggauggccauccugggcgauacagccugggacuucgggagugugggcgggguccuuaacagccuaggcaagauggugcaccagaucuucgggucugcguacacggcccuguucagcggcgugucuugggucaugaagaucggcaucggggugcugcugaccuggaucggucugaacagcaagaacacguccaugagcuuuagcugcaucgccaucgggaucauuacucucuaccugggcgcugucguacaggccgacaugggcugcgugauuaacuggaagggcaaggagcugaagugcggcagcgguauuuucgugacgaacgagguccacaccuggaccgagcaauacaaguuccaggcggacucccccaagcgccucgccacugccaucgcaggcgcgugggagaacggggucugcgggauccgcagcacgacccggauggaaaaccuguuguggaaacagaucgccaacgagcucaauuacaucuugugggagaacaacaucaagcugaccguggucgugggcgacaucaucggcguguuggagcagggcaagcgcacccugacuccucaaccgauggaacugaaguacuccuggaagaccuggggaaaggccaagaucgucaccgccgagacccaaaacagcagcuucaucaucgacggccccaacacgcccgagugccccagcgccucccgagcguggaacgugugggagguggaggacuauggguucggcgucuucaccaccaacauuuggcuaaaacugcgcgaggucuacacacagcugugcgaccauagauugauguccgcugccgugaaggacgagcgcgccguccacgccgacaugggcuacuggaucgaaucacagaagaaugggucuuggaagcuggagaaggcgagucugaucgaggugaagaccugcacguggccgaagagucacaccuuauggucuaacggcgugcucgaauccgauaugauuauccccaagagccuggccgggcccaucucccagcacaacuacaggccgggcuaccacacccagaccgccggcccauggcaccucgggaagcuggagcuggacuucaacuacugcgagggcaccacugucgugaucacugagaacugcgggacucgcggccccagcuugcggaccaccaccguguccgggaagcugauccacgaauggugcugucguagcugcacccugcccccgcuccgguacaugggcgaagacggaugcugguacggcauggagauccggccgaucagugagaaggaggagaacaugguaaagagccuggugagcgcaggcagcggggagguggacaacuucacgaugggcguccugugccucgccauauuguucgaggaggugaugcgggggaaguucggcaaaaagcacaugaucgcggggguuuucuuuacguucguccugcuccuguccggccagauuacauggcgggacauggcccacacccucaucaugaucggaucaaacgccuccgaccggauggguaugggcgucacuuaccuggcacugaucgccacauucaagauccagcccuuucuggcgcucggguuuuuccugcgaaagcugaccagccgagagaacuuacugcugggcgugggccucgccauggccacuacuuuacagcugcccgaggacaucgagcagauggccaacgggauugcguuaggacugauggcccugaagcucauuacccaguucgagaccuaccagcuguggaccgccuugaucucacucacaugcuccaacaccaucuucacccugacagucgccuggagaacggccacccugauccucgcgggggugucacuacuaccggucugccagucaagcucgaugcgaaagacugacugguuacccaugaccguggcugccaugggcgugccgccccucccguuguucaucuucagccugaaggacacgcugaagcgccgcuccuggcccuugaacgagggugucauggcugugggccucgugagcaucuuggccuccagccugcuccggaacgacguacccauggcaggcccgcugguggcaggagggcugcucaucgccuguuacgugaucaccggaaccuccgccgacuugaccgucgagaaggccgcugacgugacgugggaggaggaggccgagcagaccggagugagccauaaucugaugauuacaguggacgacgacgggaccaugcgcauuaaagacgacgagacggagaacauccuaacggugcugcugaagaccgcccuccugauuguguccgggauuuucccguacagcauacccgccacccugcucgucuggcauaccuggcaaaagcagacgcagcggucuggcgugcugugggacguacccagcccgcccgaaacccagaaggccgaguuagaggagggggucuaccgcaucaagcaacagggcauauucgggaaaacacaggugggcguggggguccaaaaggagggcguguuucacaccauguggcacgugacacggggugcggucuugaccuacaacgggaagcgccuggagcccaacugggcuuccgugaagaaggaccugaucaguuauggcgggggcuggcggcucucugcacaauggcagaagggugaggaggugcaggucauugccguggagcccggcaagaaccccaagaacuuccagacaaugccagguaccuuccagacgaccacaggggagauaggagcgaucgcccuugauuucaagcccgggacaagcggcagccccaucauuaacagggagggaaagguggucgggcuguacgggaacgggguggugacgaaaaacggcggguacgucuccggcaucgcccagaccaacgccgagccugacggccccacgcccgaguuggaggaggagauguucaaaaagcggaaccucaccaucauggaccugcaccccgggagcggcaaaacgcgcaaguaccugccggccauugugcgugaggcgaucaagcgccggcuccgcacccugauccuugccccgacccggguggucgccgccgagauggaggaggcccucaaggggcugcccauccgcuaccagaccacggccaccaaguccgaacacacuggucgggagaucguggaccugaugugccacgccaccuucacuaugcgguugcugucgcccgugcgcgucccgaacuacaaccugaucaucauggacgaggcccacuucaccgacccugcuuccaucgccgcccggggguacaucucaacccgcgugggcaugggcgaggccgccgccaucuucaugaccgcgacgccgccuggaaccgcagacgccuuuccgcaguccaacgccccaauccaggacgaggagcgcgacauccccgaacgcagcuggaacucuggcaaugaguggaucaccgauuucgccgggaaaaccgugugguucguccccagcaucaaggcgggcaacgacaucgccaauugccuccggaagaacggcaagaaggugauacagcucucgagaaagacauucgacacagaguaccagaagaccaagcugaacgacugggacuucguggucaccacggacaucagcgagaugggcgccaacuucaaggccgaccgggugaucgauccgcgccggugcuuaaagcccgugauccugaccgacggccccgagcgcgucauacuagccgggcccaugccggugaccgcggccuccgcagcgcagcggcgcggccggguggggcgcaacccccaaaaggagaacgaucaguacaucuucacuggccagccccucaacaacgaugaggaccacgcucacuggaccgaggcgaaaaugcuccuggauaacaucaacacgccugaggggauuaucccggccuuauucgagcccgagcgggagaaguccgccgcaaucgacggcgaguacagacucaagggcgagucccguaagaccuucgucgagcugaugcgacgaggggaccuccccguguggcuggcucacaaggucgcuucagagggcaucaaguauacagaucgcaaguggugcuucgacgggcagcgcaauaaccagauccuggaggagaacauggauguggaaaucuggaccaaggagggugagaaaaagaagcuacggccccgguggcuggacgcccgcacuuacucugacccgcuggcgcucaaggaguucaaggauuucgccgcaggcagaaagagcaucgcucuggaccugguuaccgagaucgggcggguacccucgcaccucgcacaccgaacccggaacgcccuagacaaccuggugaugcugcacaccagcgagcacggcggcaaggccuaccgccacgcgguggaggaguugccugagacgauggagacccuauugcuccugggccucaugaucuuacugaccggcggcgccaugcuguuccugaucucagguaaggggaucggcaagaccuccaucgggcucaucugcgucaucgccaguuccgggaugcucuggauggccgagauuccguuacaguggaucgcuucggcgaucgugcuggaguucuucaugauggugcucuugaucccagagccagagaagcagcggacgccccaggauaaccaacuggccuacgucgugaucgggauacugacccucgccgccaucauugcagcuaacgagaugggcuugcuagaaacgaccaaacgcgaucugggcaugucaaaggagcccgggguggucagccccacgagcuaccuggauguagaccuccaccccgccagcgccuggacccuguacgccguggcgacaaccgucaucacgcccaugcuucgucauaccaucgagaacuccacugccaacgugagccucgccgccaucgccaaccaggcugugguccugaugggccuggacaagggguggcccauauccaagauggaccucggcgugccucugcuggcgcucgggugcuauagccagguuaaccccuugacgcugacggccgccguccuccugcugaucacucauuacgccaucaucggccccgggcuccaggcgaaggccacccgcgaggcccaaaagcggaccgccgccgggauaaugaagaacccgacgguggacgggaucaugaccauagaccuggaccccgugaucuacgauuccaaguucgagaagcagcugggucaggucaugcuccugguguuaugcgcggugcagcuccugcugaugcggaccagcugggcccucugcgaggcccuaacccuggccacgggacccauuaccacccucugggagggcuccccaggcaaguucuggaacacgacgaucgcggucagcauggccaacauuuuccggggcaauuacuuagccggggccggccuggccuucuccaucaugaaaagcguggggaccggcaagcgcggcaccgggucccagggcgaaacacucggggaaaaguggaagaagaaguugaaccaauugagccggaaagaguucgaccucuacaagaaguccggcauaaccgagguggaucgcacggaggcgaaggaggggcugaagagaggcgagaucacccaccacgccgucucccgcggcagugccaaguuacagugguuuguggagcggaacauggugauaccggaggggagggucaucgaccucggcugcgggagaggagggugguccuauuacugcgccggccugaagaaggugaccgaggugcgcggcuacaccaagggcgggcccggucacgaggagcccguucccaugucgaccuauggcuggaacaucgugaagcugauguccgggaaggacguauucuaccuaccgcccgaaaagugcgacacccuguugugcgacaucggcgaaagcuccccgagccccaccguagaggaaucucgcacuauccgcgugcugaaaaugguggagccguggcucaagaacaaucaguucuguaucaaggucuuaaacccauacaugcccaccgugaucgagcaccuggagcggcuccagagaaagcacggcgggaugcuggugcgcaaucccuugagccggaacuccacccacgagauguacuggaucagcaauggcaccggcaacauaguggccuccgugaacauggugagccgccuccugcugaacagguucaccaugacgcaccgccggccgaccaucgagaaggacgucgaccucggcgcaggcacgcgccacguaaacgccgaacccgagacccccaacauggaugugaucggagagcggauaaagcgcaucaaggaggagcauaacucgacguggcacuacgaugacgagaacccguacaagaccugggccuaucacggcucguaugaagucaaggccaccgguuccgcgagcuccaugaucaauggcguggugaagcugcucaccaagcccugggacguggugcccauggucacgcagauggcaaugaccgacaccaccccguucgggcagcagcggguauuuaaagagaagguagacacccgcaccccgcggucgaugcccgggacccgccgggucaugggcaucaccgccgagugguuguggcgcacgcuggggcggaacaagaagccccgccugugcacacgagaggaguuuaccaagaaggugcgcaccaaugccgcgaugggggcgguguucacggaggagaaccagugggacagcgccaaggccgccgucgaagacgaagacuuuuggaagcucguggaccgcgagcgggagcugcacaagcugggaaagugcggcuccugcgucuacaacaugauggggaagcgcgagaagaagcucggcgaguucggaaaggccaaggggagccgagcgaucugguacauguggcugggagcccgcuaccuggaguucgaggcucucggguuucugaacgaagaccacugguucagucgggagaacagcuauuccgguguggagggagagggucugcacaagcucggcuauauccuucgcgacaucagcaagauccccgggggcgccauguacgcggacgacacugcggggugggacacccggauaaccgaggacgaccugcacaacgaggaaaagauaacgcaacagauggacccggagcaccgccagcucgccaacgcgaucuuuaagcugaccuaccagaacaaaguggugaagguccagcggccuacccccaccggcaccgugauggacaucauuucgcgaaaggaccagcgugggagcggucaggucgggaccuacgggcugaacaccuucacgaauauggaggcccaguugauccgacagauggagggcgaggggguccuguccaaggccgaccuggagaacccccaccucccggagaagaagaucacccaguggcuggagacgaagggcguggagcggcugaagcgcauggcgaucagcggcgacgauugcguggucaagcccaucgacgaucgcuucgccaacgcccugcuggcccugaacgacaugggaaaggugcgcaaggacaucccccaguggcaacccuccaagggcuggcacgauuggcaacagguccccuucugcagccaccacuuucacgagcucaucaugaaggacggucggaaacuggucgugcccugccgcccacaggacgagcugaucggccgggcgagaaucagccagggggcaggcuggucacuacgggagaccgccugccuaggaaaggccuaugcccagauguggucccugauguacuuucaccgccgcgaccuccggcuggcuagcaacgccauaugcagugccgugcccguccauugggugccgaccagccgcaccacguggucgauccacgcccaccaccaguggaugaccaccgaagacaugcugaccguauggaaccgggucuggauugaggacaaucccuggauggaggacaagacucccguuacgacaugggagaaugugccguaucuggggaagcgcgaggaccaguggugcggcagccucaucgggcugaccagccgggcuaccugggcgcaaaacaucccgaccgcaauccagcagguccgcucccucaucggcaacgaggaguucuuagauuauaugccuucgaugaagcguuuccgcaaggaagaggaguccgagggggcaaucugguga

SEQ ID NO: 26027 - RNA, 9873 nt, Artificial Sequence
  derived and/or modified CDS sequence (opt11) from DENV-3__FJ639757__SS-prME
accagccugugucuuaugaugauccugcccgccgcucuggcauuccaccucaccucccgggacggggaaccgcggaugauaguggggaagaacgagcgggggaagagccugcuguuuaagaccgcaucagggaucaacaugugcacccucauugcgauggaccugggcgagaugugcgacgauaccgugacuuacaaguguccucacaucacggaaguggagccggaggacaucgauuguuggugcaacuuaacaagcaccugggucaccuacgggaccugcaaccaggccggcgaacaccggcgcgacaagcggagcgucgcccuugcgccccacgugggcauggggcuggacacgcgaacacagaccuggaugucagccgagggcgccuggcgccagguggagaaggucgagacgugggcccugcgccacccgggguuuaccauauuggcguuguuccuggcccauuacauuggcaccucccucacccagaaggugguaaucuucauccugcugaugcuagucacgccguccaugaccaugcggugcguggggguggguaaucgcgacuuugucgagggccuguccggcgccaccuggguggaugugguccuggagcauggcggguguguuaccacgauggccaagaacaagccaacccucgacaucgagcugcagaagacagaggccacacagcuggcgacgcucagaaagcucugcauagagggcaagaucaccaacaucaccaccgacagccgcugccccacgcagggcgaggcagugcuuccggaggagcaggaccagaacuacgucugcaaacacaccuacguagaccggggguggggcaacgggugcggccucuucgggaagggcuccuuagugaccugcgcgaaguuccagugcuuagagcccaucgagggcaaaguaguccaguacgagaaccucaaguacaccgugaucaucacgguccacaccggggaccagcaccaagugggcaacgagacccagggcgucaccgccgagauaacgccccaagccagcaccaccgaggcgaucuuaccugaauacggcacccuggggcucgaauguuccccgcgcaccggcuuggacuucaacgagaugauccugcucacgaugaagaacaaggccuggaugguccaccggcagugguucuucgaccugccgcugcccuggaccagcggcgccaccacugagacgccaacuuggaaccgcaaggaguuacuggugaccuucaagaaugcccaugccaagaagcaagaggucguggugcuggggucccaggagggugcgaugcacaccgcccucacgggggcgaccgagauacaaaacagcggcgggaccuccaucuuugccggccaccugaagugccggcuaaagauggauaagcuugagcuaaagggcaugagcuacgccaugugcaccaacacguucguccugaagaaggaaguguccgaaacccagcaugggacuauccucaucaagguggaauacaagggagaagacgucccgugcaagauccccuucagcacagaggacggccaagggaaagcucacaacggccgccugaucacggcgaaccccguggugaccaagaaggaggaaccagucaacaucgaggcagagccgcccuucggggagagcaacaucgugaucgguauaggggacuccgcgcugaaaaucaacugguauaaaaagggcagcaguaucgggaagauguucgaggcaaccgcucggggcgcacgcagaauggccaucuuaggggacacggccugggauuucgggagcgugggcggcguccucaacucccugggcaagauggugcaccagaucuucgggagcgcguacacggcccuguucuccggcgugagcugggucaugaagaucggcaucggggugcuccugaccuggaucggccugaacuccaagaacaccagcaugaguuucuccugcaucgccauugggauaauuacccucuaccuuggcgccgugguccaggccgauaugggaugcgugaucaacuggaagggcaaagagcugaaguguggcuccgggaucuucguaacaaacgagguccacaccuggaccgaacaguacaaguuccaagcagacagccccaagcgccucgcaacagccaucgccggcgcuugggagaacggggugugcggcauccgcaguacgacccggauggagaaccugcuguggaagcaaauugcgaaugagcucaacuacauccugugggagaacaacaucaagcugaccguggucgucggggacaucaucggugugcucgaacagggcaagcgcacccugacgccucagccaauggagcugaaguacagcuggaagaccugggggaaggccaagaucgucaccgccgagacucagaacuccagcuucaucaucgauggccccaacacgcccgagugccccuccgccagccgggcguggaacguuugggagguggaggauuacggcuuuggcgucuucaccaccaacaucuggcucaagcugcgcgagguguauacucagcugugcgaccacaggcucaugagcgccgccgugaaggacgagcgugccguccacgccgacaugggcuacuggaucgagucccagaagaacgggagcuggaagcuggagaaggcgucccugaucgaaguuaagaccuguacguggcccaagucgcauacgcucugguccaacggcgugcuggagagcgacaugaucauccccaaaagccuggccgggccuaucagccagcacaacuaucgcccgggcuaccacacccagaccgcggggcccuggcaccucgggaagcuggagcuggacuucaacuacugcgagggaacgaccgucgugaucacagaaaacugcgggacccgcggcccgucccugcggacgaccaccguuuccgguaagcugauccacgaguggugcugccgauccuguaccuugcccccgcuccgguacaugggagaggauggaugcugguacgguauggagauccgcccaaucagcgagaaggaggagaacaugguuaagucccugguuagcgccggguccggggagguggacaacuucacgaugggaguccugugccucgccauccuguucgaggaggugaugcgggggaaauucggcaagaaacacaugaucgcggguguguucuucaccuucguacugcuccugagcggucagaucacauggcgcgauauggcccacacccugaucaugaucggcucaaacgccucggaccggauggguaugggugugaccuaccucgcacugaucgccaccuucaagauucagcccuuccuggcccuugguuucuuccuccgcaagcugacgagcagagagaaccuccuguuaggcguuggccucgccauggccaccacgcuacagcugcccgaggauauugagcagauggcaaacgggaucgcgcuugggcugauggcccugaagcugaucacccaguucgaaacauaccagcuguggacggcccugaucucccucacuuguagcaauaccauauucacccugacagucgccuggcgcacggccacucugauccucgcggggguuucccugcugcccgucugccaguccuccagcaugcgcaagaccgauugguugcccaugaccguggccgcuaugggcgugccgccccugccacuguucaucuucucccucaaggacacacugaaaaggcguagcuggccccugaacgagggcgucauggccguggggcucgugucuauccuggccagcagccuacuccggaaugacguccccauggcgggccccuuaguggccgguggccugcucaucgccugcuacgugaucaccgguaccuccgcggaccuuaccguagagaaggccgcggaugugacgugggaggaggaggccgagcaaacgggcgucucccacaacuuaaugaucaccgucgacgaugacgggacuaugcgcaucaaggacgaugagaccgaaaacauucucacagugcugcugaagaccgcccuccugauugugagcgguaucuucccguacagcauccccgccacucugcucgucuggcacaccuggcagaagcagacccagagaagcggcgugcugugggacgugcccagcccgcccgagacacagaaggcugagcuggaggaaggagucuaccgcaucaaacagcagggcaucuucgggaagacccagguggggguagguguccagaaagagggcgucuuccacaccauguggcacgugacgcggggcgcgguacucaccuacaacgggaagcgccuggagccgaacugggcgagcguuaagaaagaccugauauccuacgguggcggcuggcggcucagcgcccaauggcagaagggggaagaggugcaggucaucgcgguggagcccggcaagaacccaaaaaacuuccagaccaugcccggcaccuuccagacgaccacuggugagauaggcgcgaucgcccuggacuucaagcccggcaccagcgggucccccaucaucaaccgcgaggguaaggugguaggccuguacggaaacggcguggugaccaagaacggcggguacgucagcggcaucgcacagaccaaugccgagccggacggccccaccccagaacuggaggaggagauguucaagaagcggaaccucaccaucauggaccugcaccccgggagugguaagacgcgcaaguaccugccggccaucgugcgggaagcgaucaagcgccgguuacgcacccugaucuuagcgcccaccagggugguagccgccgagauggaagaggcucucaaaggccugcccauccgcuaccagaccacggcgaccaagagcgaacauacaggccgggagaucguugaccugaugugccacgcuaccuucacgaugagacuccugucccccgugcgggucccgaacuauaaccugaucaucauggaugaggcccacuucaccgauccugccucuaucgccgcgcgcggcuacauauccacccgggugggcaugggcgaggccgccgccaucuuuaugaccgcaacuccgcccgggaccgcggacgccuucccucagucgaacgcccccauccaggacgaggagcgcgacauccccgagagauccuggaacagugguaacgaguggauuaccgacuucgccgguaagaccgugugguucgucccguccaucaaggcgggcaacgacaucgccaacugccuccggaagaacggcaagaaaguaauccagcugagucgcaaaacauuugacaccgaguaccagaagacuaaacugaacgacugggacuucgugguuaccacggacauuuccgaaaugggcgccaauuuuaaggccgacagagugaucgauccgcgccggugccucaagcccguaauccugaccgacggccccgagcgcgugauccuggcugggccgaugccggugaccgcugccucggccgcacagcggcgcggacgggucgggcgcaacccgcagaaagaaaacgaccaguacaucuucaccgggcagccccuaaauaaugacgaggaccaugcacacuggaccgaggcgaagauguuauuagacaacaucaauacgcccgagggaaucaucccagcccucuucgagcccgagcgggagaagucagccgcaauugacggcgaguacagacuuaagggcgagagccguaagaccuuugucgaguugaugcgccgcggggaccuccccguguggcuggcgcacaaggucgccuccgagggcaucaaguacaccgaccgcaagugguguuucgacgggcagcggaauaaccagauacuggaggagaacauggacguugagaucuggaccaaggagggcgagaagaagaagcuccgcccacgauggcuggaugcgcguacguacagcgacccgcuugcgcucaaggaguucaaagacuucgccgcgggccgcaagaguaucgcucucgaccuggugaccgagaucggccgcguccccacccaccucgcccaccgcacccggaacgcucuggauaaucuggugaugcuccauacgagcgaacacggcgggaaggccuaccgccacgcagucgaagagcugcccgagaccauggagacacugcuccuuuugggacucaugauucugcucaccgggggcgcuaugcuguuucugauaagcggcaaggggaucggaaaaacgucaaucggacugaucugcgucaucgcuagcuccgguaugcuuuggauggcugaaaucccgcuacaguggaucgccucggcgaucguacuggaguucuucaugauggugcuccuuaucccggagcccgagaagcagcggacgccccaggacaaccagcuggccuaugucgugaucgggauccucacccuggccgccaucauugccgcgaacgagaugggccugcucgaaacgacgaagcgcgaccugggcauguccaaggagccggggguggucagccccaccuccuaucuggacguugaucuccacccugccagcgccuggacccuguacgcaguggcuaccacggucaucaccccgaugcugcggcacaccauugagaacuccaccgccaaugugagcuuagccgcuaucgccaaccaggcggugguuuuaaugggccuggacaaggguuggccgaucuccaaaauggaccucggugugccacuguuggcccucgggugcuacagccaggugaauccccugacgcugacagccgccgucuuauuacuuaucacccacuacgcgaucaucggccccggccuccaggccaaggccacccgcgaagcccagaagcggacggcugccgggauuaugaagaaccccaccguugacggcaucaugacuauagaccuggacccgguuaucuacgacucuaaguucgaaaagcagcuggggcaagucaugcuccuggugcugugcgcggugcaacugcugcucaugcgcacuagcugggcccuuugcgaagcccugacgcuggccaccggccccaucaccacgcucugggagggcucccccggcaaguucuggaacacgaccaucgcagucagcauggccaacaucuuccggggcuccuaccucgccggcgccggccucgccuucagcaucaugaaguccguggggaccggcaaacgcggcaccgggucgcagggcgagacccucggagagaaguggaagaagaagcugaaucagcugagccggaaggaguucgaccucuacaagaagucggggaucacggagguagaccgcaccgaggccaaggagggacuaaagaggggcgagaucacccaucacgcugucucgcgaggcuccgccaagcugcagugguuuguggagcggaacaugguaauaccggaagggcgcgucaucgaccucggaugcgggcggggcggguggagcuacuacugcgccggcuugaagaaggugacagagguccgcgguuacacgaagggcggccccggccacgaggagcccguccccauguccaccuacggcuggaacaucgugaaauuaaugagcgggaaagacguuuucuaccugccgcccgagaagugcgacacucugcugugcgacaucggcgaguccagccccucccccaccgucgaggaaagccgaacgauccguguguugaagaugguggagccgugguuaaagaacaaccaguucugcaucaagguccuuaacccuuauaugcccaccgugaucgagcaccuggagcgccuccagcggaagcacggcggaaugcuggugcgcaacccccuguccagaaacuccacccacgaaauguacuggaucuccaacggcaccgggaacaucguugccagcgugaacauggugagccgccuccugcugaaccgauucacgaugacccaucgccggccuaccauugagaaggacgucgaccucggagcgggcaccaggcaugugaacgccgagccggagacgcccaauauggacgucaucggagagcggaucaagcgcaucaaagaggagcacaacagcaccuggcacuacgaugaugagaacccuuauaagaccugggccuaccacgguuccuacgaagucaaagccaccgggagcgccuccagcaugaucaacgguguggucaagcugcugacuaagcccugggacguggugccaauggugacgcagauggcaaugaccgacaccacgccguucgggcagcagcgaguuuucaaagagaagguugauacccgcaccccgcggagcaugcccggcacccgucgggucaugggcaucacggccgaauggcucuggaggacccuagggcggaauaagaagccacgccuuugcacccgcgaggaguuuaccaagaaagugcgcacaaacgcggccaugggcgccguguucaccgaggagaaccagugggacuccgccaaggccgccgucgaggacgaggacuucuggaagcuaguggaucgcgaacgggagcugcacaagcucgguaagugcggcagcuguguguacaacaugauggggaagcgcgagaagaagcucggcgaguucggcaaggccaaggggucccgggcgaucugguacaugugguuaggcgcccgcuaccuggaguuugaggcccucggguuccugaacgaagaucacugguucucgcgggagaauuccuacagcggcgucgagggagagggccugcacaaacucggcuacauccugcgcgacaucuccaagauccccgggggugccauguaugcagacgacaccgcggggugggacacccggaucacggaggacgaucuccacaacgaggagaagaucacucagcagauggacccggagcaccgccagcuagccaacgccaucuucaagcuuacguaucagaacaagguggugaagguccagcggcccacccccaccggcacugugauggacaucauaucccgcaaggaccagcggggcuccggccagguagggaccuacggccugaacacuuucaccaacauggaagcccagcucaucaggcagauggaaggugaggggguccugagcaaggccgaccuggagaacccccaucucccggagaagaagaucacacaguggcuggaaaccaagggcguagagcgguuaaaaaggauggcgaucagcggcgacgauugcgucgucaagcccaucgacgaccgguucgcgaacgcccuccuggcccugaacgacauggggaaggugcgcaaagacaucccccaguggcagcccagcaagggauggcaugacuggcagcaggucccguucugcucccaucacuuucacgagcucaucaugaaggacgggcggaagcuagucguccccugccgcccgcaggacgagcucaucggaagggcccgcaucagccagggggcaggguggucccuccgugagaccgccugccuggguaaggccuacgcccaaauguggagccuuauguacuuccaccgccgcgaccuccggcuggccuccaacgccaucugcagcgccgugcccguccacugggucccgaccucccgcacgaccuggucaauccacgcccaccaucaguggaugaccaccgaggacaugcugacaguguggaacagagucuggaucgaggacaaccccuggauggaggacaagacccccgugaccaccugggagaacgugcccuaccuggggaagcgcgaggaccaguggugcgguagccugaucggucugacuucgcgggccaccugggcgcagaacaucccgaccgcgauccagcaaguccgcagccucauaggcaaugaagaguuucuggacuacaugcccuccaugaaacgguuccgcaaggaggaggagagcgagggggcuaucugguag

SEQ ID NO: 26028 - RNA, 9873 nt, Artificial Sequence
  derived and/or modified CDS sequence (opt11) from DENV-3__FJ639758__SS-prME
accagccugugccucaugaugauccugcccgcggcccuggcguuucaccucaccaguagggacggugagccccggaugaucguagggaaaaacgagcgcggcaagagccuccuguucaagacggccuccgggaucaacaugugcaccuugaucgccauggauuuaggggagaugugcgacgauaccgugaccuacaagugcccacacaucacggagguggagcccgaggacaucgacugcuggugcaaccugaccagcaccugggugaccuacggcacuugcaaccaggccggggagcaccgucgcgacaagcggagcguggcccucgcgccccacgugggcaugggccuggacacccgcacgcaaaccuggaugagcgcggagggcgccuggcggcaggucgagaaaguggagacuugggcccugcgccauccgggcuucaccauacuggcgcuguuccuggcccauuauaucggcaccucgcucacccagaagguggugaucuucauccugcugaugcucgucacgcccagcaugaccaugcggugugugggggugggcaaccgugacuucgucgagggccuguccggggccacuuggguggacgugguccuggagcauggaggcugcgugaccacgauggccaagaacaagcccacgcucgacauagagcugcagaagaccgaagcaacccagcucgcgacgcuucggaagcuaugcaucgagggaaagaucaccaacaucaccacugacucgcgcugccccacgcaaggcgaagccgugcugccggaagaacaggaccagaacuacgucugcaagcacaccuacguggaccggggauggggcaacgggugcggccucuucgggaagggcucccuggugaccugcgcuaaauuccaauguuuggagccuaucgagggcaaggucgugcaauacgagaaccucaaguacaccgugaucaucacgguacacaccggggaccaacaccaaguggguaacgagacccaggggguuaccgcggagaucacaccccaggccucaaccaccgaggcuaucuugccggaguacggcacccuggggcuagaaugcuccccgcgcaccggacuagauuuuaacgagaugauauuacucacuaugaagaauaaggccuggauggugcacaggcagugguucuucgaccuaccucucccguggaccagcggcgccacgaccgagacgcccaccuggaaccgcaaggaguuacuggugaccuucaagaacgcccaugccaagaagcaggaagucguggugcuggggucacaggagggcgcgaugcacaccgcccucacuggugcgaccgaaauccaaaauagcggugggacguccauuuucgccggccaccugaagugccggcugaaaauggacaagcucgaacucaagggcaugaguuacgccaugugcaccaauaccuuuguucugaagaaggaaguguccgagacccagcacgguaccauacucaucaagguagaguauaagggggaggacgucccgugcaagauucccuuuagcacugaggacgggcaaggcaaggcccacaacggacgucugauaacugccaacccaguugugaccaagaaggaagaacccguuaacaucgaggccgagccgccauucggggagagcaacaucgugaucggcaucggugacaacgcccugaagaucaacugguacaagaagggauccagcaucgggaagauguucgaagcaaccgcccggggugcccggcggauggccauucugggcgacaccgccugggacuucggguccgugggugggguccucaacagccuggguaagaugguccaccagaucuucggguccgcguacacggcccucuucagcggaguuuccugggucaugaagaucggcaucggugugcuucugacguggaucggacugaacaguaagaacaccuccaugagcuucuccugcauugccaucgggaucaucacauuguauuuaggcgccgugguccaggcagauauggggugcgugaucaacuggaagggcaaggagcugaagugcggcagcgggaucuucgugacgaacgagguccacaccuggaccgagcaguauaaguuccaggcggauucccccaagcgccuagccacagccaucgcaggagccugggagaacggggugugcggcaucagaagcacaacccgaauggagaaccugcuguggaaacagaucgcgaacgagcucaacuacauccugugggagaacaacaucaagcugacuguggucgugggggacgugaucggcguacucgagcagggcaagcgcacuuuaacaccccagccaauggaauugaaguauuccuggaaaaccugggggaaggccaagaucgucacagccgaaacccaaaauuccuccuucaucaucgacggccccaauacgccggagugcccuucggccagucgggcuuggaacgugugggaggucgaggacuacggguucggcguguuuaccacuaacaucuggcucaaguuacgcgagguguacacccagcugugcgaccaccggcucaugagcgccgccguuaaggacgagcgcgcugugcaugccgacauggguuauuggaucgagagccagaaaaacgguuccuggaaacuugagaaggcaagccugaucgaagugaagaccugcacguggccgaagucacacacccucuggagcaacggcguccucgaauccgacaugaucauccccaagagccuggccggacccaucucccagcacaauuaccggccgggcuaccacacccagaccgccgggcccuggcaccucggcaagcuggagcuggacuucaauuacugcgagggcacuaccguagugauaacugagaacuguggcacccgcggacccucacuccggacgaccaccgucuccgggaagcugauccacgaguggugcugccgcagcugcacccugcccccgcuccgauacaugggugaggaugggugcugguacggcauggagauucgcccgaucuccgagaaggaagagaacaugguuaaaagccugguguccgccggcagcggggaggucgacaacuucacgaugggugugcugugucuugccauccuguucgaggaagugaugagggggaaguucggcaaaaagcauaugaucgcgggggucuuuuucaccuucgugcugcuucuguccggccagaucaccuggcgcgacauggcccacacccuaaucaugaucggcucaaacgccagcgaccgaauggggaugggcgugaccuaucucgcacugaucgcgaccuucaagauacagccauuccuggcgcucggguuuuuccugaggaagcugaccagccgggagaaccuccugcugggcgucggguuagcuauggccaccacgcugcagcugccggaggauaucgagcagauggccaacgggaucgcgcucggccugauggcccuuaaguugauaacacaguucgaaaccuaccagcuguggaccgcccugauaagccucacgugcuccaacacuaucuucacuuuaacgguggccuggcgcaccgccacccugauccucgcgggggucagccugcucccggucugccaguccagcuccaugcggaaaaccgacuggcuccccaugacgguggccgccaugggcgugccgccccucccgcuguuuauauucagucucaaagacacgcugaagcgcagguccuggccccugaaugaggggguuauggcugucggucucguaagcaucuuggcguccagccuacuccggaacgacgugcccauggcgggcccccugguggccggcggccugcuuaucgccugcuacgucauuacggggacauccgccgaccugaccguggagaaggccgccgacguaacgugggaggaggaggccgagcagaccggaguaagccacaaccuuaugauuaccguggacgacgaugggacgaugcgcaucaaggacgacgaaacggagaauauccucacggugcuucugaagaccgcccuccugaucgucucuggcaucuucccguacuccauccccgcgacccugcucguguggcacaccuggcagaagcaaacgcagcgguccggcgugcugugggacguacccaguccgcccgagacccagaaggccgagcuggaggaggggguguaccgcaucaagcagcagggcaucuucgggaagacccaggugggcguagggguacagaaggagggcguguuccauaccauguggcaugucacucguggcgcaguguuaaccuacaaugggaagcgccuggagcccaacugggccuccgugaagaaggaccucaucagcuacggcgguggcuggcggcucucagcccaauggcagaaaggagaggagguccagguuaucgcgguugaacccgggaagaaccccaagaacuuccagacaaugcccggcaccuuccagacgaccaccggugagauaggcgcgaucgccuuggacuucaagccugggaccagcggcagccccauuaucaaccgcgagggcaaagucgucggacuguacggcaacgggguggucacgaagaauggcggguacguguccggcaucgcccagaccaacgcggagccggacggcccuacucccgagcuggaggaggagauguucaagaagcggaacuuaaccaucauggaccugcaccccgggagcgguaagacucgcaaguacuugccggcaauugugcgcgaggcgaucaagcgccgguuacgcacccugaucuuggcccccacacgagucguagccgccgagauggaggaagcccucaaggggcugccuauacgcuaccagaccacggcgaccaaguccgagcacaccggccgggaaauagucgaccugaugugucacgccaccuucacgaugcgcuuacugucucccguucgggugcccaacuacaaccugauuauuauggacgaggcgcacuuuaccgaucccgccuccauagccgcgcgcggguacaucagcacccgggugggcaugggcgaagccgccgccaucuucaugacugcgacgccgcccgggacugcugacgccuucccgcagagcaacgcucccauccaggacgaggaacgcgacaucccugagcgcagcuggaacuccggcaaugaguggaucaccgacuucgccgggaaaaccgucugguucguaccuucaaucaaggcgggcaaugacaucgccaacugccuccggaagaacgggaagaaggugauacagcugagucgaaagacguucgauaccgaguaccagaagaccaaguuaaacgacugggacuucgucgugacgacggacaucucagagaugggcgcaaacuucaaagccgaccgggugaucgacccgcgccggugccucaagccugucauccugacugacggcccugagcgcgugauccuggcugggcccaugcccgugaccgcagcauccgccgcucagcggcgcggccgggucgggcgcaacccccagaaggagaacgaucaauauaucuucacaggccaaccacucaacaacgacgaggaccacgcccauuggacugaagccaagaugcugcuggacaacauuaacacgccugagggcaucaucccggcccuauucgagccugaacgggaaaaguccgccgccaucgacggggaguaccgcuugaagggcgagagucggaagaccuucguggagcucaugcgcagaggggaccugcccguuuggcuggcgcauaagguggccucugagggcaucaaguacaccgaccgcaaguggugcuuugacgggcagcggaacaaccagauccuggaggagaacauggacguggagaucuggaccaaggaaggcgagaagaagaagcuacgcccccgguggcuggacgcccgcacauacuccgacccgcuggccuugaaggaguucaaggacuucgccgcgggacgaaagagcaucgcccucgacuuagucaccgagaucgggcgaguccccucccaccucgcgcaccgcacccggaacgcccuggacaaucuggugaugcuccacacaagcgagcacggcgggaaagcguaccgccacgccgucgaggagcugccugagacgauggagacccugcuccugcugggccucaugauccugcuaacagggggcgccaugcuguuccugaucagcggcaaggggaucggcaagacaucaaucggguuaauuugcgugaucgccuccuccggcaugcucuggauggcggagaucccguugcaguggaucgccagcgcgaucgugcuggaguucuucaugaugguucuccuaaucccagagcccgagaagcagcgcacgccccaggauaaccagcuggcuuacguggugaucgggauccucacccuggcggccauaaucgcagcgaaugagaugggccuacucgagaccacaaaacgcgacuuaggcauguccaaggagccggguguggugaguccaacguccuaccuggacguggaccuacaccccgcuagcgcuuggacccuguacgccgucgcgaccaccgugaucacgcccaugcugcggcacaccauugagaacaguaccgccaacgugagcuuagccgccauugcuaaccaggccgucguucugaugggccuggacaagggguggccgauuuccaagauggacuuaggcgugccucugcuggcccucggguguuacucacaggucaacccccugacccugacggccgccguccucuugcugauuacacacuacgcuauuaucgggccgggccuccaggcgaaggccacccgcgaagcccagaagcguaccgccgccgggaucaugaaaaacccgacgguggacggcaucaugaccauagacuuggaccccguaaucuacgacuccaaguucgagaagcaguugggucaggugaugcuccuagugcugugcgcgguccagcuucuucugaugcgcaccagcugggcccucugugaggcccugacccuggccacgggccccaucaccaccuuaugggaggguucgccggggaaguuuuggaacaccacuauugcggugagcauggcgaacauuuuccggggcuccuaucuggcaggggccggccuggcuuuuagcauaaugaaguccguggggacaggcaagcgcggcaccgggagccaaggcgagacucucggugaaaaguggaagaagaaacugaaccaacuuagccggaaagaguucgaccucuauaagaaauccggcauaaccgaagucgaccgaaccgaagcgaaggaggggcugaagcggggcgaaaucacgcaccacgccgucagccgcggcuccgccaagcugcagugguucguggagcggaacauggucaucccggaggggcgcgugaucgaccucggcugcgggaggggcggguggagcuacuacugcgccggccugaaaaaggugacggagguccgggguuacacaaagggcgggcccgggcacgaggaacccgugccaauguccacguaugguuggaacaucgugaagcugaugagcgggaaagacgucuucuaccucccgcccgaaaagugcgacacccugcugugugacaucggcgaaagcucucccagucccaccguugaggagagcaggaccauacgcgugcugaagauggucgagccguggcucaagaacaaccaguucugcaucaaggugcugaaucccuauaugccuacggugguugagcaucuggagcgccuccagagaaagcacggcgggaugcucguccgcaaccccuugucccggaacagcacccaugagauguacuggaucucuaacgggaccggaaacaucgucgccagcgucaacaugguuucgcgccuccugcugaaucgguucacgaugacccaccgccgaccgaccaucgagaaggacguggaccucggcgcgggcacccgccacgucaacgccgagccagagacccccaacauggacgugaucggggaacggauaaagcgcaucaaggaggaacacaacaguacguggcacuacgacgaugagaacccguacaaaaccugggcauaucacggcaguuacgaggucaaggccaccgggagcgccuccagcaugaucaacggcguggugaaacuccugaccaagcccugggaugucgugccuauggugacgcagauggccaugacugacaccacccccuucgggcagcagcggguuuucaaggaaaagguggacacgcgaacgccgcggagcaugcccggcacccgccgggucaugggcauuaccgccgaguggcuuuggaggacgcucgggcggaacaagaagccccgacuguguacucgggaggaguucaccaagaaaguccgcaccaacgcagccaugggagcuguguucacggaggagaaccagugggacuccgcgaaagcugccguggaggaugaggacuucuggaagcucgucgaccgcgagcgggagcugcacaagcugggccgcugcgggagcuguguguacaacaugauggggaagcgggagaagaagcuaggcgaguucggaaaggcaaaggguucccgcgcuaucugguacauguggcugggcgcccgguaccuagaguucgaggcccuuggguuccugaacgaggaccacugguucagccgugaaaacuccuacagcggugucgagggggagggccugcacaagcucggcuacauccuacgggacaucuccaagauccccgggggcgccauguacgcggacgacaccgcggggugggacacccgcaucacagaggacgacuuacacaaugaggagaagaucacgcagcagauggacccggagcaccggcagcuugccaaugccaucuuuaagcugaccuaccagaauaaggucgugaaagugcagaggcccacucccacaggaaccgucauggauaucaucucucggaaagaccaacgcggcuccggccaggugggcacguacgggcugaacaccuucacgaacauggaagcccaacucauccggcagauggagggcgagggcgugcugucgaaggccgaucuggagaacccacgccucccggagaagaagauaacccaaugguuggagacaaaaggcgucgagcguuuaaaacgcauggcgaucuccggcgacgacugcguggugaagcccauagacgaccgguuugccaaugcccuacuggcccugaacgacauggggaaaguccgcaaggacaucccccaguggcagcccagcaagggcuggcacgacuggcagcaggucccguucugcucccaccacuuccacgagcucaucaugaaagacgggcggaaacuggugguccccugccgcccacaagacgagcuuaucggcagggcccggaucagccagggggcgggcuggucccuccgcgagacugccugccugggaaaagccuacgcccagauguggagccugauguacuuccacaggagggauuuaaggcuggcuucuaacgccaucuguucggccgugcccguccacugggucccaaccucucgcaccaccuggagcauccacgcccaccaccaguggaugaccaccgaagauaugcuaaccguguggaaccggguguggaucgaggacaaccccuggauggaggacaagacccccgucacuaccugggagaacgugcccuaccucgggaagcgcgaggaccaguggugcggcucgcugaucgggcugaccucccgggccacgugggcgcaaaauaucccuacagcaauccagcaggucagaucgcucaucggcaacgaggaguuccuggacuacaugcccuccaugaagcgguuccgcaaggaggaggagagcgagggugccaucugguga

SEQ ID NO: 26029 - RNA, 9873 nt, Artificial Sequence
  derived and/or modified CDS sequence (opt11) from DENV-3__FJ639759__SS-prME
acuucacucugcuuaaugaugaucuuacccgccgccuuggcguuccaucucaccagucgggauggagagccucggaugauuguggggaagaacgaacggggcaagucgcugcuguucaagaccgccuccgggaucaacaugugcacacucauugccauggaucugggggagaugugcgacgacaccgugaccuacaaaugcccccauaucaccgagguggagcccgaggauaucgacugcuggugcaacuuaacuuccaccugggugaccuacgggacgugcaaccaagccggcgaacaccgccgcgacaagcguuccguggcauuagcgccccacgugggcaugggacuugauacccgcacccaaacguggaugagcgccgagggcgccuggaggcaggucgaaaaggucgagacgugggccuugcgccacccgggauucaccauccucgcucuguuccuggcgcacuacauaggaaccagucucacucagaagguggugaucuucauccuucugaugcucguaacacccagcaugaccaugcggugcguggggguuggcaaucgcgacuucgucgagggacuguccggggccacauggguugaugugguccuggagcauggcgggugcguaaccacuauggcgaagaacaagcccacccucgacaucgaacuccaaaagaccgaggccacccagcuggcgacgcuccggaaacugugcaucgaggggaagaucaccaauauuaccaccgacagccgcugcccaacccagggcgaggccgugcugccagaagagcaggaccagaacuacguuugcaaacacacguacgucgaucggggguggggcaaugggugcggccuguucgggaagggcagucuagugaccugcgccaaguuccagugcuuggagcccaucgagggaaaggucguacaguaugagaaccucaaguauacuguuaucaucacggugcacaccggagaccaacaccaggucggcaaugagacccagggggucaccgccgagauaacuccucaggccagcaccaccgaggcgauccugcccgaguacggcacgcugggccuggagugcuccccgcgcaccggccucgacuucaacgagaugauccuguuaacgaugaagaacaaggccuggauggugcaccggcagugguucuucgaccugccccugcccuggacgagcggcgccacaaccgaaacacccaccuggaaccgcaaggagcuccuggugaccuucaagaacgcccacgccaagaagcaggaggucgugguacuggggucccaggaaggggcgaugcacacugcccucacgggggccaccgagauucagaacaguggcgggaccuccaucuucgccggacaucugaagugccggcugaaaauggacaagcucgagcuaaaagggaugagcuaugcgaugugcaccaacacauucguccugaagaaagaggucuccgagacccagcacgggacgauucucaucaagguggaguauaaaggggaagacgucccuugcaagauccccuucagcaccgaggauggacagggcaaggcacacaacggccgccugaucaccgcgaaccccguggugacaaagaaggaggagccggucaacaucgaggccgagccacccuucggggagagcaacauuguaaucggcauuggggacaacgcccugaagaucaacugguacaaaaagggguccucgauagggaagauguucgaggcgacugcucggggagcccgccggauggccauccugggcgacacggccugggacuucggaucugucggcgggguccucaacagccucggcaagaugguacaccagauauucgggucugcuuacacagcuuuguucagcggcguguccugggucaugaagaucggcaucggggugcuccugaccuggaucggcuuaaacagcaagaauaccuccaugaguuucaguugcaucgccauagguaucaucacccucuacuugggcgccgugguucaggcagacaugggaugcgugaucaacuggaagggcaaggaguugaagugcggaagcgggauuuuuguuacuaacgagguccauaccuggaccgagcaauauaaguuccaagccgacucccccaagcgguuagccaccgccaucgccggcgccugggagaacgggguaugcggcauacgcagcacgacccggauggagaaucugcuguggaagcagaucgcgaacgagcucaacuacauacugugggagaacaacaucaagcugacaguggucgugggggauaccaucggcguucuagagcagggcaagcgcacgcugacgccccaaccgauggagcugaaguauuccuggaagaccugggggaaggcuaaaaucgucacugccgagacccaaaacagcuccuucaucaucgacggccccaacacccccgagugccccagcgcgucccgggcuuggaacgugugggaagucgaggacuacggguucggcgucuucacgacaaacaucuggcucaagcugcgcgagguguacacgcagcugugcgaccaucggcucaugagcgcugccgugaaagacgagcgagcaguccacgccgacaugggcuauuggaucgagagucagaagaacggguccuggaaacucgagaaagccuccuugaucgaggugaagacgugcaccuggccgaaaucccacacccuuuggagcaacggcgugcuggagagcgacaugauaauccccaagagccuggccgggcccaucucccagcacaacuaccggccgggcuaccacacucagacugccgguccauggcaccucgguaagcuagagcuggacuucaacuacugcgagggcaccaccgugguaaucaccgagaacugcgggacccgcggccccagccucagaacgaccacaguguccgggaagcuaauccacgaaugguguugucgcagcugcacgcugcccccgcuccgguacaugggcgaggacgggugcugguacgggauggagauccgcccaauuagugagaaggaggagaacauggucaagagccuggugagcgccggauccggggaaguggacaauuucaccaugggcguccugugccucgccauccuuuucgaggaggugaugcgugggaaguucggcaaaaagcacaugaucgcggggguucucuucacauuuguccuccugcuaucgggacaaaucaccuggcgcgacauggcccacacguugaucaugaucgguagcaacgcguccgaccggauggggaugggcgucaccuaucuugcccugaucgcgaccuucaagauccaaccauuccucgccuuggguuucuuccugaggaagcucaccagcagagagaaucugcuccucggcgugggccuagccauggccacgacccugcagcucccugaggacaucgaacagauggccaaugggaucgcacugggucugauggcccuuaagcugaucacccaguucgagacguaccagcuguggacugcccucaucucacuaacgugcuccaacacgaucuucacccugacgguagcguggcgcaccgccacccugauccuggcgggggugagccugcucccagucugccaguccaguuccaugcguaagacugacuggauacccaugacgguggccgccaugggcgugccuccccugccacucuucaucuuuagccuuaaggacacccugaagcgccgcuccuggccucugaacgagggcgucauggcggugggccucguuuccauccuggccuccagccuacuccggaacgacguccccauggcgggccccuugguggcugggggccugcucaucgcaugcuacgugaucaccgguaccuccgcggaccugaccgucgaaaaggccgccgacgugaccugggaagaggaggcagagcagaccgggguaagccacaaccugaugaucaccguagacgacgacgggaccaugcgcauaaaggacgaugaaacggagaacauccucaccgugcugcugaagaccgcuuugcugauaguauccggcaucuuccccuacagcauccccgccaccuuguuaguuuggcacacuuggcagaagcagacccaacgguccggcgugcugugggacgugcccagcccgcccgagacccaaaaggccgaacuggaagagggggucuaccgcauuaagcaacagggaauauucgguaaaacacaggugggcguagggguccaaaaggagggcguauuccauaccauguggcauguuacccggggcgccguccuuaccuacaacgggaagcgucuggagccgaacugggccucagugaagaaggaccugauaaguuacggagggggcuggcggcucuccgcccaguggcagaagggggaagaggugcaggucaucgcuguggagccgggcaaaaaccccaagaacuuccagacuaugcccggaacguuccagaccaccaccggggagaucggcgcgaucgcccuggacuucaaaccaggcacuagcggcagccccaucauuaaccgcgagggaaagaucgugggucucuauggcaacggggucguuaccaagaauggugguuacguuuccggcaucgcccagacgaacgccgagccagacggcccaacgcccgagcuggaggaggagauguucaagaagcgaaaucucacgaucauggaccugcaucccgggucaggcaagacccguaaguaccuuccggccaucgucagagaagccaucaagcgccggcuccgcacccuaauacuggcccccacccgcgugguggccgccgaaauggaggaggcucucaagggguuacccauccgauaccagaccagugcuaccaagucagagcacacgggccgggagauugucgaccugaugugucacgcaacguucacgaugcgguugcugucucccgugcgggugccgaacuacaaucugaucaucauggaugaggcccacuucaccgauccugcaagcaucgccgcgcgcggauauaucuccacccggguaggcaugggagaggccgccgccaucuucaugacagcgacgccgcccgggaccgccgacgccuucccgcagagcaacgcacccauccaggacgaggagcgcgauauccccgagcgcuccuggaacucggguaacgaguggaucaccgacuucgccgggaagaccguaugguucgugcccucgaucaaggcgggcaacgacaucgcgaacugucuccggaagaacgggaagaaagucauccagcuaagccgcaagacguucgacacagaguaccaaaagaccaagcugaacgauugggacuucgucgugaccacagacaucuccgagaugggagccaacuucaaggccgacagaguuaucgauccgaggcggugccucaagcccgugauccugaccgaugggcccgagcgcguaaucuuggcugggccuaugccggucaccgcggccagcgcggcccagcggcgcggccggguggggcguaauccccagaaagagaacgaccaguauaucuuuaccggccagccccucaacaacgaugaagaucacgcucacuggaccgaggcgaagaugcugcuggauaacaucaacacgcccgagggaaucaucccggcccuauucgaaccagaacgggagaagucagccgccauagauggugaguacagauuaaagggagagucacggaaaaccuucguggagcugaugcgccggggggacuugcccgucuggcuggcucacaagguggccuccgaggguaucaaguauaccgaccgcaagugguguuuugauggucagcgcaacaaccagauacuggaggagaacauggacguugagauuuggaccaaggagggcgaaaagaagaagcuccgcccccgguggcuggacgcccgcacauacagcgacccgcuggcccucaaagaguucaaggacuucgccgcgggccgcaaguccaucgcccuggaccuggugaccgagauugggcgugugcccacacaccucgcucaccgcacucggaacgcccuagauaacuuaguaaugcuccacacgagcgagcacggcgguaaggccuaucgccacgcgguagaggagcugcccgagacaauggagacccugcucuuacugggccucaugaucuuacuuaccgggggagccauguuauuccucauaagcggcaaggggaucggcaagacgucuaucgggcugaucugcgugaucgccagcuccgguaugcucuggauggcggagaucccgcuucaauggaucgccagugcgaucguacuggaguucuucaugaugguucuccugauucccgagcccgagaagcaacggacgccgcaggacaaucaauuggcuuacgugguaaucgggauacucacccuagcagccaucauagccgcgaacgagaugggccugcucgaaaccacaaagcgugaccugggcaugucuaaggagccugggguggugagccccaccagcuaccuggaugucgaucuccaucccgccagcgccuggacacuguacgcgguggcgaccacggugaucacgccaaugcugcgccacacaaucgagaacuccaccgccaacgucagccucgccgccaucgccaaccaggcgguugugcugaugggccuggacaaggguuggccgaucuccaagauggaccucggcgucccccuguuggcucucgggugcuauagccaggugaauccccugacgcugaccgcugccguguugcuauuaaucacccauuacgccauaaucggccccggcuuacaggcgaaggccacccgcgaggcccagaagcggacggccgcggggaucaugaaaaacccgaccgucgacggcaucaugaccaucgaccuggaccccgugaucuacgacaguaaguucgagaagcagcuuggccaggugaugcuccucguccugugugcggugcagcuccuucugaugcgcaccagcugggcccucugcgaggccuuaacuuuggccacaggcccgaucacgacccucugggaggguucccccgggaaguucuggaacacgaccaucgcggugagcauggccaacauauuucggggcuccuaccuugcuggggccggccuggcauucagcaucaugaagucaguugggaccggcaaacgcggcaccggaagccagggcgagacccucggugagaaguggaagaaaaagcuaaaccagcugucgcggaaggaguucgaccucuauaagaaguccggcauaacggagguggaccgcaccgaggcgaaagaggggcucaagcgaggugaaaucacccaccacgccgugagccgcgggucugccaaacugcagugguuugucgaaaggaacauggugauuccagaggggagggugaucgaccucgggugugggcgggggggauggagcuacuacugcgccggccugaagaaggucaccgagguccgcggauacacgaagggcggccccggucacgaggagccagugcccaugucaacuuacggcuggaacaucgucaaacugaugagcgggaaggacguauucuaccucccuccggaaaaaugcgacacccugcugugcgacaucggcgaaucuagcccuucccccaccguggaggaaagccggacgauccgcguccugaaaaugguggagccguggcucaagaacaaccaguucuguaucaagguacugaaucccuacaugcccaccgucaucgagcaucuggaacgccuccagaggaagcacggcgggaugcuggugcgcaacccccugucucgcaauagcacucacgagauguacuggaucuccaaugguaccgguaauauuguggccagugucaacauggugucccgccuccugcugaaccgguucacgaugacgcauaggcgcccgaccaucgagaaggacguggaccucggugcgggcaccaggcacgucaacgccgaacccgagacgcccaacauggacgucauaggggagagaaucaaacgcauuaaggaggaacacaauagcaccuggcacuacgacgacgagaacccguauaagaccugggccuaccacggcuccuacgaaguaaaggccacagggagcgccuccucuaugaucaacggcgucguaaagcugcugacgaaacccugggaugucgugcccauggugacucagauggcgaugaccgacaccacgcccuucgggcaacagcgcgucuucaaggaaaaagucgacacccgcaccccgagauccaugcccggcacccgacgggugaugggaauuacugccgaguggcucuggcgcaccuuggggcggaacaagaaacccagacugugcacccgagaggaauuuaccaagaaaguucgcacaaacgcggccaugggggcgguauucacggaggagaaccagugggacucugccaaggccgccgucgaagaugaggacuucuggaaacucguugacagagagcgggagcugcauaagcuggggaaaugcggcagcugcguguacaacaugauggggaagcgcgagaagaagcuaggcgaauuuggcaaggccaagggaucccgggcgauuugguacauguggcuuggcgcucgcuaccuugaauucgaggcccucggguuccuaaacgaggaccacugguucucacgggagaacuccuauuccggcguggaaggggaaggacugcacaagcucggcuacauccugcgcgacaucuccaagauccccgggggcgccauguacgccgacgacaccgcggggugggauacgcggaucacggaggacgaccugcacaaugaggagaagauaacccagcagauggacccggagcaucgccagcuagccaacgccauauucaagcugacguaccaaaacaaggucgugaaggugcagcggcccacuccaaccggaacggugauggauaucaucagccgcaaggaccagcgcggcuccggccaggugggcaccuacggccugaacaccuuuaccaacauggaagcccagcucauacgccagauggagggcgagggggugcugagcaaggccgaccuggagaacccccaucucccggagaagaagaucacacaguggcuggagaccaagggcguugaaaggcuuaagcgcauggcgaucuccggcgacgacugcguggucaaacccaucgacgaccgguucgccaacgccuugcuggcccugaacgacauggggaagguccgcaaggacauuccccaguggcaacccagcaaaggcuggcacgauuggcagcaggugccguucugcucccaucacuuccacgagcucaucaugaaggacgggcggaagcugguuguccccugcaggccccaggacgagcugaucggucgggcccggaucagccagggggcgggcuggucgcuccgggagacugccugccugggcaaggccuacgcgcagauguggucacugauguacuuccaccgccgcgaccucagauuagcgagcaacgcuaucuguagcgcugugccgguacacugggucccgaccagucgcacaacuuggagcauccaugcucaccaccaguggaugaccaccgaggacaugcugacgguguggaaccgggucuggauugaggacaacccuuggauggaggacaaaacccccguuaccacaugggagaacgugccuuaccucgggaagcgcgaggaccaguggugcggaucacugaucgggcugacgagucgggccacuugggcgcagaacaucccgaccgcaauacagcagguccgcagccucaucggcaacgaggaguucuuagacuacaugcccuccaugaaaagguucagaaaggaggaggagagcgagggcgccaucugguga

SEQ ID NO: 26030 - RNA, 9873 nt, Artificial Sequence
  derived and/or modified CDS sequence (opt11) from DENV-3__FJ639761__SS-prME
accagcuuauguuuaaugaugauacugccggcggcccuggccuuccaccugaccucucgugacggagaaccucguaugaucguggggaagaaugagcgggguaagagccuguuauucaagaccgccagcgggaucaacaugugcacauuaaucgccauggaccucggagagaugugcgaugacaccguaaccuauaagugcccccauauaacggagguugagcccgaagacaucgacugcuggugcaaccuuacgucuaccugggugaccuacggcacaugcaaccaggccggagagcaccgccgcgacaaaagaucaguugcccucgcaccccacguagggaugggucuggauaccagaacgcaaaccuggaugagcgccgagggagccuggcgccagguggagaagguugagacgugggcgcugaggcauccgggcuucacgauacucgccuuauuccuggcccacuacaucggcaccagccucacccagaagguggugaucuucaucuugcugaugcugguuacgccuagcaugaccaugcgguguguggggguaggcaaccgcgacuuugucgagggguuauccggcgcgacauggguggacgugguccuggagcauggcgguugcgucaccacgauggccaagaacaaacccacccuggacaucgagcuccaaaagaccgaggccacccagcuggcuacccuccguaagcuguguaucgaggguaaaaucaccaacaucaccacagacucgcgcugcccuacgcaaggcgaagcggugcugccggaggagcaggaccagaauuacguuuguaagcauacuuacguagaccggggaugggguaacgggugcggacucuucggaaaaggcucccuggucaccugugccaaguuucagugcuugcaaccuauagagggcaaagucguccaguacgagaacuugaaguacacggucaucaucacaguccauacgggggaccagcaccagguuggcaacgagacccagggggucacggcugagauaacgccccaagcuucuacgaccgaagcuauccugccagaauacgggacgcuggggcucgaaugcuccccccguacgggccuugacuucaacgagaugauccuguuaacgaugaagaacaaggccuggaugguccaccggcagugguucuucgaccuuccucugccauggacgagcggcgccacuaccgaaacgccaaccuggaauagaaaggagcuccuugucacguucaaaaacgcucacgccaagaagcaggagguggugguacuggggucccaggagggagccaugcacaccgcgcucacgggcgccaccgaaauccaaaacaguggcgggacauccaucuucgccggacaccugaaguguagacuaaaaauggacaagcucgagcuuaagggcaugagcuacgccaugugcacgaacacguuuguccuaaagaaggaggucagcgagacgcagcacgggaccauccucauaaagguggaauacaaaggugaggacgucccgugcaagaucccguuuuccacagaggacgggcagggcaaggcgcauaacggucgucugauuacggccaauccugugguaaccaagaaggaggagcccguaaacauugaggccgaaccgcccuuuggggaaagcaauaucgugaucggcaucggcgauaacgcccugaagauuaacugguacaaaaaggggucuaguaucgggaagauguucgaggcgaccgcaaggggugcucgccggauggccauccugggugacacggccugggacuucggaucggucggcgguguccucaacucgcugggcaaaauggugcaucaaaucuucggauccgcuuacacggcucuauucagcgguguguccuggguaaugaaaaucggcaucggggugcuccuaaccuggauuggguugaauuccaagaacacgagcaugaguuucuccuguauagcaaucggcaucauaacgcuguaccugggcgccgugguacaggcugacauggggugcgugauaaacuggaagggaaaggagcuaaaaugcggcucagggauuuuugugacgaacgaaguccauaccuggaccgagcaauacaaauuccaagcggacuccccgaaacgccucgccacagcgaucgccggggcgugggagaacggcguguguggcauucgcucgacaacacggauggagaaucugcucuggaagcagauugcgaaugagcucaacuauauccugugggaaaauaacauaaagcugaccguagucgucggggacaucaucggcgugcucgaacagggcaaacgcacgcuuaccccccagccgauggagcugaaauacuccuggaaaacuuggggaaaggccaagaucgucacagccgagacccaaaacucaagcuucaucaucgacgggcccaacacccccgaguguccgagcgccagucgagcguggaaugucugggaaguggaagacuauggcuuuggcguauucacaacaaauaucuggcucaagcugcgagagguguacacccagcucugcgaccaccggcuuaugagcgcagccgugaaggaugagcgcgcuguccacgcugacaugggcuauuggaucgaaagccagaaaaacggguccuggaagcuggagaaggcgagccucaucgaggugaagaccugcacuuggcccaagucccauacucucuggucuaauggcgugcuggaauccgacaugauaauccccaagucacuggccgggcccaucagccagcacaacuacagaccgggcuaccacacccagaccgcggggcccuggcaccucgguaagcuggagcuggauuuuaacuacugcgaggguaccaccgucgugaucaccgagaacugcggaacgcggggcccgucgcuccggacaaccaccgucagcgggaaacugauacacgaauggugcugcagaucauguacccugccgccguugcgauacaugggcgaggacggaugcugguauggaauggaaauucgaccaaucucggagaaggaggaaaauaugguaaagucucuggugagugccggcuccggggaaguggauaacuucacgaugggaguccucugccucgccauccucuuugaggaagucaugcgggggaaguuuggcaagaagcacaugauugcagguguguuuuuuaccuucguccugcuccuguccggucagaucacauggcgcgacauggcgcacacccugauaaugauuggcagcaacgcauccgacaggauggggaugggcgucacguaccucgcacugaucgccacguucaaaauucagccguuccuggcguuaggguucuucuugcgcaaacuuaccagccgugaaaaccugcuccugggaguuggccucgccauggcgacgacguuacaauugcccgaagacaucgagcaaauggcaaacgggaucgcgcuaggguugauggcucugaagcucaucacccaauuugagaccuaccaacucuggaccgccuugaucagccuaaccuguagcaacacgauuuuuaccuugaccguggccuggcgcacggccacccuuauccuagcaggcgugagcuuacuaccaguaugccagaguagcuccaugcgcaaaaccgacuggcuccccaugacaguggccgccaugggcgugccgccccucccccuauuuauuuucuccuugaaggacacacugaagcgccgcuccuggccucugaacgaagguguaauggccgugggccucgugaguauucuggcgagcagccuccuccgcaacgacgucccaauggcgggaccccuuguggcagggggccuguugaucgcauguuacgugaucaccgggacauccgccgaccugaccguugagaaggccgcugacguaaccugggaggaggaggccgaacagaccggugugagccauaaucucaugaucacaguggacgacgaugggacgaugcguaucaaggaugacgaaaccgagaacauacucacugugcuacuuaagaccgcccucuuaauaguguccggcauauuccccuauaguauacccgccacccuguuagucuggcacaccuggcagaagcagacgcaacgguccggcguccugugggacgugccuucuccgcccgagacccagaaggcugagcuggaagaaggggucuaucgcauaaagcagcagggcaucuucggaaagacgcaggugggaguggggguccaaaaagagggcguguuccauacgauguggcacgucacacggggcgcaguacucaccuacaacgguaagcgacuggagccgaacugggcauccguuaagaaggaccuaaucucguacggagguggguggcgguuauccgcccaguggcagaagggggaggaaguucaggucaucgccgucgaaccaggcaaaaaccccaagaauuuccagaccaugccuggcacauuccagacuaccaccggggagaucggagcaaucgccuuagacuucaagccggggacgucaggaagcccaaucaucaacagggaaggcaaggugguagggcuuuauggcaacggaguggugacgaaaaacggcggauaugucuccgggaucgcccagacuaaugccgagccagauggccccaccccggaacuggaggaggagauguucaagaagcggaaccucacuauuauggacuugcaccccgggagcggaaagacaagaaaguaccucccagccaucguccgagaggcgauaaagcgccggcuacgcacucugauacuggcacccacccgggugguagccgcggagauggaggaagcccucaaggggcuacccauucgguaccagaccacugccacaaaguccgagcacaccggacgggagaucguggauuuaaugugucaugccacauuuacaaugcgcuugcugucacccgugagggucccgaauuacaacuuaaucaucauggaugaggcccacuuuacugaccccgccuccaucgcagcacgcggauacauauccacccggguggggaugggcgaggccgccgccaucuuuaugacggcgacgccgcccgggaccgccgacgcuuucccgcaguccaacgccccaauacaagacgaggagcgcgacauccccgagcgcucuuggaacuccggcaacgaguggaucaccgauuucgccgggaagaccgugugguucguccccagcaucaaagcugggaacgacaucgccaacugccuccggaagaacgggaagaaggugauccagcucucucgcaaaacauucgacaccgaguaccaaaagaccaagcuuaacgacugggacuucgucgucacaacggacaucagcgagaugggugccaacuucaaagcagaucgaguuaucgacccgcgcagaugcuugaaaccgguuauacucacggacggcccggagcgcguaauauuggcaggcccgaugccggugaccgcggccuccgccgcacaaaggcgcggccggguugggagaaauccccagaaggagaacgaccaguauaucuucacagggcagccccucaacaacgacgaggaccacgcgcacuggaccgaggcgaagaugcuguuagacaauauaaacacgccggaggguauuauuccagcccuguucgagcccgaacgggagaaguccgccgccaucgacggcgaguauagacugaagggcgaguccaggaagaccuucgucgagcugaugaggcgaggggaccuucccgucugguuagcgcacaaggucgcaagcgaggggaucaaguauaccgacaggaaguggugcuuugacgggcagcggaauaaucagauccuggaggaaaacauggacguggagaucuggacuaaggagggcgaaaagaagaagcuacgucccagaugguuagaugcccgcacuuauuccgauccucuggccuuaaaagaauuuaaggauuuugccgcuggccguaagaguaucgcgcuggaccuagugaccgagauagggcgcgugcccacccacuuggcacaucguaccaggaacgcccuggacaaucuggugaugcuccauacguccgagcacggggggaaggcauaccgccacgcgguagaagagcugcccgagaccauggaaacccuuuuacuacuggggcuaaugauccuguugaccgggggcguaaugcuguuccucaucagcggcaaagguauuggcaagacuucuauuggacuuauuugugugaucgccagcagcggcaugcuuuggauggccgaaaucccguuacaauggaucgcauccgccaucguauuggaauucuucaugaugguacuucugauucccgaaccugaaaaacaacggacgccccaggacaaccagcuggcguauguagugaucggaauauugacgcuagccgccauaaucgcggccaacgaaaugggguugcucgagacuacgaagcgcgaccuggguaugagcaaggagccaggugucgugucgccaacuagcuaucuggacguugaccuccaucccgcuuccgccuggacccuguaugcuguagccacgacugucaucacgcccaugcuccggcacaccaucgaaaacuccaccgcaaaugugucccucgccgccaucgcgaaccaggcuguuguguuaaugggccuagacaaaggguggccgaucagcaaaauggaccucggagugccucugcuggcccucgggugcuacucccaggucaacccccuuacucugaccgccgcggugcuccugcugauuacgcacuacgcaaucaucggacccggccuccaggcuaaggcaacgcgcgaagcucagaagcgcaccgccgccgggauuaugaaaaacccgaccguggacgggaucaugacgauugacuuagaccccgucaucuacgauagcaaguuugagaagcagcugggccagguuaugcuccuggugcucugugcuguacagcuccuacugaugcguacuuccugggccuuaugugaggcucugacgcuggccacugguccuauaaccaccuuaugggaggguucucccgggaaguuuuggaacacgaccaucgccgugucuauggcuaauaucuuccggggaucauaucucgcaggggcgggcuuggcuuucaguaucaugaaauccguugggacgggcaagcgggguaccgggcugcagggcgaaacgcugggggagaaauggaagaagaagcugaaccaacucuccagaaaggaguuugacuuguacaaaaagucagggaucacggaggucgauaggacugaagccaaagagggacugaagcggggugaaaucacacaccaugcggugagccgcggguccgccaagcuccaaugguuuguugagcgaaacauggucauccccgaaggacgugugaucgacuuagguugugggcggggcggauggucauacuacugugccggguugaagaaggugaccgaggucaggggcuacacgaagggcgggccaggucacgaggagccuguaccaaugaguaccuacggauggaacauagugaaacuaaugagcggaaaagacguuuucuaccuaccgcccgaaaagugugacacccugcugugcgauaucggugaguccagcccauccccuaccguggaggagagccgcacgauccgcguacucaagauggucgaaccuuggcuuaagaacaaccaguuuugcaucaagguccugaaccccuacaugcccacggugauugaacaccucgaacgauuacagcggaagcacggggggaugcugguccgcaacccucucucccgaaacuccacucaugagauguauuggaucuccaacgguacugggaauaucguggcuagcgucaacauggucagucgccugcuacuaaaucgguucaccaugacacaccgccgaccgaccauugagaaagacguggaccugggcgcuggcacccgccacguaaaugcggaacccgagacaccuaacauggacgucaucggggagcggauaaagcgcauuaaggaggagcacaacagcaccuggcacuacgacgacgaaaacccuuacaagacaugggccuaucaugggucuuacgaggugaaagccacugggagugccuccucaaugaucaacggcgucgugaaguugcugacgaaacccugggacgugguccccauggugacgcaaauggccaugaccgacaccacgcccuucggccagcaacggguguucaaggaaaaggucgacacacgcacgccgagguccaugcccggcacccgucgggucaugggcauaacggcggaaugguuguggcgcacucuagggcgcaauaagaagccccguuugugcacuagagaggaauucaccaagaaagugcguaccaacgccgccaugggcgccguuuucaccgaggagaaucagugggauagcgccaaagcagccgucgaggacgaagacuuuuggaaacugguggaccgcgaacgggagcugcacaagcuagggaagugcgguaguugcguguacaacaugauggggaagcgcgaaaagaagcugggcgaguucggcaaagcaaaagggucgcgggccaucugguauauguggcugggcgcuagguaucuggaauucgaggcccugggguuccugaacgaggaccacugguucagcagagagaacuccuacagcgggguggaaggagagggacuccacaaauugggcuauauccuaagagacaucuccaaaauuccagggggugcaauguaugccgacgacaccgccgggugggauacccggauuacggaggaugaucuccauaacgaggagaagauuacccaacaaauggacccugaacaccggcaguuggcgaacgccaucuucaaauuaaccuaccaaaauaagguagugaaggugcagagacccacgccaaccgggaccgucauggacaucauuucuaggaaggaccagcgggggucgggucaggucgggacuuacggccuaaauaccuucaccaacauggaggcccagcugaucagacagauggagggcgaggggguccuuagcaaggccgaccucgagaauccacaccucccugaaaagaagaucacgcaguggcuggaaacaaagggcguugagcgacugaaacgcauggccaucuccggcgacgacugcgugguuaaaccuaucgacgaccgguucgcgaaugcgcugcuggccuuaaaugacauggggaaagugcgcaaggacaucccccaguggcaacccagcaaggguuggcacgauuggcagcaggucccguucugcucccaccacuuccaugaguugauaaugaaagauggucguaagcuaguggugccuugccgcccccaggacgagcugauuggcagagcccgcaucagccagggggccggcuggagucugcgugaaaccgcaugccugggcaaggccuaugcgcagauguggagccuaauguauuuccaccgcagagacuuaagauuggccucgaacgcgauaugcagcgcaguuccugugcauugggugccaaccucccgcacgacguggagcauacaugcccaccaccaauggaugacgacugaggauaugcucaccguauggaacaggguauggaucgaagauaaccccuggauggaagauaagacgcccgucacgacgugggaaaacguccccuaccuggguaagagagaggaccaaugguguggcucgcugaucgggcucacgagccgggccacaugggcucagaacaucccgaccgcgauacaacaaguccggagccucaucggcaacgaagaguuucuggauuacaugccuuccaugaaacgcuucaggaaggaggaagagucagagggcgcaaucugguag

SEQ ID NO: 26031 - RNA, 9873 nt, Artificial Sequence
  derived and/or modified CDS sequence (opt11) from DENV-3__FJ639762__SS-prME
acuucacucuguuuaaugaugauacugccagccgcucuugcuuuucaccucacuagccgggacggggaaccccgaaugauugugggaaagaacgagaggggaaagucucugcuguuuaagacggcuagcgggaucaacaugugcacccuuauagccauggaccugggcgagaugugcgaugacacggugaccuauaaaugcccccauaucacggagguugagccugaggacauugacugcuggugcaaucugaccucaaccuggguuaccuacgggaccugcaaccaagcgggcgagcaucgucgagacaagcgguccguggcuuuggccccucacgugggcaugggccuggacacucggacccagaccuggaugucugccgagggcgccuggagacagguugaaaaggucgagacgugggcccugcgccacccuggguucaccauacucgcgcuguuccucgcgcacuacaucggcacaucccucacccagaagguugugaucuucauccugcuaaugcuugucacaccuagcaugacuaugcggugcgugggugugggcaacagggacuuuguagaggggcuguccggggccaccuggguggacgugguucucgagcacggcgguugcgugacgacgauggcgaagaacaagcccacccucgacauagagcugcagaagacagaggccacccaacuggcgacacuucgcaaauuguguaucgagggcaagaucaccaacaucaccacagacucacgcugcccaacgcagggcgaggccguguuacccgaggaacaggaccagaacuacgugugcaagcauaccuaugucgacagggguugggggaauggaugcggccucuucgguaaggggucccucgugaccugcgcgaaauuccagugccuggagcccaucgaagggaaggucgugcaguacgagaacuugaaguacaccgugaucaucacuguccacacuggggaccaacaucaggugggaaaugagacccaggggguuacugcggaaaucacgccccaggccagcaccaccgaggcaauccugccagaauacggcacccuggggcucgagugcucuccgcgcaccggccuggacuuuaaugagaugauacugcucacgaugaaaaacaaggccuggauggugcaccggcagugguucuuugaccuuccgcuccccuggacuuccggcgccaccaccgagacgcccaccuggaaccgcaaggagcuauuagucaccuucaagaaugcacacgccaagaagcaagaaguagugguccuuggcagccaggaaggcgcgaugcauacagccuugacuggcgccacagagauacagaacagcggcgggaccucuaucuucgccggccaccuuaagugucggcugaagauggacaagcucgaacuaaagggcaugaguuacgccaugugcaccaacacguuuguacugaagaaggaggugucggagacccagcaugggacgauccucauaaaaaucgaguauaaaggcgaggacguaccgugcaagauccccuucaguaccgaggacggacagggaaaggcgcacaacggccggcuuaucacggccaaccccguagugaccaagaaagaggagccagucaauaucgaggccgagccaccauucggagagagcaacauagucaucggaaucggggacaaugccuugaagaucaacugguauaagaagggcuccagcaucgggaagauguuugaggcgaccgcccguggcgccagacggauggccauccuaggcgacaccgcaugggacuucggcagcgugggugggguacucaacagccugggcaaaaugguccaccagauauucggauccgcguacacugcuuuauucuccggcgugagcugggugaugaagaucggcaucgggguccucuuaaccuggauaggucucaacagcaagaacaccuccaugucauucuccugcaucgcuaucgggaucaucacacucuaccugggcgcuguggugcaggccgauauggggugcgucauuaauuggaagggcaaggagcugaaaugcgguagcgggaucuucgugacaaacgagguccacaccuggaccgagcaguacaaguuccaggcggacucccccaaacgccuggccaccgcaaucgccggcgccugggagaauggugugugcggcauucgauccacgacacggauggagaaccugcucuggaaacagaucgcgaacgagcucaacuacauccugugggagaauaacauaaagcugaccguaguggucggcgacaucauaggcgugcucgagcagggcaagcgcacccugacgccccagccgauggagcuuaaguacucauggaagaccugggggaaagcaaagauugugaccgccgagacccagaacagcucauuuaucaucgacggccccaauacgcccgaaugccccagcgcaucccgggcauggaacgucugggagguggaagacuacggguuugguguuuucacuaccaacaucuggcucaaacugcgcgagguguacacccagcugugugaccaccgcuuaaugagcgccgccgugaaggaugagagagccguucacgccgacaugggcuacuggaucgagucacagaagaauggguccuggaagcuggagaaggcgagccugauugaggucaagaccugcacguggccgaaaucccacacacuauggucuaacggcgugcucgagucagacaugaucauccccaagagccuggccggacccaucucccagcacaauuaucggccgggcuaccauacccaaaccgccggcccauggcaccucgguaaacuggagcuggacuucaacuacugcgagggcacgacugugguaaucaccgaaaacugcgggaccagagggcccucacuccggaccaccacggugucugggaagcugauccacgaauggugcugccgcagcugcacacugccaccgcuccgguauaugggcgaggacggcugcugguacgguauggagauccgacccaucuccgagaaggaggaaaacaugguaaaaagccuggucuccgccggcagcggggaaguugacaacuucacgaugggugugcugugccuagccauccucuucgaggagguuaugcgggggaaguucggcaaaaagcauaugaucgcggggauauuuuucaccuucgugcugcuccuguccgggcagaucacuuggagggacauggcacacacccucaucaugaucggcagcaacgcguccgaccguauggggaugggcgugacauaucucgcccugaucgcgaccuuuaagauucagcccuuccuggcauuaggguuuuuccugcgaaagcugaccagcagagagaaucuccugcugggcgucggccucgcaauggccacgacgcugcagcugcccgaggacaucgagcagauggccaacgggaucgcucucggcuuaauggcgcugaagcucaucacacaguuugaaaccuaccaacuguggacugcccugauuagccucacgugcagcaacacaaucuucacccuuaccguggccuggcgcacggccaccuugauccucgcgggaguguccuuacugccggucugucaauccagcucaaugcggaaaaccgacugguuacccaugaccguggccgcaaugggugucccgccccucccgcuguucaucuucucacucaaagacacgcucaagcgaagguccuggccccuaaacgagggcgugauggcugugggccucgucagcaucuuggcuucgucccuguuacgaaaugacgugcccauggcgggaccacuuguggcaggcggccugcucauugccuguuacgucaucaccggaacaagugccgaccugaccguggagaaggccgcggacgugaccugggaggaagaggcggagcagaccggcgucagccacaaccugaugaucacugucgacgacgacgggacgaugcgcaucaaggacgacgagacugagaacauccucacggucuugcugaagacugcccuccugaucgucagcggcaucuucccguauagcauuccggcgacccugcucguguggcacaccuggcaaaaacagacgcaaagaagcggcguccucugggacguccccucgccgccagagacacagaaggccgagcuggaagagggaguguaccgcaucaagcagcagggcaucuucgggaagacccaggugggcguggggguacagaaagagggaguguuccacaccauguggcacgucacgagaggggcgguacucaccuacaacgggaagcgcuuagaacccaacugggccucggugaaaaaggaccugaucagcuacggcggcggguggcgacucucugcccaguggcagaagggagaggagguccaggugaucgccgucgagcccggcaagaaccccaagaacuuccagacaaugcccggcaccuuccagaccaccacaggggagauuggggcgauagcguuagauuucaagccuggcaccuccggcagccccaucaucaaucgcgaagguaagaucgucggccuguacggcaauggagucgugacgaagaacggcggguaugucucaggcaucgcccagaccaacgccgagccggacggccccacucccgagcucgaggaggagauguucaaaaagcgaaaccucacuauuauggaccugcaccccgggagcgggaagacgaggaaguacuuaccugccaucguucgagaggcgaucaagaggcggcuccgaacgcugauccuggcccccacccggguggucgccgcagagauggaagaggcccucaaggggcugcccauccgcuaucaaaccacggcgaccaagucugagcauaccggacgggaaaucguggacuuaaugugccacgccaccuuuaccaugagacuccuguccccagugcggguccccaacuacaaccuuaucaucauggaugaggcccacuucaccgaccccgccucuaucgccgcgcgcggguacaucagcacccggguaggcaugggugaggccgccgccaucuuuaugacugcgacgccucccgggacugccgaugccuucccgcagaguaacgccccgauccaggacgaggaacgcgacaucccggagcgcaguuggaacuccggcaacgaguggaucaccgacuucgccgggaagaccguaugguuuguccccagcaucaaggcgggcaaugacauagccaacugccuccguaagaacgggaagaaggugauccagcuuucccgcaagacguucgacacagaguaucagaagaccaaguuaaacgacugggacuuugugguuacgacggacaucucggagaugggcgccaacuucaaggccgaccgggugauugauccgcgcagauguuugaagcccgugauccucacggacggccccgaacgcgucauccuggccggaccuaugccggugaccgcagccucggccgcccagcggcgcggccguguggggcggaacccacagaaggagaacgaccaauacaucuucaccgggcagccccucaacaacgacgaggaccacgcccacuggaccgaggcgaagaugcugcuggacaacaucaacacgcccgaaggaaucauuccggcacuguucgagcccgagcgagagaaguccgccgccauugacggcgaguauaggcugaaaggcgagucacgcaagaccuucgucgaguugaugcgcagaggggaccuccccguuuggcuggcgcacaaaguugcuagcgaaggcauaaaguacaccgaccgcaagugguguuucgaugggcagaggaacaaccaaauccuagaagagaacauggacgucgagaucuggaccaaagagggcgagaagaagaagcucaggccccggugguuagacgcccgcacguacuccgauccgcuggcccucaaggaguucaaggacuucgccgccggcagaaagagcauugcccuggaccuggugaccgagaucgggcggguaccgacgcaucucgcccaccgaacccggaacgcccuagacaaccuugugaugcuccacaccuccgaacauggcgggaaagccuacagacacgccguggaggaguugcccgagaccauggagacccugcugcugcugggucucaugauacugcugaccggcggagccaugcuuuuucugaucagcgggaaggggauugguaagacgagcaucggucuuaucugugucaucgccuccucuggcauguuauggauggccgagauaccgcuccaguggaucgccagugcuaucguucuggaguuuuucaugaugguucuccugaucccagagccugagaaacaacggacgccccaagacaaucaacuggccuacgucguaauaggcauccucacucuugcagcgauaaucgcggcgaacgagaugggcuuacucgagaccacuaaacgcgaccuggggaugucgaaggaaccggggguaguuucccccaccagcuaucuggacgucgaccuccaccccgccuccgccuggacccuguacgccguggcgaccacggucaucacccccaugcugcgacacaccaucgaaaauucuacagccaacgugucccucgcugccaucgcuaaccaggcgguggucuugauggggcuggauaaggguuggcccaucucaaaaauggaucucggcgugccccugcuggccuuagggugcuacucccaggugaaccccuugacgcugaccgccgccguccuucuucucauuacccacuacgccaucauaggcccgggcuugcaggcuaaggcuacccgagaggcccagaagcgcacagccgcggggauaaugaagaacccgaccguggauggcaucaugaccaucgauuuagacccagugauauacgacagcaaguucgagaagcagcuggggcaggucaugcuccuggugcucugcgcggugcagcuccugcuuaugaggacuuccugggcgcucugcgaggcccugacgcuggccaccggcccgaucaccacccucugggagggcaguccuggaaaguucuggaacacgaccaucgcuguauccauggccaacaucuuccgaggcagcuaccuggccggggcgggcuuggcauucucaaucaugaaguccguuggaacuggcaagcgcggcaccgggucucagggcgagaccuuaggagagaaguggaagaagaagcugaaucagcugagccguaaggaguucgaccucuacaagaaguccgguaucacggagguggaccgcacugaggcgaaagaagguuuaaagcggggagagaucacccaccacgccgucagccgcggcagcgccaaauuacagugguucguggagcggaacaugguaaucccggaggguagagucaucgaccucggcugcgggcggggcggaugguccuacuacugcgcagggcucaaaaaggugaccgagguaaggggcuauacuaagggcggacccggccacgaggaacccguccccaugucuaccuacggcuggaacaucgucaaacugaugagugggaaggacguguuuuaccuacccccagaaaagugcgacacccugcugugugacaucggcgaaagcucccccagccccaccguggaggaguccagaacgauccgcgugcugaagaugguggagcccuggcucaagaacaaccaguucuguauuaagguacucaacccauacaugccuaccguuaucgagcaccuggagcgucuccaacgaaagcacggcggcaugcugguucgcaacccccugagucgcaauuccacccacgagauguacuggaucucgaacggcaccggaaauaucgucgcuucggugaacaugguuucccgccuccugcuuaaccgguucacgaugacccauagacggcccacuaucgagaaggacgucgacuugggcgcgggcacucgccaugugaaugccgagcccgagacgcccaacauggaugugaucggggaacggaucaagcgaauuaaagaggagcacaacuccaccuggcacuacgaugaugaaaacccguauaagaccugggccuaucacggcagcuacgaggucaaggccaccggguccgccucguccaugauuaauggcguugugaagcugcugacgaagcccugggaugucguacccauggucacgcagauggccaugaccgacaccaccccauucgggcagcaacguguguucaaggagaagguggauacccgcaccccucggagcaugcccggcacacgccgggugaugggcaucacugcugaguggcucuggcgcacucugggucggaacaagaaaccucgcuuauguaccagagaggaguucaccaagaaagugcgcacgaacgccgccaugggcgcgguguucacagaagagaaccaaugggauagcgccaaggccgccgucgaggaugaggacuucuggaagcucgucgaucgcgagcgggagcugcacaagcugggaaaguguggcuccugcgucuacaauaugauggggaagcgcgaaaagaagcuaggcgaguucgguaaggccaaggggucucgggcgaucugguauauguggcugggagccagguaccucgaguucgaggcccuaggguuucugaacgaagaucacugguuuucccgggaaaacagcuacuccggugucgagggggaggggcugcacaaguuagguuacauccugcgugacaucagcaaaaucccugggggcgccauguacgcagacgacacggcugggugggacacccggaucacagaagacgaccugcacaaugaggagaaaaucacccaacagauggauccggagcaccgacaguuggccaacgccaucuucaaguugacuuaccagaacaagguggugaaggugcagcggcccacccccacuggcacaguuauggacaucaucucgcgcaaggaccagcggggcagcggacaggugggcaccuacggacuaaacaccuuuacuaacauggaggcccagcucauacgccagauggagggcgagggcguccuguccaaggccgaccucgagaacccccaucucccagagaagaagaucacgcaguggcuggagacgaaaggcguggagcggcugaagcguauggccauaagcggagacgacugcguggucaagcccaucgacgaucgguuugccaacgcccuccuggcucugaacgacauggggaaggugcgcaaggacauaccacaguggcagccuagcaagggcuggcacgauuggcaacaggucccguuuugcagccaucacuuccacgaguuaauuaugaaagacgggcgaaagcuggucguaccgugcagaccccaggacgaacugaucggccgggcccgcauuucccagggcgcgggauggagccuccgggagacagccugccugggcaaggcguacgcgcagauguggucgcugauguauuuccaccgccgcgaccugcggcuggcgagcaacgccaucugcuccgccgugcccguccacugggugccgacgagucgcacuaccugguccauccacgcccaccaccaauggaugacaacagaggacaugcugacggucuggaacagggucuggauagaagauaaccccuggauggaggacaagacgcccguaaccaccugggaaaacgucccguaccucgggaagcgggaggaucaguggugcggcagccugaucggucuaaccagccgggccacuugggcccagaacauuccgacugcuauccagcagguccgcucccugaucgguaacgaggaguuccuggauuacaugcccagcaugaagagguuccgcaaggaggaagaguccgagggggccaucugguga

SEQ ID NO: 26032 - RNA, 9873 nt, Artificial Sequence
  derived and/or modified CDS sequence (opt11) from DENV-3__FJ639763__SS-prME
accagucugugccucaugaugauccugccugcggcccuggcguuccaccucaccucgagggacggggagccgcgcaugaucguggggaagaacgaacggggaaagagccugcuguucaagacggccuccggcauaaacaugugcacccuaaucgccauggaucugggggagaugugcgacgacaccgugaccuacaaaugcccccacaucaccgaaguggagcccgaggacaucgacugcugguguaaccugaccagcaccugggugaccuacgggacgugcaaccaggcgggggagcaccggcgcgacaagcggucaguggccuuagcgccccaugugggcauggggcuggacacccgcacccaaaccuggaugagugccgagggcgccuggcgccagguggagaagguggagacgugggcccuucgucacccgggguucaccauccucgcccuguuccuggcccacuacaucggcaccucccucacccagaaggccguaaucuucauacugcugaugcucgugacgcccucgaugacgaugcggugugugggcgugggcaaccgugacuucguagagggcuuguccggggccaccugggucgacguggugcuggagcacggugggugcgucacuacgauggccaagaacaagcccacccucgauaucgagcugcagaaaaccgaggcaacgcaguuggcaacccuccggaaacugugcauugagggcaagaucacaaacaucacgaccgacagccgaugccccacgcaaggcgaggcggugcuuccugaggagcaagaccagaacuacgugugcaagcacacauacguggaccggggguggggaaacgggugcgggcucuucgguaagggcucccuugucaccugcgccaaguuccagugccuggagcccaucgagggaaaggugguccaguacgagaaccucaaguacaccgugaucaucacggugcauaccggggaccagcaccaggucggaaacgagacccagggggugaccgccgagaucaccccgcaggcgagcaccaccgaggccauccugcccgaauacggaacccuggggcucgagugcucgccgcgcaccggacuggacuucaacgagaugaucuugcugacgaugaagaauaaggcguggauggugcaccgacaaugguucuucgaccugccccugcccuggacgucaggugccaccaccgagacgcccacauggaaccgcaaagagcucuuaguuaccuuuaagaaugcccaugcuaagaagcaggaggugguggugcuagggucccaagaaggcgcuaugcacacggcccucacgggggccaccgagauccagaauagcgggggcacguccaucuucgccggccacuugaagugccggcugaagauggacaaguuggagcugaaggguaugagcuacgcaaugugcaccaacacguuuguccugaaaaaggaggucagcgagacccagcacgggacgauauugauaaagguggaguacaagggggaggacgugccgugcaagauccccuucagcacagaggacgggcagggcaaggcccacaacggccgccugauuacggcgaaucccguugugacaaagaaggaggagcccgugaacaucgaggccgaaccgccauuuggggagagcaacauagucaucggcaucggggauaacgccuugaaaaucaacugguacaagaagggcaguagcaucgggaaaauguucgaggccaccgcccggggugcccgccggauggccauccugggggacacugcgugggacuucgguuccgugggcggaguucucaacagccugggcaaaaugguucaccagaucuucgguuccgcguacacagccuuguucagcggcguguccugggugaugaaaauugguaucgguguacucuugaccuggauaggccugaacagcaagaacaccuccaugagcuucuccugcaucgccaucgggauaauuacccucuaccugggcgccguggugcaggcggacauggggugcgucaucaacuggaaaggcaaggagcugaagugcggcuccgguaucuucgucacgaacgaagugcacaccuggacugagcaguacaaguuucaggcggacucccccaagagacucgcgaccgccaucgccggcgccugggagaacggcgucugcggcauucguagcacgacccggauggagaaccugcuguggaagcagaucgcuaacgagcucaacuacauccucugggagaacaacaucaaacugaccgugguugucggggacaucauuggcgugcuagagcagggcaagcgcacccugaccccccagccuauggaguuaaaguacaguuggaagaccuggggaaaagccaagaucgugaccgccgagacacagaauagcuccuucaucauagacggcccaaacacgcccgagugcccgagcgcgucccgggccuggaacgucugggagguggaggacuauggguucggcguguucacaaccaacaucuggcucaagcugcgcgaggucuacacccagcugugcgaccaccggcucaugagcgccgccgugaaggacgagcgcgccgugcacgcagacaugggcuacuggaucgagucucagaaaaacggauccuggaagcuggagaaggccucacugaucgaggucaaaaccugcacguggccgaagucccacacccucuggucuaacggcguucuggagucagacaugaucauucccaagagccuggccgggcccaucagucagcacaacuacaggccgggcuaccacacccagaccgccgggcccuggcaccucggcaagcuggaguuagacuucaacuauugcgagggcacgaccguggucaucaccgagaacugcgggacgcgcggccccagcuugcggaccaccacgguguccgggaagcugauccacgaguggugcugccgcagcugcacgcugcccccgcuccgguacaugggcgaggacggaugcugguacggcauggagaucagacccaucuccgagaaggaggagaacauggucaagagccuggucuccgcuggcagcggggagguggacaacuucacaaugggcguguuaugccuggcgauacuauucgaggaggucaugagagguaaguuuggcaagaagcauaugaucgccgggguguucuucaccuucguccugcuccuguccggccagauaaccuggcgcgacauggcccacacccugaucaugaucggcagcaacgcgucggaccguauggggaugggcgucacguaccuugcccugaucgcgaccuucaagauacagcccuuucuagcccucggauucuuucuucgcaagcugaccagccgugagaaucuccugcugggcguaggccucgccauggcaacgacgcugcaguugcccgaagacaucgagcagauggcgaacgggaucgcacuuggccugauggcccugaaauugauaacccaguucgagaccuaccagcuguggaccgcccugaucagucucacgugcaguaauaccaucuucaccuuaaccguggccuggagaacggcgacccugauacucgccggggucagcuugcugccaguuugccaauccagcuccaugcggaagaccgacuggcuccccaugaccgucgccgcaaugggcgugccgccccucccucuguucauauucagcuuaaaggacacgcuaaagaggcgcuccuggccccucaacgaaggcguaauggccgucggccucgugagcauccuggcgucuagccuucuucggaacgacgugcccauggcggguccccucguagccggggggcugcucauagcuuguuacguaauaacugggacguccgccgaccugacgguagaaaaggcggccgacgucaccugggaggaggaagccgaacagaccggggugagccacaaccuaaugaucaccguggacgacgauggcaccaugcgcaucaaggacgacgagaccgagaacaucuuaacgguccugcuuaagaccgccuugcuuaucguguccggcaucuucccguacuccauccccgccacgcugcucguuuggcauaccuggcaaaaacagacgcaacgauccggcguccugugggacgugccgucuccgccagagacgcagaaagcggagcuggaggaagggguguaccgcaucaagcagcagggcauuuucgggaagacccaggucggagugggggugcaaaaggagggcgucuuccacaccauguggcacgugacucguggcgccgugcucaccuacaaugguaagcgccuggagccgaacugggcguccgugaaaaaggaccugaucagcuacggggggggguggcggcucuccgcccaguggcagaaaggcgaagaaguccaggugaucgcggucgagccggguaagaacccuaagaacuuccagaccaugcccggcaccuuccaaacuaccaccggggagaucggagccauugccuuggauuucaagcccgggaccagcgguagccccauaaucaacagggaggguaaggugguggggcuguauggcaacggggucgugacgaagaacggcggguacguguccggcauagcccagacuaacgccgaaccagacggccccacccccgaacuugaggaggaaauguucaaaaagcggaaccucaccauuauggaccugcaccccgguagcggcaaaacgcgcaaauaccuuccggcgaucguccgggaggcuaucaagcgccggcuccguacccugauccuggcccccacccgggugguggccgcggagauggaagaagcguugaaggggcugcccauccgcuaccagacgacagccaccaaguccgagcacacaggccgcgagaucgucgaccugaugugccacgccaccuucacgaugcgccuacugagccccgugcgggucccgaacuacaaccugaucaucauggacgaggcccauuucacggaccccgccuccaucgcggcacgcgguuauaucagcacacgaguuggcaugggggaggccgccgccaucuucaugaccgccacgccucccgggaccgccgacgccuucccgcagaguaacgcccccauccaggacgaggagcgcgacaucccagagcgcagcuggaacaguggcaacgaguggaucaccgacuucgccgggaagaccgugugguucguccccagcaucaaagccgggaacgacauugcaaauugccuccggaaaaacgggaaaaaagucauccagcugucccgcaaaacguucgauacggaguaccagaagaccaaacucaacgacugggauuuuguggugaccacggacaucagcgaaaugggcgcuaacuucaaagccgaccggguaaucgacccgcgccggugccucaagccagugaucuugaccgauggacccgagcguguuauccucgcggggccgaugccugugaccgccgccagugcugcccagcggcgcggacggguagggcggaacccccagaaagagaaugaccaguacaucuucaccggccagcccuuaaacaacgacgaggaccacgcgcacuggaccgaggccaagaugcugcuggacaacaucaacacgcccgaggggaucauaccggcccucuucgagccggagcgggagaaguccgccgcgaucgacggcgaguaccgccuuaagggcgaauccagaaaaaccuucguugagcugaugcgccgaggugaccuccccgucuggcuugcccauaagguggcgagcgaggguaucaaguacaccgaccgcaaguggugcuucgacgggcagcggaacaaccaaauccuugaggagaauauggacgucgagaucuggaccaaggagggcgagaagaagaagcuacgcccccguuggcuagacgcccggacguacuccgauccgcuagcccuaaaagaguucaaagacuuugcggccggccgcaagaguaucgccuuagacuuagugaccgagaucgggcgggugcccucccacuuggcucaccguacccggaacgcccuggacaacuuagucaugcuccacaccagcgagcacggcgggaaggcguacagacacgcaguggaggaguugcccgagacaauggagacccugcuccugcugggccucaugauccugcugaccgggggcgccaugcuguuccugauuagcggcaaggggaucggcaagaccuccaucgggcugaucugcgugauugccagcucagguaugcuuuggauggccgagaucccauugcaguggauugcgagcgccaucguccuggaguucuucaugauggugcucuuaauucccgaacccgaaaagcagcggacuccccaggacaaccaauuagccuacguggucaucgggauccucacccuggccgcuaucaucgcggccaacgagauggggcugcuggagaccaccaagcgcgaccugggcauguccaaggaaccggggguaguuucacccacuuccuacuuggaugucgaccugcaccccgcaagcgccuggacccuauacgcgguggcgaccaccgucaucacgcccaugcugcggcauaccaucgagaacuccaccgcuaacgucagccucgcugccauagcgaaccaggcggugguccugauggggcuggacaagggguggccgaucuccaagauggaccucggcguuccccugcuggcacucgggugcuacucgcaggugaaccccuugacccugacggcggcagugcuccugcugaucacccacuacgcgaucaucgggccuggcuugcaggccaaggcuacccgugaggcccagaagcggaccgccgcggggaucaugaagaacccgacgguggauggcauuaugaccaucgaccuggaucccgugauauacgacuccaaguucgagaagcaacuuggccaggugaugcuccugguccugugcgccgugcaacuccugcuuaugcgcacuagcugggcccucugcgaggcccugaccuuagcgacgggccccauaaccacccucugggagggauccccaggcaaguucuggaacaccacgaucgcgguauccauggccaacauuuuccggggcucuuaccuggcaggcgccggccuugcguucagcaucaugaaauccgucgguaccggcaagcgugguaccgguucgcagggggaaacccugggggagaaguggaagaagaaguugaaccagcucagccggaaggaguucgaucucuacaaaaaguccgguaucaccgagguugaucgcacggaggccaaggaggggcugaagcggggagagaucacccaccacgccgucucacgcggcuccgccaagcugcagugguucguugagcggaacauggugauaccggagggacgcguuauagaccucggcugcgggcggggcggguggagcuacuacugcgccggccucaagaaggucaccgaggugcgcggcuauaccaagggcgggcccgggcaugaggagcccgugcccauguccacuuacgguuggaacauagucaagcugaugagcgggaaggacguguucuaucucccgcccgagaagugcgacacccugcuaugcgauaucggcgagaguagccccucccccaccgucgaggagagccgcaccauccgcguacuaaagauggucgagccguggcucaaaaacaaccaguucugcaucaaggucuugaaccccuacaugcccacggugaucgagcaccuggagcggcuccaacggaagcacggcgggaugcuggugaggaacccccuaucccggaauagcacccacgagauguauuggauauccaauggcacuggaaacauuguggcgagcguuaauauggugucacgucuccugcugaaccgguucaccaugacgcaucgccguccaaccaucgagaaagacguggacuugggcgccggcacacgccacgucaacgccgagcccgagacccccaacauggacgugaucggugagcggaucaagcgcaucaaggaggagcacaacagcacguggcacuacgacgaugagaacccguacaaaaccugggcuuaccacggcuccuaugaggugaaggcaaccgggagcgcguccuccaugaucaacgggguggugaagcugcuaaccaagcccugggacguugugcccauggugacgcagauggccaugacggacaccacccccuucgggcagcagcgugucuucaaggagaaggucgacacgcgaacgccgcggagcaugccaggcacccgccgggugaugggcaucaccgccgaguggcucuggcgcacuuuaggacggaacaagaagccccgacugugcacccgggaggaguuuaccaagaagguacgcaccaacgccgcgaugggcgccguguucacggaggagaaucagugggacagcgccaaggccgccguggaggacgaggauuucuggaagcucguugaccgugagcgggaguuacacaagcuggggaagugcggcaguugcguauacaacaugauggggaaaagggagaaaaagcucggagaguucggcaaggcgaaggggagucgggccauaugguacauguggcugggcgcacgcuaccuggaguucgaggcccuugguuuccugaacgaggaccauugguucagccgggagaauuccuacagcggcguggaaggggagggccugcacaagcucggcuauauccugcgcgauaucuccaagauccccggcggcgccauguacgcggacgacaccgccgggugggacacccggauuacugaggacgacuuacacaacgaagagaagaucacgcaacagauggacccugagcaucgccagcuugcuaacgccauauucaaacugaccuaccaaaacaaggucguaaaggugcagcguccgaccccgaccggcaccgucauggacaucaucagccgcaaggaccagagaggcucuggccaggugggcacauaugggcuuaacaccuuuacaaacauggaggcacagcuaauccgccagauggagggcgaaggugugcugagcaaagcggaccucgagaacccgcaccucccggagaagaagaucacccaauggcuugagacuaacggcgucgagcggcugaagcgcauggccaucuccggggacgacugcgugguuaagccgaucgacgaucgguucgccaacgcccucuuagccuugaacgacaugggcaagguccgcaaggauaucccccaguggcagcccucgaagggcuggcacgacuggcagcaagucccguucugcucccaccacuuucacgaguugaucaugaaggacggacggaagcuggugguccccugcagaccccaggacgagcugaucgggcgggcgcgcaucagccagggggccggcuggucccuccgggaaacagccugucugggcaaagccuaugcgcagauguggagucugauguacuuucaccgccgcgaccuccggcuggcauccaacgccauaugcagcgcugugcccguacauugggugccgaccuccaggaccacguggagcauucacgcccaccaccaauggaugaccacugaggacaugcugaccguguggaaccgggucuggaucgaagauaaccccuggauggaggacaagacgcccgucaccaccugggagaacguccccuaccucgggaagcgagaggaucaauggugcggcucacugaucggacugacuucccgugcgacgugggcccagaacaucccaaccgccauccagcagguccgcucuuugaucggcaacgaggaguuccuggacuacaugccuuccaugaagcgauuccgcaaggaggaggaaagcgagggggccaucugguaa

SEQ ID NO: 26033 - RNA, 9873 nt, Artificial Sequence
  derived and/or modified CDS sequence (opt11) from DENV-3__FJ639765__SS-prME
accucacuuugccucaugaugaucuugcccgcagcacuggcguuccaccucacgucgcgggacggggaaccccggaugaucgugggcaagaacgagcggggcaagagccugcuguucaagaccgccagcgggaucaacaugugcacccucaucgcuauggaccugggugagaugugcgacgacaccgugaccuauaaguguccacauaucacagagguggagcccgaggacaucgacugcuggugcaaccugaccagcacauggguuacauacgggacaugcaaccaagcgggcgagcaccggcgcgacaaacggagcguggcccucgcgccccacgugggcauggggcuggacacccgcacccaaaccuggaugagcgccgaaggugcuuggcgucagguagagaagguagagacgugggcccugcgucaccccggcuucaccauccucgcauuauuccuagcucacuacaucggcaccagucucacccagaaaguagugaucuucauccugcugauguuagucacgcccagcaugacuaugcggugcguuggugugggcaaccgcgauuucgucgagggccugucgggggccacauggguggauguuguccuggagcacggcggcugcgugaccacgauggccaagaacaagcccacccucgacauagaguuacagaagaccgaggccacccagcuggcaacgcuccggaagcugugcaucgaggggaagaucaccaauaucacgaccgauagccgcugccccacucagggcgaggccgugcugccugaggagcaggaucagaacuacgucugcaagcacaccuacguggaccggggguggggcaacgguugcggccucuuuggaaagggcuccuuggugaccugcgcuaaguuucagugucuggagccgaucgaaggcaaggucguucaguaugagaaccugaaguacaccgucauuauaacgguacacaccggggaccaacaccagguuggcaacgaaacccagggggugacugcugagauaacgccccaggcuagcacuaccgaggcgauccuaccggaguacggcacccuggggcucgaaugcuccccgagaaccggccuggacuucaacgagaugauauuacuaacgaugaagaauaaagccuggaugguccaccgccaaugguucuucgaccucccccuacccuggaccagcggcgcaacgacggaaacaccaacguggaaccggaaagaguuacuggugaccuucaagaacgcccacgcuaagaagcaggaggucguagugcuggggucccaggagggcgcgaugcacacagcccucacgggggccaccgaaauccagaacucgggcgggaccagcauuuuugcagggcaucugaagugccgguugaagauggacaaguuagaacugaaggggaugagcuacgccaugugcaccaacacguuuguccugaagaaggaaguguccgagacccagcacggcaccauccucaucaagguggaguacaagggcgaggacgucccgugcaaaauccccuuuaguaccgaggaugggcaggguaaggcgcacaacggccgccuaaucacagccaacccuguuguuacaaaaaaggaggagcccgucaauaucgaggcggagccccccuucggcgagagcaacaucgugaucggcaucggggacaacgcccugaagaucaacugguacaagaagggauccagcaucggcaaaauguucgaggcgacagcccggggggcccguaggauggccauacuuggagacaccgccugggacuucgguucggugggcggcgugcucaacagccugggcaaaauggugcaucagaucuucgguuccgcguacacggccuuguucucuggcguguccugggucaugaagaucgguaucgggguucuuuugacuuggaucggccugaacagcaagaacaccaguaugucauucucuugcaucgccaucgggaucaucacccucuaccucggcgcagugguccaagccgacauggggugcgucaucaauuggaaagggaaggagcugaagugcggcucugggauuuucgugacgaacgaaguacacaccuggaccgaacaguacaaauuucaggccgacagucccaagcgccucgccaccgccaucgcgggcgccugggagaauggcgugugugguaucagaagcacaacgcggauggagaaucugcuguggaagcaaaucgcgaacgagcucaacuauauacugugggagaauaacaucaaacugacgguggucgugggggacaucaucggcguccucgagcagggcaagcgcacacugaccccccagccgauggagcuuaaauacuccuggaagacaugggggaaggcaaaaaucgucaccgcagagacccagaacaguuccuucaucaucgacggccccaauacucccgaaugccccucggcuucccgggcguggaacguaugggagguagaagauuauggguucggcguauucaccacaaauaucuggcucaagcugcgcgagguguacacccagcugugugaccaccgguugaugagcgccgccgugaaggacgaacgagcaguccaugcugauaugggcuacuggauugaaucucagaagaaugggaguuggaagcuggagaaggcgagccugaucgaggugaagaccugcacguggcccaagucccacacccuuuggaguaauggagugcuggagucugacaugaucauccccaagagccuggccggucccaucagccagcauaacuaccggccgggguaucacacucagaccgccgggccuuggcaccucggcaagcuggaacuagacuuuaacuacugcgaaggcacgaccguugugaucaccgagaacugcgguaccaggggccccagccuccggacaacuaccguuuccggcaagcugauccacgaauggugcugucguaguugcacccugccccccuuacgguacaugggcgaggacgguugcugguacggaauggagaucagacccaucuccgagaaggaggagaacauggucaaaagccugguguccgccggcagcggggagguagacaacuucacgaugggcguccugugccucgccauacuguucgaggaggugaugcgggggaaguuuggcaagaagcacaugaucgccgggguguucuucacauuugucuuauugcugagcggccagauuacguggagagauauggcacacacacucaucaugauuggaucgaacgccuccgaccgcauggggauggguguaacauaccucgcccugaucgccaccuucaagauccagcccuuccuggcguuggguuucuuuuugcgcaagcugaccaguagagagaaccuccugcuuggaguuggccucgccauggccaccacgcugcaacugcccgaggauaucgagcagauggccaaugggaucgcgcucggccugauggcucugaagcucaucacccaguucgagaccuaccagcuguggaccgcccugauaagccucacgugcaguaacaccaucuucacccuuacggucgcguggaggacggccacccuuauccucgcgggggugagcuugcugccgguuugccaaucuagcuccaugcggaagaccgacugguugcccaugacgguggccgccaugggcgugccgccccucccgcuguucauauucucacucaaagauacacugaagcgccgcucauggccccugaacgagggggucauggccguagggcucgucagcauacuugcuuccagccugcuccggaaugacgucccuauggcgggcccccugguggcggggggacugcuaaucgccugcuacgugaucacagggaccuccgccgaucugaccgucgagaaggcagcggacgugacgugggaggaggaggcagagcagacgggcgugagccacaaccugaugaucaccguugacgacgaugggaccaugcgcaucaaggacgacgaaacagagaacauccucacugugcuccugaaaacggcccuccugaucguguccggcaucuuccccuacuccauucccgccacccugcugguuuggcacaccuggcagaaacagacgcagcgguccggcgugcugugggacgugccaagcccgccggaaacccagaaggcugagcuggaggaaggggucuaccgcaucaagcagcagggcauuuucgggaagacccaggugggcguggggguacagaaagagggcguguuccacacgauguggcacgugacccggggcgcgguccucaccuauaauggaaagcgccuggagcccaacugggccuccgugaagaaggaccugaucagcuacggcgggggcuggagauuauccgcccaguggcagaaaggggaggagguacagguaaucgcgguggagcccggcaagaacccuaagaacuuccagaccaugcccggcaccuuccagacaaccaccggggagaucggggcgauugcccuggacuucaagcccgggacgagcggcagccccauuaucaaccgggagggcaagguggucgggcuguacgguaacgggguggucacgaagaacggcggguacguuuccggcaucgcccagaccaacgcagagccugacggacccaccccagaacuggaggaggagauguucaagaagagaaaccucaccauuauggacuugcaccccggaucgggcaagacccggaaguaucugccggcuaucgugcgggaagccaucaagcgcagacucagaaccuuaauucuugcccccacccggguagucgccgccgagauggaggaggcacucaaggggcuccccaucagauaucagaccaccgcaacuaaguccgagcacaccggccgggagauaguggacuuaaugugccaugccaccuucacgaugcgcuuacuaagccccgugcggguuccgaauuacaauuuaaucaucauggacgaggcccacuucaccgauccagccagcauugcggcucguggguacaucuccaccagaguuggcaugggcgaagccgccgccaucuucaugaccgcaacgccgcccgggaccgcagacgccuucccgcaguccaacgcccccauccaagacgaggagcgcgauauccccgaacgaucuuggaacucaggcaaugaguggaucacagauuucgcugggaagaccgugugguucguccccagcaucaaggcggggaacgacauugcgaauugccuccguaaaaacgggaagaaagugauccaguuaucccgcaaaacguucgacaccgaguaccagaagaccaaacuaaacgacugggauuucgugguuacgacggacauuagcgagaugggcgcgaacuucaaggccgaccgggugaucgauccgcgccgcugccucaagcccgugauccuuacggacggucccgagcgcgucauccuggcgggcccgaugccggucaccgcagcgagcgcagcucagcgucggggccgggugggcagaaauccccagaaagagaacgaccaguacaucuucacgggccagccccucaauaacgacgaggaccacgcccacuggacugaggcgaaaaugcugcuggacaauauuaacacgcccgaagggaucauuccggcccuuuucgagccggaacgagaaaagagugccgcgaucgauggcgaguaccgucugaaaggcgaguccaggaaaaccuucguagagcuaaugcgucgcggggaccuucccgugugguuagcgcacaaagucgccuccgagggcaucaaguacaccgaccgcaaguggugcuucgacggccagagaaacaaccagauccuugaagagaacauggacguggagauuuggaccaaggagggugagaagaaaaagcuacguccacgguggcuggaugcccgcaccuacuccgacccgcuggcacucaaggaguucaaggacuucgcagcuggccguaaaagcaucgcccuggaucuggugaccgagaucgggcggguccccacccacuuggcgcaccguacccgaaacgcccucgacaaucucguaaugcuucacacgucggagcacggcgggaaggccuacagacacgccguggaggagcugccugagaccauggagacccugcuccugcugggccugaugauauugcugaccggaggcgccaugcuguuccugaucucaggcaagggaaucggcaagacgagcaucggucugaucugcgucaucgccuccagcggcaugcucuggauggccgaaaucccgcuccaguggaucgccuccgcgauaauuuuagaguucuucaugauggugcuccugauacccgagcccgagaagcagcgaacuccccaggacaaccagcuggccuacguggucauagggauacuaacccuagcggcuaucaucgccgcaaacgagaugggccugcucgagacaacgaagcgugaccuggggaugagcaaggaaccggggguugugucccccaccagcuaccuugacguggacuugcaccccgccucggccuggacauuguaugccguggcgaccacggugauuaccccuaugcugcggcauaccaucgagaacagcaccgccaauguaucccuugcggccaucgccaaccaagcugugguccuuaugggccuggauaagggguggccaaucucuaagauggauuuaggcgucccgcugcuggccuuggggugcuauagucaggugaacccucugacgcugacugccgccgugcuccugcuuauuacgcauuacgcuauuauugggcccggucugcaggcgaaggccacccgcgaggcucagaagcggacggccgcggggauaaugaagaacccgaccgucgauggaaucaugaccaucgaccuagacccggugaucuacgauucaaaguucgagaagcaacugggccaggugaugcuccuagucuuaugcgcggugcagcucuuacugaugcgcaccuccugggcccucugcgaggcccugacgcuggcaacuggccccaucaccacccucugggaggguuccccagggaaguucuggaauacaacuaucgcggugucuauggccaacaucuuccggggcucauaccuggcaggggccggucuggccuucuccaucaugaaguccgucgggaccggcaagcgcggcacuggaucccaaggcgagacacucggggagaaauggaagaagaaguuaaaucaauuaagccggaaagaauucgacuuguacaagaaguccggcaucacggaaguggaccgcaccgaggccaaagaggggcugaagcggggcgagaucacccaucacgccguguccagaggcagcgcuaagcugcagugguucguggagcgcaacauggugaucccagaggggcgcgucaucgaccuggggugcggccgcggugggugguccuauuauugugccggccugaagaaggucaccgagguccgcgguuauacgaaaggagggccagggcacgaggaacccguacccaugagcaccuacggcuggaacaucgucaagcugauguccgggaaggacguuuuuuaccugccucccgagaagugcgacacccugcugugcgacaucggcgagagcucgcccagccccaccguggaagagucacgcacuauucguguccugaagaugguggagccguggcucaagaacaaccaguucuguaucaaggugcugaacccuuacaugcccaccgucauagagcaccucgaacgcuuacagaggaaacauggcgguaugcuggugcgcaacccucugagccggaacucaacccacgagauguacuggaucagcaauggcaccgggaacauaguggccucugucaacauggugagccgucuccugcugaaccgguucaccaugacccaccgccggccuacgaucgagaaggacguggaccucggcgcgggcacacgccaugugaacgccgagcccgaaacucccaauauggacgugaucggcgagcggaucaagcgcaucaaggaggagcacaacuccaccuggcauuacgacgaugagaacccauacaagaccugggccuaucacgggagcuaugaggugaaagccaccggauccgcaagcucgaugauuaacgguguagugaagcuucugacgaagcccugggacgucgugcccauggugacccagauggcgaugacggauaccacgcccuuugggcagcagcgggucuuuaaggagaagguggauacccgaaccccgcgguccaugcccggcacccgucgcgugauggguauaacagccgaguggcucuggcgcacacugggucggaacaaaaagccccgacugugcacccgggaagaguucaccaagaagguccgcaccaacgccgccaugggcgccguguucaccgaggagaaucagugggacagcgccaaagcggccguggaggacgaagacuucuggaagcuagucgaccgcgaacgggagcugcacaagcuggggaaguguggcuccugcguguacaacaugauggggaagcgcgagaagaagcuuggcgaguucggcaaggccaaggguagccgggcgaucugguauauguggcucggggcuagguaccuggaauucgaggccuugggguuucugaacgaggaccauugguucucccgggagaacagcuacuccggcguggagggugagggacugcacaaacucggcuacauccugcgcgacaucagcaagauacccgggggcgccauguaugccgacgacaccgcggggugggauaccaggaucacggaggaugaccugcacaacgaggaaaagauuacccagcagauggaccccgagcaccgccaacucgcgaacgccaucuucaaacugaccuaccagaauaaggucgugaaagugcagcggcccacgccuaccggcaccgucauggacaucaucucccgcaaagaccagagaggcuccggccaggugggcaccuacggguugaacacauucaccaauauggaggcgcagcugauacgccagauggagggcgaggggguauuguccaaggccgaccucgagaacccucaccugccggagaaaaagaucacgcaguggcuagagaccaagggaguagagcggcugaagcgcauggcgaucagcggggacgacugcguggugaagcccaucgacgaccgguucgcgaacgcccuccuggcccugaaugacauggggaagguccggaaagauaucccccaguggcaacccucgaagggcuggcaugacuggcagcagguccccuucugcagccaccacuuccacgaacucaucaugaaagacggucggaagcugguagucccgugccgcccccaggacgaacugaucgggcgggcccgcaucucccagggcgcgggcuggagccuccgggagaccgccugccuggguaaggcauaugcccaaauguggucccugauguacuuucaccgccgcgaccucagacuggcgagcaacgccaucugcuccgccgugccagugcacuggguuccgacuagucgcacgaccuggaguauacacgcccaucaccaauggaugacaaccgaggacaugcugacgguauggaaccggguguggauugaggacaaccccuggauggaggacaagaccccugucaccaccugggagaacgugcccuaccuaggcaagcgggaggaccaauggugcggcagccugaucggucugacgagccgggccaccugggcgcagaacaucccgaccgcaauccagcaaguccgcuccuuaauugggaacgaggaguuccuggacuacaugccaagcaugaagcgguuccggaaggaggaggaauccgaaggugcgaucugguga

SEQ ID NO: 26034 - RNA, 9873 nt, Artificial Sequence
  derived and/or modified CDS sequence (opt11) from DENV-3__FJ639766__SS-prME
accagccugugcuuaaugaugauccugcccgccgcgcuggcguuccaccucacaagucgugacggcgagcccagaaugaucguggggaagaacgagaggggcaagagccuucuguuuaagaccgcuuccgggaucaacaugugcacacucaucgccauggaucugggugagaugugcgacgauacagugacauacaaguguccccacaucacagagguggagcccgaagacaucgacugcuggugcaaccuuaccaguaccugggugaccuacggaacgugcaaccaggccggcgagcaccgucgcgacaagcggucagucgcucuugcgccacacguggggaugggccuggacacccgcacccagacauggaugagcgccgagggagcauggaggcaaguggagaagguagagacgugggcccuucgccacccgggcuucaccauacuugcgcuuuuccuagcccacuacaucggcaccagccucacccagaagguggugaucuucauccugcugaugcuuguuacacccagcaugaccaugcggugcguggggguggggaaccgcgacuuugucgaaggccuguccggugccacaugggucgacguaguucuggagcacggcgggugcgugacaacgauggccaagaacaagcccacccucgacauagagcugcagaagaccgaagccacccaacuggcgacucuccggaagcuuugcaucgagggaaaaaucaccaacaucaccaccgacagccgcugcccuacgcagggcgaggcggugcugccggaggagcaggaucagaacuacgucugcaagcacaccuacguggaccggggguggggcaacggaugcggccucuucgggaagggcucccugguuaccugugccaaguuccagugccuggagcccaucgagggcaaggucgugcaguacgaaaaccuaaaguacacggugauaaucacgguccacaccggggaucagcaccaagucggcaacgagacccagggggucacugccgagaucacgccgcaggccagcacaacugaggcuaucuuacccgaguacggaacccugggucucgagugcuccccgcguaccggacuugauuucaacgagaugauucugcucacgaugaagaacaaggccuggauggugcauagacaaugguucuucgaccugccccugccuuggacaucuggcgccaccacugagacccccaccuggaaccgcaaggagcuccugguaacguucaaaaacgcccacgcuaagaaacaagagguugugguccuggggucacaggagggcgcaaugcacaccgcucucacgggggccacugagauacaaaacagcggcgggaccucgaucuucgccggccaccuaaagugccggcuuaagauggauaagcuugagcugaagggcaugagcuacgccaugugcaccaacacguucguccugaagaaggaggugucggagacccagcacgggaccauucucaucaagguggaguacaagggcgaagacgucccaugcaagauccccuucucgacugaggacggucaaggcaaggcgcacaauggucgccugaucacugccaaucccguugugaccaagaaggaggagcccgucaacaucgaggccgaaccgccauucggcgagagcaauaucguuaucggcaucggcgacaacgcccugaagaucaacugguacaagaaggguuccagcaucgggaagauguucgaggcgaccgcccggggagcccgucggauggcuaucuugggcgacaccgcaugggacuucggcuccgucggcgggguacucaacagccugggcaaaauggugcaucaaauauucggguccgcguacacugcgcucuucagcgggguguccugggucaugaagaucggcauuggugugcuguugacauggauuggccugaacucaaagaacaccuccaugagcuucuccugcauagcuaucggcaucaucacacucuaccugggcgccgugguacaggccgacauggggugcgugaucaacuggaaaggcaaggagcugaaaugcggaagcgggaucuucgugacgaacgaaguccacaccuggacagagcaguacaaguuccaggccgacucccccaagcgcuuggccaccgccauugccggcgcaugggagaacggggugugcggaauccgcagcacaacccggauggaaaaccugcuguggaagcagaucgccaacgaacucaauuacauccugugggagaauaacaucaagcugaccguugucgugggggacauuaucggggugcucgagcagggcaagcgcacccuaacuccccagccgauggagcugaaguacuccuggaagacuugggggaaggccaagauuguaaccgccgaaacgcagaacagcuccuucaucaucgacggcccgaacacgcccgagugcccaagcgccuccagagcguggaaugugugggaaguggaggacuacggauucggcguuuucacgaccaacaucuggcucaagcugcgagagguguacacccaacucugcgaccaccgucuuaugucggcggcagugaaggacgaacgcgcgguccaugcggacaugggguacuggaucgagucucagaagaacggaucauggaaacucgagaaggcgagucugaucgaggugaagaccugcacguggccgaagucccacacgcucuggagcaacggcguccuggaaucggacaugaucauccccaagagccuggccggacccauaucccagcauaacuacagaccuggcuaucacacccagacugccgggcccuggcaccucggcaagcuggagcuggacuucaauuacugcgaggggacgaccgucgugauuaccgagaacugcggcacccgcggccccagccuucgcacgaccacuguauccgggaagcucauucacgaguggugcugccgcagcugcaccuuacccccuuuacgcuacaugggcgaggacgggugcugguacggcauggagauccgccccaucagugagaaggaggagaacauggucaaaucccugguguccgcuggcagcggggagguagacaacuucacgauggggguccugugccucgcaaucuuguucgaggaggugaugcgggggaaguucggcaagaaacauaugaucgccgggguguucuucaccuucguccugcuccuguccggccagaucaccuggcgcgacauggcccacacauuaaucaugaucggcucuaacgcauccgaccggauggggauggguguaacguacuuggcccugauugccaccuucaagauccagcccuuucuggcgcucggauuuuuccugcgcaagcugacgagccgagagaauuuacuguugggugugggccucgccauggcgaccacgcugcaguugcccgaggacaucgagcagauggcuaacggcaucgcgcucggccugauggcacugaagcuuauaacccaguucgagaccuaccagcuguggaccgcccuuaucagccucacgugcuccaacaccaucuucacccugaccgucgcuuggcgcacggccacacugauucucgcgggugugucccugcugccggucugccaguccagcuccaugcggaagaccgacuggcuccccaugaccguggcugcuaugggcgucccgccccucccuuuguucauauucaaccucaaggacacguugaagcgccgcagcuggccccugaacgagggggucauggccgugggccucguguccauccuggcgagcuccuugcuccggaacgacguccccauggcgggcccccugguggcagggggccugcucaucgcaugcuaugugaucaccgggaccucugccgaccucacagucgagaaggccgcagacgugacgugggaagaggaggccgagcagaccggcgugucccacaaccugaugaucaccgucgacgacgacgggaccaugcgcaucaaagaugacgaaaccgagaauauccucacggugcuacugaagacggcauuacugaucgugagcggcaucuucccguacucaauucccgcaacccuccucguguggcauaccuggcaaaaacagacgcagcggucaggugugcugugggacguccccagcccgcccgagacccagaaggccgaguuggaggagggggucuaucggauuaaacagcagggcaucuucggcaagacccaggugggcguagggguccagaaggagggcguguuccauaccauguggcaugucacgcggggggcgguccucaccuauaacgggaagagauuggagcccaacugggccucagugaaaaaagaccugaucuccuauggaggaggcuggcgcuuaagcgcucaguggcaaaagggggaggaggugcaagucauugccguggagcccggcaagaaccccaaaaauuuccagacuaugcccggcaccuuucagacgaccacaggggagaucggugcgauagccuuggacuucaagccugggaccaguggcagccccaucauuaaccgcgaggggaagguggucggucuguauggaaacgggguggugacgaagaacggcggauacgugucaggcaucgcacagaccaacgccgagcccgauggccccacccccgagcuugaggaggagauguucaagaagcggaacuuaaccauaauggaccugcaccccggcuccgguaagacgcgcaaguaccugccggccauugugcgggaggcgauuaagcggcggcuccgcacccugauccuagccccuacacggguggucgccgccgagauggaagaggcccucaagggguugccaauccgcuaccagaccacugcgaccaaaagcgagcacaccggccgggaaauuguggaccuaaugugccaugcuaccuucacgaugcgccuccugagccccgugcggguuccgaacuacaaccugaucaucauggacgaggcccacuucaccgaucccgcgagcaucgccgcgagaggguacaucuccacccgugugggcaugggcgaggcagccgccauuuucaugaccgccacgccgcccgggaccgcggacgccuucccgcagagcaacgccccgauacaagacgaggagcgcgacaucccugagcgcuccuggaacagcggcaacgaauggaucaccgacuuugcagguaagaccguaugguucgucccauccauuaaggcgggcaaugacauagccaacugccuccggaagaacgggaagaaagugauccaacugagccgcaagacguucgacaccgaauaccagaagacaaaguuaaacgacugggauuuugugguaacaacggacaucuccgagaugggcgccaacuucaaggcagaccgcguaauagacccgcgccgcugccucaagcccguaauccugacagacggacccgagcgagugauucuggccgggcccaugccggucacggcggccagcgccgcccagaggcguggcaggguggggcgcaacccccagaaagaaaacgaucaguacaucuucacaggccagccccucaacaacgacgaagaccaugcccacuggaccgaggcgaagaugcugcuggacaauauuaacacgcccgaaggcaucaucccggcgcuguucgagcccgagcgggagaagagugccgccaucgacggcgaguaccgccugaagggugagagccggaaaaccuucguggaacugaugcgacgcggggaccucccuguguggcuggcgcacaagguggcauccgaggggauuaaguacaccgaccguaaguggugcuucgacggacaacggaacaaccagauccuagaggaaaacauggauguggagaucuggaccaaggagggcgagaaaaagaagcuccgcccucgguggcuagaugcgcggacguacucagacccgcuggcccucaaggaguucaaagacuucgccgcgggacgcaaguccaucgcccuggacuuagugacagagauuggccguguucccacccaucucgcccaccgcacacggaacgcccuggauaaccuggugaugcuccacacgagcgagcacggcgguaaagcuuaccgccacgcuguggaggagcugcccgagacaauggagacacugcuucuacugggcuugaugauauuacuuacagggggcgccaugcuguuccugauaucuggaaaggggaucggcaagacgucuaucgggcugaucugcgucauagccucuaguggcaugcuauggauggccgagaucccgcugcaguggaucgccagcgcuaucgugcuggaauucuucaugaugguccuccuuaucccggagcccgagaagcagcggacuccccaggauaaccagcuugccuaugucgucaucgggauccucaccuuggcagcgaucauagccgcgaaugagaugggucugcucgagaccacgaagcgagaccugggcauguccaaggagcccgggguggucagccccacguccuaucucgacguggacuugcaccccgcguccgccuggacccuguacgccguggcgaccacgguaauuacaccgaugcuccggcauacaauagagaauuccacugccaacgugagccucgccgccauagcgaaccaggcugugguccugaugggccucgauaaaggguggcccaucuccaagauggaccucgguguaccgcugcuggcccucgggugcuacagccaggucaaucccuuaacgcugaccgcugccguccucuugcugauuacccacuaugcgaucaucggccccgggcuccaggcuaaagcaacacgcgaggcccagaaacggacggcagccgggaucaugaaaaacccaaccguagacggcaucaugaccaucgaccuggaccccgugaucuacgacucuaaguucgaaaagcaacuggggcaggucaugcucuuggugcugugcgcagugcaguugcugcugaugcgcaccagcugggcguuaugcgaggcucugacgcuggccacuggaccaaucaccacccucugggagggcucccccgggaaauuuuggaacacgaccaucgcgguuaguauggcgaauaucuuuaggggcuccuaccuggccggugccggccuggcuuucagcaucaugaaguccguuggcacuggcaagcgcggaacagggagccagggcgagacguuaggggagaaguggaaaaagaagcucaaccaauuaucccggaaggaguucgaccucuacaagaaguccggcaucacggagguggaccgcaccgaagcgaaggaaggguuaaaaagaggcgagaucacacaccacgccgugagccgcggcucugcaaaguuacagugguucguggagcggaacauggucaucccggagggccgcguuaucgacuuaggcugcggccgggggggguggagcuacuacugugccggucugaagaagguuaccgaggugcgcggcuacacgaagggaggaccaggacacgaagagcccguccccauguccacauauggguggaacaucgugaaguugaugagcgggaaagacguguucuaccucccgcccgagaaaugcgacacacugcugugcgacaucggcgaguccagucccuccccgaccgucgaggaaucgcggacgauucgcgugcugaagaugguggagccgugguugaagaacaaccaguucugcaucaagguccugaaccccuacaugccuaccgugaucgagcaccuggaacgccuccagcggaagcacggcgggaugcugguacgcaacccccugucccggaauagcacacacgagauguacuggaucuccaacggcaccgggaauauagucgccagugugaacauggugucccgccuacuacugaaccgauucacgaugacacaccgccggccgaccauugaaaaggacgucgaccucggagcgggcacccgucacgugaacgccgagcccgaaacgcccaacauggacguuaucggugagcggaucaagcgcaucaaagaagagcauaauagcaccuggcacuaugacgacgagaauccguacaagacaugggcguaucacggcuccuacgaggucaaggccacggggucggccuccaguaugaucaacggcguggugaagcugcuaacgaagcccugggacguugugcccauggucacccagauggcgaugaccgacaccacgcccuucgggcagcaacgaguuuucaaggagaagguggacacccgcaccccgcgguccaugccaggcacccgccgggucaugggcaucacggcagaguggcuguggcgcacccuggggcggaacaagaaaccccgccugugcaccagagaagaguucaccaagaaggugcgcacgaacgcggccaugggggcgguuuuuaccgaggagaaccagugggacagugcaaaggccgcuguagaggacgaggacuuuuggaaacucguggauagggagcgggagcugcacaagcuagggaaguguggcaguugcguguacaacaugaugggaaagcgcgaaaagaagcucggcgaguucggcaaggcaaaggggucccgggcaauaugguacauguggcugggcgcccgcuaucuggaauucgaggcccucggguuccugaacgaagaccacugguucagcagagaaaacuccuacagcggcgucgagggggagggccugcacaaacucggguacauccugcgcgacauauccaagauccccgggggcgcaauguacgccgacgacaccgcugggugggacaccagaaucacggaggacgaccugcacaacgaggagaagaucacccaacaaauggacccggagcaucgccagcucgccaacgccaucuucaaauuaacauaccagaauaagguggucaaaguacagagacccacccccaccggaaccgugauggacaucaucagucgcaaggaccagcgaggcuccggucaggugggaaccuacggucugaacacauucaccaacauggaggcacaacucauucgccagauggagggggaggggguccugagcaaggcagaucuggagaacccgcaccucccggagaagaagaucacucaauggcuggagacgaaggguguggagagauuaaaacgcauggcgaucuccggggacgauugcguggugaagcccaucgacgaccgguucgccaacgcccuccuggcacugaacgauauggggaaagugcgcaaggacaucccccaguggcagcccagcaagggauggcacgauuggcagcaggucccguucuguucccaccacuuccacgagcucaucaugaaagacgggagaaagcugguuguccccugccgcccccaggaugaguugauaggccgggcgcgcaucagccagggggccggcuggucucuccgggagaccgccugccugggcaaggcauaugcccaaauguggagccugauguacuuccaccgacgcgaccuccggcuggccucgaacgccauuuguagcgcagugcccgugcacuggguucccaccucccgcacgaccuggucgauacaugcccaccaccaguggaugaccacggaagacaugcugacgguguggaacagggucuggaucgaggauaaccccuggauggaggacaaaaccccuguaaccaccugggagaaugugcccuaccucgggaagagggaggaucaauggugcggaucccugauugggcucaccagcagggcuaccugggcgcaaaauaucccgaccgccauccagcagguccguagccucaucggcaacgaggaguuucuggacuauaugcccuccaugaagcgguuccgaaaggaggaggagucagagggggccaucugguga

SEQ ID NO: 26035 - RNA, 9873 nt, Artificial Sequence
  derived and/or modified CDS sequence (opt11) from DENV-3__FJ639767__SS-prME
accagccugugccucaugaugauccugcccgccgcuuuagcguuucaccucaccagccgggacggggagccccggaugaucgugggcaagaacgaacgcgguaagucgcugcuguuuaagacggcuucuggaaucaacaugugcacucucaucgcgauggaccugggcgagaugugcgacgacacagugaccuacaaguguccccauaucacggagguggagcccgaagacaucgacugcuggugcaaccugacgagcaccuggguaacauacggaacgugcaaccaggcgggcgaacaccggagggauaaacguucugucgcccucgcgccccacgugggcauggggcuggacacccggacacagaccuggaugagcgccgaaggugccuggcgccagguggagaaggucgagacgugggcgcugcgccauccgggcuucaccauucucgcgcuguuucuugcccauuacaucggcaccagccuaacgcagaagguggugaucuucauccugcugauguuagucacccccuccaugacaaugcggugcgucggggugggcaauagggauuucguagagggacugaguggggccaccuggguggacgugguccuggagcauggcggcugcgugaccacgauggccaagaacaagcccacucuggauaucgagcugcagaagaccgaggccacccagcuggcgacgcugcggaaacuuugcaucgagggcaagauuaccaacauaacuaccgacagucgcugccccacacaaggcgaggccgugcugccggaggagcaggaucagaacuauguuugcaagcacaccuacguggaccggggguggggcaacgguugcggcuuguuuggaaaaggcucacugguuaccugcgccaaauuccaaugccuggagcccaucgagggcaaggucgugcaauacgagaaccucaaguacacagugauaaucacggugcacaccggugaucagcaccaagugggaaacgaaacucagggcguaacugccgagaucaccccgcaggccagcacaaccgaggcuauacugcccgaauauggaacccugggguuagaaugcagcccccgcaccggccucgauuucaaugagaugauccugcucacgaugaagaacaaggccuggaugguucaccgccagugguucuucgaccugcccuugcccuggacuagcggcgccaccacugagacgcccaccuggaaccggaaggaguuacuggugacguucaagaacgcccacgcaaagaaacaggagguagugguccuggggucccaggagggcgcaaugcacacugccuuaacaggggccaccgagauccagaacagcggcgggaccucuaucuucgcaggccaccuaaagugccggcugaagauggacaagcucgagcuuaagggcaugucuuacgccaugugcaccaacacguuuguacuaaagaaggagguguccgaaacccagcacgggaccauccucaucaagguggaguauaaaggcgaagacgucccgugcaagauccccuucagcaccgaagaugggcagggcaaggcgcauaacggacgcuugaucacggccaaccccguggugaccaagaaggaggaacccguuaacaucgaggcagagccgccauucggggaaaguaauaucgugaucggaaucggcgacaacgcucugaaaaucaacugguacaagaagggcuccagcauagggaagauguuugaagcgaccgcccgaggcgcccgccggauggcaauacugggcgacaccgccugggacuucggguccguaggagggguccucaauagccugggcaaaaugguucaccagauauucggguccgcauacacggcacucuucagcggcguguccugggugaugaagaucgguauuggggugcuccucaccuggaucggccuuaauagcaagaauaccucuaugagcuucucuugcaucgcgaucgggaucauuaccuuauaccugggggccgugguccaggcugacaugggcugcgugaucaauuggaagggcaaagaguugaagugcggcaguggaaucuucgugacgaacgaaguacacacguggaccgagcaguauaaguuccaggcggacagccccaaacgccucgccaccgcaaucgccggcgccugggagaacgggguguguggaauccgcagcacaacccggauggagaaccugcuauggaagcagaucgcgaacgagcucaauuacauccugugggagaacaauaucaagcugacuguggucgucggggacaucaucggcgugcucgaacagggcaagcguacccucacaccccagccgauggagcugaaguacuccuggaaaacauggggcaaggccaagaucgucaccgcugaaacacagaacagcucuuuuaucaucgacgggcccaacacgcccgagugccccagcgcauccagagcguggaacgugugggagguggaagacuauggcuucggcgucuucaccacgaacaucuggcucaaacuccgcgaggucuacacgcaauuaugcgaccaccgucucaugagcgccgccgugaaggacgagcgugccguccacgccgacaugggauacuggauagaaucgcagaagaacggcucauggaagcuggagaaggcaagucugauugagguuaagacuugcacguggccgaaaucccacacccucuggagcaacggcgugcuggaguccgacaugauaauucccaagagccucgcgggccccauaucccagcacaacuaccggccgggcuaccacacgcagaccgccgggcccuggcaccucggaaaguuggagcuggacuuuaacuauugcgagggaacgacgguugugaucaccgagaacugcgguacccggggccccagccuccggacuaccaccguguccgggaaacugauccaugaguggugcugccggagcugcacgcugccgccacuccgauacaugggcgaagacggaugcugguaugguauggaaauacgccccauuuccgagaaggaggaaaacauggucaagagccuaguguccgccggcucgggggagguggacaacuucacgaugggcguccugugccucgcuauccucuucgaagaggugaugagagggaaguucggcaagaagcacaugauagcggggguguucuucaccuucguccugcuccuguccggucagaucaccuggcgcgacauggcccacacucugauaaugaucggaucaaacgccuccgacagaaugggcaugggcgugacguaccucgccuugaucgccacguucaagauccagccuuuccucgcgcucggguucuuccugcgcaaguuaaccagccgggagaaucuccugcugggcgugggccucgccauggccaccacgcugcagcugcccgaggauaucgagcagauggccaacgggaucgcgcuagggcugauggcccugaaacucaucacccaguuugagaccuaccaacuguggaccgcccugauaagccucacgugcuccaacaccaucuucaccuugaccgucgccuggcgcaccgccaccuugauccucgcgggagugagccuccugccggucugucaguccagcuccaugcggaagacggacuggcuccccaugacgguggccgccaugggcgugccgccccucccccuguucaucuucagccucaaggacacgcuaaagagacgcuccuggccccuaaacgaaggggucauggccgugggucucguuagcauacuagccuccucgcugcuccgaaacgacguucccauggcgggcccccucguggcagggggacuucucaucgccugcuaugugaucaccgggaccuccgccgaccucacuguugagaaagccgcagacgugacuugggaggaggaggccgaacaaaccggagugagccacaaucuaaugaucaccgucgacgacgacgggaccaugcgcaucaaggacgacgaaacggagaacauccucacggugcuguuaaagacggcccuccugauuguguccgggaucuucccguacagcauucccgcaacccugcucguauggcauacuuggcagaagcagacgcagcgguccggcguguugugggacgugccaagcccgcccgagacccagaaggcagagcuggaagagggcgucuaccgcaucaaacagcagggcaucuucgggaaaacccaggugggcguggggguccagaaggagggcguguuccacaccauguggcacgugacgcggggagcggugcucaccuacaacgggaagcgccuagaacccaacugggcuucagugaagaaagaccugaucagcuacggagggggauggcggcuuuccgcccaguggcagaagggggaagaggugcaagugauugccguagagccaggcaagaaccccaaaaacuuccaaaccaugcccggcaccuuccagacuaccaccggggagaucggggcgaucgcacuggacuucaagcccgggaccucuggcagccccaucaucaauagagaggguaagguggucgggcuguacggcaacggagucguaacgaagaauggcggcuacguguccggcaucgcccagaccaacgccgagccggauggcccuacccccgagcuggaggaggagauguuuaagaagcggaaccucaccaucauggaccuccaccccggcagcggcaagacgagaaaauaccugccggcgaucgugcgggaggcuauuaagcgccggcuccgcacccugauccuggcccccacccggguggucgcagccgaaauggaggaggcccuuaaggggcugcccauccgauaucaaaccacggcgaccaaaucagagcacaccggccgggagaucguggaccugaugugccacgccaccuucacgaugcgccugcucagccccgugcgggucccgaacuacaaccugauaaucauggacgaggcccacuucacugaccccgcuuccaucgccgcccggggguacaucagcacccggguuggcaugggcgaggccgccgccaucuucaugaccgcgacuccucccgggacugcagacgccuucccgcagucgaaugcucccauccaggacgaggagcgcgacaucccagagcgcagcuggaacaguggcaacgaguggaucaccgacuuugccgggaagaccgugugguuugucccuagcaucaaggcgggcaaugacaucgcaaacugccuccggaagaacgguaagaaggugauacagcugucccgcaagaccuuugacacggaguaucagaaaacgaaacuuaaugacugggauuucgugguaaccaccgacauaagcgaaaugggggcuaauuucaaggcugaccgcgugaucgauccgcgccguugccugaagcccgugauccugaccgacggcccggaacgcgucauuuuggccggucccaugcccgugaccgcggccuccgccgcccagcggcgaggccggguagggcgcaacccacaaaaggagaacgaccaguacauauucaccgggcagccccugaacaacgacgaggaccacgcccacuggaccgaagcgaagaugcugcuggacaacauuaacacgcccgaggggaucaucccggcacucuucgaacccgagcgagaaaaguccgccgcuaucgacggcgaauacagacugaagggcgaaucccggaagacauuugucgaacucaugcgccgcggggaccuccccgucuggcuggcgcacaaggucgccagcgagggcauuaaauacaccgaccgcaaaugguguuuugacgggcagcggaacaaccagauccuggaggagaacauggauguggagauauggaccaaagagggggagaagaagaaacuucgcccccggugguuagacgcccgcacguauuccgacccacuggcacucaaagaguucaaagacuucgccgcgggccgaaagagcaucgcccuggaccuagugaccgagaucgggcggguucccucacaccucgcgcaccggacccggaacgcccuugacaaccuggugauguugcauacgagcgagcacgggggcaaagcguacagacacgcgguggaggaguugcccgagacgauggagacacuacuucugcugggccucaugauccugcugaccgggggcgccaugcuguuccugaucucugguaagggaaucgguaagaccuccauugggcuaaucugcguaaucgccagcuccgguaugcucuggauggccgagaucccacugcaguggauugccagcgcuaucgugcuugaguucuuuaugaugguguuacugauccccgagcccgaaaagcagcggacgccccaggacaaccagcuggccuacguugugaucggaauccucacccuagccgccauuaucgccgccaacgagaugggccuacuggagaccaccaaacgggacuugggcauguccaaggagccggggguggucagccccaucuccuaccuggacguggaccuccaccccgccucugcauggacguuauacgccguagcgacgacagucaucacccccaugcuucgacacacgaucgagaacuccaccgccaaugugucgcucgcggcgaucgccaaccaggccgugguucuuaugggccuggauaaaggguggccgauuucgaagauggaccucggugugccccugcuugcauuggggugcuacagccagguuaaccccuuaacccugaccgccgccguccuccuccugaucacgcacuaugccaucauuggcccuggccuccaggcuaaggccacgcgcgaggcccagaagcggaccgccgcuggcaucaugaagaacccgaccguugacggcauuaugacaauagaccuggaccccgugaucuacgacuccaaguucgagaagcagcuggggcaggucaugcuacugguacugugcgcggugcagcuccugcugaugcgcaccagcugggcccucugugaggcccugacccuggccaccgggcccauuacaacgcucugggaaggcucccccgggaaauuuuggaacaccaccaucgcuguaagcauggccaacaucuuccgaggcagcuaccuggccggggccggacuggcauucucaauuaugaaguccguggggacggguaagcgaggcacggggagccaaggggagacccuaggggagaaguggaagaagaaacugaaccagcuuagucggaaagaauuugacuuguauaagaaguccggcaucaccgagguggaccgcaccgaagcgaaggaggggcugaagagaggggaaaucacgcaccaugccguaagccgcggcuccgccaaacugcaaugguuuguggaacggaacauggugaucccggaggggcgcgugauagacuuaggcugugggcggggcgguuggaguuauuacugcgccggacugaagaaggugaccgaggugaggggauauaccaagggcgggccagggcacgaggagccugucccaauguccaccuacggcuggaacauugugaagcucaugucagggaaggacguguucuaccuaccgccagagaaaugcgacacucugcugugugacauaggcgagaguucucccucccccaccguugaggagagccgcaccauccgcguucugaagaugguggagccguggcucaagaacaaccaguuuugcauaaaaguccucaaccccuacaugcccaccgugaucgaacaccuggagcgccuccagagaaagcacggcggcaugcugguacgcaaccccuuguccaggaauagcacacacgagauguacuggauuagcaauggaaccggcaacaucgucgcaagcgugaacauggugucccgccuucugcugaaccguuucaccaugacacaucgccggcccacuauagagaaggauguggaucuuggcgcaggcacgaggcacgugaacgccgagccugagaccccaaauauggacgugaucggggaacggauaaagaggaucaaagaggagcacaacagcaccuggcacuacgacgaugagaaccccuauaagacgugggcauaccacggauccuacgaagucaaggcuaccggguccgccucuagcaugaucaacggcguggucaaacuucugaccaagcccugggacguggugccaauggucacccagauggccaugaccgacaccacccccuucgggcagcagcggguauuuaaggaaaagguggacacacgcacaccgcggagcaugcccggcacccgccgcgucaugggcaucaccgccgaguggcucuggcgcaccuuggggcggaacaagaagccgcgccugugcacgcgggaggaguucaccaaaaaggugcgcaccaacgccgcgaugggcgcgguguucacagaagagaaccagugggacuccgccaaagccgccgucgaggacgaggacuucuggaagcucguggaccgggagcgggagcuacauaagcucgggaagugcggcagcugcguuuacaacaugauggggaagcgcgagaagaagcuaggcgaguucggcaaggccaagggguccagggcgaucugguacauguggcugggcgcccgcuaccucgaguuugaggcccucggguuccuaaacgaggaccacugguuuagccgcgaaaauuccuacagcggagucgagggggagggcuuacacaaacucggcuacauacugcgggacaucuccaagauccccggaggcgcuauguacgccgacgacacggcggggugggacacccggaucacggaggaugaucugcauaacgaggagaagaucacccagcagauggacccggagcaccgucaguuagccaaugccaucuucaagcugaccuaccagaacaagguggugaagguccagcggcccaccccgacuggcaccgugauggacaucaucagccgaaaggaccagagaggcuccggccaggugggcacuuacgguuugaacacguucacuaacauggaggcucagcucauacgccagauggagggggaggggguucucagcaaagccgaccuggaaaacccucacuuacccgagaagaagaucacgcaguggcuggagaccaaagggguggagcgucugaagcgcauggcgaucucaggagacgacugcgucgucaaacccaucgaugaccgauucgccaacgcccuccuggcccugaacgacauggggaaggugcgcaaggacaucccccaguggcagcccucgaagggcuggcacgacuggcaacaggucccguucuguucgcaccacuuccacgagcugaucaugaaggacgggcggaagcuggucgugcccugccgcccccaggacgaacugauaggccgggcccgcaucucccagggugcuggcuggucccuccgggagacagcuugccuugggaaggcguaugcccagauguggagucugauguacuuccaccgccgggacuuacggcucgcguccaacgcuauuuguagcgccgugccgguccauuggguuccaacaucccgcaccaccuggaguauccacgcccaccaccaguggaugacgaccgaggauaugcugaccguguggaaccgugucuggauagaggacaacccauggauggaagacaagacuccugucacgaccugggagaaugugcccuacuuaggcaagcgcgaagaucaguggugcggcucgcuaaucgggcugaccucccgugcuaccugggcgcaaaauauuccgacggccauccagcagguccgcagccuaaucggcaaugaagaguuccuggacuacaugcccuccaugaagcgguuuagaaaggaggaggagagcgagggcgccaucugguga

SEQ ID NO: 26036 - RNA, 9873 nt, Artificial Sequence
  derived and/or modified CDS sequence (opt11) from DENV-3__FJ639768__SS-prME
accucccugugccugaugaugauccugcccgccgcccuggcauuccaucucaccagccgggacggggaaccucggaugauuguagggaagaacgagcggggcaaguccuuacuguucaagacggccagcgguauaaacauguguacccucaucgccauggaccugggggagaugugcgacgacaccgugaccuauaagugcccccacauaacggagguggaacccgaggacaucgauugcuggugcaaccugaccagcacguggguaaccuacgggacguguaaccaggccggcgagcaccggcgcgauaagcgguccguagcccucgcgccccacgucgggauggggcuggauacccgcacccagaccuggaugagcgcagagggcgccuggcgacagguggagaaaguggaaacaugggcccugcggcacccgggguucaccauccucgcccuguuccuugcccauuacaucggcaccucgcucacccagaagguggugaucuuuaucuugcugaugcucgucacgcccagcaugaccaugcggugcgugggggucggcaaccgcgacuucgucgaaggcuuguccggcgccaccuggguggacguggugcuggagcacggaggcugcgugaccaccauggcuaagaacaagccgacccucgacaucgagcugcagaaaaccgaggccacgcagcuggcgacgcuccgcaagcugugcauagagggcaagaucaccaauaucaccaccgacagccggugcccuacgcagggcgaggcuguacugccggaggagcaggaccagaacuacgucugcaagcacaccuacguggaucggggcuggggcaacggcugcggccucuucgggaagggcuccuuagugacuugugccaaguuccagugccuggagccgaucgaggggaaggucgugcaguacgagaaccucaaguacaccgugauaauuacgguccacacgggggaccaacaccagguuggcaacgagacccagggggucacagccgagauuacuccccaggccucuaccaccgaggcgauccugcccgaguacggcacccuggggcuugagugcucuccgcgcaccggccuggacuuuaacgagaugauccugcuaacgaugaagaacaaggccuggauggugcaccggcagugguucuucgaccugccucugcccuggaccagcggugccaccaccgagacgcccacguggaaccguaaggagcuccuggugacauucaaaaacgcccaugccaagaagcaggaggucgugguucucgggucccaagagggcgcgaugcacaccgcccucacgggggcgaccgagauccaaaauucgggcggcaccuccaucuucgccggccaccugaaaugccggcugaaaauggacaagcucgagcugaagggcaugagcuacgccauguguaccaauacguucguccugaagaaggagguuuccgagacccagcacgggaccauccucaucaaaguggaguauaagggcgaggacgucccaugcaagauccccuucagcacggaggacggacagggcaaagcccacaacggacgccugaucacagcuaaccccguggugacaaagaaggaggagcccgucaacaucgaggcggagccgcccuucggagagagcaacaucgugaucggcaucggggacaacgcccugaagaucaacugguauaagaagggcucuagcaucggcaagauguucgaggcgaccgccagaggcgcccgccggauggccauccugggcgacaccgccugggacuucggguccguuggagggguccuuaauucccugggcaagauggugcaccagauauucggcuccgcguacacugcccuguucucuggcguguccugggucaugaaaauaggcaucggagugcuccuuacuuggaucgggcugaacuccaagaacaccuccaugagcuucaguugcaucgccaucgggaucaucaccuuauaccugggcgccgugguccaggccgacauggggugcguaaucaacuggaagggaaaggagcucaagugcggcagcgguaucuucguuacgaaugaaguccauaccuggaccgagcaauacaaguuccaggcggacuccccgaagcgccucgccaccgccaucgccggcgccugggagaauggagugugcggaauccgcagcacgacccggauggagaaccugcuuuggaagcagaucgcgaacgaacucaacuauauacugugggagaacaacaucaagcugacgguagucgugggggauaucauagguguacuugagcaaggcaagcgcacccugacgccccagccgauggagcucaaguacuccuggaagacgugggggaaggccaagaucgucaccgccgagacccagaacagcuccuuuaucaucgauggccccaacacgcccgagugccccagcgccucccgggcguggaacgugugggagguggaagacuacggauuuggcgucuucaccaccaacaucuggcugaaguuacgcgagguguacacacagcugugugaccaccggcuaaugagcgccgccgucaaagacgagcgugccguccacgccgacaugggcuacuggaucgagucccagaagaacggguccuggaaguuagagaaggcgagcuugaucgaagugaagaccuguacguggccgaagucccacacccucuggucaaacggagugcuggaguccgacaugaucaucccuaaaucacuggccgguccgaucucccagcacaacuaccggccgggcuaccacacccagaccgccgggccguggcaccucggcaagcuggaguuagacuuuaacuauugcgagggcacuacggucgugaucaccgagaacugcgggacucgcggccccagccuccggacgaccaccguguccgggaaacuuauccacgagugguguugucgcagcugcacccugcccccguuacgguacaugggcgaggacgggugcugguauggcauggaaauacgcccuaucuccgagaaggaagagaacauggucaagagccugguuuccgccgggucaggugagguggacaauuucacuaugggcguucucugccucgccauccuguucgaggaagugaugcgggggaaguucggcaagaagcauaugaucgccgggguguucuucaccuucguccuguuacuaaguggccagaucaccuggcgcgauauggcccacacgcugauuaugaucggcagcaacgcuucagaucgcauggggaugggugugacguaccucgcuuugaucgccaccuucaagauccagcccuuccuggcacucggguuuuuccugcgcaagcugacuagccgggagaaccugcugcugggcgugggccucgccauggccaccacgcugcagcugcccgaggacauagagcagauggccaacgguaucgcuuugggccugauggcccugaagcucaucacgcaguucgagaccuaccagcuguggaccgcccugauaagccucacaugcuccaacaccauauuuacucuuaccgucgccuggcgcacggccaccuugauauuggccggggugagccuguugccggucugucaguccagcuccaugcggaaaacagacuggcuccccaugaccguggcagcaaugggcguaccgccccuuccacuguucaucuucagccucaaggacacgcugaagaggcgcuccuggccccugaacgagggggucauggccgucgggcucgugagcauccuggccagcagcuuacuucggaacgaugucccgauggcgggcccccugguugccgggggccugcucauugccugcuacguuaucaccgggacgagcgcugaccugaccguagagaaggcugcggacgucacgugggaggaggaggccgagcagaccggcgugucacacaaccugaugaucaccgucgacgacgacgggacuaugcgcaucaaggacgacgagaccgagaacauucucacagugcugcugaagaccgcccuacugauugugucaggcaucuucccguacucaauacccgccacccuguuggucuggcacaccuggcagaagcagacccagcggucaggcgugcuaugggacgugcccaguccacccgagacccaaaaggccgaguuggaagaggguguguaccguauuaaacagcagggcaucuucgggaagacccaggugggcguggggguucagaaagaggggguguuccacaccauguggcacgugacgagaggggcggugcucaccuacaacgggaagcgccuggaacccaacugggccuccgucaagaaggaccugauaagcuacggcggugguuggcgguuaaaugcccaauggcagaagggggaggagguucaggucaucgccguugaacccggcaagaacccgaagaacuuccagaccaugcccggcacauuccagacgaccaccggggagaucggcgcgaucgcccuggacuucaagcccgggaccuccggcagccccauaaucaaucgcgagggcaaaguggucgggcucuacggcaauggcguggugacgaagaacggcgguuacguuagcggcaucgcgcagacaaacgccgagccggacggccccacucccgaauuagaggaggagauguuuaagaaacggaaucuuaccaucauggaccugcaccccggguccggcaagacgcgcaaguaccugccggcaaucgugagagaggcgaucaaacgccggcuccgcacccugaucuuagcccccacccggguggucgcugccgaaauggaggaggcacucaaggggcuucccauccgcuaccagaccacggcaacaaagagcgagcacacuggccgggagauuguggaccugaugugccacgccacguucacaaugcgccuccuaucccccguucgggugccgaacuauaaccugaucaucauggacgaggcccacuuuaccgacccagccucaaucgccgcgagaggguacaucucaacgcgggugggcaugggugaggccgccgccaucuucaugaccgcgacgccgcccgguaccgcagacgccuucccgcagagcaacgcaccuauccaggacgaggagagagacauccccgagcgguccuggaacagcggaaacgaguggaucaccgacuucgcggggaagaccgugugguucguuccguccaucaaggcgggcaaugacaucgccaacugccuucggaagaacgggaaaaaggugauucagcugucccgcaaaacguucgacacggaguaccagaaaaccaaacugaacgacugggacuucgucgucacaacggacauauccgagaugggcgcgaacuucaaggcagaccgagugaucgacccgcgccggugccucaagcccgugauccugaccgacggcccagagcggguuauucuagcggggcccaucccggugaccgcggccagcgcggcccaacggcgcggcagaguggggcggaacccccagaaggagaacgaccaguacaucuucacaggccagccccucaacaacgaugaggaccacgcacacuggacagaggcuaagaugcuucuggauaacauuaacacgcccgaggggaucauccccgcccucuuugagcccgaacgcgagaaguccgccgccauagacggcgaguacaggcugaagggcgagagucguaagaccuucgucgagcugaugcgccgcggggacuugcccguguggcuggcacacaaggucgccuccgagggcaucaaauacaccgaccgcaaguggugcuucgacgggcagcggaacaaucagauccuggaggagaacauggauguugagaucuggaccaaagagggagagaagaagaaacuccggccccgguggcuggacgcccggacguacagcgacccgcuggcccucaaggaguucaaggacuucgccgccggccgcaaguccaucgcccuggaccuggugacugagauuggucgggucccuagccaccucgcccacagaacccggaacgccuuagacaaccuggugaugcuccacaccuccgagcauggugggaaggcuuaccgccacgcaguagaggagcugcccgagacgauggagacccugcuacugcugggccucaugauauugcugaccgggggugccauguuguuccugaucagcggcaaggggaucggcaagaccagcaucgggcugaucugcgucaucgccaguagcggcaugcucuggauggccgagaucccauugcaauggaucgccuccgcgaucgugcuggaguucuucaugauggugcucuuaaucccugagccggagaagcaaagaacgccccaggacaaccagcuggccuacguagugaucgggauccucacauuggccgccaucaucgccgcgaacgagaugggccugcucgagacaaccaagcgcgaccugggcaugagcaaggaaccagggguggucucccccaccagcuaccuggacguggaccuccaucccgccuccgccuggacccuguacgccguggccaccaccgucauuacgccaaugcugcggcacacuauugaaaacagcaccgccaacgugucccuggccgccauagcuaaccaagcgguuguccuuaugggccuggacaagggguggccuaucagcaagauggaccucggcgugccccugcuggcccucggguguuacucacaggugaacccccugacgcugacggcggcaguccuccuacugaucacccacuacgccaucaucggccccgggcuucaggcgaaggccacccgcgaggcccagaagcggaccgccgccgggaucaugaagaacccgacgguugacggcaucaugaccauugaccuggaccccgugaucuacgauagcaaauucgagaagcagcugggccaaguuaugcuccuggugcugugcgcggugcaacuccugcugaugcgcaccuccugggcccucugcgaggcccucacccuggccaccggccccaucaccacacucugggagggcagccccggcaaguucuggaacaccacgaucgcggucuccauggccaacaucuuccgggggagcuacauagccggggccggccuggcguucagcaucaugaaaagcguagggaccggcaagcgcggcaccgggucacagggugagacccugggagagaaguggaagaagaagcucaaucagcugagccggaaggaguuugaccuuuacaagaagucaggcaucaccgagguugaccgcaccgaggcgaaagaggggcucaagcggggagaaaucacacaccacgccgucucccgcgguagcgccaagcugcagugguuuguggaacggaacauggugaucccggaggggcgcgugaucgacuuggguugcgggagaggaggguggagcuacuacugcgccggccucaagaagguuaccgagguccgaggcuauaccaagggcgggcccgggcacgaagaacccguccccaugucuacguacggcuggaacauagugaagcugauguccgggaaagacguguucuaccucccgcccgaaaagugugacacccuccugugcgacaucggcgagagcucacccagccccaccguugaggagucccggaccauccgcguacugaagaugguggagccguggcugaagaacaaccaguucuguaucaaggugcucaaccccuacaugcccacuguuauagagcaccuggagcgcuuacaacgaaagcauggcggcaugcucgucaggaaccccuuaagccgcaacagcacccaugagauguacuggaucagcaacggcaccgggaacaucgucgccagcgugaauauggucagccgcuuacuccugaaccgguucaccaugacgcaccgccguccgaccaucgagaaagacgucgaccugggcgcgggcacccgccacgugaacgccgagcccgaaacccccaacauggacgugaucggggagcggaucaagcgcaucaaagaggagcacaacuccacguggcauuacgacgacgagaacccguacaagaccugggccuaccacggcagcuacgaggugaaggcaaccggguccgccucuuccaugauaaaugggguggucaagcuccugacaaaacccugggacguggugcccauggucacucagauggcgaugaccgacaccacgcccuucgggcagcagcggguguucaaggaaaagguggacacgcguaccccgcggagcaugcccggcacccgccggguuaugggcaucacugccgaguggcuguggcguacgcuagggcggaacaaaaagccccgccugugcacccgcgaggaguuuaccaagaaggugcgaaccaacgccgccaugggagcuguguucacggaggagaaccaaugggacucggccaaggcggcgguggaggacgaggacuuuuggaaauugguggaccgcgagcgcgagcuccacaagcucgggaaguguggcucaugugucuacaauaugaugggcaagcgcgaaaagaagcucggcgaguucggcaaggcgaaggggagccgggcgaucugguacauguggcucggcgcccgcuaccuggaguucgaggccuuaggguuccucaacgaagaccacugguucucccgggagaacuccuacuccggcgucgagggggagggccugcacaaacuugguuacauccuucgcgacaucagcaagauccccgggggcgcaauguacgccgacgacaccgcgggaugggacacucggaucaccgaggacgaccugcacaacgaggagaaaaucacgcagcagauggacccggagcaccgccaguuagccaacgccaucuuuaagcucacguaccagaacaagguggugaagguccagcggcccacucccaccggaaccgucauggacauaaucucccgcaaggaccaacgggggagcggccagguagggacguacgggcugaacacguucaccaacauggaggcccagcugauccgccagauggagggcgaagggguccucuccaaggccgaucuggagaauccccaucuccccgagaagaagaucacccaauggcuggagaccaagggcguagagcggcugaagcgcauggcgaucagcggcgacgauugcguggucaagcccaucgacgaucguuucgccaacgccuugcucgcccugaacgacauggggaaggugcgcaaggacaucccacaguggcagcccuccaagggcuggcacgacuggcagcaggucccguucugcucucaccacuuccacgagcugauuaugaaggacggacggaagcucgucgugcccugccgcccgcaggacgagcugaucggcagagcccgcaucucccagggggcgggcuggagccugcgggagaccgccugccucggcaaagcguacgcccagauguggucgcugauguacuuucaccgccgugaccugaggcucgcgagcaacgccaucugcucagccguccccguccacuggguaccgaccucacgcaccacgugguccauacacgcccaccaccaguggaugaccacagaggacaugcugaccguguggaaucgagucuggauagaagacaaccccuggauggaagacaagacuccagugaccaccugggagaacgugcccuaccuggggaaacgcgaggaccaguggugugggagccucaucggucugaccagccgggccacgugggcgcagaauauuccgaccgccauccagcaaguacgaucccugaucggcaaugaagaguuccucgacuacaugcccagcaugaagcgguuucgcaaggaggaagaguccgagggugccaucugguaa

SEQ ID NO: 26037 - RNA, 9873 nt, Artificial Sequence
  derived and/or modified CDS sequence (opt11) from DENV-3__FJ639769__SS-prME
acaagccugugcuuaaugaugauacugcccgccgcccuggccuuccaccucacaagccgggauggcgaaccccggaugaucgucgggaagaacgagcggggcaaaagccuuuuauucaaaacagcaagcgguaucaacaugugcacccucauagccauggaccucggcgagaugugugacgauaccgugacguacaagugcccccauauuacggagguggaaccagaggacauugacugcuggugcaaccugaccagcaccugggugacguacggcacguguaaccaagccggcgagcaccggcgcgacaagcggagcgucgcccucgcgccacacguugggauggggcuggauacccgcacccagacauggaugucugcggagggcgcuuggagacagguugagaaaguggagacgugggcacuaagacacccgggguucacuauccuggcccucuuccucgcccacuacauugggaccucccuuacccagaagguagugaucuucauacuauugaugcuggugacgcccucuaugacuaugcggugcgugggggugggcaaccgcgacuucguagagggacucagcggcgccaccuggguggacgugguccuggagcacggugggugcgugaccaccauggccaagaacaagcccacccucgacaucgaacugcagaagaccgaagcgacucagcuagccacacuucggaaacuguguauagagggcaagaucaccaacauaaccacagacaguagguguccaacgcagggggaggccgugcugccggaggagcaagaucagaauuacgucugcaagcauaccuacguagaccgcgguuggggcaauggaugcggcuuauucgguaagggcucccuggugacuugcgccaaguuccagugcuuagagccgaucgagggcaaggucguccaguacgagaaccucaaguacaccguaaucaucacuguacacaccggggaucagcaccaggucggaaacgagacgcaaggggucaccgcggagauaacgccccaggcauccaccaccgaggcaauccuaccggaguacgggaccuuagggcuagaguguuccccgagaaccggccuggauuucaaugaaaugauacugcuuacaaugaagaacaaggcauggauggugcaccggcagugguucuuugaccuaccccugccauggaccaguggcgccacgacggagacccccaccuggaaccggaaagagcuccuagugaccuucaagaacgcccacgccaaaaagcaggaggucguggugcuggggucgcaagaaggagccaugcacaccgcccucacgggggccacagagauccagaacucaggcggcaccuccaucuuugccggccacuuaaagugcagacugaagauggacaaacuagagcugaagggcaugucguaugcuaugugcaccaacacguucguacugaagaaagaagucagugagacacaacacgggaccauacucaucaagguggaauacaagggugaagaugucccguguaagauccccuuuagcaccgaggacgggcaggguaaggcgcacaauggcaggcugauuacggccaaccccgucguuaccaagaaggaggagccugucaacauugaggcugagccgccuuucggagagucuaacaucgugaucgggaucggugauaacgcucugaagaucaauugguauaagaaaggcuccaguauuggaaaaauguuugaagcgaccgcucggggcgcccgacggauggccauccucggcgacacagccugggacuuugggucgguaggcggaguccuaaacagcuuagguaagauggugcaccagaucuucgguuccgcguacacagcccucuucaguggcguauccuggguaaugaagauugguaucgggguccuccugacguggauuggcuugaacagcaagaacacuuccaugucuuucuccugcaucgccaucggaauaaucacccucuaccuaggugccgugguccaggccgacauggggugcguaaucaacuggaagggaaaggaacuuaagugcggcuccggaaucuucguuacgaacgaggugcauaccuggacugaacaguacaaauuccaggccgacuccccaaagaggcuggccaccgccaucgccggcgccugggaaaacggggugugcggcauccguucaacuacaagaauggagaaucugcucuggaagcagaucgcgaaugagcucaacuacauuuuaugggagaacaacauuaagcugaccguggucgugggggacaucauaggcgugcucgagcagggcaagcggacccugacgccucagccuauggaguugaaguauuccuggaagacuugggggaaagcuaaaaucgucaccgccgagacccaaaacagcuccuucaucauagacggccccaauacuccagagugcccaucagcgucacgggcauggaaugugugggaggucgaggacuacggguucggcguguuuacgaccaacauuuggcucaaacuucgugagguguacacccaacugugcgaccaucgguuaaugucagccgccgugaaagaugagcgcgccguccacgccgacaugggauacuggaucgaaagccagaagaaugggucuuggaagcuggaaaaagcgagccuaauugaagugaagaccugcacguggccgaaaagccacacccuauggagcaacggcguacucgaguccgacaugauaauccccaagaguuuagccggacccauaucccaacauaacuaccgcccaggauaccacacccaaaccgccgggcccuggcaucucggcaagcuggagcucgauuuuaacuacugugaagguacgacgguugugauuaccgagaauugcggaacccgcggccccagucuccggacgaccacggucuccgggaaacugauccacgaauggugcugccgaagcugcacccugcccccguuaagguacaugggcgaggacgggugcugguacggcauggagauccgccccaucuccgagaaggaagaaaacauggucaaaagccugguauccgcaggcucgggggagguugacaacuucaccauggguguacugugccucgccaucuuauucgaggaagucaugcgggggaaguuuggcaaaaagcacaugaucgcgggaguauucuuuaccuucguacugcugcucucugggcagaucaccuggagagacauggcccauacacugauaaugauuggcucaaaugccagcgaucgcauggggauggguguuacguaccuggccuugaucgccacguuuaagauccagcccuuccuggcauuggguuucuuccuaagaaagcugacgagccgugagaaccucuugcugggcgugggccucgccauggccaccacgcuucagcuccccgaggacaucgagcagauggccaacgggauagcgcucggccugauggcgcugaaacucauuacccaauucgagaccuaucagcuguggacagcccucaucagcuuaacaugcagcaauacaauuuuuacucugacagucgccuggcgcacggcuacgcugauccucgcggggguuagccugcuaccagugugccaauccagcucaaugcggaaaaccgacuggcucccgaugacgguggccgccaugggcguaccucccuugccauuguucauuuuuagcuugaaggacacgcucaaacgucgcagcuggccacugaacgaaggcguuauggcugugggauuagugaguauucuggcauccucccugcucagaaacgacgucccaauggcgggcccauuaguugccgggggacugcucaucgccugcuaugucaucacugggaccucggccgaccugaccgucgagaaggccgcagacgugacgugggaggaggaggcagagcagaccggcgugucacauaaccucaugaucacagucgaugaugauggcaccaugcgcauaaaggacgacgagacggaaaacauccucacgguccuccugaagaccgcccuucugaucguaucgggaaucuucccguacucaauccccgcgaccuugcucgucuggcacacguggcagaagcaaacgcagcggagcggggugcugugggacgugcccucaccacccgagacccagaaggccgaguuagaggagggggucuacaggauuaagcagcagggcaucuucggcaagacgcagguaggagucgggguccagaaggaaggcguguuccacaccauguggcacgugacucgcggcgccguuuuaaccuacaacggaaagcgacuggaacccaacugggccucugucaagaaggaccugauuaguuacggcggaggguggcgccucagcgcccaguggcaaaagggggaggagguccagguaaucgcaguggagcccggcaagaaucccaaaaacuuucagaccaugcccggcaccuuccaaacuaccacaggggagaucggagcaaucgcccucgacuucaagcccgguacuucuggcagccccaucauaaaccgugagggcaaggugguuggucuguacggcaacgggguggugaccaagaauggaggguacguauccggcauugcccagacuaacgcagaaccagaugggcccacgcccgagcuggaggaggagauguucaagaagcgcaacuugaccaucauggaccugcaccccggaagcggcaagacccggaaguaucugccggccauagugcgagaggccaucaagaggcgacucaggacccuaauccuggccccuacucgcguuguagccgcugagauggaagaggcccuaaagggcuugccgauccgauaccaaacaaccgcgaccaaauccgagcacaccggccgggagaucgucgaccugaugugccacgccaccuuuacgaugcgccuccugagccccguacgggucccgaacuauaaccuaaucauaauggaugaggcgcacuuuaccgacccagcuuccauugcugcgcgcggguacaucagcacccgaguuggaaugggcgaggcagcagcuaucuucaugacagcaacgccuccugggaccgcugaugcuuucccacagucuaacgcccccauucaggacgaggaaagagacaucccagagcgcagcuggaacucugggaacgaauggauaaccgacuucgccgggaagaccgugugguuuguucccucgaucaaagcaggcaacgacaucgccaacugccuacgcaaaaacgggaagaaggugauccaguuauccagaaagacguucgacaccgaguaucagaaaacuaagcugaaugacugggacuuuguagucacuacggacauuagcgagaugggggcuaauuucaaggccgaccgggugaucgacccgcgacgaugccucaagcccgugauucugaccgauggcccagaacguguuauccuugcaggccccaugcccgucaccgcugcguccgcggcccagcgcagggggcggguggggcgaaacccucagaaggagaacgaccaguacauuuucaccggccagccccucaacaaugacgaagaucaugcccacuggaccgaagcaaagaugcuucuggacaacaucaacacacccgaggggauaauacccgcccuuuucgagcccgagagagagaagucugcugccauugacggggaauaccgccucaagggcgaaucccggaagaccuucguggagcuuaugcgccgcggggaucuccccguguggcuggcgcauaaaguugccagcgagggcaucaaguacaccgaccgcaaguggugcuuugacgggcagagaaacaaccagauucuggaagagaacauggacguagagaucuggaccaaggagggugagaagaagaaacuccgcccccgguggcuggacgcgcgaacguacuccgacccgcuggccuugaaggaguucaaggacuucgccgccggcaggaagucaaucgcgcuggaccuggucaccgagauuggucgggucccuacacaccuggcccaccgcacccggaaugccuuggacaaccugguuaugcugcauacaucggagcacggcgguaaggccuaccgccaugcgguggaggagcuaccggagaccauggaaacccugcuccugcuaggccucaugauacugcugaccgggggcgcaaugcuguuccugaucuccggcaaggggaucggcaagacgagcaucgggcuaauuugcguuaucgccuccagcgguaugcucuggauggccgagauuccgcugcaauggaucgcauccgcgaucgugcuggaguucuucaugauggugcuccugaucccugagccggaaaaacaacggacaccccaggacaaccagcuugcguacgucgucauagggauacugacccuggcugccaucaucgccgcgaaugagauggggcugcuagaaacgacgaagagggaccuagggaugaguaaagagccggguguggucagccccaccagcuaccuggacguggacuugcaccccgccuccgccuggacccuuuacgcuguggcaaccacuguaaucacucccaugcuacgccacacaaucgagaacuccacagccaaugugucacuugccgcaaucgcgaaccaggcggugguccugaugggccuagauaagggauggccaaucucaaagauggaccucggggugccgcuguuagcgcucggauguuacucccaggugaauccgcugacgcucacggcagccguguugcugcucaucacccacuacgccaucaucggcccaggacugcaggcaaaagccacgcgugaagcccaaaaacggacggccgcggggaucaugaaaaauccgaccgucgacggcaucaugacaaucgaucuggaucccgugauuuacgacucuaaguucgagaagcagcugggccagguuaugcuccuggugcuguguguaguccagcuccugcugaugcgcaccuccugggcucugugcgaagcgcuaacgcuugcgacgggccccaucacaacccucugggagggaucaccggguaaauucuggaacacgaccauagccgugucuauggcgaacauuuuucguggcucguaccuggccggggccggacuggccuuuaguaucaugaagucggucgggaccggcaagcgcggcaccgggucucagggcgagacccucggggagaaguggaaaaagaaacugaaccagcuuagccggaaggaguuugaccuguacaagaaguccggcauuacggagguagauaggaccgaagccaaggaaggucugaagcggggcgagaucacgcaccacgcaguaucccgcgguucggccaaacugcagugguuuguggagcggaacauggugaucccggaggggcgcgucaucgacuuagguugcggccggggagggugguccuacuacugugcggggcugaaaaagguaaccgaggugcgcggcuacacuaaaggagggcccggucaugaggagcccgugcccauguccaccuacggcuggaauaucgucaaguugauguccggcaaggacgucuuuuaccuuccucccgagaagugcgacacccugcugugcgacaucggcgagucuucgccuagccccaccguugaggaaucccggacgauccgcgugcugaaaauggucgagccauggcuuaaaaacaaccaguucuguaucaagguucuaaaccccuacaugccaaccguaaucgagcaccuagagcgacuucagcggaagcacggagggauguugguccgcaaucccuugagccguaauucuacccaugagauguauuggauuagcaauggcaccgggaacaucguggcuuccguuaauauggucagccggcuccugcuaaaucgcuuuacgaugacucaccgacggccuaccaucgagaaggacgucgaccucggcgccggaacccgccauguaaacgcagaacccgagacgccuaauauggacguaaucggggaaaggaucaagagaauaaaggaagaacauaacucaacuuggcacuacgacgacgagaauccauacaagacgugggcguaccacggguccuacgaggucaaggcaaccgguagugcaagcagcaugauuaacggcguagucaagcugcugacgaaacccugggacguagucccaauggucacacagauggccaugaccgacaccacgccauucgggcaacagagagucuuuaaagagaaggucgauacccgcaccccucggagcaugcccgguacccgccggguuaugggcauuacggcggaauggcuauggcgcacucuugggcggaauaagaaaccaaggcuuuguacgcgggaggaguuuaccaaaaagguccgcacgaacgccgccaugggagcggucuucaccgaagagaaccagugggacagcgcaaaggcggcuguggaggacgaggauuucuggaagcucguugaucgcgaaagggagcugcacaagcugggcaagugcggcuccugcgucuauaacaugauggggaaaagggagaagaagcucggcgaguucggcaaggccaaggggagccgggccaucugguacauguggcugggcgcgcgauaucuagaguucgaggcccugggguuccucaacgaggaucacugguuuucacgggagaacagcuacuccggcguugagggggagggauugcauaaguugggcuauauccugcgcgacauuagcaagauucccggcggagccauguaugccgacgacacagccgggugggacacaagaaucacagaagacgaccugcacaacgaggagaagauuacgcagcagauggacccagagcacagacaacuugcuaacgccaucuucaagcucaccuaccagaacaaggugguaaagguucagcggcccacccccacugguacugugauggacauuaucucccggaaggaccaacguggcagcggucaagucgguacauauggacuaaacaccuucaccaacauggaggcccaacugauucgccagauggagggggagggagugcugagcaaggcggaucuggaaaacccccaccuuccggagaagaaaauaacucagugguuagagaccaagggugucgagcggcugaagaggauggcuaucaguggcgacgauugcgucgugaaaccuauagaugaccgcuuugcgaacgcccuccucgcccugaacgauauggguaaaguacgcaaggacauuccacaguggcagcccuccaagggcuggcacgauuggcagcagguaccguuuuguagccaucacuuccacgagcucaucaugaaagacgggcggaaguugguugugcccugucggccccaggacgagcugaucgggcgggcccgcauuucccagggggcgggcuggagccuacgggaaacggcuugucugggcaaggcuuacgcccaaauguggucccugauguacuuccaccggcgcgaccuccggcuggccucgaacgcgauauguagugccguccccguacacuggguaccgacaagccguaccacuugguccauccaugcccaccaccaguggaugacuaccgaggauaugcugaccgucuggaaccggguguggaucgaagauaacccuuggauggaggacaagacccccgugaccaccugggagaacguccccuacuuggggaagcgcgaggaccaguggugcggaagccuaaucggauugacuagccgugccaccugggcccagaacaucccgaccgcgauccagcaagugcguucgcucaucggcaaugaggaauuucuggacuacaugcccagcaugaagcgcuuccgcaaggaagaggaguccgagggggcgauaugguga

SEQ ID NO: 26038 - RNA, 9873 nt, Artificial Sequence
  derived and/or modified CDS sequence (opt11) from DENV-3__FJ882577__SS-prME
acgucacugugccucaugaugauccugcccgccgcccuggcuuuccaccuaaccagccgggauggagagccccggaugaucguggggaagaacgagcgggguaagagccugcuguucaagacugccagcgggaucaauaugugcacccucauugccauggaccucggagagaugugcgacgacaccgugaccuacaagugcccccacaucacggagguggagcccgaggacaucgacugcuggugcaaucugaccagcaccuggguuaccuacgggacgugcaaccaggcuggcgagcaccggcgcgacaagcggagcguggcccucgcgccccacgugggcauggggcuugacacccgcacccagaccuggaugagcgccgagggcgccuggcgccagguggagaaggucgagacgugggcgcuccgucacccgggauucaccauccucgcgcuguuccuggcacacuacaucggcaccucccucacccagaaggucgugaucuucauuuugcugaugcucgucacgcccagcaugacuaugcggugcgugggggugggcaaucgcgacuucgucgagggucuaucgggggcuaccuggguggacgugguccucgagcacggugggugcguaaccacgauggcaaagaacaaaccaacccuagacaucgagcugcagaagaccgaggccacucagcuggcuacccuucggaagcugugcauagagggcaagaucaccaacaucaccaccgacagucgcugucccacgcagggugaggccgugcugccggaggagcaggaucagaacuacgucugcaaacacaccuacguggaccggggguggggcaacggcugcggcuuauuugggaagggcucccuggugaccugcgccaaguuccagugccuggagcccaucgagggcaagguuguccaguacgagaaccucaaguacacagugaucaucacgguccacaccggggaucagcaccaaguaggcaaugagacgcagggggucaccgccgagaucacgccccaggccagcaccaccgaggcgaucuuacccgaguacgggacccugggacucgagugcuccccccgcaccgggcuggacuucaacgagaugauccugcugacgaugaagaacaaggccuggaugguccaccggcagugguuuuucgaccugccucugcccuggaccagcggcgcuaccaccgagacgcccaccuggaaccgcaaggagcuccuggugaccuucaagaacgcccaugccaagaagcaggaggucguggugcucgggucccaggagggcgccaugcacaccgcccucacgggggccaccgagauccagaauaguggcgggaccuccaucuucgccggccaccugaagugucggcugaagauggacaagcucgaacuuaagggcaugucguacgccaugugcaccaacacguucguccuuaagaaggaggugucugagacccagcaugggacaauccucaucaagguagaauauaaaggcgaggacgucccgugcaagauccccuucagcaccgaggacgggcagggcaaggcccacaacggacgcuuaaucacggccaaccccgugguuacgaaaaaggaagagcccgugaauauugaggccgagcccccguucggggaaagcaacaucgugaucgggauaggcgacaacgcccugaagauaaacugguacaagaagggaagcagcaucgggaagauguuugaggcgaccgcccguggugcacgccggauggccauccugggagacaccgccugggacuucggguccguuggagggguccucaacagccugggcaagauggugcaucagauauucgggagcgcguacaccgcccuguucagcggcgugucgugggucaugaagauuggcauagggguccugcuaaccuggaucggccugaacagcaagaacacaucgaugagcuucuccugcauugccaucgggauaaucacccucuacuuaggcgccguuguccaggccgacauggggugcgugauuaacuggaagggcaaggaacugaagugcggcuccgguaucuuugugacgaacgagguccacacguggaccgagcaguacaaauuccaggcggacuccccaaagcgccucgccacugccauugccggagccugggaaaacggggugugcggcauccgcagcacaacccggauggagaaccugcuuuggaagcagaucgcgaacgagcucaacuacauccuuugggagaacaauaucaagcugacuguagucguuggagacauaaucgggguccucgagcaagggaaacgcacccuuacgccccagccgauggagcugaaguacuccuggaagaccuggggcaaggcuaagaucgugaccgccgagacccagaacagcaguuucaucaucgacggccccaacacucccgagugccccucagcgucccgggcauggaacgugugggagguggaggauuacggguucggcgucuucaccaccaauaucuggcucaagcugcgcgagguguacacacagcuaugugaccaccggcucaugagcgcggccgugaaggacgagcgcgccguucacgccgacauggguuacuggaucgagagccaaaagaacggguccuggaagcuggagaaggcgagccugaucgagguuaaaaccugcacguggccgaagucccauacccucugguccaacggcgugcuggaguccgacaugaucauccccaagucccuggccgggccuaucucccagcacaacuaccgaccagguuaucacacucagaccgccgggccuuggcaccucggcaagcuggagcuggacuucaacuacugcgagggcacgaccgucgugaucaccgagaacugcgggacccgcggccccagucuccggacgaccaccguguccgggaagcugauccacgaaugguguugccgcagcugcacccugcccccccuccgguacaugggagaggacgggugcugguacggcauggaaauccgcccgaucuccgagaaggaggagaacauggucaaaagccugguguccgccggcagcggggagguggacaacuuuacgaugggcgucuugugccucgccaucuuauucgaggagguuaugcgggggaaguucgggaagaagcacaugauugcgggaaucuucuucaccuucgugcugcucuuauccggccagaucacguggcgcgauauggcccacacccugauaaugaucggcucgaacgccagugaccgcauggggaugggcgugacguaccucgcccuuaucgccaccuuuaagauccagcccuuccucgcgcucggcuucuuccugcgcaaguugaccagccgggagaaccuccuucugggcgugggccucgccauggcaacaacguugcaauugccugaagacaucgagcagauggcaaacgggaucgcucucgggcugauggcccuaaagcucauuacccaguucgagaccuaccagcuguggaccgcccugaucucucucacaugcaguaacaccaucuucacgcugaccguggccuggcgcacugcgacacugauccucgcgggggucucgcugcuuccggugugccaguccagcuccaugcggaagaccgacuggcucccaaugaccgucgccgccaugggcgugccgccccucccgcuguucaucuucagccucaaggauacgcuaaagcgccgaucuuggccccuaaacgagggggucauggccgucggccucgugagcauccuggcguccagccugcuccggaacgacguccccauggcuggccccuuggucgcggggggccuucucaucgccugcuacgugauuaccgggaccucugcagaccugaccguggagaaggccgcggacgucacgugggaggaggaggccgagcagacuggcgugagccacaaucugaugaucaccguggacgacgacggcaccaugcgcaucaaggacgacgagacggaaaacauccucacgguccugcugaagaccgcuuuauuaaucguguccggcaucuuuccguauagcauucccgccacucugcucguuuggcacaccuggcaaaagcagacacagcgguccggcguccuaugggacgugcccuccccgcccgaaacccagaaggccgagcuggaagaggggguguauaggaucaagcagcagggcauuuucgggaagacacagguaggggugggggugcagaaggagggcgucuuccacaccauguggcacgugacgcggggugccgugcucaccuacaacgggaagcgccuagagccaaacugggcguccgucaagaaggaccugaucuccuacggcgguggcuggagacucuccgcccaguggcagaagggggaggagguucaggugaucgccgucgagcccggcaagaacccgaagaacuuccagaccaugcccggcaccuuccaaacaacuaccggggaaauaggcgcgaucgcacuggacuuuaagcccgggacgaguggcagccccauaauaaacagagagggaaagaucguggggcuguacgguaacggcguggucacgaaaaacggcggauacguguccggcaucgcgcaaaccaacgcggagcccgacggccccacccccgaacuggaggaggaaauguucaaaaagcggaaccucaccaucauggaccugcaccccgggagcggcaaaacgagaaaguaucucccggcaaucgugcgcgaggcgaucaagaggcggcuccgcacccugauacuggcccccacccgggucguggccgccgaaauggaggaggcccucaaagggcugccgauccguuaccagacaacggcgaccaaauccgagcacaccggccgggagaucguggaucuaaugugucacgccaccuuuacgaugcgcuugcugagccccguccgggugccaaacuacaaccugaucaucauggacgaggcgcacuucaccgacccugcauccaucgccgcgaggggguacauuagcacccgggucggcaugggcgaagccgccgccaucuucaugaccgcuacgccccccggaaccgccgacgccuuuccgcagucgaacgcccccauccaggaugaggaacgcgauauccccgagcgcagcuggaacuccggcaacgaguggaucacggacuucgccgggaagaccgucugguucgugcccuccaucaaggcgggcaacgacaucgccaacugccuccguaagaacgggaagaaggugauccagcugucccgcaagacguucgacaccgaguaccagaagaccaagcugaacgacugggacuuuguugugaccacggacauuuccgagaugggcgccaacuuuaaggccgaucgagucaucgacccgcgccgaugccucaaaccgguaauccugacggacggccccgagagggugauucuggccgggcccaugccggugaccgcggccuccgcggcccagcgucgcggccgggucggucgcaacccccagaaggagaacgaccaguacaucuucaccggccagccucucaacaacgacgaggaccacgcccacuggacggaagcgaagaugcuguuggacaacauaaacacgcccgaggggaucaucccggcccucuucgagccugagcgggagaaauccgccgccaucgacggcgaguaccgacugaagggcgagucccgaaagacguucguggagcugaugcgccgcggggaccuccccguguggcuggcgcacaagguagcgucggaggggaucaaauacacagaccgcaaguggugcuucgacgggcaacgaaacaaccagauccuggaggagaauauggacgucgagaucuggacuaaggagggugagaagaagaagcuccggccaagauggcuggacgcacgaacguacuccgacccucucgcccucaaagaguucaaggacuucgccgcuggccgcaagagcauagcccuggaccuggugaccgaaaucgggcgggugcccacccacuuggcucacaggacccguaacgcucuggauaaccucgugaugcuccacacgagcgagcacggcgggaaggcuuaccgucacgcggucgaggagcugcccgagaccauggagacccugcuccuacugggccucaugauucugcuaacagggggggccauguuauucuugaucucuggcaaggggaucggcaagaccagcaucggccugauaugcguaaucgcuuccagcggcaugcucuggauggcugagaucccucuucaguggaucgccucugcgauaguacuggaguucuucaugaugguccuccucauccccgagcccgagaagcagcggacgccccaagacaaccagcuggccuacguggucaucgggauccucacucucgccgcgaucaucgccgcgaaugagaugggccugcucgagacaacaaagcgugaccuagguaugagcaaggagccgggggucguuucccccaccagcuaccuugacgucgaucuccaccccgccuccgccuggacccuguacgcagucgcgacuacgguaaucacccccaugcugcggcacaccaucgagaacagcaccgcgaacgugucccuagcugccaucgccaaccaggcggucguucugauggggcucgacaagggguggccgaucucaaagauggacuuggguguuccgcuucuggcccucgguugcuacucccaggucaacccguugacgcuaacggccgcaguguugcugcugauaacccacuacgccauuaucggcccaggccuccaggcgaaggccacucgcgaggcccagaagcggacggccgccggcauuaugaagaacccgaccguggauggcauuaugaccaucgaccuggaccccgucaucuacgacagcaaguuugaaaagcagcugggccaggugaugcuccugguuuugugcgcugugcagcucuuacugaugcguaccuccugggcccucugcgaagcccugacgcuggccaccgggcccaucaccacccucugggagggcagccccgggaaguucuggaacacgaccaucgcgguguccauggcuaacaucuuccgaggcagcuaccuggccggggccgggcuggccuucuccaucaugaagagcguggggaccggcaagcgcggcaccgggucucagggcgaaacgcugggugaaaaguggaaaaagaagcugaaccagcugagccggaaagaguucgaccuauacaagaaaucgggcauuacggaggucgacagaacggaggcaaaggagggccucaagcggggugagaucacccaccacgccgugucccgaggcagcgccaaacugcagugguucgucgagcggaauauggugaucccggaagggcgcgugaucgacuuaggcugugggaggggagggugguccuacuacugcgccggccugaagaaggucaccgagguccgcgguuacacgaagggggggcccgggcacgaggagcccgugcccaugagcaccuacggcuggaacaucgugaaauuaauguccgggaaggacgucuucuacuugccgccugagaagugcgacacucugcugugcgacaucggugagucuucccccagcccaaccguggaggagucacggacgauccgggugcugaagauggucgagccguggcucaagaacaaucaauucugcaucaaggugcugaaucccuacaugccuaccgugaucgagcaccuggagcguuuacaacggaagcacgguggcaugcugguccgcaacccccugagccggaacaguacccacgaaauguacuggauuucaaauggcaccgggaacauaguagccuccgugaacauggucagccgccuccugcugaaucgguucacgaugacccaccgccggccgaccaucgagaaggacguggaccuaggcgcggggacccgccacgugaaugccgagcccgagacccccaauauggacgucauaggggagcggauaaaacgcaucaaggaggagcacaacagcaccuggcacuacgacgacgagaacccguacaagacuugggccuaccacggcuccuacgaggugaaggcuaccggguccgccagcuccaugaucaauggcguggucaagcugcugacgaagccgugggacguaguccccauggucacccagauggcgaugaccgacacaacgcccuucgggcagcagcggguguucaaagagaaggucgacacccgcaccccgcggagcaugcccggcacccgucggguuaugggcaucacggcugaauggcucuggcgcacccuggggcggaauaaaaagccccgccugugcacccgggaggaguucaccaaaaaggugcgcaccaacgccgccaugggcgcggucuucacggaagagaaccagugggacagcgccaaggccgccguugaggacgaggacuucuggaagcucguggaccgcgagcgggagcugcauaaguuagggaagugcggcuccugugucuacaacaugauggggaaacgcgagaaaaagcucggcgaguucggcaaggccaaggggagcagggcgaucugguacauguggcugggggcccgcuaccuggaguucgaggcccucggguuccugaacgaggaccacugguucucccgcgagaacagcuacucuggcguggagggggagggccugcacaagcucggcuacaucuuaagagacaucagcaaaauccccgggggcgccauguacgcagaugacacugcagggugggacacccggaucacggaagacgacuugcacaacgaagagaaaauuacccaacaaauggauccggagcacaggcagcucgccaacgccaucuucaagcugaccuaucagaacaagguggucaaaguacagcggcccacccccaccgguacggugauggacaucauuucccgcaaggaccagcggggcagcgggcaggucggcacuuacgggcugaacaccuucaccaauauggaggcccagcucauccgucagauggagggagaaggggugcuuuccaaggcugacuuggagaacccccacuugccggagaagaagauuacgcaauggcuggagacgaagggagucgagcggcugaagcgcauggcgaucucuggcgacgacugcguugugaaacccaucgacgaccgguucgccaacgcacuccuggcacugaacgacauggggaagguaagaaaggauaucccccaguggcagcccagcaagggcuggcacgauuggcagcaggucccguucugcagccaccacuuccaugagcucaucaugaaggacggaaggaagcugguggugcccuguaggccccaggacgagcugaucggccgggcccgcaucucccagggugccggcuggagccuccgggagaccgccugccugggcaaggccuacgcccagauguggucccugauguacuuccauagacgcgaccuccgccuggcgagcaacgcuaucugcuccgccgucccggugcacugggugccgaccagccgcacuaccuggucgauccacgcucaccaccaguggaugaccaccgaggacaugcugaccgucuggaaccggguauggauugaggacaacccauggauggaggacaaaaccccggugaccaccugggagaacgucccuuaccucgggaagcgagaggaccaauggugcggcagccuuaucgggcuaacuucaagagccacuugggcccagaacaucccgaccgccauccagcagguccgcucccucaucggcaacgaggaguuccuggauuacaugcccagcaugaagcgguuccgcaaggaagaggaguccgagggggcaaucugguga

SEQ ID NO: 26039 - RNA, 9873 nt, Artificial Sequence
  derived and/or modified CDS sequence (opt11) from DENV-3__FJ850096__SS-prME
acgagccuuugccucaugaugauccugccugccgcccuggcauuucacuugaccagccgggacggggagccacggaugaucgucgggaagaacgagcggggcaagagccugcuguucaagacugccagcggaaucaacaugugcaccuugaucgcgauggaccugggagagaugugcgacgacacagugaccuacaagugcccccauauaaccgaggucgagcccgaagacaucgacugcuggugcaauuugacaagcaccugggucaccuacgggacgugcaaccaagcaggcgaacaucggcgcgacaaaagauccguugcuuuggcgccccaugugggaauggggcuggacacaaggacccagaccuggaugagcgccgagggcgcauggagacaggucgaaaagguggaaacgugggcccugagacauccgggguucaccauccucgcccuguuccuggcccacuauauuggcaccucccugacacagaagguugucauauucauucugcuaaugcucgugacgcccaguaugaccaugcggugugugggggugggcaaucgagacuucgucgaaggccuuucgggggcuacuuggguggacgucguauuggaacacggggggugcguuacaacaauggccaaaaacaagcccacccucgacaucgagcuucagaagacagaagccacccaguuagcgacgcuacgaaagcuuugcaucgagggcaagauuaccaacaucaccacagacagccgcugcccuacgcagggcgaggcagugcuuccggaggagcaggaccagaacuacgucuguaagcacaccuauguggauagaggguggggcaacggcugcggccucuucgggaagggcucccuggugaccugcgcgaaguuccagugucuggaacccaucgaggguaaggucgugcaauacgagaaccuaaaguacaccgucaucaucacgguccacaccggcgaccagcaccagguuggcaacgagacccagggugucacugcagagauaacgccgcaggcuagcaccacugaggcuauccugcccgaguacgguacccugggacuugagugcucuccgcgcaccggcuuagacuuuaaugagaugaucuuacucacaaugaaaaacaaggccuggaugguucacagacaaugguucuuugaccugccccuucccuggaccagcggugcaaccacugagacgcccacguggaaccgcaaggagcuccuggugaccuucaagaaugcccacgccaaaaagcaggagguugugguacucgguucccaagagggcgcuaugcacaccgcucugacuggggccaccgaaauccagaauagcggcgggacguccaucuucgccggccaucugaagugccggcugaagauggacaagcucgaacucaagggcauguccuacgccaugugcaccaacacguucguccugaagaaggagguuuccgagacccagcaugggacgaucuuaaucaagguggaguacaagggcgaagacguccccugcaaaauccccuucagcacagaagaugggcaggguaaagcgcacaauggacgccugaucacggcgaaccccguugugaccaagaaggaggagcccgucaacaucgaggccgagccgcccuucggcgagaguaacaucgugaucggcaucggcgacaaugcucucaaaauaaacugguacaagaaaggcagcagcauugggaagauguucgaagcgaccgccagaggcgccaggcgcauggccauccucggcgacacagcgugggacuucgggucugugggcggggugcucaauucgcugggcaagauggugcaucagaucuucgguucugcauacaccgcccuguucagcggcguguccuggguaaugaagauaggcaucggucuccuguugaccuggaucggccugaacagcaagaacaccuccaugagcuucuccugcaucgccaucggaaucaucacccuguaccucggcgcaguugugcaggcggacaugggaugcgucaucaacuggaaggggaaggagcucaagugcggcuccgggaucuucgugacgaaugaggugcacacuuggacggaacaguacaaauuccaggcggacucccccaagcgcuuagccaccgcgaucgccggggcgugggagaauggagucugugggaucagaagcacgacccguauggagaauuuacucuggaagcagaucgcuaacgaacugaauuacauacugugggagaauaacauaaagcucaccguggugguuggggacaucauaggcgugcuggagcaggguaagcgcacucugacgccccagccgauggagcucaaauauaguuggaagaccugggggaaggccaagauuguuacugccgaaacccagaacucgucauucaucaucgacggccccaacacgcccgagugccccagcgccucucgggcguggaacgugugggagguggaggacuauggguucggcguauuuacuacaaacaucuggcucaaacugagggaagucuacacacagcucugcgaccaccggcugaugagugccgcugugaaggacgagcgcgccgugcaugccgacaugggguacuggauugagagccagaagaacggaucauggaaacuugagaaggcuucccucaucgaggucaaaacgugcaccuggccgaagucacacacccuguggagcaacggcgugcuagagagugacaugaucauccccaagagccuagccgggcccaucucccaacauaacuaccggccgggcuaucacacccaaaccgccgggccguggcaccuggggaagcuggagcucgacuucaacuacugcgagggcacgacgguggucaucaccgagaacugcgguacacgcggcccaagcuugcggacgaccacgguaucagggaaacuaauccacgaauggugcugccgcagcugcaccuuaccgccccugcgguacaugggugaggacgggugcugguacggcauggagauccgccccaucagcgagaaggaggagaauauggucaagagccuggucuccgccggcagcggggagguggacaacuucacgaugggcgugcucugccuugcaauccuguucgaagagguaaugagagguaaauucgggaagaagcacaugaucgccgggguguucuucaccuucgugcuucugcuguccgggcagaucaccuggcgcgacauggcucauacccucaucaugaucgguagcaacgccuccgaccggauggggaugggcgucacguaccuggcccucaucgcaaccuuuaagauucagccauuccucgcacugggguucuuccugcgcaagcugaccucccgggagaaccuccuacucggggugggccuugcuauggccacgacgcugcaacugccugaggauaucgagcagauggcuaacgggaucgcgcugggccugauggcccuuaagcugaucacccaguucgaaaccuaucaacuguggaccgcccugauaucucuuacguguaguaacacgaucuucacccucacgguggcuuggcgcacugccaccuugauccuggcgggugugagccuucuccccgugugccaguccaguuccaugcgcaagacagauuggcugcccaugacgguggccgccauggguguaccaccacucccccucuucaucuucucccugaaggacacgcugaagcgccgcuccuggccucucaaugaaggggugauggcggucggccuggugaguauccuugccuccagccuccugcggaacgauguucccauggcggggccccuggucgccgggggacuccugauagccugcuacgugauaacugggaccuccgccgaccugacaguggagaaggccgcugacgucacgugggaggaagaggccgaacagaccggcgucagucauaacuugaugaucacuguggacgacgacgggaccaugcgcaucaaagacgacgaaaccgagaauauccuaaccguccugcucaagacugcccugcugauaguguccggcaucuuuccguauagcauccccgccacccuccugguguggcauaccuggcagaagcagacgcagagguccggcguccugugggauguucccagcccgcccgagacacagaaggcggagcucgaggaggguguuuacaggaucaagcaacagggcaucuuugggaagacccagguaggcgugggagugcagaaggaggguguauuccacaccauguggcaugugacgcggggcgccgugcugaccuacaacgggaaacgacuggagcccaacugggccaguguaaagaaagaccuaaucagcuacggcggcgguuggcggcuguccgcccaauggcagaagggagaggaaguucaggugaucgccgucgaaccggguaaaaaccccaagaauuuccagacuaugccgggcaccuuccagacuaccaccggggagauuggagcgaucgcccuggauuucaagcccgggaccaguggaagucccaucaucaaucgcgaggguaagguggucgggcuguacggcaacggggucgugacgaagaacggcggguacguauccggcaucgcccaaaccaacgcugaaccggauggccccacccccgaauuggaggaggagauguucaagaagcggaaccugaccaucauggaccugcaccccgggagugggaaaacgcgcaaauaccucccggccaucguccgggaagcgaucaagcgaagacugcgcacguuaauucucgcaccuacucggguaguggccgcugagauggaggaggcacugaaggggcugcccauccgcuaccagaccacggcgaccaaguccgagcacacaggccgggagaucgucgacuuaaugugccaugcaaccuucacgaugcgccuucugagccccgugcgggugccaaauuacaaccucauuaucauggaugaggcccacuucaccgacccggccucaauugccgcacguggguacaucagcacucgggucggcaugggcgaggccgccgcaaucuucaugacggcgacgccgcccgggacagcggacgccuuuccgcaguccaacgcccccauacaagacgaggaaagagacauccccgagcgaagcuggaacaguggcaacgaguggaucaccgacuucacggguaagaccgugugguucguaccgagcauaaaagccgguaaugacaucgcgaacugccuccggaagaacgggaaaaaaguuauucagcugucgaggaagaccuucgacaccgaguaccaaaaaaccaagcuuaacgacugggacuucguggugacgacggauauaagcgagaugggcgccaauuucaaagccgaccgggucaucgacccgcgcagaugccugaagccaguaaucuuaaccgacggccccgagagggucauccucgcugggccgaugccggucaccgccgcuucagcagcccagaggcggggucgcgugggccgaaacccccagaaggagaaugaccaauacaucuucaccggccagccucugaauaacgacgaggaccacgcgcacuggaccgaggccaagaugcugcucgauaacauaaacacccccgaggggaucauuccggcguuguucgagcccgagcgugagaagucggcugcgaucgacggcgaguaucgccugaagggcgagucucggaagaccuuuguggagcuaaugcggcgcggggaccugcccgucuggcuggcccacaagguggcgagcgagggcaucaaauacaccgaucggaaguggugcuucgacgggcagcgcaacaaccagauccucgaggaaaacauggacgucgagaucuggaccaaagagggcgagaagaagaaguugcgcccccgcuggcuggacgccagaaccuacuccgacccucucgcccucaaggaguucaaggacuucgccgccggccgcaagucuaucgcacuggaccucgugacagagauagggcggguacccucccaccuggcccacaggacgcggaaugcccuggacaacuuaguuaugcugcauacaucggagcacggcgggaaggccuaccgucaugcgguugaggagcugccugagaccauggagacucuccugcuucugggcuugaugauccugcucaccgguggcgcgaugcuauuccugaucagcgggaaggggaucggcaagacguccaucggguuaaucugugugauagccagcuccgguaugcuguggauggccgagaucccguugcaguggaucgccagcgcgauaguccucgaguuuuucaugaugguuuuacugauacccgaacccgagaagcagcggacgccccaggacaaucagcucgcguacguggucaucgggauccugacccuggcagccauaaucgccgccaaugagaugggccuguuagagaccacgaagcgcgaccuagguaugucuaaggagcccgggguggugagccccaccuccuaccuugacgucgaccugcacccagcaagcgccuggacccuuuacgccguugccaccacgguuaucacccccaugcugcgacacacaaucgagaacuccacugcgaacguuagccuggccgccauagccaaccaggcaguggugcugaugggcuuagacaagggguggccgaucaguaaaauggaccugggggugcccuugcucgcgcuggggugcuacagccagguaaauccccucacgcucaccgccgccguucuucugcucaucacccacuaugcgaucaucggccccggccugcaggccaaggcgacucgcgaggcccaaaagcggacggcggccggcauuaugaagaacccgacagucgacggcauaaugaccaucgaucuggaccccgucauauacgacucaaaauucgagaagcagcucggccaggugaugcugcugguccucugcgccgugcagcuacuccugaugcgcacaagcugggcccuaugcgaagcgcugacgcuugcaaccggccccaucacgacacuuugggaggggucccccgggaaguucuggaacacuaccaucgccgugagcauggcgaacaucuuccggggcucauaccuggccggggcuggccucgccuucagcaucaugaaguccguggggaccgggaagcgcggcaccggcagccagggugagacucugggggagaaauggaaaaagaaacugaaccaacuaagucguaaggaguucgaccuuuauaaaaaauccggcaucacggagguggaccggaccgaagcuaaagagggguuaaagcggggcgagauaacccaccacgccgugagccgcggcuccgcuaaacuccagugguucgucgaacggaacaugguuauaccggaggggcgaguuaucgaucugggcuguggucggggcggguggucguacuacugcgccggccuuaagaaggucacggaggucagagguuacacgaagggcggccccggacacgaggagccggugcccaugucaaccuacggauggaacaucgucaaacucaugucuggcaaggacguguucuaccuuccgccagagaagugugacacgcuauugugugacaucggcgaguccagccccucccccaccguagaggagucucggacaauccggguccuuaagaugguagagccguggcugaaaaacaaccaguucugcaucaaggugcugaacccguacaugcccaccgucaucgagcaccuagagcgacugcagcggaagcacggcgguaugcuggugcggaauccccuguccagaaacaguacccacgaaauguacuggaucuccaacggcaccgggaauaucguggccucggucaacauggugucccgccugcuacucaaccgguucacgaugacccauaggcgaccgaccaucgagaaagacgucgaccugggugccggcacccgccacgucaacgcggagcccgagacgcccaacauggaugugauuggggagcggauuaaacgcauaaaggaggaacauaacagcacguggcacuaugaugacgagaacccguacaagaccugggccuaccacggcuccuacgaggugaaggccaccgggagcgccuccucaaugaucaacggcgucguuaaguuacucacgaaacccugggaugucgugcccaugguuacccagauggccaugacggacaccacgcccuucgggcagcagcgggucuucaaggaaaagguggacaccaggacaccucggaguaugcccggcacucgcagagugauggggaucacggcugagugguuauggcgcaccuuagggcggaacaagaagccccgucucugcacgagggaggaauucacaaagaaagucagaacgaaugccgccaugggcgcugucuuuaccgaggagaaccagugggauuccgccaaagccgcaguggaggacgaagacuuuuggaagcuugucgaccgcgaacgcgaacugcauaaacuggggaaguguggaagcugcguguacaacaugauggggaaacgcgagaaaaagcucggcgaguucgggaaagccaaggguucccgggccaucugguacauguggcugggggcacgcuaccucgaguuugaagcucugggguuccugaacgaggaccacugguucagcagggaaaacaguuacucaggcguggagggggagggacuccauaagcucgguuauauccugcgcgacaucuccaagauacccgggggcgcaauguacgcugacgacaccgcggggugggacacucggaucacugaggacgaccugcacaaugaggagaagaucacccagcagauggacccagagcaucgccagcuugcgaacgccaucuuuaaguuaaccuaccagaacaaggucgucaaggugcagagaccuaccccgaccgggaccgucauggacauuaucagccgcaaggaccagcggggcaguggccaggugggcacguacggucucaacaccuucacgaacauggaggcccagcugauccgccagauggagggugaagggguguugucaaaagccgaucucgagaacccccaucuccccgagaagaagaucacgcaguggcuggagacgaagggcgucgagcgauugaagcgcauggccaucuccggcgacgacugcguggucaagcccauagacgaccguuucgccaacgcccugcuggcccucaacgacauggguaagguccgcaaagacaucccccaguggcagccaucaaagggcuggcacgacuggcagcagguaccguucugcucccaccacuuccacgagcuuaucaugaaagacgggcggaaguuaguaguccccugccgcccccaagacgaacucaucggccgcgccagaaucagccagggggccggauggucccugcgggagacggcgugucugggcaaggccuacgcccagauguggagccucauguacuuccaccgccgcgaucugcgacuggccucaaacgcaauauguagugccgugccggugcacugggucccaacuucccgcaccaccuggagcauccacgcccaccaucaguggaugaccaccgaagacaugcuaacgguguggaaccggguguggauugaggacaacccuuggauggaagacaagacccccguaaccaccugggagaacgugcccuaccuggggaagcgagaggaccaguggugcggcagccugaucggauuaacguccagggcgaccugggcccaaaauaucccgaccgccauccagcagguccgcucacugaucggcaacgaggaguuccuggacuacaugccaucaaugaagcgguuucgcaaggaagaggaaagcgagggcgccauuugguga

SEQ ID NO: 26040 - RNA, 9873 nt, Artificial Sequence
  derived and/or modified CDS sequence (opt11) from DENV-3__FJ882578__SS-prME
accucgcuaugccuaaugaugaucuuaccugcggcacuggcuuuccaccuaaccagccgggacggggaacccagaaugaucgugggcaaaaacgaacgagguaaauccuugcuguuuaaaaccgcaagcggcaucaacaugugcacuuuaauagcaauggacuugggagaaaugugugaugacacagugacguacaaauguccgcacauaacggaaguagaaccggaagacaucgacugcugguguaaucuuacaagcacguggguaacauacggaacguguaaucaagcgggcgaacaccgccgcgacaaacggucaguugcacuagcaccccacgugggcaugggauuagauacacgcacccaaaccuggaugagcgcagaaggagcauggcgacaaguugaaaaagucgaaaccugggcccuacggcacccgggauuuacaauacuggcgcuguuccuagcgcacuauauuggcacgucgcugacgcaaaaaguuguaaucuucauacugcuuauguuggugaccccguccaugacgaugcgcugugucggagugggcaaccgcgauuucguagaaggccuaucaggggccacaugggucgaugucguccuagaacacgguggaugcguuacgaccauggccaaaaacaaaccaacacucgacaucgaacuacagaaaacggaagcuacgcaacuagccacacucagaaaacuaugcaucgaaggcaaaauaacgaacauaacaaccgacucgaggugccccacccagggugaagcugugcucccagaagaacaagaucaaaacuauguaugcaaacacacauacgucgacagagguuggggaaacgguugcggccuauucggcaaaggcagucuggucaccugugccaaguuccagugccuagaacccauagaagguaagguggugcaauacgaaaaccucaaguacaccgucauuaucacgguacauaccggagaccaacaccaaguuggaaaugaaacccaaggcguaacagcugaaauuacaccccaggccuccacuacggaagcaauucuccccgaauacgggacgcucggauuggagugcaguccgcgcaccggccuggacuucaacgagaugauucucuugaccaugaagaacaaggccuggaugguccaccgacaaugguucuuugaccuaccccucccauggaccuccggggccacgacugaaacaccgaccuggaacagaaaagaacuauugguaacuuuuaaaaacgcucacgccaagaaacaggaaguggucguacuggguagccaggagggcgccaugcacaccgcacuuaccggcgcgacagaaauacagaacucaggggguacuagcauauucgcgggccaccucaaaugucgccuaaaaauggauaaacuugaacuaaaaggcaugagcuaugcgaugugcacaaacacguuuguccucaagaaagaaguguccgagacccagcauggcacgauacugaucaagguagaguacaagggagaagacgucccaugcaaaauaccauucaguacugaggauggccaagguaaggcacacaauggacgccugaucaccgccaacccagugguaacaaagaaagaagaaccggugaauauugaggcggaaccacccuucggagagaguaacaucgucauuggaaucggagauaacgcauuaaaaaucaauugguacaaaaagggaucguccaucggaaaaauguuugaagcaaccgcgcgaggggcccggcgcauggccauucucggggacacagccugggacuucgguuccguaggagguguacucaacagucucgggaaaaugguacaccagaucuuuggaucagcauacaccgcucuauucucggggguuagcugggucaugaagauagggauaggaguacuguugacauggauuggacuaaauucuaaaaacacaagcaugagcuuuucuugcaucgcaaucgggauuauaacacuauaccuaggcgccguaguacaagcggacauggggugcguaaucaacuggaaggggaaggaacucaaaugcggcagcgggaucuucguaacuaacgaagugcauacauggaccgaacaguauaaauuccaagcagauucgcccaaacgacucgcaaccgcgauagcgggagcuugggaaaacggagugugcggcauucggaguacgacaagaauggagaaccuauuguggaaacagaucgccaacgaacucaacuacauacucugggaaaauaauaucaaacuuacagucguugucggagacaccauagguguauuggagcaaggaaaacgcauacuuacgccccaaccaauggagcugaaauauuccuggaaaacaugggggaaagcgaagaucgugacugcggagacccaaaacucaucauuuaucaucgaugggccgaacacacccgaaugccccucagcgucccgcgccuggaauguaugggagguugaggacuaugguuucggcguauucacaacgaauauauggcugaaacuacgggaggucuacacgcagcucugcgaccaccgguuaauguccgcggccgucaaagacgaaagggcuguccaugcagacaugggauacuggauagaaagccagaaaaacgggaguuggaaacuggaaaaggccagcuuaauugaaguaaaaaccugcaccuggccuaagucacacacguuauggagcaacggcgugcuagagagcgacaugaucauccccaaaucacuagccgggcccaucucgcaacacaauuacagaccaggauaucacacccagacggccggcccguggcaucucggaaagcuagagcuugauuucaacuacugugaagggacuaccguaguuauuaccgaaaauugcggaacgcgggguccaucccuacgcacaacuacagugaguggaaaacuaauccacgaaugguguuguagaagcugcacccuaccaccauuacguuacaugggugaagacgguugcugguacggaauggaaauccgcccaauaucggaaaaggaagagaacauggucaagagccuggucagcgccggaagcggagaaguagauaauuucacgaugggaguacuuugucuugcgauccuguucgaagaaguaaugcgagggaaauucggcaaaaagcauaugaucgcggggguguucuucacguucguccuacuguuaucaggccagauaaccuggcgugacauggcacacacacucaucaugauaggcucaaaugcgagugacagaauggguaugggaguaacguaccuggcgcucaucgccaccuuuaaaauccaaccuuuccuggcccugggguucuuucuucgaaaacuaacgagccgagagaaccuacuccuuggagucggacuugccauggcaaccaccuuacaacuaccggaagacauagaacaaauggcgaaugguauagcgcucggucucauggcccucaaacuuaucacacaauucgagacauaccagcuuuggacggcccucaucucgcucacuugcagcaacacaauuuuuacccuaacggucgcauggcgcacggcgacauuaauacucgcgggcgucagccuuuuacccgugugucaguccuccucuaugcguaagaccgauuggcuuccuaugaccguagccgccaugggugucccaccccuaccgcuauucaucuuuucccucaaggacacacucaaaaggcguagcuggccucugaaugaaggaguaauggccgucgggcucgucagcaucuuggcuagcucacugcuccguaacgacgucccuauggccgggccccuagucgccggcggacuucuaaucgcaugcuacgugauaacggggaccagcgccgacuuaacggucgagaaagcagccgacguaaccugggaggaagaagccgaacaaacaggagucucacacaaucuaaugauaacaguagaugaugacggaacuaugagaauaaaagacgacgaaaccgagaacauacugacuguccuucugaaaaccgcgcucuugauugugucaggaauuuucccauauucgaucccagcaacucuccuagucuggcacaccuggcagaagcagacccaacggucaggggugcuaugggauguuccgaguccgcccgagacgcagaaggcugaguuggaggagggaguguacagaauaaaacagcagggcauauucggaaagacgcaggucggcgucggaguccaaaaagagggcguuuuccacacgauguggcacguuacuaggggagccguccuaacuuauaacggcaaacggcucgaacccaacugggccagugucaagaaagaccugauaucuuauggaggcggcuggcgguuaucggcccaguggcaaaagggcgaagaaguacaggucaucgcgguugagcccgggaaaaaccccaagaauuuccagacgaugcccggaacauuucagaccacgaccggcgaaaucggggcaauagcccuggacuucaaacccggaacaucaggguccccaauaaucaaccgcgaaggcaaggucgucgggcuauacggcaacggcgucguaacgaagaaugguggguacgucucaggaauugcccaaaccaacgcggaaccagaugggcccacuccagaguuggaagaagaaauguucaagaaacgcaaccuaacaauaauggaccuacaccccggcucugggaaaaccagaaaauaccugccagccauuguacgcgaggccaucaaacguaggcugcgcacucucauacuggcgccgacgagaguaguggccgcugaaauggaagaggcgcuaaagggacuaccgaucagauaucaaacgaccgccacgaaguccgagcacaccggaagagagauagucgaccucaugugccacgcaaccuucacuaugcggcuauugucccccguacgagucccuaacuacaaucucaucauaauggacgaagcacauuucacagacccugcaucaaucgcggcacggggguacauaucgacacgcgucgggaugggggaggcggccgcgaucuucaugaccgcaacgcccccgggaacagcagacgcuuucccucaauccaacgcacccauccaggacgaggaacgcgacaucccggaacguagcuggaacuccggcaacgaauggauaacagacuucgcagguaaaacggugugguucguaccgagcaucaaggccggaaacgauaucgcgaacugcuuacgcaaaaacggcaagaaaguaauacaacucucgagaaagaccuucgacacugaguaucaaaagacaaagcucaacgauugggacuucguggugacuacagacaucucggagaugggagccaauuucaaagcagacagagugauugacccucgaagguguuuaaaaccggucaucuuaacggauggaccagagcgaguuaucuuagccggaccuaugcccguaaccgcagcaagcgccgcccagcgcagggggcggguaggacggaacccgcaaaaagagaacgaucaguacauauuuaccggacaaccacuaaacaacgaugaagaccacgcucauuggacagaagccaaaaugcuccuugacaacauaaauacccccgaagggaucauccccgcccucuuugagccagaacgagagaaaucugcagccaucgacggggaauaucgauuaaaaggcgaaucccgaaaaacauucgucgaacucaugaggcgaggagaucugcccguauggcuggcgcacaagguggccagcgagggcaucaaauacacagacagaaaguggugcuucgauggacagaggaacaaccaaauacucgaagaaaacauggacguagaaauauggaccaaagagggugagaaaaagaaacugagaccgcgguggcuagaugcgcgcaccuacagcgacccgcucgcccucaaagaauuuaaagacuucgcagcaggucgaaagagcaucgcgcucgaccuaguaacugaaaucggccggguuccgacacaccucgcacacaggacaaggaacgcucuagacaacuuagucaugcuacacacaucggaacacggcggaaaagcauacagacacgcagucgaagaauuaccagaaaccauggagacccugcuauugcuuggucucaugauucuccugacgggaggggcaauguuguucuugaucaguggaaaagguauagguaaaacaagcauuggacugaucugcgugauugcaaguuccggcaugcuuuggauggcggagauuccccuacaguggauugccagcgcaaucgugcuagaauuuuucaugaugguacuguuaaucccagaaccagaaaaacaacgaaccccacaagacaaucagcuagcuuauguugucauaggcaucuuaacauuagccgcaaucauugccgcuaacgagaugggccuuuuggagaccacgaagcgugaccucgguaugaguaaagaaccagggguggucucccccacauccuaccuggauguagaccuccauccagccuccgcguggacacuauaugcgguagccacaacugucauaacacccaugcuccggcauacgaucgagaacagcaccgcaaacgugucauuggcagccaucgcaaaccaagcaguuguucuaaugggacuugauaaaggcuggccaauaucgaaaauggaccuaggaguaccccuacuagcgcuaggaugcuacucacaggucaacccacuuacucucacugccgccguacugcuacugauuacccacuacgcaaucauaggcccgggucuacaagccaaagccacacgagaggcacagaaaagaacagcagcagguaucaugaagaacccuacaguggacggaauaaugacgaucgaccucgacccggugauauaugauagcaaauuugaaaaacaacucggccagguuaugcugcugguacuaugugccgugcaauuacuccucaugcgcaccucgugggcgcuaugcgaagcgcuaacacuggccacggggcccaucacaacacugugggagggaagcccggggaaauucuggaacacgacgaucgcagucagcauggcuaacauauuucguggaagcuaucucgcaggggcgggacucgcguucuccauaaugaaaucagucggaacgggaaagagagggacgggaucgcaaggcgagacacuaggggagaaguggaagaaaaaguuaaaccaauugaguaggaaagaauuugaucuguacaagaagucggguaucaccgaaguagauagaacggaggcaaaagagggccucaaacggggagagaucacacaucaugcugucagccguggcagugcaaaacuccagugguucgucgaacgaaacauggucauaccggagggccgcguaaucgaccuaggaugcggccgcggaggauggagcuacuacugcgccggccucaaaaaggucacagaaguacgaggcuacacaaaagguggacccggacaugaagaaccagugccaaugagcacguacgguuggaacaucguuaaacugaugucaggcaaagaugucuuuuacuugccacccgaaaaaugcgacacccugcugugcgacauaggugagucuaguccauccccgacaguugaagaaagcaggacaaucaggguacucaaaauggucgagccuuggcugaaaaauaaucaauucuguaucaaaguguuaaacccguacaugcccacaguaaucgaacaccuggaacgacugcagagaaaacaugggggcaugcuaguccggaaucccuuaagccgcaacagcacucacgaaauguacuggauaagcaacgguaccggaaacaucguggccagcguuaacauggucuccagacuacucuuaaaucguuucacgaugacgcacagacgaccuacuauagaaaaggacguggaccucggagccggcacgcgccacgugaacgcggaaccagaaaccccgaacauggacguaaucggggaacggaucaagcggauuaaggaggagcacaauuccacauggcacuacgacgaugaaaauccguacaaaacuugggcauaccacgguuccuacgaagugaaagcaacgggaucggcaucaucuaugaucaacgguguagucaaacuacucaccaaaccaugggaugugguccccaugguaacacagauggcgaugaccgacaccacgccauucggacagcaacgcguauucaaggaaaaaguagacaccaggacgccgagaagcaugcccgggacccgacgaguaauggggauaacagcggaauggcucuggcgcacgcucggacguaacaagaaacccagacucuguacccgggaggaguucacuaagaaggucagaaccaacgccgcgaugggagccgucuucacggaggaaaaccagugggauucagccaaagcagcagucgaggacgaagauuucuggaagcuagucgaucgggaaagagagcuccacaaacuagguaaguguggaagcugcguuuacaacaugaugggaaagagagagaaaaagcugggggaguucgguaaagccaaaggcagucgagccaucugguacauguggcugggagccagauaccuagaguucgaagcacucgguuucuuaaacgaagaucacugguucucaagagagaauaguuauagcggaguugagggggaggggcuacacaaacucggauauauacugagggacaucucaaagauuccagggggagccauguacgccgacgacacagcgggaugggacacaagaauaacagaagaugacuuacacaacgaagagaaaaucacccagcaaauggacccugaacaucgacaacuagcgaaugcgauauucaaacuaacuuaccaaaacaagguugucaaagugcaacggcccacgccgacugggacagucauggacaucauuucacggaaagaucaacgcggcucgggccagguagggacauacggacucaacacguuuacaaacauggaagcucaacucauacgucagauggaaggcgagggggugcuuagcaaggcagaccuagaaaacccgcauuugccagagaagaaaauuacacaauggcuggaaacaaaagguguagagcgucugaaacgaauggcaaucagcggcgacgacugcgugguaaagcccauagaugacagauucgcaaacgcccugcucgcgcuaaaugauauggguaaaguucgcaaggacauuccgcaauggcaaccaagcaaaggcuggcaugacuggcaacaagucccguuuugcagccaccacuuucaugaacuaaucaugaaggauggaaggaaacucgucguccccugccgcccacaagacgaacucauuggacgagccaggaucucucaaggggcaggguggagucuaagggaaacagcgugccuggggaaggcauacgcccagauguggucucugauguacuuccaucggcgcgaccucagacuggccucaaacgccauaugcuccgcugugccaguccacuggguacccaccagccguacgaccuggagcauucacgcccaccaccaguggaugacgacagaagacaugcucacagucuggaaccgagucuggaucgaggacaacccauggauggaagacaaaaccccagucacaacgugggaaaacguaccguaccugggaaagagagaagaucagugguguggcagcuuaaucggacuaaccucgcgugcaaccugggcacaaaauauacccacugcaauccagcaaguacgaagccuuauagguaaugaggaguucuuagacuauaugcccagcaugaagcgguucagaaaggaagaagaauccgaaggugcgaucugguag

SEQ ID NO: 26041 - RNA, 9873 nt, Artificial Sequence
  derived and/or modified CDS sequence (opt11) from DENV-3__FJ639770__SS-prME
accagccugugccucaugaugauccugcccgccgcccuggcguuccaccucacuagccgggacggcgagccccggaugauuguggggaagaacgagcgcggcaagagccugcuguucaagacugccagcgggaucaauaugugcacccuuaucgccauggaucugggcgagaugugcgacgacaccgugaccuacaagugcccccacaucacggagguugagcccgaggauaucgacugcuggugcaaccugaccagcaccuggguaaccuacgggacgugcaaccaagccggcgagcaccggcgcgauaagagauccguggcccucgccccccaugugggcaugggguuagacacccgcacccagaccuggaugagcgccgagggcgcuuggcggcaggucgagaaggucgagacgugggcccugcgccaccccggguucaccauccucgcgcuguuucuggcacacuacaucggcaccucccucacacagaagguagugauuuucaucuugcugaugcucgucacgccuagcaugaccaugcggugugucggugugggcaaucgagacuucgucgagggucuuuccggggccaccuggguggacgugguccuggagcacggggggugugugacaacgauggcaaagaacaaacccacccucgacaucgagcugcagaagaccgaggccacccaacuggcgacgcuccggaagcugugcauugaggggaagaucaccaauaucaccaccgacagccgcugccccacgcagggcgaggccgugcuucccgaggagcaagaccaaaacuaugucugcaagcacaccuacguggaccggggguggggcaacgggugcggccucuucgggaagggcucccuggugaccugcgccaaguuccagugccuggagcccaucgagggcaaagucgugcaguacgagaaccucaaauacaccgugaucaucacgguccacaccggggaucagcaucaggugggcaaugaaacccaggggguuaccgccgagaucacaccccaggccagcacgacugaggcgauccugcccgaguacggcacccuggggcucgagugcuccccgcgcaccggccuggacuucaacgaaaugauccugcuuacgaugaaaaacaaagccuggaugguucacaggcagugguucuucgaccugccccugccauggaccagcggggccaccaccgagacgcccaccuggaaccgaaaggagcugcuggugacauucaagaacgcucaugcgaagaaacaggaggucguagugcugggaucgcaggagggagcaaugcacacggccuuaacgggggccaccgagauacagaacagcggcgggaccuccauuuucgccggccaccugaaaugccggcucaagauggacaagcucgagcuaaagggcauguccuacgccaugugcaccaacacguucguccugaagaaggagguuuccgagacccagcacgggaccauccuuaucaagguagaguacaagggcgaagacgucccguguaaaauccccuucagcaccgaggaugggcagggcaaggcccacaacggccgucuaaucacggccaaccccguggugaccaagaaggaggagcccgucaacaucgaggccgagccgcccuucggggagagcaacaucgugauuggcauaggggacaacgcccugaagaucaacugguacaagaagggcuccagcaucgggaagauguuugaggcgaccgcccggggcgcccgccggauggcgauuuuaggcgacacagccugggacuucgggagugugggcgggguccucaacagcuuaggcaagauggugcaccagaucuuuggguccgcguacacggcccuguucagcggaguguccugggucaugaagauaggcaucggggugcuccuaaccuggauugggcugaacucuaagaauacauccaugagcuucuccugcaucgcgauagggaucaucacccucuaccugggcgccgugguccaagccgacauggggugcgugaucaacuggaagggcaaggagcugaagugcggaagcgggauuuucgugacaaacgagguccacaccuggaccgagcaguacaaguuccaggcggacucccccaagagguuggccacagccaucgccggcgccugggagaacggggugugugguaucaggagcacgacccggauggagaaccugcuguggaagcagaucgcgaacgagcucaacuacaucuuaugggagaauaacaucaagcugaccguggucgugggggacgugaucggcguccucgagcagggcaagcgcacgcugacgcuccagcccauggagcucaaguacuccuggaagacuugggggaaggccaagaucgugaccgcugagacccagaacagcuccuucaucauugacggcccgaacacgcccgagugccccucugcguccagagcguggaacgugugggaggucgaagacuacggguucggcguguucaccaccaacaucuggcugaagcugcgggaggucuacacacaacucugugaucaccggcugaugagcgccgccguaaaggacgagcgagccgugcacgccgacaugggcuacuggauugagagccagaagaacggcuccuggaagcuggaaaaggccagccuaauagaagugaagaccuguacguggcccaagucccacacccuguggaguaacggcguccuugaguccgacaugauaauccccaagucgcucgccggucccauaucccagcacaacuaccgucccggcuaccacacucagacagccggcccguggcaccugggcaagcuggaacucgacuucaacuacugcgagggcacgaccguggugaucaccgagaacugcgggacccguggccccagccugcggacgaccacugucucugggaaacugauucacgaguggugcugccgcuccugcacccugcccccccuccgcuauaugggcgaggaugggugcugguaugggauggagaucaggccuauauccgagaaagaagaaaacauggucaagagccugguaagcgccggcagcggcgaggucgacaacuucacgaugggcgugcucugccuggccauccuauucgaggaggucaugcgggggaaguuuggcaagaagcacaugaucgcaggggucuuuuucaccuucgugcuccugcuguccggacagaucaccuggcgcgacauggcccacacgcucaucaugaucggcagcaacgccuccgaccggauggggaugggcgugaccuaucuggcccugaucgccaccuucaaaauccagcccuuccucgcgcugggguucuuccugcgcaagcucaccagccgggagaaccugcugcucggcgucggccuggccauggccaccacgcugcagcuccccgaagacaucgagcagauggccaacgggaucgcgcugggacugauggcccucaagcugaucacacaguucgaaaccuaccagcuguggaccgcccuuaucagccugacgugcuccaauaccaucuucaccuugaccguggccuggcgcacggccacgcucauccuggcgggggucagccugcuccccgugugccaauccagcuccaugcggaagaccgacuggcuaccaaugaccguggccgccaugggcgugccuccccugccccuuuuuaucuucucccugaaggacacgcugaagagacgcuccuggccguugaacgaggguguaauggcagugggccuggucucgaucuuagccuccagccucuuacggaacgacgugcccauggcggguccccugguggccggaggccuccugauugccugcuacguaaucacgggcacguccgccgaccugacuguggagaaggcagcggacgugacuugggaggaggaggcugagcagaccggcgucagccacaaccucaugaucaccguggacgacgacgggacuaugcgcaucaaggacgacgagacugagaauauccugacggugcuucugaagaccgcucugcugaucgucucaggcaucuucccguacagcaucccggccacccuccucguguggcacaccuggcagaaacagacgcagcgguccggcgugcugugggacguccccuccccgcccgaaacccagaaagcagagcucgaggaggguguuuaccgcaucaagcagcaagggauuuucgggaagacgcagguaggugugggggugcagaaagagggcguguuccacaccauguggcacgucacgcgcggcgcggugcugaccuacaacgggaaacgccuggagccgaacugggccuccgucaagaaggaccucaucagcuacggcgggggcuggcgucuguccgcccaguggcagaaaggggaagagguccaggugaucgccguggagcccggcaagaaccccaagaacuuccagaccaugcccggcaccuuccagacuacgaccggggagaucggcgcgauugcccucgacuucaaaccgggcaccagcggcagcccaaucaucaaccgcgagggcaaggucguggggcucuacggcaaugggguggucacgaaaaacggcggguacguguccggcaucgcccagaccaacgcugagcccgacggcccgacccccgagcucgaggaagagauguucaagaagcggaaccugaccaucauggaccugcaucccgggaguggcaagacgcggaaguaccuccccgccaucgugcgggaggcgaucaaacgccgacugagaacccucauccucgccccgacacgggucguggccgccgagauggaggaggcccugaaggggcugcccauccgcuaucagacgacggcgaccaaguccgagcacaccggccgggagaucguagacuugaugugucacgccacuuucacgaugcgccugcugagccccguccgggugcccaacuacaaccucaucaucauggacgaggcucauuuuaccgauccggccuccaucgccgcgcgcggguacauaagcacccggguagggaugggcgaggccgccgcaaucuucaugaccgcaaccccgcccgggaccgccgacgcguucccucaguccaacgccccgauccaggacgaggagagggacauccccgagcggagcuggaacagcggcaacgaguggaucaccgacuucgccgggaagaccgucugguucgugcccagcaucaaggcgggcaaugauaucgccaacugccugcggaagaacgggaagaaagugauccagcugucccgcaaaacguucgacaccgaguaccagaagacaaagcucaaugauugggacuucgucguaaccacggacaucagcgaaaugggcgccaacuucaaagccgaccgggugaucgacccacgacggugccugaagccggucauccugaccgacggccccgaacgcgugauccucgccgggcccaugcccgugaccgcggccuccgccgcccagcggcgcggccgggucggacgcaacccgcagaaggagaacgaccaguacaucuucaccggccagccccugaacaaugacgaggaucacgcacacuggaccgaagcgaagaugcugcucgacaacaucaacacgcccgaggggaucauccccgcccuguucgagccggagcgggagaaguccgccgccauugauggcgaauaccgcuugaaaggcgagucccggaagaccuucguggagcucaugaggcgcggggacuuaccaguuugguuggcgcacaaggucgccagcgaggggaucaaguacaccgaccgcaaguggugcuucgacgggcagagaaacaaccagauccucgaggagaacauggauguggagaucuggaccaaggagggcgagaagaagaaguugcgcccccgguggcuggacgcccgcacguacucggauccccucgcucugaaagaguucaaggacuucgccgcgggccgcaagagcaucgcccuggaccucgucaccgagaucggccgggugccgucccaucuagcccaccgcacccggaacgcucuagacaaccucgucaugcugcauaccuccgagcacggcgggaaggccuacaggcacgcgguugaagagcugcccgagaccauggagacccucuuacugcucggccugaugaucuugcucacggggggcgccauguuguuccuuauuucaggcaaggggaucggcaagaccuccaucgggcucaucugcgugaucgccagcuccggcauguuguggauggccgagaucccccugcaguggaucgcgagcgcgaucguucuggaguucuucaugaugguccuucuaaucccggagcccgagaagcagcggaccccccaggacaaccaacucgccuacguggugaucgggauccugacccuggccgccaucaucgccgcgaaugagaugggccuccuggagaccaccaagcgcgaccuggggauguccaaggaacccggggucguguccccgacguccuaccucgacguggaccugcaccccgccagcgccuggacacuguacgcagucgcgacaaccguaaucacgcccaugcuccgccauaccauagagaacuccaccgcuaacgugagccuggccgccaucgccaaccaagcggucguacuaaugggccucgacaagggguggcccauuuccaagauggaccugggcgugccgcuguuggcccuggggugcuacagccaggucaauccccugacccucacggcugccgugcugcugcucaucacccacuacgcuaucaucggucccggccugcaggcgaaagccacacgcgaagcccagaagcggaccgccgccgguaucaugaagaaccccacgguggacggcaucaugaccaucgaccuggacccggucaucuacgacuccaaguucgagaagcaacucggccaggugaugcuccugguacucugcgccguccagcuucuucucaugcgcaccagcugggcccugugcgaagcacugacacucgccacgggacccaucaccacacugugggagggcuccccugggaaguucuggaauaccacgaucgcggugagcauggccaacauuuuccggggcuccuaccuggccggggcaggccucgcuuucagcauaaugaaguccguagggaccggcaagcgcggcacugggagccaaggcgagacccuuggggagaaguggaagaagaagcugaaccagcucucucggaaggaauucgaccuguacaaaaaaucaggcaucaccgaggucgaccggacggaagcgaaagaggggcuuaagcggggagagauuacccaccacgccgugagccgcggcuccgccaaguugcagugguucguagagcggaacaugguuauccccgaggggagagugaucgaccuggguugcgggcgggguggguggagcuacuacugugccggccugaagaaggugaccgagguccgcggcuacaccaagggaggcccggggcacgaggagcccgugcccauguccacguacggcuggaauaucgugaagcucaugagcggcaaggacguuuucuaccugcccccggaaaagugcgauacccuguuaugcgauaucggcgagucgagccccucccccaccguggaggagucccggacaauccgcgugcucaagauggucgagcccuggcugaagaacaaccaguucugcaucaagguacugaacccguacaugcccacggugguugagcaccucgagcgccugcaacggaagcacggcgggaugcucgugcgcaacccgcucagccggaauagcacccaugaaauguacuggaucuccaacgguaccgggaacaucguggccagcgucaacauggugucccgccugcuucucaaccgguucaccaugacccaccgccggcccaccaucgagaaagauguggaccugggcgcggguacccgccacgucaacgccgagccggaaacccccaacauggacgucaucggggagcggaucaagcgcauuaaggaggagcacaacagcacguggcacuacgacgaugaaaaccccuacaagacaugggccuaccacggcuccuacgaggucaaggcgacggggagugccuccagcaugaucaacgguguggugaagcuguugaccaagccgugggacgucgugcccaugguuacgcagauggcgaugaccgacaccacacccuucgggcaacagcggguuuucaaggagaagguggacacgcgcaccccccggagcaugccgggcacccgccgggugaugggcaucacugcugaguggcuguggcgcacccugggacgaaacaagaagccccgccucugcacccgggaggaguucaccaaaaagguccgcaccaacgccgccaugggugcgguguucacggaagagaaccagugggacuccgccaaggccgccguggaggacgaggacuucuggaagcucguggaccgcgagcgggagcugcacaagcucgggaagugcggcucaugcguguacaacaugauggggaagcgcgagaagaagcugggcgaguucggcaaggcaaaggguuccagagcgaucugguacauguggcugggcgcccgcuaccucgaguucgaggcccugggguuucugaacgaggaccauugguucagccgggagaacucauacagcggcguggaaggggagggcuuacacaagcucggcuacauccuacgcgacaucucgaagauccccggaggcgccauguacgccgacgacaccgcggggugggacacucggaucaccgaggacgaccuccacaacgaggagaaaaucacgcagcagauggaccccgagcaccgccagcuggccaacgcuaucuucaagcugaccuaucagaacaaggucgugaagguucagcggccgaccccaacaggcacugucauggacaucauuucccgcaaggaccagcguggcuccgggcagguggggacauacggacucaacaccuucaccaacauggaggcacagcugauccgccagauggaaggcgagggggugcugagcaaggccgaccucgagaacccccggcugcccgagaaaaagaucacccaguggcuggagacgaagggcguggagcgcuuaaagcggauggcgauuuccggcgacgacugcgucgugaagccgaucgaugaccgcuucgcuaacgcccuacuggcccucaacgauaugggcaaaguccggaaggacaucccccaguggcagccauccaagggcuggcacgacuggcagcaggugcccuucugcucccaccacuuccacgagcugaucaugaaggacgggcgcaagcugguggucccgugccggccccaggacgagcucauaggcagagcccggaucagccagggggcaggcuggucccugcgcgagacagccugccugggcaaggccuacgcccagauguggucauugauguauuuccaccgccgggaccugcgccuggcguccaacgccauaugcagcgccgugcccgugcacuggguccccaccucccggacuacguggagcauccacgcucaccaccaguggaugaccacugaggacaugcucaccguguggaaccgcguauggaucgaggacaacccuuggauggaggacaaaacgcccgucacgacaugggagaacgugcccuaccuggggaaacgggaggaccaguggugcggcagccugaucgggcucacgucccgcgccacgugggcgcagaacauccccaccgcaauccagcagguccggagccugauuggcaacgaagaauuccuggacuacaugccuucgaugaagagguucaggaaggaggaggagagcgagggggccaucugguga

SEQ ID NO: 26042 - RNA, 9873 nt, Artificial Sequence
  derived and/or modified CDS sequence (opt11) from DENV-3__FJ639771__SS-prME
accagccugugcuugaugaugauucugcccgccgcccuggcuuuucaccucacaagccgggacggggagccccggaugaucgugggcaagaacgagcgcggcaagucuuugcuguucaagacggccagcgggaucaauaugugcacccucaucgccauggaucugggggagaugugcgacgacacugugaccuauaagugcccccacauaacggaggucgagccggaggacaucgauugcuggugcaaccugaccagcaccuggguaaccuacgggacguguaaccaggccggcgaacaccguagagacaagcgguccguggcccucgcgccgcacgugggcaugggccuggacacccggacacaaaccuggaugagcgccgagggcgcguggcggcaggucgaaaagguggagacgugggccuugcgccacccggguuucaccauucucgccuuauuccuggcccacuauaucggaaccucacugacccagaagguggugauauucauauuacugaugcuuguuacccccuccaugaccaugcggugcgucggggucggcaaccgcgacuuugucgagggccuguccggggccacauggguggacguggucuuagagcacggcgggugcgugaccacgauggccaaaaacaagccgacccucgauauugagcugcagaagaccgaggccacccaguuggcgacgcuucgcaaacuguguauugagggcaaaauuaccaacaucacaaccgauaguaggugccccacgcagggcgaggccgugcugccggaggagcaagaucaaaacuaugucugcaaacacaccuauguugaccggggguggggcaacggguguggccucuucgggaagggcucccucgugaccugugccaaguuucagugccuagaacccaucgagggcaaggucgugcaguaugagaaccugaaguacaccgucaucauaacuguccacacuggcgaccagcaccaggugggcaacgagacccaggggguaacagccgaaauaacuccgcaggccagcacuacggaggcgauccugcccgaguauggcacccuaggguuagaguguuccccgcgcaccggcuuagacuucaacgagaugauacugcuaacgaugaagaacaaggcuuggauggugcaucgccagugguucuuugaccugccgcuaccuuggaccagcggcgccaccaccgagacgcccacauggaaccgaaaggagcuacuggugaccuucaaaaacgcccacgccaagaagcaagaaguagugguauuggggucccaagagggggcgaugcacaccgcccucacgggagccaccgagauccagaacucaggcggaaccucuaucuuugccggccacuugaagugccgacucaaaauggacaaacucgagcugaagggcaugucuuacgccaugugcacgaacacauucguacugaagaaagaagugagcgagacccagcauggcaccauccucaucaagguggaguauaagggagaggacgucccgugcaagauccccuucagcaccgaggaugggcaggggaaggcgcauaacggccgcuuaaucacggccaaccccguggugaccaagaaagaggagcccgucaauaucgaggcugagccgcccuucggagaguccaauaucgucaucggcauuggcgacaacgcacugaagaucaauugguauaagaaaggcuccucaaucgggaagauguuugaagcgacugcccggggagcccgcagaauggccauacugggcgauacggccugggacuucggcuccgucggcggcguacucaacagccugggcaagauggugcaccaaaucuucggguccgcguacacggcccuguucagcggcguauccugggucaugaaaaucggcaucggaguccuccugacuuggaucggacucaacaguaagaacaccuccaugagcuuuuccugcaucgccauaggcaucauuacucucuacuuaggggccgugguucaggccgacauggggugcgugaucaacuggaagggcaaggagcuaaagugcggcagcgggaucuucgugacgaacgagguccauaccuggaccgagcaguauaaguuccaggcggacagccccaaacgccucgcgaccgccaucgcuggcgccugggagaauggggugugcggcaucagaucaaccacgcgaauggagaaccuauuauggaaacagaucgcgaacgagcucaacuacaucuuaagggaaaauaauauuaagcucaccgucguagugggggacguaaucggcguucucgaacagggcaagcgaacccugacgccccagccgauggagcuaaaauauaguuggaagaccugggggaaggccaagauagugaccgccgagacccagaauaguaguuucaucaucgacggcccgaacacucccgagugucccagcgcaagccgcgcguggaacgugugggaagucgaggacuacggguucggcguuuucaccaccaauaucuggcucaaacuucgagagguguacacccagcugugcgaccaccgcuuaaugagcgcugccgugaaggacgagagggccgugcaugcagacaugggcuacuggaucgagagccagaagaacggguccuggaagcucgagaaggcgucacugaucgaagugaagaccugcacguggccuaaaucccauaccuuauggagcaacggagucuuagaguccgacaugaucaucccaaagagccuggccggacccauaagccaacacaauuacaggccaggcuaccacacccagaccgccgggcccuggcauuugggcaagcuggagcuggacuucaauuacugcgagggcaccaccguggugauuacagagaacugugggacccggggccccagcuuacgaacuaccaccgucuccgggaagcugauccacgagugguguugcaggagcugcacucugcccccgcuucgcuauaugggcgaggacgguugcugguacggcauggagauucgucccaucuccgagaaggaggagaacauggucaaaagccugguaucugcuggaagcggggaggucgacaauuucacgaugggcguguuaugcuuagcaauacuauucgaggaaguaaugcgcgguaaguucggcaagaagcacaugauagcgggaguauuuuucacauucguguugcuccuguccgggcagaucacauggcgggacauggcccacacacugauaaugaucggcagcaacgcgucugaccgcauggggaugggggugacguaccuugccuuaaucgccacuuucaagauccagcccuuccuggcgcucggguucuuccugcggaaguugaccagucgcgagaaccugcugcugggcguggggcucgccauggccaccacgcuacagcugcccgaggacaucgaacagauggccaacggcaucgcccucggccugauggcccugaaguuaaucacccaguucgagacauaccagcuguggaccgcucugauuuccuugacaugcuccaauaccaucuucacuuugacuguggccuggcggacagccacccuaauccucgcgggugucagccugcuccccgucugccaauccagcuccaugcgcaagacugacuggcuccccaugaccguggccgcaaugggcgugccgccccucccguuauuuauauucagccugaaggacacgcugaagcgccgguccuggccccugaacgaggguguaauggccguuggucugguuagcauucuggcuuccagccugcugcgcaacgacgugcccauggcaggaccucugguggccgggggccugcugaucgcaugcuaugucaucaccggcacaucagccgaccuuacgguggagaaggcagcggacguaaccugggaggaagaagccgaacaaaccggcguuucgcacaaccugaugaucaccgucgaugacgacgggacuaugcgaaucaaggacgacgagacugagaacauccucacuguacuguuaaagaccgcccucuuaaucgucuccggcauauuucccuacucaaucccagcgacacugcugguguggcacaccuggcaaaagcagacgcagcgcuccggcguccugugggauguccccucaccgcccgagacgcagaaggccgagcuggaggaggggguguaccggauaaagcaacagggcaucuuugggaagacccaagugggggucggggugcaaaaggagggcguuuuccacaccauguggcacgugacacgcggcgcggugcuaaccuauaacggaaagcggcuggagcccaacugggcgucugugaagaaggacuuaaucagcuauggcgggggcuggcgccuaucugcccaguggcaaaaaggggaggaaguccaagugaucgcuguagagccuggcaagaaccccaagaacuuccagaccaugcccggcaccuuccagacuacgacuggggaaaucggcgcgaucgcccuggauuuuaagcccgggaccagcgggagccccaucaucaauagggagggcaaggucguggggcuguacggcaacggaguagucacgaagaacggaggguacgugucugguaucgcccagaccaaugcggaaccggacggcccuacccccgagcuugaggaggagauguuuaagaagcgcaaccucacuaucauggaccuccacccugggagcggcaagacgcggaaguacuugcccgccauagugcgcgaggcgaucaagcggcgacuccggacccucauccucgcccccacccgugugguggcagcagagauggaagaggcccucaagggauugcccauaagauaccaaacuacggcgaccaaguccgagcacaccggccgcgagaucguggaccugaugugccacgccaccuuuacuaugcggcuucuaagccccgugcgcguaccgaacuacaaccugaucauuauggacgaggcgcacuucacggauccggcauccaucgccgccaggggauacaucagcaccaggguggggaugggcgaggcggccgccaucuucaugaccgcgacgccacccgguaccgccgacgcguuuccgcagucuaacgcacccauccaggaugaggagcgcgacaucccugaaagguccuggaacuccggcaacgaguggauaaccgacuucgccggcaagaccgucugguuuguacccagcaucaaggcuggaaacgacaucgccaacugccuccgcaagaacgggaagaaggugauccagcugucccggaagacguucgauaccgaguaucagaaaacuaagcugaaugauugggacuucguggugaccacggacaucagcgagaugggugcgaacuuuaaggccgaccgagugaucgacccgcgucgcugccucaagccagucauucugacggacggccccgaacgggucauauuagccgggcccaugccgguuacggcggcguccgccgcccagcggcgaggcagaguagggcggaacccccagaaggagaacgaccaguacauauucaccggccaaccucuuaacaacgacgaggaucaugcccacuggaccgaagcaaaaaugcugcuggacaauaucaacacgcccgaggggaucauaccggcccucuucgagcccgaacgcgagaaauccgccgccaucgauggcgaauacagacugaagggugaaagcaggaagaccuucguggagcuaaugaggcgcggggaccuccccgucuggcuggcgcacaaaguggcgucagaaggcaucaaguauaccgaucggaaaugguguuuugacggacagcgcaacaaccagauccuggaagagaauauggacguggagaucuggacaaaggagggagaaaagaagaagcucaggccgcgcuggcucgacgcccgcacauacuccgauccgcuggcccuuaaggaguucaaggacuucgccgcaggccgcaagagcaucgcccuggaccuggucacagagaucggacgagugcccucccaccucgcccaccgcacccgcaaugcccuggacaacuuagugaugcugcacacaucagaacaugggggcaaggccuaccggcacgcgguggaggaacugccagaaaccauggaaacccugcuacuacugggccucaugauccugcugacagggggagcuaugcuauuccugauuagcggcaagggaaucggaaagaccucaaucgggcuaauuugcguuaucgcuucgucuggccuucuguggauggccgaaauuccacugcaguggaucgccagcgccauaguccucgaguucuuuaugauggugcuccuaauccccgaaccugagaagcaacguacgccccaggacaaccagcuugcauacguggugaucggaauccugacucuggccgccaucaucgcugcgaaugagauggggcuccuggagaccaccaaacgggaccugggcaugagcaaggagcccggggucgugagucccacguccuaccucgacguggaccuccaucccgccucggccuggacccuguacgccgucgcgaccaccgugaucacgccaaugcucagacauacuaucgaaaacucaaccgccaacgugagccuggccgccauagcgaaucaagccgucgugcugaugggccuggacaagggguggccgaucuccaagauggacuugggcguuccccugcuagcuuuaggguguuacagccaggucaacccccugacccucaccgccgccgugcuuuuguugaucacacacuaugccaucauaggccccggccugcaagcgaaggccacccgggaggcccagaagcgcaccgccgccgggaucaugaagaacccuacgguggacggcaucaugaccaucgaccuggaccccgucaucuacgacuccaaguucgagaagcaguugggccagguaaugcugcucguguugugcgcgguccagcugcugcucaugcggaccagcugggcucuuugcgaggcgcugacccucgccaccggcccaaucaccacguuaugggagggcucccccgggaaguucuggaacacuacgaucgcggugagcauggcaaauaucuuccgcggcuccuacuuggcaggagccgggcucgcauuuagcaucaugaaguccguggggaccggcaaacggggcacgggcagccaaggcgagacccugggcgagaaguggaaaaagaaacugaaccaacucagccgcaaggaguucgacuuauacaaaaagucugggaucaccgaggucgaccguacggaggcgaaagaagggcucaaaaggggcgagaucacccaccacgcggugagccggggcucagccaagcuccagugguuuguggaaaggaacauggucaucccggaggggcgggucauagacuugggcugugggcgcggcggguggucguacuauugugccggccugaagaaggugaccgaggucagaggcuacaccaagggaggacccgggcaugaggagcccgugcccaugucgacguacggcuggaauauugugaaacuuaugagcgguaaggacgucuucuaccugccacccgaaaagugugacacacuucuaugcgacaucggagagucgucucccucccccacgguagaggaaucccgcacgauacgcgugcuaaagauggucgaaccguggcugaagaauaaucaguucugcaucaaggugcugaaccccuacaugcccacggugguagaacaucucgagcggcuccaacgcaaacacggcgggaugcuggucaggaacccccucucgcgcaacagcacccacgagauguacuggaucuccaacggcacggggaacaucguggcaagcguaaacaugguaucccggcugcugcucaaccgcuucacgaugacgcaccggcgcccgacuaucgagaaggaugucgacuugggcgcgggcacacggcacgucaacgccgaacccgagacccccaauauggacguuauuggggaacguauaaagcggaucaaggaggagcacaacagcaccuggcauuacgacgacgaaaacccuuacaagaccugggccuaucacggguccuaugagguuaaggccaccgggagcgccagcagcaugaucaacggcguggugaaacuguugaccaaacccugggacgucgugcccaugguaacgcagauggcgaugaccgacaccacgccguuugggcagcaacgagucuuuaaggaaaagguagacacgcggacaccacgcuccaugcccggcacgcggcgcgugauggguaucaccgcugaguggcuguggcggacgcuggggcgcaauaagaaaccucgguugugcacgcgcgaggaguucacgaagaagguccgaacuaacgcugcaaugggggcuguguucacggaggaaaaccaaugggacuccgccaaggcggccguggaggacgaggacuucuggaagcucguagaucgggagcgggagcugcacaagcucgggaagugcggcagcugcguguauaacaugauggggaagcgggagaagaaacuuggcgaauuuggcaaggccaaagggaguagagcaauaugguacaugugguuaggcgccagauaccucgaguucgaggcccugggauuccugaacgaggaccauugguuuagccgagagaacuccuacagcggaguggaaggggagggccuacauaagcugggguacauccugagagauauauccaaaauccccgggggugccauguacgccgacgauaccgcggggugggacacccggaucacggaggacgaucuccacaacgaggagaagauaacacagcagauggacccggagcaccgccagcuggcuaacgccaucuuuaagcugacguaucagaauaaggucgugaaggugcagcgccccaccccuaccggcaccgucauggauauaaucucccggaaggaccagcgaggcuccgggcaagugggcacguacggacucaacaccuucaccaauauggaggcccagcugauucgccagauggaaggcgagggggugcuguccaaggccgaucucgaaaacccacgccuuccggagaagaagauaacccaauggcuggaaacgaagggcguagagcggcucaaacgcauggccauuuccggcgacgacugcgugguuaagcccaucgaugaccgguucgcuaacgcgcugcuggccuuaaaugacauggggaagguccgcaaggacaucccccaguggcaaccaagcaagggauggcacgauuggcagcaggucccauucugcagccaucacuuccacgagcugauuaugaaggaugggcggaagcugguggucccaugccggccccaggacgaacucaucggccgggcccguauaucacaaggggcgggcuggucccuucgagaaaccgccugucuuggcaaggccuacgcccaaauguggucgcucauguacuuccacaggcgcgaccucagacucgcuuccaacgcuauuugcucggcuguccccgugcacuggguccccacgucccgcaccacguggagcauacacgcucaccaccaguggaugacgaccgaggacaugcucacgguuuggaacagaguguggaucgaggauaacccguggauggaggacaagacgcccgucacaaccugggagaacguacccuaccucgguaagcgcgaggaccaguggugcggaagccugaucgggcuaaccucccgggcgacaugggcgcagaacauuccgacugccauccagcaggucaggagccucauaggcaaugaggaguuccucgauuacaugcccuccaugaagcgguuccgcaaggaggaggagagcgagggcgccaucugguga

SEQ ID NO: 26043 - RNA, 9873 nt, Artificial Sequence
  derived and/or modified CDS sequence (opt11) from DENV-3__FJ639772__SS-prME
acgagcuugugccucaugaugaucuuacccgccgcccuggcguuucaucucacaucccgggauggggaaccacgcaugaucgucgggaaaaacgaacgcggcaagucgcugcuguucaagaccgccuccgggaucaacaugugcacccugauagcuauggaucugggggaaaugugcgacgacaccguaacguacaagugcccccacaucacggagguagagcccgaggacauagacugcuggugcaaccugacgagcaccugggugacuuacgggaccugcaaccaggccggggagcaccgacgcgauaaacgcuccguggcccucgcgccacaugugggcaugggccuggacacuaggacccagacguggaugagcgcagaaggcgccuggcgccagguggagaaaguggagacgugggcccugcggcacccaggguucaccauccucgcgcuguuccuggcccauuauaucggcaccucccucacccagaagguagugaucuucauccugcucauguuagucacgccuucuaugaccaugcggugcguggggguugguaaccgcgacuucgucgagggacugucaggggcuacauggguggacguuguccuggagcacggcgggugcguaaccaccauggccaaaaauaagcccacccuagauaucgagcugcagaagaccgaggcgacccaauuagcgacgcuccggaagcugugcaucgagggcaaaaucaccaauaucaccacugacagccgcuguccgacgcagggcgaggccguacugccggaggagcaagaccagaacuacgucuguaagcacaccuacguggaccggggguggggcaacgggugcggccucuucgggaaggguucccugguaaccugcgccaaauuccaaugccuggagcccaucgagggaaaggucguccaguacgagaaccucaaguacacagugaucaucacgguacacaccggagaccagcaucaaguuggcaaugagacccagggcgugacugccgagaucacgccccaggccagcacgaccgaagcgauccugcccgaguauggcacccuggggcucgagugcuccccgcgcacaggccuggacuuuaacgagaugauucugcucaccaugaagaauaaggccuggauggugcaccggcagugguucuuugaccugccccugcccuggacaucgggcgcgaccacugaaacgcccacuuggaaccgaaaagaguuacuggugaccuucaagaacgcacacgccaagaagcaggaggucgucguacuggggucccaggagggcgcgaugcacacugcccucacgggagcaacugaaauccagaacagcggcgggacuuccaucuucgccgggcaucuuaagugucgucugaagauggacaaacuugaguuaaaggguaugagcuacgccauguguacgaacacguuuguccugaagaaagagguguccgagacccagcacgggaccauccucaucaagguggaguacaaaggagaggaugcgcccuguaagaucccuuucagcaccgaggaugggcagggcaaggcacacaauggccgccugauuacggccaacccuguggugaccaagaaggaggagccagugaacaucgaggccgagccgcccuucggggagagcaacaucgucauuggcaucggggacaacgcgcugaagaucaacugguauaagaagggcuccagcaucgggaaaauguucgaagccacagcccggggcgccagacggauggccauucuaggggacaccgccugggauuucggguccguaggcgguguccucaacagccugggcaagaugguccaccagaucuuuggguccgccuacacggcgcuguucaguggcguauccugggugaugaagauuggcaucgggguccuccucacguggaucggccuaaauucuaagaacacgaguaugagcuucucauguaucgccaucggaaucaucacccucuauuuaggggccguugugcaagcggacauggggugugugaucaacuggaagggcaaagaacugaagugcgguuccgggaucuucgugacgaacgaggugcacaccuggaccgagcaguacaaguuucaggcagacucccccaagcgccucgcaaccgccaucgccggggcgugggagaacggggucugcggaaucaggagcacgacccggauggagaaccugcuguggaagcagaucgccaacgagcuaaacuacauccugugggagaauaauauuaaguugaccgugguggucggagacauuaucggcgugcuugagcagggcaagcgcacccugacgccccagccgauggaacugaaguacuccuggaagacauggggaaaggccaagaucgugacugcugagacccagaacucuuccuucaucaucgacggacccaacacgcccgagugcccgagcgccucccgggccuggaacgucugggagguggaggacuacggguucggaguguucaccacuaacaucuggcucaagcugcgcgagguuuacacccaacugugcgaccaccggcuuaugagcgccgccguuaaggaugagcgcgcgguccacgcggacaugggcuacuggaucgagagccagaagaacggguccuggaaacuggagaaggccagccugaucgaggucaaaaccugcacguggccgaagucccacacuuugugguccaacggcgugcuugagucagacaugaucauaccuaagucgcucgccgggccuaucucucagcacaacuaccggccgggcuaucacacccagaccgccgggcccuggcaccugggcaaacuagaauuggacuucaacuacugcgagggcacgaccguggucaucaccgagaacugugggacccgaggccccagccuacggacgacuaccgugucagggaagcugauccacgaaugguguugccgcagcugcacccugcccccgcuccgguacaugggcgaagacgggugcugguacgguauggagauccgucccauauccgagaaagaagagaacaugguuaagagccuggucagcgccggcagcggggagguugacaacuucacaaugggggugcucugccucgcgauccuguucgaggagguuaugcggggaaaauucgggaagaagcacaugaucgccggggucuucuucacuuuugugcugcuccuguccggccaaaucacuuggcgugacauggcgcacacccugauaaugaucggcagcaacgcgagugaucggauggggaugggcguaacauaccucgcgcuaaucgcgacauucaagauccagcccuuucuggcccucgguuucuuucugcggaagcugaccagcagggagaaccuccuacugggcguuggccucgccauggcgaccacgcugcaacugcccgaggacaucgagcagauggcaaacgggauagccuuaggccucauggcgcugaaacucaucacccaguucgagaccuaccagcuguggaccgcccugaucagucugacgugcucgaacacgauauucacccuuacggucgcguggcgcacggcgacccugauccucgccggggucucacugcugccugugugccaguccagcuccaugcggaagaccgauuggauccccaugaccguugcagccaugggcgugccgccccucccgcuguuuaucuucagccugaaggauacguugaagcgccgcuccuggccccugaacgagggugugauggccgucggguuggugagcauccuugcuuccagccugcugcggaacgacgugccuauggcagguccgcucgucgccggagggcugcugaucgccugcuaugugaucacggggaccucugccgaucucaccguggagaaggcugccgacgucacgugggaggaggaagcagagcagaccggagugucacacaaccugaugaucacuguagacgacgacgggacuaugcggaucaaggacgacgagacagagaacauccugacgguacuccugaaaacugcccugcugaucgugaguggcaucuucccguacagcauucccgccacacuccugguguggcacacauggcagaagcagacucagcgguccggcguccucugggacgugcccaguccgcccgagacccagaaggcggagcuggaagaggguguguacaggaucaagcagcagggcaucuucgggaagacccagguaggcgugggugugcagaaggagggcgucuuccacaccauguggcacguaacgcgaggcgccgugcugacuuacaacggaaagaggcucgagcccaacugggcgucugucaagaaggaucugaucucuuacggggguggcuggcgguuaucggcccaguggcagaagggggaggagguucaggugauagcggucgagcccggcaagaacccgaagaacuuccagaccaugcccggaacauuccaaacgaccacaggugagauaggggccaucgcgcucgauuucaagccugguaccucugggucgcccauuaucaaccgugagggcaagaucgucgggcucuauggcaacggaguuguuaccaagaacggcggguauguguccgguaucgcacaaaccaacgccgagccggacggccccacacccgaacuggaggaggagauguucaagaaacggaaccugaccaucauggaccuucaccccgggagcggaaaaacgcgcaaguaccugccggcaaucgucagagaggccaucaagcgccggcugcgcacccucauccuggcacccacuagggugguggccgccgagauggaagaagcucugaaggggcuccccauccgcuaccagaccucggcaaccaagucagagcacacgggccgggagauaguggaccugaugugucacgccacuuucaccaugcgccuguuaucaccgguccgggugcccaacuacaaccugaucaucauggacgaggcccacuucacggaucccgcuagcauugcugcccgcggguacaucucaacccggguggggaugggcgaggccgcugccaucuucaugaccgccacgccaccugggacggccgacgcauucccgcaguccaacgccccgauccaggacgaggagcgcgacauccccgaacgcuccuggaacagcggcaacgaguggaucaccgacuucgcggggaagaccguaugguucguacccuccaucaaagccgggaacgacaucgccaacugccugcgaaagaacgggaagaaagugauccagcuaagccguaagacauucgacacggaguaucagaaaaccaaguugaacgacugggacuucgucgugaccaccgacaucuccgagaugggugccaauuucaaggccgaccgggugaucgauccgcgacgcugccugaaacccgucauccucaccgacggccccgagcgcgugauccuggcggggcccaugcccgucacggccgccuccgcagcccagcggagaggccgcgucgggcgcaacccccagaaggagaacgaccaguacaucuucaccggccagccccugaacaacgacgaggaccacgcgcacuggaccgaggccaaaaugcuucuugacaacauaaauacccccgaggguaucaucccggcccuguucgaacccgagcgagagaaauccgccgcgauugauggcgaguaucggcucaagggggagagccggaagacguucguggagcugaugcgacgcggugaccugcccguguggcucgcccacaaggucgccuccgagggcaucaaguacaccgaucgcaaguggugcuuugacgggcaaagaaacaaucagauccuggaggagaacauggacguugaaaucuggaccaaagagggcgagaaaaagaagcugcguccccgguggcucgacgcccgaaccuacagcgacccgcuggcacucaaggaguuuaaagacuucgcggccggccgcaaaucuaucgcccuggauuuagucacggagaucggccgggugccgacgcaccuggcccaccgcacccggaacgcucuggacaaucuggugauguuacacaccucugagcacggcgggaaggcguaccgccacgcggucgaggagcuucccgagacgauggagacccugcugcuccuagggcugaugauccuccugacaggaggggcgaugcuguuucucaucucagguaaggggaucggcaagacuuccaucgggcugaucugcgugaucgcaagcuccggaaugcuguggauggccgaaaucccgcuacaguggaucgcuagcgccaucgugcuggaguucuucaugaugguccuguuaauccccgagcccgaaaagcagcggacgccccaggacaaccagcuagccuacguggugaucgggauccugacccucgcagccauuaucgcggcgaacgagaugggacugcuggagaccaccaagcgcgaccuugguauguccaaggagccgggaguugugucccccacuucauaccuugacguugaccuucaccccgccagcgccuggacccucuacgcgguugccacaacggugauuacgccuaugcugcgccacaccaucgagaacuccaccgcuaacgugucuuuggccgcuaucgcgaaccaggccguggugcucaugggguuggacaaaggguggccgaucuccaaaauggaccugggcgugccccuccuggcucuggggugcuacucccaggucaacccccucacccugacagccgccguacugcucuuaauaacccauuacgcaauaaucggacccgggcugcaggccaaagccacccgcgaggcucagaaacggaccgccgcggggaucaugaaaaacccgacuguagacggcauuaugaccaucgauuuggaccccgucauauacgacuccaaguucgagaagcagcugggccaagugaugcuacucguucugugcgccguccagcugcugcugaugaggacaucuugggcacugugcgaggcucucacccuggcgacgggccccaucaccacgcugugggaagguuccccuggcaaguucuggaacaccacgaucgccgugagcauggcgaacaucuuccggggcuccuaccucgccggggccggccuagcguucagcauuaugaaauccgugggcaccggcaagcgcgguacggggagccaaggcgagacccugggggaaaaguggaagaagaaguugaaccagcugagccgcaaagaguucgaccuguacaagaaguccggaaucaccgaggucgaccgcacggaagccaaggaggggcucaagcgcggcgagauaacccaucacgcuguuagccguggcuccgccaagcugcaaugguucguggagagaaacaugguaauuccggaggggcgcgugaucgaccuaggcugcgggcgggguggguggagcuacuacugcgccggccucaagaaggugaccgaggugcgcggcuacaccaagggcgggcccgggcacgaggaacccgugccgauguccacauacggcuggaacaucgugaagcugaugagcgggaaggaugucuucuaccugccgcccgagaagugcgacacccuccugugcgacaucggagaguccagccccucccccaccguggaggagagccggaccauuaggguccugaaaaugguugagcccuggcugaaaaacaaccaguucugcaucaaggugcucaaccccuauaugcccacuguaaucgagcaccuagagcgccuccagcggaagcacggcgggaugcucguccgcaacccccugucccggaacucgacccacgagauguauuggaucuccaacgggacugguaacaucguggcuagcgucaacauggucucccgccugcuccugaaccgguucaccaugacgcaccgcagaccuaccaucgagaaagauguugaucugggcgccggcacccgccauguuaaugcagagccggaaacccccaacauggacgucaucggggagcggaucaagagaaucaaggaagaacacaacuccacguggcauuacgacgacgagaacccguacaagaccugggcguaucacggcuccuacgaggugaaggcuaccgggagcgccuccaguaugauuaacggcguggucaagcuccugaccaaacccugggacgugguuccgauggugacgcaaauggccaugaccgacacuacuccguucgggcagcagcggguguucaaggagaaggucgacaccaggaccccgcggucuaugcccggcacccgccguguaaugggcauaaccgccgaauggcucuggagaacgcuagggcgcaacaaaaagcccagacuguguacgcgggaggaguucaccaagaaggugcgcacgaacgccgcgaugggagccguauucacggaagagaaccagugggacuccgccaaagcagccguggaggaugaggacuucuggaaguuaguagaccgcgagcgggagcuccacaagcuggggaagugugguagcuguguauauaacaugauggggaaacgcgagaagaagcugggcgaguuuggcaaagcgaaggggagucgggccauaugguauauguggcuuggcgcccgcuaccuugaguucgaggcucugggauuccugaacgaggaccacugguucagccgggagaacuccuauagcggcguggaaggggaagggcugcacaagcugggcuauauccuccgcgacaucuccaagauccccgggggagcgauguaugcagacgacaccgccggcugggacacccggaucacggaggacgaucugcacaacgaggagaaaaucacgcagcaaauggacccggagcacaggcagcuggccaaugccaucuucaagcucaccuaccagaacaagguuguuaaggugcagaggcccaccccaaccggcaccgugauggauaucauuagccgcaaggaccagcgcggcuccggacaggugggcacguacgggcugaacaccuuuaccaacauggaggcccagcugauacgucagauggagggcgaggguguccugagcaaagcggaccuugagaacccgcaucuccccgagaagaagaucacccaguggcuggagacgaagggcguggaacgccucaagcgcauggcgaucuccggcgacgacugcgucgugaaaccgaucgacgaucgguuugccaaugcacugcucgccuugaaugacauggggaaggugcgcaaggacaucccccaguggcagcccagcaaaggcuggcacgacuggcaacaggucccguuuugcucccaucacuuccacgagcugaucaugaaggacgggcggaagcucgucgugcccugccgaccccaagacgaacuaauuggccgggcacgaauuagccagggggcaggcuggagccugcgagagaccgccugccucggcaaggcauaugcgcagauguggucgcugauguacuuccaucgccgcgaccuacguuuagccuccaaugccaucuguagcgccguccccguucacuggguuccgaccucucgcaccacguggucgauccacgcccaucaccaguggaugaccaccgaggacauguugacagucuggaaccggguguggaucgaggacaacccauggauggaggacaagacuccugugaccaccugggagaacgucccuuaccuggggaagcgcgaagaccaguggugcggaagccucaucggccugacgucacgggccacaugggcacagaacauccccacggccauucagcagguccgcagccuaauagggaacgaagaguuccuugauuacaugcccagcaugaagcguuuccgcaaggaggaggaaagcgagggggccauuugguga

SEQ ID NO: 26044 - RNA, 9873 nt, Artificial Sequence
  derived and/or modified CDS sequence (opt11) from DENV-3__FJ639774__SS-prME
accagccuguguuugaugaugauacuaccugccgcgcucgccuuccaccucaccucacgagauggcgaaccgcggaugauagugggcaagaaugaaagagggaaaucucuccuauucaaaacagccuccgggauaaacaugugcacguuaauagcaauggaccuaggggaaaugugcgaugacacgguuacauacaaaugcccacauauaacggaaguagaaccugaagacaucgacugcuggugcaaccuaacuagcacgugggucacauacgggaccuguaaccaagcgggugaacaccgacgggacaaaagaagcgucgcuuuagcaccccacguaggcaugggccuggacacucggacacaaacauggauguccgcagaaggcgcauggcgccaggucgagaagguggaaacgugggcgcuacggcacccuggauucacaauacuggcacuauuucuagcacacuacauagggacgucacuuacgcagaaggucgucauauucauacuccugauguuagugacgcccagcaugacgaugagaugcgucggcguagguaaucgagacuuugucgaaggacuaagcggagccacaugggucgacguuguccuggagcacggagggugcgugacgacaauggccaagaauaaacccacacuagacauugaauugcaaaagacagaggcaacccaacuugcuacacuuagaaagcucugcaucgaagguaaaaucaccaacauaacaaccgauucaagaugccccacucaaggcgaggccguguuaccugaggaacaagaccagaauuacguuuguaagcacacauauguagaucgaggcuggggaaacggaugcggacuauucggaaaagguagccuagucacaugcgccaaauuccaaugccuggaaccuauugaagggaaggucguccaauacgaaaaccuuaaguacacagugaucauaacgguccacacaggugaucaacaccaagugggaaacgaaacucagggggucacggcugagaucacaccccaagcgagcacaacugaagccauauugcccgaauacggcacacucggacuagagugcucgccccgcaccggacuggauuucaacgaaaugauucuccuaacaaugaagaacaaggcauggaugguccaucgacaaugguucuucgauuuaccccucccauggaccucaggcacaaccacagaaacaccgacauggaacaggaaagaacugcucgucacguucaagaacgcucaugcuaagaagcaagagguagucguccuaggaucccaagaaggcgcuaugcacacggcucucacgggcgccacagaaauacaaaauagcggggguacuagcauauucgcaggccaucuaaagugccgccuaaaaauggauaaguuggagcuaaaaggcaugagcuaugcaauguguaccaacacguucguccucaagaaagaaguaucagagacccagcacggaaccauucuaaucaagguggaauacaaaggugaagacguaccaugcaaaauucccuucaguaccgaagacggucaggggaaggcgcacaacggcagacugaucaccgcgaaucccgugguaacaaagaaggaagaaccaguaaacaucgaggcggaaccaccuuuuggcgaguccaacaucgugaucgggaucggagacaacgcacugaagauaaacugguacaagaaaggcagcuccauagggaaaauguucgaagcgaccgcuagaggggccagacgaauggcaauccuaggagauacagccugggacuuuggguccguagggggaguccucaauucucuagguaagaugguacaccaaaucuucggaagugccuacacagcgcuauucagcggugucagcugggucaugaagauagguauaggcguacuacuaacauggaucggguuaaacaguaagaacaccagcaugucguucucgugcauagcaauaggaaucauuacccuauaccuaggcgcaguugugcaggccgauaugggcugcgucauuaauuggaaaggaaaagaacucaagugcggcuccgguauauucguuaccaacgaggugcacacguggacugaacaauacaaauuccaagcagauagcccgaaacgauuagccacggcaaucgcgggugccugggaaaacggcguaugcgggauacguagcacaacucgaauggaaaaccuacucuggaaacagauagccaacgaauugaacuacauccugugggaaaacaauauaaaacucaccgucgucgucggggacauaauuggcguacucgagcagggaaagcgaacguuaacgccacaaccaauggaauugaaauauuccuggaagacaugggggaaggcaaaaauaguaaccgcagagacacaaaacuccagcuucaucauagauggacccaacacaccagagugccccaacgcaaguagagcauggaacgucugggaggucgaagacuacggguucggagucuucaccaccaauauuugguugaaacuccgagaagucuauacccaacuaugcgaccaccgucugaugagugcugcagucaaggacgagcgggcaguacacgcagauaugggcuacuggaucgaaagccagaagaacggcucguggaagcucgaaaaagccucacuaauugagguaaaaacgugcaccuggccaaagucacacacgcugugguccaauggcguuuuggaaagcgauaugaucauuccuaaaagccucgcggggccgauaagucagcacaacuauaggccgggguaccauacacaaacggcaggcccauggcaucuagggaaacuugaacuagacuuuaacuacugugaggguacaacggucguaaucacggaaaacugugggacgagaggcccgucccugaggacgacgaccguauccgggaaacucauacacgaauggugcugcagguccugcacauugccaccguuaagauacaugggagaagaugggugcugguacggaauggagaucagaccuaucagcgaaaaagaggagaacaugguuaagagccucguaucagccggguccggagaggucgacaacuucaccaugggaguucuaugccuagcgauacuauucgaagaaguaaugcgaggaaaauuugguaaaaagcacaugaucgccggagucuucuucacuuucgugcuauuacucuccgggcagaucaccuggcgggacauggcccauacgcugauuaugaucggaagcaacgccucagacaggaugggaaugggggugacauacuuagcccugauagcuaccuuuaagauccagccguuucucgcacugggguucuuuuuacgcaaacuuaccagccgggagaaucugcuguugggaguggggcuagcaauggcaacgacucugcagcuacccgaggauauagagcaaauggccaacgguaucgccuuaggccuaauggcucuaaagcucaucacccaguucgagacguaccaacuguggacggcuuuaauaucccuaacgugcucaaacaccauauucacgcugacgguagcuuggaggaccgccacccuaaucuuagcgggggucagucuccugccgguaugccaaagcuccucgaugcgaaaaaccgacuggcuaccuaugacugucgcagcaaugggggucccgccacugccacuauucauauucagccugaaagacacacuaaagagaagaaguuggccacuaaacgagggcgucauggcaguuggucuagucucaauacuagcuucgucccuccuacgcaaugacguccccauggcuggacccuuggucgcggguggacuacuaauugcaugcuaugugauuaccgggacgucagcagaccugacgguugaaaaagccgcagacguuaccugggaagaggaggccgagcaaacaggcgugagccacaauuuaaugaucaccgucgaugacgacggaaccaugcgcauaaaggacgacgaaaccgagaacauccugacgguccuuuuaaagacagcacuucucauaguauccggcaucuucccauacaguauaccagcgacccuccucguuuggcacaccuggcaaaaacagacgcagcgaucaggcgugcucugggacgugccaagucccccggaaacccaaaaggccgagcuagaagagggugucuacagaauaaaacaacaaggaaucuuugggaaaacacaagugggagucggaguacaaaaggagggagucuuccacacaauguggcacgugacccgaggcgcuguacuaacauauaacggcaaaagacuagaaccaaacugggcaaguguaaagaaagaccucauuucauacgguggggguuggaggcuaucagcgcaauggcagaaaggggaagagguacaaguaauagccgucgagcccggaaagaaccccaaaaacuuucaaaccaugcccgguaccuuccagacaacaacaggagaaaucggagcuauagcacucgacuucaagccggggaccucagggucccccauaaucaaccgggagggaaagguagugggucucuacgguaauggaguagugacgaaaaaugggggauaugugagcgggaucgcacaaacuaaugcggaacccgacgggcccacaccagagcuagaggaagagauguucaagaaacgaaaccuaacaauuauggaccuccacccaggcuccggcaagacaagaaaguaucuaccggccauagugagggaagcuaucaagcggagacugagaacgcucauacuggcacccacccgagugguugcugcagagauggaagaggcccugaaaggccugccgaucagauaccagacaacugccacaaaaucagaacacacaggccgagagauaguagacuuaaugugccacgcgaccuucacgaugcggcugcuuagcccgguucgugugccaaacuacaaucuuauaaucauggaugaagcacacuucacagaucccgcaagcauagccgcacggggcuacaucagcacccgcguugguaugggcgaggccgcugccauuuucaugaccgcaaccccuccagggaccgcagacgcauucccacaaagcaacgcgcccauccaggacgaagaacgagacaucccggagagaagcuggaauagcgggaaugaauggauuaccgacuuugcagggaagaccgugugguucgucccgaguauaaaagcugggaacgacaucgcaaauugccuccggaaaaaugguaagaaagucauacaacugucgagaaaaacauucgacacagaauaccagaaaacgaaacucaaugacugggacuucguagugacaaccgacauuucggagaugggcgccaacuucaaagcggaccgagucaucgacccaagaaggugccuaaaaccugucauacucacggacggcccagaaaggguuaucuuggccgggccaaugccaguuacagccgcgagcgcagcacagagaagaggacgcguugggcgaaacccgcaaaaggaaaacgaucaguacauauucacagggcagccacugaacaaugaugaagaccacgcccauuggacagaggccaaaauguuacuggacaacaucaauaccccagaaggaaucauaccggcguuguucgagcccgagagggaaaaaucggcggcaaucgauggcgaguaccggcuaaaaggcgaaucucgcaaaaccuucgucgaauuaaugaggcgcggggacuuaccgguauggcucgcccacaaaguagccuccgaaggcauaaaauacacggaccgcaaguggugcuuugacgggcaacgcaacaaucaaauacuagaggagaacauggacgucgagaucuggaccaaggagggcgaacgaaagaaguuacgaccccgguggcuugaugcacgcaccuacucggacccccucgcacuaaaggaauuuaaggacuucgcagcgggccguaaguccauagcucuagaccucgucacugaaauuggcagagucccuacacaccuagcucaccgaaccagaaaugcgcuugacaaucuagugaugcuacacacgucagaacacggaggaaaggccuacagacaugcagucgaggaauugccagagacgauggagacgcuccugcuacucggucuaaugauccuucucacuggaggagccaugcucuuucuaauuaguggcaaagggaucggcaagacgucgaucggccugauuugcguaaucgccucuucuggcaugcuauggauggcugaaauaccucuacaauggauagcgucggcgaucguccuagaauuuuucaugauggugcuccucauaccagaaccggagaaacaacgaaccccacaagacaaccagcucgcuuacguaguaauugguauccucacacuggcggccauaauugcggcaaaugaaaugggucuucucgagacaacgaaaagggaccucggcaugucaaaggaaccagggguagucucccccacaagcuaccuagacguggaccugcaccccgcgagugccuggacgcuauacgcggucgcgacgacaguuaucacuccgaugcuccgacacaccauagaaaacuccaccgccaaugugagucucgccgcgauagccaaucaagccguagugcuaaugggccucgacaaaggcuggccaauaagcaaaauggaccucggugucccauuacuggcauuaggcugcuacucccaagucaauccauugacacuaacagccgcaguacuacuacucaucacccacuacgccauaaucggucccgggcuucaagcgaaagccacccgggaggcacagaaaaggacggccgcuggaaucaugaagaacccaacugucgacggaauuaugaccaucgaucuggacccggugaucuaugacucaaaguucgaaaagcaauugggacaaguaaugcugcuaguacucugcgcaguacaauugcuacuuaugagaacaagcugggcacuaugcgaagcccugacucuggcgaccggcccaauaacaacucucugggaagggucuccaggcaaguucuggaacacaaccauagcaguaagcauggccaauaucuuccgaggaagcuaucuagcuggcgcaggauuagcguucagcaucaugaaaagcgucggcaccggcaaacgcggcaccgggucccaaggugaaacucuuggagaaaaauggaagaagaaacuaaaccaguugagucgcaaagaguucgaucuguauaagaaaagcgguauuaccgagguggaccgcacugaggccaaagaaggucugaaacgaggcgaaaucacacaccacgcagucagcagaggauccgcaaaacuacagugguucguagaaagaaacauggucauaccggaaggacgcgugauugaccuuggcugcggcagaggcggcuggaguuacuacugcgcgggguugaagaaaguaacggagguccgcggauacacgaaagggggcccgggccaugaggagcccguaccgaugucgacguauggguggaacaucguaaaacugaugaguggcaaagacgucuucuaucugccgcccgagaaaugugacacacuuuuaugcgacauaggggagagcucgccgagcccaaccguggaagaaagccgaacaauacgagucuuaaaaaugguagaacccuggcucaaaaacaaccaauucugcaucaagguauuaaauccauacaugccggcuguaauagaacaccuagaacgccugcaacgaaaacauggggguaugcuugugcguaacccacuaagcaggaacucgacucacgaaauguacuggaucuccaacggaaccggcaacaucguggcgagcgugaacauggugucgcggcuucuacuaaauagauuuaccaugacacaucgacgcccaaccauagaaaaagacguggacuugggagcggggacccgacacguuaacgcagagccagaaacacccaacauggaugugauaggcgagcggauuaaaaggauaaaagaggaacacaacaguacauggcauuacgacgacgagaauccauacaaaacgugggcuuaccacggaucauaugagguaaaggcgaccggguccgcaaguagcaugauaaaugguguagucaaacuguugacgaagccaugggacgugguaccaauggugacccaaauggcaaugacggacacgacccccuucggccaacagcggguauucaaggagaagguugacacgcggacuccucguuccaugccuggaacaaggagaguaauggggaucacagcagaaugguuguggcggacguuagggaggaacaagaaaccuaggcucugcacacgcgaagaauuuacgaagaaaguucguaccaaugcggccaugggcgcgguguucaccgaggagaaucaaugggauagugcaaaagcagcgguagaggacgaagacuucuggaaacuggucgacagggaacgggaacuacacaaacuagguaagugcgguucaugcgucuauaacaugauggggaaaagggagaaaaagcucggcgaguucggaaaagcaaaagggagcagggccaucugguacauguggcuaggagcacgcuaccuagaguucgaggcccucgguuucuuaaacgaagaccacugguucucacgagaaaauagcuacuccgggguugaaggugaaggacuccauaaacuaggauacauccuuagagacaucagcaagauaccaggcggggcuauguacgcagacgacacggcagggugggauacacgaauaaccgaagacgaucuccauaaugaggagaaaaucacccaacagauggaccccgaacaccgccaacuggcuaaugccauuuuuaagcugaccuaccaaaacaaaguggugaaggugcaacgcccgacccccacagggacugugauggacauaauaagucgcaaagaccagcgcggguccggucagguagggacguacggccuuaacaccuucaccaauauggaggcucagcucaucagacaaauggagggcgaggggguucucucaaaagcagaccuagaaaacccgcaucugccggagaaaaagauuacccaauggcucgagacgaaggggguggaacgccugaagagaauggcgauuucgggggacgacugcguagugaagcccaucgacgauagauucgcaaacgcccuucuagcacuaaacgacaugggaaagguaagaaaggacaucccacaguggcaacccaguaaaggauggcacgacuggcaacagguaccauucugcagccaccacuuccacgagcucauaaugaaggauggccgaaagcuagucgugccuugcaggccccaagacgaacuuauagggcgcgcgagaauuucacaaggugcuggguggucgcuccgagagacggcaugccucggaaaagcauacgcacagauguggagccuaauguacuuccauagaagagaccuccggcuugcgucaaacgccauaugcagcgcuguccccguacacuggguaccaaccuccaggaccacauggagcauacacgcacaucaccaauggaugacuacugaagacaugcugaccguauggaaccgggucuggaucgaggacaauccguggauggaagacaaaacgcccguaaccacaugggaaaacgugcccuaccugggcaagagagaagaccaauggugugggagccucaucggcuugacaucccgcgcaacgugggcccaaaauaucccuacggcaauccaacaggugcgaagccucaucggaaacgaagaguuucuagacuauaugccguccaugaagcgauucagaaaggaggaagagucugaaggcgccauaugguaa

SEQ ID NO: 26045 - RNA, 9873 nt, Artificial Sequence
  derived and/or modified CDS sequence (opt11) from DENV-3__FJ639775__SS-prME
accucacugugucucaugaugauccugcccgccgccuuggcguuccaccucacuucgcgagacggggaaccccggaugauuguggggaagaacgagcgcggcaaaagccugcuguucaagacggccuccgggaucaacauguguacccucauagccauggaccugggcgagaugugugacgacaccgugaccuacaagugcccgcacaucacggaaguggagcccgaggacaucgacugcugguguaaccugaccagcaccugggugaccuacgggacgugcaaccaggccggcgagcaccggcgcgacaaacgguccguugcgcucgcgccgcacguggggaugggcuuagacacgagaacccagaccuggaugagcgcggaaggcgccuggcgacagguagagaagguugagacgugggcccugcggcauccgggguucaccauuuuagcgcuguuccuggcccauuacaucggcaccucccucacccagaagguugugauuuuuauccuguugaugcucgucacgcccucgaugaccaugcggugcgugggggugggcaaccgcgacuucgucgagggccuguccggggcaaccuggguagacgucguccuggagcacggcggcugcgugaccacgauggccaaaaacaagcccacccucgacauagagcugcagaagaccgaggccacccaacuggcgacacuccggaagcugugcauugagggcaagaucaccaacaucaccaccgacagccgaugcccuacgcagggugaagccguccugccagaggaacaagaccagaauuacgucugcaaacacaccuauguggaucguggcuggggcaauggguguggccucuucgggaagggcuccuuggugaccugcgcuaaauuucagugccuggagcccauagaggggaaggucgugcaguacgagaaccucaaguacacgguaaucaucacggugcacaccggagaccagcaccaagugggcaacgagacccagggggucaccgcugagaucacgccccaggccaguaccaccgaggcgauccugcccgaguacggcacucuggggcucgagugcucaccgcgcaccggccuagauuucaacgagaugauccuguugacgaugaagaacaaggccuggauggugcaccggcagugguucuuugaucuuccccugcccuggaccucaggcgcaaccaccgaaacuccuaccuggaaccgcaaggagcuccuggugaccuucaagaacgcccacgccaagaagcaggagguugugguucuggggucccaggagggagcgaugcacaccgcgcucacgggggccaccgagauccaaaauaguggcggcacguccauuuucgccggacaccugaagugccgguugaagauggacaagcucgagcugaagggcaugagcuacgcuaugugcacgaacaccuuuguauuaaagaaggaagugucagagacccaacacgggaccauccucaucaagguggaauacaaaggggaggaugucccgugcaagauccccuucagcaccgaggacggacagggcaaggcgcauaacggcaggcugaucacggccaaucccguggugacuaagaaggaggagcccgucaauaucgaggcugagccaccauucggggagagcaacaucgugaucggcauuggcgacaacgcccugaagaucaacugguacaagaaaggcucgucgaucgggaaaauguucgaggcgaccgccagaggcgcccgacguauggccauucugggcgacacggccugggacuuugggucaguuggcggcguccucaacucgcugggcaagauggugcaccagaucuucgggagugccuacacggcccuuuucagcggcguguccugggucaugaagauaggcaucgguguccugcugaccuggaucggccugaacagcaagaacaccuccaugagcuucagcugcaucgccaucgggaucaucacccucuaccugggcgccguggugcaggccgacauggggugcgugaucaacuggaagggcaaggagcugaagugcggcagcgggauuuucgugacgaacgagguccacacauggaccgagcaguauaaguuccaagcggacucccccaaacgccucgccaccgcuaucgcuggcgccugggaaaacggggugugcggcauucgcuccaccacucggauggagaaccuucuguggaagcaaauagcgaacgagcucaacuacaucuuaugggagaacaacaucaaacugacuguggucguaggugauaucaucggcgugcuagagcaggggaagaggacccucacaccccagccgauggagcugaaguacuccuggaagaccugggggaaggccaagauugucaccgcggagacccaaaauagcuccuuuaucaucgacggcccaaacacgcccgaaugcccuagcgcaucccgggcguggaacguaugggaaguggaggacuacgguuucggugucuucaccacgaacaucugguugaagcugcgcgaggucuacacccagcugugcgaucaccggcucaugagcgccgccgugaaggacgaacgcgccguucacgccgacaugggguauuggaucgagagccaaaagaauggguccuggaagcuggagaaggcgagccugaucgaagugaagaccugcacguggcccaagucccacacccucuggagcaacggcgugcuggaguccgauaugaucauucccaagagccuggcagggcccaucucgcagcauaacuaucggccgggcuaccacacccagaccgccgggccuuggcaccugggcaagcuggagcuggacuuuaacuacugcgagggcacgaccgucgugauuaccgaaaacugcggaacccgcggccccagccugcggacaaccaccgugagcggaaaguuaauacacgaguggugcugccgcagcugcacgcugcccccgcuccgguacaugggugaggacggguguugguacggaauggagauccguccgaucuccgagaaggaggaaaacauggucaagagccugguauccgcggggucgggggagguagacaacuucacgaugggcgucuuaugccucgccauccuguucgaggaggugaugcggggcaaauucggaaagaagcacaugaucgcgggaguguucuuuaccuucguccuacugcuguccggccagaucacuuggagagacauggcccacacccugauuaugauuggcucaaacgccagcgaccggauggggaugggcgugacguaucucgcccucauagccacauucaagauccagccguuccuggcgcucggguucuuccugcgcaagcugaccagccgggagaaccuccuacugggagugggccuagcuauggccacaacgcugcagcugcccgaggauaucgagcagauggcaaacggaaucgcccucggccugauggcccugaaacucaucacccaguucgaaacguaucagcuguggaccgcucugaucucauugacguguuccaauaccaucuuuacucugacugucgcuuggcguaccgccacccuuauccucgcgggcgugagccugcugccagucugucaguccagcuccaugcguaagacagacuggcugcccaugaccguggcugcgaugggcgugccgccacucccucuguucauauuuagccuaaaggacacgcugaagagacgcuccuggccccucaaugagggugucauggccguggguuuagugagcauccuggccuccagccugcuccggaacgacgucccaauggcgggcccccugguugccgggggccuccucauagccugcuaugugaucacuggaaccuccgccgaccuuaccguggagaaggccgcggaugucacgugggaggaggaggccgagcagaccggggugucacauaaccuaaugaucacaguugacgacgaugggaccaugcgcaucaaggaugacgaaaccgagaacauccuuacggugcuucugaagaccgcccuccuuauagugagcgggaucuucccguauucuauccccgccacucugcuagucuggcacaccuggcagaagcagacgcagcgguccggcgugcucugggaugugcccuccccgcccgagacccagaaggccgaauuggaggaggggguguaccgcaucaagcagcagggcauauuugggaagacucaggucggcguggggguucagaaggagggcguguuucacaccauguggcacgugacgcggggcgcaguucuuaccuacaacgguaagcgccuggagcccaacugggccagcgugaagaaagaccugaucaguuacgguggaggcuggcggcucuccgcucaguggcagaaaggggaggaggugcagguuaucgcaguggaaccgggcaagaaccccaaaaacuuccagacgaugcccggcaccuuccagacgacaacuggagagauuggagcgauagcacuugacuucaagccggggaccaguggcagcccaaucaucaaccgcgaagguaagguggucgggcuguacggcaacgggguggugacgaagaauggcggcuaugucuccggcauagcccaaacaaacgccgagccggacggucccacccccgagcucgaggaggagauguucaaaaagcggaacuuaacuauaauggaccugcaccccgggagcggcaaaacgcgcaaguaccuuccggccauagugcgggaggcuaucaagcggcgacuccgaacccugauccuggcucccacccggguggucgccgccgaaauggaggaagcccucaaaggacugcccauacgcuaccagaccacggcgacgaaguccgagcacaccggacgggagaucguggaccugaugugccaugccaccuuuacgaugaggcuccucagccccgugcgugucccgaacuacaaucugauaaucauggacgaggcccacuuuaccgaccccgccuccaucgccgcgcgcggguacaucagcacacggguaggcaugggggaggccgccgccaucuucaugacugcgacaccgcccggaaccgccgaugccuucccgcaguccaaugcccccauucaggacgaggaacgcgacauccccgagcgcagcuggaacuccggcaacgaguggauaaccgacuucgcugggaagacugugugguucguccccaguauuaaggcggggaacgacauagccaacugccuccggaagaacggcaagaaggugauucaacugucgaggaagacguucgauaccgaguaccagaagacaaaacugaacgacugggacuucguugucaccacggacaucagugagaugggcgccaacuucaaggcagaccggguuaucgacccgagacggugucucaagccaguuauccugaccgacgggcccgagcgcgucauccuggccgggcccaugccugugaccgcagccucagcugcccagcggcgcgggagaguagggcgcaauccccaaaaggagaacgaucaguacauauucaccggccagccccucaauaaugacgaagaucacgcccacuggaccgaggcgaaaaugcugcuggauaacauuaacacgccggaggggauuauacccgcccucuucgaacccgaacgugaaaagucagccgcgauagauggcgaguaccgcuugaagggcgaauccagaaagaccuucguagagcucaugcgccgcggcgaccuccccguguggcuggcgcacaaggucgcaagcgaaggcauaaaguacacugauagaaaaugguguuucgacgggcagcggaacaaucaaauucuagaggagaacauggacgucgaaaucuggacgaaggagggugagaagaagaagcuccgcccuagguggcuagaugcccgcacguacuccgacccguuagcccucaaggaguucaaggacuucgccgcgggccgcaaaagcauagcccuggaccuagugaccgaaauugggcgcguccccucccaccucgcccaccgcacccggaacgcguuggacaacuuggugauguugcacaccagcgagcacggcggaaaggccuaucgccaugcggucgaagaacugcccgagacaauggagacccugcuccuguugggccucaugauccugcuaaccgggggagccaugcuguuccuuaucucagguaaagguaucgggaaaacguccaucgggcugaucugugucaucgccaguaguggaaugcucuggauggccgaaauaccacugcaguggaucgccucggcaauugugcuggaguucuucaugaugguucuccugauaccggagcccgaaaagcagcggacgccacaggacaaccagcuggcauacgucgucaucgggauccucacgcuggcagccauuaucgccgccaaugaaaugggccugcucgagaccaccaagcgcgaccuggguauguccaaggagcccggcgugguuagcccgacguccuacuuagacguggaccuucaccccgccucugccuggacccuguacgccguggcgaccaccgucaucacgccgaugcuacggcauacgauugagaauagcacugccaacgugagccucgccgccaucgccaaucaggcuguggucuuaaugggccuggacaagggguggccgaucucgaagauggaccucggcguaccauuacuggccuuggggugcuacagccagguaaacccccucacacuaacggccgccguccuccuccugaucacucacuacgccaucaucggacccggacuccaagcgaaggccacucgcgaggcccagaagcggaccgcggccgggaucaugaaaaacccgacggucgacgguaucaugaccaucgaccuggaccccgugaucuacgauuccaaguucgagaagcagcugggacaggucaugcuccucgugcugugcgcugugcagcuucuacugaugcgaaccagcugggcccucugcgaggcucugacccuggccaccggccccaucacgacucucugggaggggucccccgguaaguucuggaacaccacgaucgcugugagcauggccaacaucuuccggggcucuuaccuggcuggggcaggccuggcguucagcaucaugaaguccguggggaccggcaagcgcggcaccgggagccaaggcgagaccuugggcgagaaauggaagaagaaacuuaaccagcuuagccggaaagaguucgaccucuacaagaagucugggauuaccgagguggacagaacggaggcgaaggaggggcugaagcgcggcgagauaacucaccacgccgucucacgcggcucggccaaacuucagugguucguggagcggaacauggugauccccgagggucgcgucaucgaccucggcugcgggagagguggguggagcuauuacugcgccggccuuaagaaggugacggagguucgcggcuacaccaaaggcggacccggacacgaggagcccguccccauguccaccuacggcuggaacaucgugaagcugaugagcgggaaggacguauuuuaccucccgcccgagaagugcgauacccugcugugcgacaucggagagucuagccccucccccaccgucgaggagagucggaccauccgggugcugaaaauggucgagccguggcucaagaacaaccaauucuguaucaagguccugaaccccuacaugccgacagugauagagcaccuggagcgccuccagagaaagcacggaggaaugcuagugcgcaacccccugucccguaacucaacccacgagauguacuggaucuccaacggaaccgggaacaucguggccagcgucaacauggugucccgccuccugcugaaccgguucaccaugacucaccggagaccgaccaucgagaaggacgucgaucucggcgcgggcacucggcacgugaaugccgagcccgagacaccgaacauggauguuauaggcgagcgcauaaagagaaucaaggaggagcacaacagcaccuggcacuacgacgacgagaaccccuacaagaccugggccuaccacggcuccuaugaagucaaagcgacgggcagcgccuccagcaugaucaacgggguggucaagcugcuuacgaagcccugggacgugguucccauggucacgcagauggcgaugaccgacaccacccccuuugggcaacaacgggucuucaaggagaaggucgacacgcgcacaccccggagcaugccgggcacccgccgggccaugggcaucaccgccgaguggcucuggcgcacauugggucggaacaagaagccccggcugugcacgcgugaagaguucaccaaaaaggugaggaccaaugccgcgaugggcgccguguucacggaggagaaccagugggacuccgccaaggccgcuguggaggacgaagacuucuggaagcucguugaucgcgagcgggagcugcacaaguuggguaagugcggcagcugcguguacaacaugauggggaagcgagaaaagaaacucggagaguucggaaaggcgaaagggucccgggccauaugguacauguggcugggcgcccgcuaccuggaguucgaggcucucggguuccugaaugaggaccacugguucucccgggagaacuccuacagcggugucgagggggaaggccuacacaagcucggcuauauacugcgcgauaucucuaaaauccccgggggugccauguacgcugacgacaccgcuggaugggacacucgcauuaccgaagaugaccugcacaacgaggagaagaucacccagcaaauggacccagagcaccgccaauuggccaacgccaucuucaagcucaccuaccagaauaaggucgucaagguccaacgcccuacgcccaccggaacugucauggacaucaucagccgcaaggaccagcggggcucaggccaggugggcacguacggcuugaacaccuuuacaaauauggaggcccagcuaauucggcagauggagggcgagggggugcugagcaaggcggaccuggagaauccccaccucccggagaaaaagaucacacaauggcuggagacgaagggugucgagcggcugaagcgcauggcgaucuccggcgaugacugcguagugaagccaauagacgaccgguucgccaacgcccuccuggccuugaacgacaugggaaaggugcguaaagacaucccccaauggcagccuagcaaaggcuggcacgacuggcagcagguaccguucugcucccaccacuuccacgagcucaucaugaaagauggccgcaagcuggugguccccugcaggccccaggacgaguugaucggccgggcacgcaucucccagggagcaggcuggucccuccgggagaccgccugccuaggaaaggcauacgcccagauguggagccugauguacuuccaccgcagggaccuacggcuggcguccaacgccaucugcagcgcagugcccgugcacuggguccccaccucccguaccacguggucaauccacgcccaccaccaauggaugaccaccgaggacaugcuaaccguguggaaccggguauggaucgaggacaaccccuggauggaggacaagacgccggucaccaccugggaaaaugugccguaccuggguaagcgcgaggaccaguggugcggaagccugaucgggcugaccucccgggccacaugggcacagaacauaccgaccgccauccaacagguacggagccucaucgggaacgaggaguuccucgacuacaugccgucaaugaagcgguuccgaaaggaggaagagucagagggggcgaucugguaa

SEQ ID NO: 26046 - RNA, 9873 nt, Artificial Sequence
  derived and/or modified CDS sequence (opt11) from DENV-3__FJ639777__SS-prME
accagcuuaugucucaugaugacuuugcccgcagcguuagcguuucaccucacaagccgagacggagaaccacgaaugauagucggcaaaaaugaacgagguaaaucacuccucuucaaaaccgccucugggaucaacaugugcacccuuaucgcuauggaccuuggagaaaugugcgaugacaccguaaccuacaaaugcccgcauaucacggaagucgaaccggaagauauagacuguuggugcaacuugacgaguacuuggguaacuuacggaacguguaaccaagccggagaacaccgccgcgacaaaagaagugucgcacuagcaccccacgugggaauggggcucgacacaagaacgcaaaccuggaugagcgccgaaggggccuggagacaaguagagaaaguggagacgugggcucuccgacacccggguuuuaccauacuugcgcuuuuucucgcccacuacauugguaccucccugacacagaaaguagugaucuucauccuacucaugcuugucacgcccagcaugaccaugcguuguguaggaguagggaaccgggacuuugucgaaggacucagcggagcgacauggguggacgucgugcucgagcacgguggauguguaacgaccauggccaaaaacaaacccacccuggacauagagcugcagaaaacagaagcaacgcaacuggccacucugcgcaaauugugcauugaaggaaaaaucacgaacaucacuaccgacucucgcugccccacacagggagaagcaguacucccggaagaacaggaccagaacuacgucugcaaacauacauacguagaucgcggauggggcaacggcugugggcuuuucggaaaaggauccuuaguuacgugugcaaaauuccaaugccuggagcccauagaagguaaaguagugcaguacgagaaucuuaaauacacggucauuaucacaguccauaccggagaccaacaccaagucggcaaugaaacacagggcguaaccgcagagauaaccccucaagcauccaccacagaagcaauccugcccgaauacgguacgcuuggccucgagugcagcccccgcacaggccuugacuucaacgaaaugauucuuuugaccaugaagaacaaggccuggaugguccacagacaaugguucuucgaccuuccacugcccuggacguccggcgcgacuacagagacaccaaccuggaaccgcaaggaacuacuuguuaccuucaagaacgcgcacgcgaagaagcaagaagucgucgugcugggcucacaggaaggugcgaugcacacagcccucacgggcgcaaccgaaauucaaaauuccggagggaccucaaucuucgcaggacaccucaaaugccgccugaagauggauaagcucgaacuaaagggaaugucauacgccaugugcacaaacacauuuguccugaagaaggagguaagcgaaacccaacacggcacgauccuaauaaaaguggaauacaagggggaagacgucccauguaagauucccuucagcacagaggacggacaagggaaggcucacaacggaaggcugauaacagcgaauccaguugucaccaagaaagaagaacccgugaacauagaagccgaaccgcccuucggggagucaaacauaguuaucgggauuggagacaacgcacucaaaauaaacugguacaagaagggcucaucaaucggaaaaauguucgaagccacugcgcggggagcccggagaauggcaauacugggcgauacagcaugggacuucggcagcgucggaggagugcucaauucccucggcaaaaugguacaccaaaucuucgguagcgcauauacagcguuauucagcggcgucucuugggucaugaaaauagggaucggcguacuccucaccuggauugggcucaacagcaaaaauaccagcaugagcuucuccuguauagcgauaggcauaaucacucuuuaccuuggcgccgucguucaagcagacauggggugcguuauaaacuggaagggcaaagaguuaaagugcggauccggcauauucguaaccaaugaaguccacacuuggacggaacaguauaaguuccaggccgauagcccgaagaggcuggccacugcgaucgccggcgccugggaaaauggaguaugcgguauccgcagcacgacgcggauggagaaucugcuguggaaacaaauagcaaacgaacucaacuacauccucugggagaauaacaucaagcugaccguggucgucggagauauaauagguguacuagaacagggcaaaagaacgcucacaccucaaccaauggagcucaaauauucauggaagaccuggggaaaagcuaaaaucgucgccgccgaaacgcaaaacucgagcuuuaucauagacggccccaacacgcccgaauguccgagcgcaagucgcgccuggaauguaugggaaguagaagauuacggcuucgggguauucacgacgaacaucugguuaaaacuacgcgagguauauacccaacugugcgaccaccgcuugauguccgcagcagucaaagacgagcgugcaguacacgcggauaugggguauuggauagaaagccagaagaacgggucguggaaacuggagaaggcaucguugauugaagugaaaacuuguacuuggccgaaaucgcacacucuguggaguaacggcguucuggaaagcgacaugauaaucccaaagagcuuagcugggcccaucucccaacacaacuaccgccccggauaccacacucaaacagcaggcccauggcaccugggcaagcucgaacuagauuuuaacuacugcgaaggcacuacaguggucauuaccgaaaauugcggaacucgggggccaagccuccgaacaacgaccgugucgggcaaacucauacacgaauggugcugucguuccugcacccugcccccacuacgguacaugggagaggauggaugcugguacggcauggaaaucagacccauuagcgagaaagaggagaacauggucaagucgcuagugucagcaggcucaggcgaaguagauaacuucaccauggggguccugugcuuggccauacucuucgaagaggugaugagaggcaaacuuggaaagaaacauaugaucgcgggcguauucuucacauucguucuccuccugagcggacaaaucacauggagagacauggcacauacccucauaaugauuggcuccaacgccucggauagaaugggaaugggcguaaccuauuuagcauugauagccacauucaaaauucaaccguuccuggcccuagguuucuuccuccgaaaacuuacgucucgagaaaaucuacuacuagggguaggacuagcaauggcaaccacccuccaacuaccugaggacauagaacagauggcaaacggaauagcgcucggacuuauggcccuaaaacugaucacgcaauucgaaacuuaccaacuauggacggcccuaaucucacugaccuguuccaauacaauuuuuaccuugaccguggccuggcgaaccgcgacacucauacucgcggguguaucccuacugcccguaugccagagcagcagcaugaggaagaccgacuggcuaccgaugaccguagcagcuaugggcgucccuccacugccacuauuuaucuuuucccucaaagauaccuuaaagcgucgguccuggccccuuaacgaaggugucauggcagucgggcucgugagcauacuggcaagcucacugcuuaggaaugacguccccauggccggaccccucguugcgggcggccuccuaauagcgugcuacguaauaaccggaacaagcgcggaccuaacgguagagaaagccgcggaugugaccugggaggaagaagcagagcagaccggagugucccacaaccuaaugauaaccguagacgacgacggaacaaugcggauaaaagacgaugagacugaaaauauccuuacgguuuuguugaaaacagcgcugcuaaucguaucagguaucuuucccuacuccauaccagcgacauuguuaguguggcacacauggcagaagcaaacacagcgaucaggagucuuaugggacgucccgagcccaccagaaacucaaaaagcggagcucgaggaggggguuuaccguaucaaacagcagggaauuuuuggaaaaacgcaagucggagugggaguacagaaggaaggcgucuuccacaccauguggcacgugaccagaggugcaguucucacauauaaugggaagcgucuagagcccaauugggcgagcgucaagaaagaucugauaucuuacgggggaggcuggcguuuaaacgcucaauggcaaaagggagaagaaguccaaguaauagcagucgagccuggcaaaaaccccaaaaacuuucaaacaaugccaggaacauuccaaaccaccacgggcgagaucggagccauugcgcucgacuuuaagccugggacgagugggucccccauaauaaaucgagaagguaaaguggucgggcucuacgguaacggcguggucacuaaaaacggaggguacgucagcggcaucgcucagacaaacgccgagccggacggacccacuccagaacucgaagaggagauguucaaaaagcgcaaucuuacaaucauggaccuacacccgggguccgggaaaacacgaaaguauuuaccugcgaucguaagggaagcaaucaagcgacgacugcgcacccugauucucgcccccacucgaguagucgccgccgagauggaagaagcgcuaaagggacuucccauaagguaccaaacaaccgcaaccaaaucggaacacacaggccgggaaaucguugaccuaaugugucacgccacguucaccaugcgacuacucucaccaguacgaguccccaacuacaaccucauaaucauggacgaagcccacuuuaccgaccccgcuagcauugccgcuaggggcuacaucucaacccgaguaggcaugggcgaagcagccgccauuuuuaugacagcgacuccaccgggaacggcggacgcauuuccucagagcaacgcgccuauccaagacgaagaacgggacauccccgagcgaaguuggaacucagggaacgaauggaucacagacuucgccggcaaaaccgugugguuuguacccagcauaaaagccggcaaugacauagcgaacugccuaaggaaaaacggcaagaaagugauucaacucucacgcaagacauuugacaccgaguaccagaaaacaaaacuaaaugacugggacuucguaguaacuaccgacaucagcgaaaugggggcaaauuuuaaggcagacagagugauagacccacgucgcugccucaagccagugauacuuacagacggccccgaacgggugauacucgcaggcccaaucccugucacagcagcaagcgcggcgcaacgcaggggccguguaggccguaacccucaaaaggagaacgaccaguacauuuucacggggcagccccuaaacaacgacgaagaccacgcgcacuggaccgaagccaaaaugcuccuagacaacauaaacacuccggaaggaauuauaccagcguuauucgagccagagcgggaaaagucagcggccaucgauggcgaguaccgauugaaaggcgaaagcaggaaaacauucguagaacuaaugagacgcggagaucugcccgucuggcuggcucauaaagucgccagcgaggguauaaaguacacugaccggaaguggugcuucgacggccaacgaaacaaucaaauccuggaagaaaacauggacguagaaaucuggacgaaagaaggcgaaaagaagaaacugaggccccgguggcuagacgccagaacguacagugacccucucgcccucaaggaguuuaaggacuucgcugcaggcaggaaaucuaucgcgcuagaccuggucaccgaaauuggacgcguccccagucacuuggcccaccguacgcgcaacgcucuugacaaucucgucaugcuccauacaagcgaacauggaggcaaggccuaccgccaugcaguggaagaauuacccgagacuauggagacuuuacuacuuuugggacugaugauccugcucaccggaggggcaaugcuauucuuaauuuccggaaaagguaucgggaaaaccucaaucggucugauaugugucauagcgagcucggguaugcucuggauggcagagaucccauugcaauggaucgccagcgccauaguccuagaguucuucaugauggugcuccugauuccagaacccgagaaacaacgcacaccgcaagacaaccaauuagcguaugucgugauaggaauccucacacucgcggcgauaaucgccgccaaugaaaugggacugcuggaaacuacaaaacgggaccuagggaugucaaaggagccaggaguggucucacccaccagcuaccuugacguugaucuucacccagcaagcgccuggacacuguacgccguugcuacgacggugauaacucccaugcucagacacacgaucgagaacuccaccgccaacguaucccuggccgccaucgcaaaucaggccguaguacuaauggggcucgauaaaggguggccgaucucaaaaauggacuuaggcgugccacuguuggcacuggggugcuauucgcaggucaacccccuaacacuaacugccgcggugcuacuccuaauuacccacuacgccauuauaggaccuggccuccaggccaaggcaacacgagaagcgcagaaaagaacggcagcgggcauuaugaagaacccgacgguggauggcaucaugacuauagaccuugacccgguuauuuaugacucuaaauuugagaagcaacucgggcaaguaaugcuacucguccugugcgccguccagcugcugcugaugcggacgucaugggcacuaugcgaggcucucacccuagcaaccggacccauaacaacccuaugggaggggagccccggaaaguuuuggaacacgaccaucgcggucucgauggccaacaucuuccgugguucguauauagcuggggcagggcuugcauucaguauaaugaaaucaguaggaacgggcaaacgaggaacgggcucucagggcgaaacacucggagagaaguggaagaagaaauugaaucaacucagcaggaaggaguucgaccucuacaagaaguccgggauaaccgaagucgaccggaccgaagcaaaagaaggccuaaaaaggggugagauaacccaccacgcaguaucccggggaucggccaagcugcaaugguucgucgaacgcaauaugguaacacccgaggggagagugaucgaccucggcugcggacgagggggcuggagcuacuauugcgccggccugaagaaagucacagaaguaagaggcuauacgaagggagggcccgggcacgaggaaccaguaccuaugucgaccuauggauggaacauagucaaacucaugucaggcaaggacgucuucuaccucccaccagaaaaaugcgacacacuacuuugcgacauaggcgaaagcagccccagcccaaccguagaagaaucgagaacgauaaggguacuaaagauggucgagccauggcuaaagaacaaccaguucugcaucaaagugcuuaacccuuacaugccuaccgucauagaacaucuagaacgacuacagaggaagcacggggguaugcugguccgaagcccucuguccagaaacucaacccaugaaauguacuggaucucaaacggcacaggaaacauaguagcaagcguaaacauggucucacgccuacuacuuaaccgcuuuaccaugacacacaggcggccuaccauugaaaaagacguggaucuaggcgcagggacccggcacguaaacgcagaaccggagacacccaacauggacguuauuggagaaagaauaaaacguauaaaggaggaacauaacagcaccuggcacuaugacgaugagaacccauauaaaacaugggcauaucacggcagcuacgaaguaaaagccacaggaagugcuaguucaaugauaaacggugucguuaagcuccugacgaaaccgugggaugugguaccuauggucacacaaauggcgaugacggauacgacaccguucggccaacagcgaguguucaaagaaaaaguagacacccgcacgccccgcucaaugcccggaacacguagaguaauggguaucacggcagaauggcuauggcgcacgcuuggacgaaauaagaaaccgcggcucugcacuagggaagaguucaccaaaaaggugcguaccaacgccgcaaugggugccguuuucacagaagaaaaucagugggacucagcaaaagcggcggucgaggaugaagacuucuggaagcuggucgaccgggagcgagaacuccacaggcugggcaaaugugggucauguguuuauaacaugaugggcaaacgagagaagaaauugggagaguucggaaaagccaaggguucuagggcaauaugguauauguggcugggggcgagauaccuggaguucgaagcucuuggcuuccuuaacgaagaccacugguucagccgcgaaaacucuuacagugggguagagggagaaggcuuacacaagcugggguauauccugagggacauaucaaaaauacccggaggcgcaauguaugcagacgauaccgcagggugggauacgcguaucacagaagacgaccuacacaacgaagagaaaauuacgcagcagauggacccagagcaccggcaacuagcuaaugccauauucaaacugacguaucaaaacaaggucgucaaaguacagcgccccacgccaacaggcacgguuauggauauaaucucccggaaggaccagcgcgguucaggacaagugggaaccuacggacugaauacauucacgaacauggaggcccagcucauaagacaaauggagggcgagggcguacuaucgaaagcggaucuugagaacccccaccuccccgagaagaaaauaacacaguggcucgaaacgaaggggguagaaaggcuaaagcguauggcgauuaguggagacgacugcgucgucaaaccuaucgacgaccgauucgcaaacgcccuccucgcccuaaaugauauggguaaagugagaaaagauauaccacaguggcaaccgucuaaaggauggcacgacuggcaacaaguaccuuucugcagccaccauuuucacgagcucauaaugaaagacgggaggaaacuugugguaccaugcagaccgcaggacgaauugauaggcagagcucguaucucacaaggcgccgguuggagccuucgagaaaccgccugucugggcaaagcauacgcgcaaauguggagccuaauguacuuccaccgcagggaccugaggcucgcgaguaaugccaucuguuccgcaguuccggugcacugggugcccaccucccggacuaccuggagcauucacgcacaccaccaguggaugacaacggaagauauguuaacaguauggaacagaguauggaucgaagauaacccuuggauggaggacaaaacccccguaacaaccugggagaaugucccauaccugggaaaacgcgaagaucaaugguguggaagccuaauaggacucacgucacgugcgacuugggcucaaaacauucccacggcuauucagcaaguaaggagcuuaauagguaacgaagaguuccuagauuacaugccgagcaugaagagguuccgaaaagaagaggaaagugagggugcaauaugguaa

SEQ ID NO: 26047 - RNA, 9873 nt, Artificial Sequence
  derived and/or modified CDS sequence (opt11) from DENV-3__FJ639778__SS-prME
accagccugugcuugaugaugauccuucccgccgcccuggcguuccaccucaccucucgggacggcgagccccggaugaucgugggaaagaacgagcgggggaagagcuuacucuucaagacggccagugggaucaacaugugcacccugaucgcgauggaccugggcgagaugugcgacgacaccgugaccuacaagugcccacacaucacggagguggagccagaggauaucgacugcuggugcaaucugaccagcacgugggugaccuacgggacgugcaaccaagccggcgaacacaggcgugacaagcgcagcgucgcguuggcgccccacgucggcauggggcuggacacccgcacccagaccuggaugucagccgagggcgccuggcgccagguggagaagguagagacgugggcacuucgccauccgggguucacuauccucgcgcucuuucuggcccauuauaucggaacgucccucacacagaagguggugauuuuuaucuuguugauguuggucacgcccagcaugacgaugcggugugugggagugggcaacagggacuuuguggagggccuguccggugccaccuggguggacguugucuuagagcacggcggaugcgugaccacgauggccaaaaauaagcccaccuuggacaucgagcugcaaaagaccgaggccacccagcuggcgacacuccgaaagcugugcaucgagggacgcauuaccaacaucacuacugauagcaggugccccacgcagggcgaggccguguugccugaagagcaggaccagaacuacgucuguaaacacacauacgucgaccguggguggggcaacgggugcggccucuucgggaaaggcucccuggugaccugugcuaaauuccagugccuggagcccaucgagggcaaggucgugcaguaugagaaccuaaaguacaccguuauaauuaccguccacaccggcgaucagcaccagguggggaacgagacccagggcgucacagccgagaucacgccccaggcgagcaccaccgaggcgauccugcccgaguacggcaccuuagggcucgaguguuccccgcggacaggauuagauuucaaugagaugauccugcugacuaugaagaacaaagccuggaugguucaccgucagugguucuucgaccugccccuaccguggaccucaggcgccaccaccgagacgccgaccuggaaucggaaggagcucuuagugaccuucaagaacgcucacgcaaagaagcaggaggucguggugcuggggucccaagagggcgcuaugcauaccgcccucacgggggccaccgagauccagaacagcggcgggacuuccaucuucgccggccaccugaagugccgccuuaagauggacaagcucgagcugaaggguaugagcuacgccaugugcaccaacacuuuuguccugaagaaggagguguccgagacccaacacggcaccauccucaucaagguggaguauaaaggcgaagacgucccgugcaagaucccguucagcaccgaggacgggcagggcaaggcgcacaacggccggcugauuacggccaaccccgucgugaccaagaaggaggaacccgucaacaucgaggccgagccgccauuuggggagagcaacaugguuauaggcaucggggacaacgcccugaagaucaacugguacaagaagggcaguaguaucggaaagauguucgaggcgaccgcccgcggugcacguaggauggcgauccugggcgacaccgccugggacuucggguccgugggcggggucuuaaacagccuuggcaagaugguacaccagauuuuugggucagcguacacggcccuguucagcggcguguccugggucaugaagaucggcaucgggguguuacuuaccuggaucggccugaauagcaaaaacaccuccaugucuuucucuugcaucgccaucgggaucaucaccuuguaccugggcgcaguggugcaggcugauaugggaugugugaucaacuggaagggcaaggaacugaagugcggcagcgggaucuucgugacaaacgagguccacacuuggaccgagcaguauaaauuccaggcagacucacccaagcgccucgcgacggccaucgccggagcuugggagaacggggucuguggcauucggagcacgacccggauggagaaccugcuguggaaacagaucgcgaacgagcucaacuacauuuugugggagaacaacaucaaacugaccguggucgucggggacauaaucggugugcucgaacaggguaagcguacccuaacgccccagccgauggagcugaaauacuccuggaagacauggggaaaggccaaaaucgucacugccgagacucaaaauagcuccuucauuauagacggacccaacacaccugagugcccuagcgccucccgcgcguggaaugugugggagguggaggauuacggcuucggugucuucacuacaaacauuuggcucaagcugcgggagguguacacccagcuaugugaucaccgcuuaaugagcgccgccguuaaggaugagcgggccguccacgcugacaugggcuacuggaucgagagccagaaaaacggguccuggaaguuagagaaggcaaguuugauagaggugaagacgugcacuuggccgaagucccacacccucuggagcaacggcgucuuagaguccgacaugaucauccccaaaagcuuggccgguccaauuucccagcacaauuaccgcccgggauaccacacgcagaccgccggcccauggcaucucggcaagcuggagcuggacuuuaacuauugcgagggcacgaccgucgugaucaccgagaacugugggacccgaggacccagcuugcgcacgaccacggugagugggaaguuaauccacgaguggugcugccggagcugcacgcugccaccccuccgcuacaugggcgaggacgggugcugguacggcauggagauccggccaauauccgagaaggaggagaacauggucaagagcuuaguuuccgccggaaguggagaaguggacaacuucacgaugggcgucuuaugucucgccauccuguucgaggaggugaugcgggggaaguucgguaagaagcacaugauagcgggggucuucuucacuuucguacuucuccugaguggccagauuaccuggcgggauauggcgcauacccugaucaugaucggcagcaacgccuccgacaggaugggcaugggggugacguaccucgcccugauugcaaccuucaagauccagcccuuccuggcucucggguucuuccugcggaaacugaccagccgcgagaaccuccugcugggcgugggccucgccauggccacuacgcuucagcugcccgaggacaucgagcagauggccaacgggaucgcuuuaggccugauggcccugaagcucaucacccaauucgaaaccuaccagcuuuggaccgcccugaucagccucacguguuccaacacgaucuucacccugaccgucgccuggcggacggccacccugauccucgcgggugugagccugcuuccugucugccaguccucuucuaugcggaaaaccgacugguugcccaugacuguagccgccaugggaguaccgccccucccgcucuucaucuucagccucaaggauacguuaaaacguagguccuggccacugaacgagggagucauggccguaggccuggugagcauacuggcuuccagucuucucaaaaacgacgucccgauggcgggcccacugguggccggcggccugcucaucgcgugcuacguaaucaccgggacgucggcggacuuaaccgucgagaaggccgcggacguaacgugggaggaagaggccgagcagaccggcgugagccacaaccugaugaucaccgucgacgacgacgggaccaugcguauuaaagacgacgagaccgagaacauccucacggugcuucugaagacggcccuccugaucguauccggcaucuucccauauagcauccccgccaccuugcucgucuggcacaccuggcaaaagcagacccagcgguccggcguucugugggacgugcccagcccgcccgagacccagaaagccgagcuggaggagggcgucuaccgcaucaagcagcagggcaucuucggcaagacucaaguaggcguggggguccagaaggaaggcguguuccacaccauguggcacguuacacggggggcgguccucaccuacaacgggaagcgccuggagccgaacugggccuccguaaagaaggaucuuaucagcuacggcgggggcuggcggcucagcgcccaguggcagaaaggcgaggagguccaagucaucgccguggagcccggcaagaacccaaagaacuuccagaccaugcccggcacguuccagacgacuaccggggagaucggugcgaucgcccuggacuucaagcccgggacgucugggagccccaucauuaacagagagggcaagguagucgggcuauacggcaacgggguugugacgaagaacggcgguuauguguccggcaucgcccagaccaacgcagagccggacggccccacacccgagcuggaagaagagauguucaagaagcggaaccugaccaucauggacuugcaucccggaagcggaaaaacccgcaaauaccugccggccaucgugagggaggcgaucaagcgccggcuccgcacccugauccuggcccccacccggguggucgcagccgagauggaagaagcacucaagggucugcccauacgcuaccagaccacggcuacgaaguccgagcacaccggucgggagaucguugaccuuaugugccacgccacauucaccaugcgccuccugagccccgugcgcgucccuaacuacaaccugaucaucauggacgaagcacauuucaccgaccccgccucgauugccgcgcggggguacaucagcacucggguggguaugggcgaggccgccgccaucuucaugaccgcgacaccgcccgggaccgcagacgccuucccgcagucgaacgccccgauccaagacgaagagcgcgacauccccgagcgcuccuggaacuccggaaacgaauggauaacugacuucgccggaaagaccgugugguucgucccaagcauaaaggcgggcaacgacauagccaacugccuccgaaagaacgggaagaaaguuauccagcugucucgcaagacauucgacacggaauaccagaagacaaagcugaacgauugggacuucguuguaacuacggacaucagcgagaugggcgccaacuucaaagccgaccgggugaucgacccccgcagaugccucaaacccgugaucuugaccgacggccccgagagagugauccuggccgggcccaugccugugaccgcggccuccgccgcccaaagaagaggacggguagggcgaaacccccagaaggagaacgaccaauacauuuucaccggccagccucucaacaacgacgaggaucacgcccacuggaccgaggcgaagaugcuacuggacaacaucaauacgcccgaggggaucaucccagcccucuuugaacccgagcgggagaaguccgccgccaucgacggcgaguaucgucuuaagggcgagucccggaagacuuucguagagcugaugcgacgcggagauuugcccgucuggcuggcgcacaagguggccagcgagggcaucaaguacaccgaccguaagugguguuucgacgggcagcggaacaaccagauucuagaggaaaauauggacguggagaucuggacuaaggagggcgagaagaagaaguugcguccccgguggcucgacgccaggacuuacuccgacccgcucgcccucaaggaauucaaggacuucgcagcgggccgcaagagcaucgcccuggaccuggugaccgagauuggacggguccccacgcaccucgcucaucgcacucggaacgcuuuagacaaucuggugaugcuccacacauccgagcacggaggaaaggccuaccgccaugcgguggaggagcugcccgagaccauggagacccugcuucugcugggucuaaugauccugcugacagggggcgccauguuauuccugaucaguggcaaggggaucggaaagacgucgaucggccugauuugcgucauagcuucgaguggcaugcucuggauggccgagauaccucugcaauggaucgcgagugccauagugcuggaguucuucaugauggugcuccugaucccggagcccgaaaagcaacggacgccccaggacaaccagcuagccuacgucguuaucgggauccucacucuggccgccaucaucgccgcaaacgagaugggccugcucgagaccacuaagcgugaccugggcaugagcaaggagcccgggguggucucccccaccucguaccuugacguggaucuccaccccgccagugcguggacccuuuacgccguugcgaccacggucauuacccccaugcugagacacaccaucgaaaacucuaccgccaacgugucccuggccgcgaucgccaaccaggccguugugcugauggggcuggacaaaggauggccgaucagcaaaauggaccucggcguaccgcuguuggcccuuggguguuauucgcaggugaacccacuaacgcugaccgccgcuguccuccuucugaucacucauuacgccaucaucggccccggacuccaagcgaaggccacccgcgaagcccagaagcggacggccgcugggaucaugaagaacccaaccgucgacgggaucaugacaaucgaccuggacccggucaucuaugauucgaaauucgaaaaacagcuggggcaaguaaugcuccuggugcugugugccgugcaacuucugcugaugcgcaccuccugggcacucugcgaagcgcuuacacuggccaccggcccuaucaccacccuaugggaggguagccccgggaaguucuggaauacgacuaucgcagucucaauggccaauauuuuccgggggagcuaccuggcuggggccgggcucgccuucuccaucaugaaguccgugggaacaggcaagaggggcaccgggucccagggcgagacccucggggagaaguggaagaagaaacugaaccagcugagccgaaaggaguuugaccuuuacaagaaguccggcaucacggagguggaucgcaccgaggcaaaggaagggcugcgucgcggcgagaucacccaccacgccguaucccggggcucggccaagcugcaaugguucguggagcgcaacaugguuauuccggagggacgaguuaucgaccuagguugcggaaggggcgggugguccuacuacugcgccggccuuaagaaggugaccgagguacggggcuacacgaagggcgggccagggcacgaagaacccguccccaugucaacguacggcuggaacaucgugaaacugauguccgguaaggacguauucuaccucccccccgagaagugcgacacucugcugugugacaucggagaaagcucccccucucccaccgucgaggaauccaggaccauccgcguguuaaagaugguggagccguggcucaagaacaaccaguucugcauaaaaguccugaacccuuacaugcccaccgugaucgaacaccuggaacgguuacaaaggaagcacggcgggaugcugguacgaaacccucugucaagaaauagcacacacgagauguacuggaucagcaaugguaccggaaacaucguggcauccgugaacauggugucacgccuccuucugaaucgcuucacgaugacucaccgacgcccgaccauugagaaggacgucgaucucggcgcgggcacccggcacgugaacgcugagccggagacaccuaacauggaugugaucggggaacgcauaaagcggauuaaggaagagcacaacuccaccuggcacuacgacgacgaaaacccguauaagacgugggcauaccacgguagcuacgagguaaaggccacaggguccgccaguaguaugauaaacggcguaguaaagcugcugacgaagcccugggacgucguucccauggucacccagauggcgaugacggauacuacgcccuuuggacagcaacgcguguucaaggagaaggucgacacccggacgccgcgcuccaugcccgguaccaggcgcgucaugggcauuacugccgaguggcucuggcggacccuggggcgcaacaagaagcccaggcugugcacccgcgaggaguucacaaagaaggugagaacuaacgccgccaugggagcuguguuuaccgaggagaaccagugggacucggccaaggcugccguggaggaugaggacuuuuggaagcucguggaccgagagcgcgagcugcacaagcucgggaagugcggcuccugcguguacaacaugaugggcaagcgagagaagaagcucggcgaauucggcaaggcuaagggcagccgcgcgauaugguacauguggcugggcgcccgguaccuggaguucgaagcccucggguuccugaacgaggaccacugguucucccgggagaacagcuacagcggggucgagggggagggacugcacaagcuaggcuauauccugcgggacaucagcaagauccccgggggcgcuauguacgccgaugacaccgcggggugggacacacgcaucacggaggacgaccuucacaacgaggagaagauaacccagcagauggacccggagcaccggcagcucgccaacgccaucuuuaagcugaccuaccagaacaaggucgugaagguccagcggcccaccccaaccggcacggugauggacaucaucucacgcaaggaucagcgcggcagcggccaaguggggacauacgggcugaauaccuucacuaacauggaggcccagcucauccggcagauggagggcgagggggucuuauccaaggccgaccuggaaaacccccaucuaccggaaaagaagaucacgcaauggcuggagaccaaaggcguggagcgccugaagcggauggcgauuaguggcgacgacuguguggucaagccaaucgacgaccgcuucgccaaugcccuccuggcucugaacgacauggggaaggugaggaaagacaucccccaguggcagccguccaaaggcuggcaugauuggcagcaggugcccuucuguagccaccauuuccacgagcucauuaugaaggacgggcgcaagcugguagugccgugcagaccccaggacgaguugaucggccgcgcacggaucucacaaggggcaggcugguccuuacgcgagaccgcgugccuggguaaggccuacgcccagauguggucccugauguacuuccaccgccgggaccuccgccuggcgucgaaugccaucugcuccgccguaccaguccacugggugccaaccagccggacgaccugguccauccacgcccaccaccaguggaugaccaccgaggacauguuaacuguguggaaccguguguggauugaggacaacccuuggauggaggauaagacccccgugaccaccugggagaacguucccuaccucgggaagcgggaggaccagugguguggcagccugauaggacugacgucccgcgcaaccugggcgcagaacauaccgaccgccauccaacagguccggucccucauuggcaacgaggaguuccuggacuacaugccuagcaugaagcgcuuucgcaaagaagaggaguccgaaggggccaucugguaa

SEQ ID NO: 26048 - RNA, 9873 nt, Artificial Sequence
  derived and/or modified CDS sequence (opt11) from DENV-3__FJ639779__SS-prME
accagccugugccucaugaugauccugcccgcggccuuggcguuucaccucaccagccgggacggcgagccccggaugaucgucgggaagaacgagcgggggaaaagccuguuauucaagacggcgagcgguauaaacaugugcacccucauugccauggaccugggcgagaugugcgacgacaccgugaccuacaaguguccccacaucaccgagguggagcccgaagacauagacuguugguguaaccugaccagcaccugggugacguacgguacgugcaaucaggccggcgagcaccggcgcgauaagcggagcguggccuuggcaccccacgugggcauggggcuggauacccgcacccagacauggaugagcgccgagggcgccuggcgccagguggagaaggucgagacgugggcccugcgccacccgggguucaccauccucgcacuguuccuggcccacuacaucggcaccucccucacccagaaggucguaaucuucauccugcugauguuagucacgccgagcaugaccaugcggugcgugggcgugggcaaccgagacuucgucgagggucugucuggggccacguggguggacguggucuuggagcauggcgggugcgugacgacgauggccaagaacaagccuacccucgauaucgagcugcaaaagacggaggccacccagcuggcgacgcuccgaaaacuuugcauagaagggaagaucaccaacaucaccaccgacucccgcugccccacgcagggcgaggccgugcugccggaggagcaggaccagaacuacgucugcaagcacaccuacguggaccggggcuggggcaacggaugcggccucuucgggaagggcagccuagugaccugcgccaaguuccagugccuagagcccauugagggcaaggucguacaguacgagaaccuuaaguacaccgugaucaucacgguccauaccggggaccagcaucaggugggcaaugagacccagggggugaccgccgagaucacgccccaagcaagcaccaccgaggcgauccugcccgaguacggcacccugggacucgagugcucaccgcguaccggccucgacuucaacgagaugauccuguuaacgaugaagaacaaagccuggauggugcaccggcagugguuuuucgacuugccucuccccuggaccagcggcgcaaccaccgagacccccaccuggaacagaaaggaacuccuggugaccuucaagaacgcccacgccaagaagcaggaggucguuguguuggggucccaggagggcgcgaugcacacugcccucacgggggccaccgagauccagaacucuggugggacgucaaucuucgccgggcaccucaagugccggcugaagauggauaagcucgagcugaaggggaugagcuacgccaugugcaccaauacguucguccugaagaaggagguguccgagacccaacacggaaccauucucaucaaaguggaauacaaaggcgaggacgucccgugcaagauccccuucagcaccgaagacgggcagcgcaaggcgcacaacggccggcugauuacggccaaccccguggugaccaagaaagaggaacccgucaacaucgaggcagaaccacccuucggcgagagcaacauugugaucgggaucggagacaacgcucugaaaaucaauugguauaagaaggggucgagcaucggcaagauguucgaggcgacagcccgcggggcccggcgcauggccauacugggcgauaccgcaugggauuucggcuccgucgggggcgucuugaacagccuggggaagauggugcaccagaucuuuggcuccgcguacacggcccuguucagcgggguguccugggucaugaagaucggaauaggcguguuacugaccuggaucgggcugaacucgaagaacaccucuaugagcuucuccugcaucgccaucggcaucaucacccucuauuuaggugccgugguccaggccgacaugggcugcgugaucaacuggaaggggaaggaacugaaaugcggcucaggcaucuucgugacgaacgagguccacaccuggacggaacaguacaaauuccaggcggacucccccaaacgccucgccaccgccaucgccggggccugggagaacggagugugcgguauccggagcacgacucgcauggaaaaccugcuguggaaacaaaucgcuaacgaacucaauuauauucucugggagaauaacaucaagcugacgguggucgugggcgacaucaucggugugcucgaacagggcaaacgaacccugacgccccagcccauggaacugaaguacuccuggaagaccuggggcaaggccaagaucgugaccgccgagacgcaaaacagcuccuucaucaucgacgggcccaacacgcccgagugccccuccgccucccgggcguggaaugugugggagguggaagacuacggcuucggggucuucaccaccaacaucuggcucaagcugcgggagguuuacacacagcugugcgaccauagauugaugagcgccgccgugaaagacgagcgugccguccacgccgacaugggcuacuggaucgagagccagaaaaauggcuccuggaagcuggagaaggcgagccugauugaggugaagaccugcaccuggccgaagucgcacacccucuggagcaauggggugcuugaguccgacaugaucauucccaagagccuggccggccccaucagccagcacaauuaccgcccgggguaccacacgcagaccgccggccccuggcaccucgggaagcuggagcuggacuucaacuacugcgagggcacgaccguagugaucaccgagaauugcggcacccggggucccucucuccgcaccaccaccguguccggcaaacuuauccacgaguggugcugccggagcugcacucugcccccgcuccgcuauaugggggaggacggaugcugguauggaauggagauacggcccaucuccgagaaggaggagaacauggucaagagccuggucucagccgggagcggcgagguggacaacuucacgaugggcguccuaugccucgcgauccuguucgaggagguaaugcgcggcaaguuugggaaaaagcauaugauugcgggcgucuucuuuacguucgucuuguugcuuuccgggcagauaaccuggcgggacauggcccacacccugaucaugaucggcagcaacgccuccgaccguaugggaaugggcgucacuuaccucgccuugaucgcgacuuucaaaauccagcccuuccuggcauugggcuucuuccugcggaaacuuaccagccgcgaaaaccuauugcuggggguaggccucgcgauggccaccacccugcagcucccagaagacuucgaacagauggccaacggcaucgcgcucggguugauggccuuaaagcugaucacucaguucgaaaccuaccagcuuuggaccgcccugaucagccucacgugcucaaacacgaucuuuacucugaccgucgcauggcggacagcgacccucauccucgcgggcguuagucugcugccgguaugccagucaagcuccaugcgaaagaccgacuggcuccccaugaccgucgccgcgauggggguuccuccgcucccacuguucaucuucagccuaaaggauacgcugaagcgccgguccuggccucugaacgaaggggucauggccguggggcucgugagcauccuggccucuagccugcuacguaacgacguacccauggcgggcccccugguggccggagggcuguugauugccugcuaugugaucaccggcacauccgccgaccugaccguagagaaagcagcggacgugacgugggaggaggaggcagagcaaaccggcgugagccauaaccugaugaucaccgucgacgacgacggcacuaugcggaucaaggacgacgagaccgagaacauccucaccgugcugcugaagacggcccuccugaucguguccgggaucuucccuuacagcauacccgccacccugcucgucuggcacacuuggcagaagcagacgcagcgcuccggcgugcugugggacgugcccagcccucccgagacccagaaagccgagcuagaggagggcgucuaccggaucaagcaacagggaaucuucggcaaaacccaaguuggggugggcguucagaaggaggggguguuccacaccauguggcacgugacgcguggcgcgguccucaccuacaacggcaagcggcucgagccuaacugggccuccgugaagaaggaccugaucucuuacgggggcggguggcgccucuccgcccaguggcagaagggggaggaaguacaggugaucgccguggagcccgggaagaaucccaagaacuuucagacgaugccagguaccuuccagacgaccaccggagagaucggggcgaucgcccuggacuucaaacccggaaccagcgggagcccaaucaucaaucgagagggaaagguggugggccuguacgggaacggcguggugacgaagaacggggguuacguuuccgggaucgcccagaccaacgccgagccggacggucccgcccccgagcuggaggaagagauguuuaagaagcggaaccucaccaucauggaccugcaucccggaagcggcaaaacucggaaguaccugccggccaucguuagggaggccaucaagcggcgccuccguacgcugauccucgcccccacccguguggucgccgccgagauggaggaggcgcucaaggggcugcccauccgguaucagacgaccgcaacgaaguccgagcacacugggcgcgagaucguggaccugaugugccacgccaccuucacgaugcggcucuuaucucccgugcgagucccgaacuacaaucuuaucaucauggacgaggcucacuucacggaucccgcauccaucgcggcgcgcggcuacauuagcacgcguguggggaugggcgaggccgcagcgaucuucaugaccgccacaccgccuggcacggccgacgcauucccgcaguccaaugcccccauccaggacgaggagagagacauccccgagcguucauggaacucggggaaugaguggaucaccgacuucgcgggcaagaccgugugguucguccccagcauuaaggcagggaacgacauagccaacugccugcgcaagaacggcaagaagguaauccagcugucucggaagaccuuugacacugaguaccagaagaccaagcugaaugacugggacuucguggucaccaccgauaucagcgagaugggagccaacuucaaggccgaccgcgugaucgacccgcggcgcugucucaagcccgugauccugacggacggccccgagcgggucauccuggcgggccccaugccggugaccgccgccuccgccgcccagcgccggggacgcgugggccggaacccccagaaggaaaaugaccaguauauuuuuaccgggcagccccucaacaacgacgaggaccacgcgcacuggaccgaagccaagaugcuguuagacaacaucaacacccccgaggggaucaucccggcccucuucgagcccgagcgagagaagucagccgcgaucgacggggaguaccggcugaagggcgagucucgaaaaacguucgucgagcugaugcggcgcggggauuugcccguguggcuggcccacaagguagccuccgaggggaucaaauauaccgaccggaagugguguuucgacggccagcggaacaaccagauucuggaggagaacauggacguggagaucuggacuaaggagggggagaagaagaaguuacggccccgcuggcuggacgcccgcaccuacuccgacccgcuggcccuuaaggaguucaaggauuuugcggccggccgcaagagcauugcccuggaccugguuacggagaucggccgcgucccaacccaccucgcccaccggacccggaaugcccuggauaaccuuguuaugcuccacaccucggagcauggagguaaggcguaccggcacgccguggaggagcugcccgagacgauggagacccuguugcuacuggggcucaugauccuccugaccggcggagcaaugcuguuucugaucagcggcaagggcauugggaagaccagcaucggucuaaucugcgucaucgccuccucugggaugcucuggauggccgaaauuccgcuacaauggauugcgagugccaucguucuggaguucuucaugauggugcucuugauccccgagccggagaagcagcgcacgccacaggacaaucagcucgcguacguaguaaucggcauucucacccuggcagccaucauagcggccaaugagauggggcugcucgaaaccaccaagcgggaccuggguauguccaaggagccgggaguagucucccccacuagcuaccuggacguggaucuucaccccgcauccgccuggacccuguacgcaguugccaccaccgugauaacgcccaugcugcggcacacgauagagaacagcaccgccaacgugucccuagcugcuaucgcaaaccaggccgugguccuaauggggcuggacaagggcuggccgaucagcaaaauggaucucggaguaccccugcuggcuuuggguugcuauucccaggugaacccccugacccugaccgcagccguccuucugcugaucacgcauuaugcgaucaucgggcccggccuccaggccaaggcgacacgcgaggcccagaagcgcaccgcggcgggcaucaugaagaacccgacgguggacgggaucaugaccauagaccuggaccccgugaucuacgauagcaaguucgaaaagcaguugggccaagucaugcuccuggugcugugcgcagugcagcuccugcugaugcggacauccugggccuuaugcgaggcccugacccuggcgacggggcccaucacgacccucugggagggcagcccgggcaaauuuuggaacaccacgauugccgucuccauggccaacauauuccgcgggucauaccuagcgggcgccgggcuggcguucuccaucaugaagucugugggcaccggaaagagaggcaccggcucccagggggagacccucggcgagaaguggaagaagaagcuaaaccagcugagccgcaaggaguucgaccuguacaagaaguccgggauuaccgagguggacaggacggaggccaaggaaggccugaagcgcggagagauuacacaucaugccgugucccggggcagugccaagcugcagugguucgucgagcgcaacauggugauuccggagggccgggucaucgaccucggcugcggccgcgggggcuggucuuacuacugcgcagggcugaagaagguuaccgagguccggggcuacacaaagggcgggccaggccaugaggagcccgugccaaugagcacguacggcuggaacaucgugaagcugauguccggcaaggacguguucuaccucccgcccgagaagugcgacacgcuguugugcgacaucggggagagcucccccucucccaccgucgaggaaucccgcaccauccgcguccugaagaugguggagccguggcucaagaacaaccaguucuguaucaagguccugaaccccuacaugccgacggugaucgagcaccuagagcggcuucagcgcaagcacggcggaaugcuggugcggaacccucugucucgcaacuccacccacgagauguacuggauuagcaacgggaccggcaacaucgucgcguccgugaacaugguguccaggcuccuacugaaccgcuucaccaugacgcaccggcgcccgaccaucgaaaaggacgucgaccuaggggccggcaccagacacgugaacgcugagccggagacaccuaauauggauguuaucggcgagcgcaucaagcggaucaaggaggagcacaacuccacguggcauuaugacgacgagaacccguacaagaccugggcauaccaugggagcuaugaggucaaagccacaggcuccgccagcuccaugaucaauggaguggucaagcugcuaacgaagcccugggacgugguacccauggucacgcagauggccaugaccgacacuacccccuucggccaacagcgaguguucaaggaaaaaguggacacaagaaccccucgcuccaugcccgggacccggcgcgucaugggcaucaccgcagaguggcucuggcggacccugggccgcaauaaaaagccccggcugugcaccagggaggaguucaccaagaaggugcgcaccaacgccgcgaugggggcuguuuucacggaggagaaccaaugggacuccgccaaggccgccgucgaagacgaggacuucuggaagcucguggaucgggagcgcgagcugcacaagcugggaaagugcggguccugcguguacaacaugaugggaaagcgggagaagaagcugggagaguucggcaaggcgaagggaagccgcgccaucugguacauguggcugggggcccgguacuuggaguuugaagcccucggauuccugaacgaggaccacugguucuccagggagaacucauacuccggagucgagggcgagggguuacacaaacuggguuacauccuacgcgacaucagcaagauccccggaggggccauguaugcggacgacaccgccgguugggacacccgcaucaccgaggacgaccugcacaaugaggagaagaucacgcagcagauggauccggagcaccggcagcucgccaacgccaucuucaagcugaccuaucagaauaaagucguaaaaguucagagaccgaccccaaccgggaccgugauggacaucaucuccagaaaagaccagcgcggcagcggccaaguggguacguauggacugaacaccuucaccaacauggaggcccagcucauccggcagauggagggagaggggguccuguccaaggccgaccuggagaauccccacuugccggagaagaagaucacccaguggcuggagacgaaggggguggagagacucaagcggauggcuaucagcggugacgacugcguggugaagcccaucgacgaccgcuucgcuaacgcccuccuggcgcugaacgacaugggcaaggugcggaaggacaucccccaguggcagccuuccaagggguggcacgacuggcagcagguaccguucugcagccaccacuuccacgagcucaucaugaaggacggccgcaagcuggucgugccaugccggccccaagacgagcugaucgggcgcgcgcggauaucccagggcgccggguggagccuccgcgagaccgcgugccugggcaaggcguaugcgcaaauguggucccugauguauuuccacagacgcgacuuacgccuggccucuaacgcuaucugcuccgccguccccguucauugggugccgaccagccggaccacgugguccauccaugcccaccaccaauggaugacaaccgaggacaugcugaccguguggaacagaguauggaucgaggacaaccccuggauggaggacaagacgcccguuaccaccugggagaacguacccuaccucggcaagcgggaggaccaguggugcgggucucugaucggccuuaccucgcgcgcgacuugggcccaaaacaucccaaccgccauccagcaaguccguucccucaucgggaacgaggaguuccuggacuacaugcccgccaugaagcgcuuccggaaggaggaggagagcgagggcgccauaugguga

SEQ ID NO: 26049 - RNA, 9873 nt, Artificial Sequence
  derived and/or modified CDS sequence (opt11) from DENV-3__FJ639780__SS-prME
acaagccucugucucaugaugauccugcccgcggcgcuggcuuuccaccucaccagccgggacggcgaaccgcggaugaucguggggaaaaacgaacggggcaagagccuguuguuuaagaccgcauccgguaucaacaugugcacccucaucgccauggaccugggcgaaaugugcgaugacaccguuaccuacaaguguccucacauuacagaggucgagcccgaggacaucgacugcuggugcaaccugaccagcaccugggugaccuacgggacgugcaaucaggccggcgagcaccggcgcgacaagcgguccguggcucucgcgccccacgucggcauggggcuggacacccgaacccagaccuggaugagcgccgagggcgccuggagacagguggagaagguggagaccugggcccugcgacacccgggguucaccauccucgcgcuguuccuggcucacuacauaggcaccucccucacucagaaaguggugaucuucauccuccugauguuggucacgcccagcaugaccaugcguugcgugggggugggaaaccgcgacuucgucgagggccuguccggggccaccuggguggacguggugcuggagcacggcgggugugugaccacgauggccaagaacaagcccacccucgacauugaacugcagaagaccgaggccacccagcuggcaacgcuccggaaguuaugcaucgagggcaagaucaccaacaucaccaccgacucucggugcccgacucagggcgaggcagugcuuccugaggagcaagaccagaacuaugucuguaagcacaccuauguagaucggggguggggcaacgggugcggcuuauucgggaagggcucccuugugaccugcgccaaguuccagugucuugagcccaucgagggcaagguagugcaguaugagaacuuaaaguacacgguuauaaucaccguacacaccggggaccagcaccaagugggcaacgagacccagggggucaccgccgagaucacgccccaggccucgacgaccgaggcgauacugcccgaguacgggacucuggggcucgagugcuccccgcgcaccggacuggacuucaacgagaugauucugcucacgaugaagaacaaagccuggauggugcaccggcagugguucuuugacuuaccccugcccuggaccaguggcaccacgacggagacuccuaccuggaaucgcaaggagcuauuagugacuuuuaagaacgcccacgcaaagaagcaggaggucguggugcuggggucacaggaaggcgccaugcacacagcgcucaccggggcuaccgagauccaaaauucuggcggcaccuccaucuucgccggccaccugaagugccggcugaagauggauaaacuugagcugaaggggauguccuaugcgaugugcacuaacacauuugucuuaaagaaggagguaagugagacccagcacgggacaauccuaaucaagguggaguauaagggcgaggaugugcccugcaagaucccguuuagcacggaggacggccaggggaaggcccacaacggccgccucaucacugcgaaccccguggugaccaagaaggaggagcccgucaacaucgaagcggagccacccuucggggagagcaacaucgugaucggaaucggcgacaacgcccugaagauuaacugguacaaaaagggcuccagcauaggaaagauguuugaggccacugcgcggggcgcccgccggauggccauuuugggcgacacggccugggacuucgggagugucggagggguccucaacagccugggcaagauggugcaccagauauucgggucagcauacacagcucuuuucucuggcguguccugggucaugaagaucggcaucggcgugcuccugacguggaucggcuuaaacagcaagaauaccuccauguccuucucgugcaucgcaaucggaaucauuacacucuauuugggcgccgugguccaggcggacaugggguguguaaucaacuggaaggguaaggagcuuaagugcggaucagggaucuucgugaccaacgagguccacaccuggaccgagcaauacaaauuccaggccgacucccccaagcgccucgcgacggccaucgccggcgcuugggagaacggggugugcgguauccgcagcacuacccggauggagaaccugcuguggaagcaaaucgcaaacgaguuaaauuacauccucugggagaacaacaucaagcucaccguggucgugggggacaucaucggaguucucgagcagggaaagcgcacgcugacgccccagcccauggaguuaaaauacaguuggaagaccugggggaaagcaaagaucguuaccgcagaaacccagaacagcuccuucauuaucgacggccccaacacccccgagugccccaacgccagccgggccuggaacguuugggagguggaggacuacggguucggcguauucacuaccaacaucuggcucaagcuacgugagguguacacccagcugugcgaccaccgucucauguccgcggccgugaaggacgagcgcgccguccacgccgacaugggcuacuggaucgagucacagaaaaacgggagcuggaagcuggagaaggccucccugaucgaggugaagacgugcacauggcccaagucccacacacucuggucaaacggcgugcucgagucagauaugaucauccccaaaucccuggcggggcccauaagccagcacaacuaucggccgggauaucacacccaaacggccggacccuggcaccucggcaagcuggagcuugauuucaacuacugcgagggcaccacugucgugaucaccgagaacugcggaacgcgcgggcccucccuccggacaaccacugugagcgggaagcugauccacgaguggugcugcaggaguugcacgcugcccccucuccgguacaugggcgaggacgggugcugguacggcauggaaauucgccccaucagugaaaaggaggagaacaugguuaagagccuggugagcgccggcuccggggagguggacaacuucaccaugggcguccugugccuagccauccuguucgaggaagugaugcgugggaaguucggcaagaagcacaugauugccgggguauuuuucaccuucguccuacuccugagcggccagaucaccuggcgcgacauggcgcacacgcugaucaugaucggcagcaacgccucagaccggaugggaaugggcguuaccuaccucgcccugaucgccaccuucaaaauccagccuuuccuggcccucggauucuuccugcgcaagcuaaccucccgggagaaucuccugcucggcgugggccuggcgauggccacgacccugcagcugccagaagacaucgagcagauggcaaacgggaucgcccucggccugauggcgcuaaaacuuaucacccaguucgagaccuaucagcuguggacugcccugaucagcuugaccugcagcaacacgaucuuuaccuuaacgguggccuggcgaaccgccacccugaucuuagccggggugucccugcugcccguaugccagagcaguucuaugcggaagaccgacuggcuccccaugacgguggccgccaugggcaucccgccucucccgcuguucauauucagccuaaaggacacccugaagcgccgcucguggccccugaaugagggggugauggccgugggccucguauccauauuggccagcucccugcuccggaaugacgugccaauggccggcccucuggucgccggcggguugcuaauugccugcuacgugaucacggggaccagcgcagaucugacgguggagaaggccgccgacgucaccugggaggaggaggcggagcagacgggcgugucccacaaccugaugaucaccguggacgacgacgggaccaugagaaucaaggacgaugagaccgagaacauccucaccgugcugcugaagacggcccuccugaucguguccgggauauucccguacaguauccccgccacccuccucguguggcacacguggcagaagcagacccagcggagcggaguccugugggacgugccuagcccgcccgagacccaaaaagccgagcuggaagaggggguguacaggaucaagcagcaaggcaucuucgggaaaacccaagucggcgugggcguacagaaggagggcgucuuccacaccauguggcacgugacacgcggcgccgugcucaccuacaacgggaagcgucuggagcccaauugggcgagcguaaagaaggaucugaucucuuacggugggggcuggcggcuuagcgcccaguggcagaagggggaagagguacaggugauugcuguagagcccggaaagaaucccaagaacuuccagaccaugcccggcacguuccagaccaccacuggagagauaggcgccaucgcgcuggacuucaagcccgggacguccggcagcccuauuaucaaccgcgagggcaagguaguuggcuuauacggcaacggggucgugaccaagaacggcggguacguaagcggcaucgcccagaccaacgccgagccggaugggcccacccccgagcuggaggaggagauguucaagaagaggaaccucacgauuauggaccugcaccccggguccggcaagacccgcaaguaccugcccgccaucguccgggaggccauaaagcgccggcuccgcacccuuauccuggcacccacccggguaguggccgccgagauggaggaggcccuaaaggggcuacccauccgcuaccaaacgaccgcaaccaagagugagcauaccggcagggagaucguagaccucaugugccacgcgacguucacuaugcgcuuacugucccccgugcgugugccgaacuacaaccugauaaucauggacgaggcccacuucacggaccccgcaagcaucgccgcgcgcggcuacaucuccacccgggucggaaugggcgaggcagccgcuaucuucaugacggccacgccuccagggaccgcggacgccuuuccgcagagcaacgcucccauccaggacgaggagcgcgacauuccagagcgcuccuggaacagcggaaaugaguggauuaccgacuucgccgguaagacgguaugguucguucccuccaucaaggcaggaaacgauaucgcgaacugccuccggaagaacgggaagaaggugauccagcugagccgcaagaccuucgacaccgaguaccagaagaccaagcugaaugacugggauuucguggugacgaccgauauuucagagaugggcgcuaacuucaaggccgaccgggucaucgauccgcgccggugccucaagcccgugauucugaccgacggcccugagcgggugauccuggcgggccccaugccgguaaccgcagcgagugccgcccaacggcgcggcagaguggggcgcaauccccagaaggagaacgaccaguacauuuucaccggacagcccuuaaacaacgacgaggaccacgcucacuggacggaggccaaaaugcuucuagacaacaucaacacccccgaggggaucaucccggcccucuuugagcccgaacgggagaaauccgccgccaucgacggcgaguacagacucaagggcgagagccggaagaccuucguggaguugaugcggcgcggagaccuccccgucugguuagcccacaagguggcgagugagggcaucaaguacaccgaccgcaaguggugcuucgacgggcagcggaacaaucagauccuggaggagaacauggacgucgaaaucuggacgaaggaaggggagaggaaaaagcuccguccccgcuggcuggacgcccgcaccuacagcgauccgcuggcccucaaagaguucaaggauuucgcagccggccguaaguccaucgcguuagaccuggucaccgagaucgggcgcguacccacacaccucgcccaccggacgcgcaacgcucuggacaaccucgucauguuacacaccagcgagcauggcgggaaggccuaucggcacgccguggaggagcugcccgagaccauggagacccugcucuuacucggccuuaugauacugcugaccggcggagcgaugcuguuccuaaucuccgggaaggggauuggcaagaccagcaucgggcugaucugcgugauagccagcuccggcaugcucuggauggccgagaucccgcugcaguggauagccagcgccaucguccuggaguucuucaugauggugcuuuuaauucccgagcccgagaagcagcgcacgccccaggacaaccagcuugcguacguggucaucgggauacuaacccuggccgccaucauugccgcuaacgaaaugggccugcucgaaacgaccaagcgggaccugggcauguccaaggagccgggugugguuagccccacuuccuaccuggacgucgauuuacaccccgcgucggcguggacccuguaugccguggccacgaccgugaucacccccaugcugcgccauaccaucgagaacaguaccgcgaaugugagccucgcggccauagccaaccaggccguggugcucaugggccuggacaagggguggccgaucuccaagauggaccucggcgucccccugcuggcgcuagggugcuacagccagguaaacccccucacccugaccgccgcuguguugcuuuugaucacccacuacgcaaucauugggcccggcuuacaggccaaggcgacacgggaggcccagaagcgcaccgccgccgggaucaugaagaauccuaccgucgacggcaucaugaccaucgaccuggaccccgucauauacgacuccaaguucgagaagcagcugggccaggugaugcuccugguucugugcgccguucaguuacugcugaugcggacguccugggcgcucugcgaggcccugacccuggccaccggccccaucaccacgcucugggagggcucccccgggaaauucuggaacaccaccaucgccguuagcauggcuaacaucuucagaggauccuaucuggcuggggccggccuggccuucagcauaaugaaguccgucggaaccggaaaacgggguaccgggagccagggcgaaacgcucggggaaaaguggaagaagaagcucaaucagcugucccgcaaggaguucgaccucuacaagaaauccggcaucaccgagguagaccggaccgaggcgaaggaggggcuuaaacgcggcgagaucacgcaucacgcugugagccgaggcuccgccaaacugcagugguucguggagcgcaacaugguaauccccgaggggcgugugaucgaucugggaugcggacgcgguggguggagcuacuauugcgcgggacugaagaaggucacggaggugcggggcuacaccaagggcgggcccgggcacgaggagcccgugccgaugagcaccuacggcuggaacaucgucaaacuuaugagcgggaaggacgucuucuaucucccgccugagaagugugacacccugcuuugcgacaucggcgaguccucuccuucccccacgguggaggagagucgcaccauccgcguccugaagaugguggagccauggcuaaagaacaaucaguucugcauaaaggugcugaaccccuauaugcccgcggucaucgagcaccuggaacgucuccagcguaaacacggcgggaugcuggugagaaacccccugucccggaacucgacccacgaaauguacuggaucuccaacggcacagggaauauuguggccagcgucaacauggugagucggcugcugcugaacagauucacgaugacccacaggcgcccgacgaucgagaaagacguggaccucggcgcuggcaccagacacguaaacgccgagcccgaaacucccaacauggacgugauaggggagcgcaucaagcggaucaaggaggagcacaacagcaccuggcauuacgaugacgagaacccguacaagaccugggcguaccacggcucguacgaggugaaagccaccggcagugccaguagcaugaucaacggagucgugaaguuacugacgaagcccugggacgucgugcccauggugacccagauggcgaugaccgacaccacccccuucgggcagcagcgagucuucaaggagaagguggacacccggaccccgcgguccaugcccgguacccggcgcgugaugggcaucacggcugaguggcucuggcggacccuggggaggaacaagaagccgcggcuguguacacgggaggaguucaccaaaaaggucaggacgaacgccgccaugggcgcgguguucaccgaagagaaccaaugggacagcgcaaaggcggccguggaggacgaggacuucuggaaguuaguugaccgggagcgcgagcugcacaagcugggcaaguguggcagcugcgucuacaacaugauggggaagcgugagaagaagcucggagaguucggcaaggccaaagggucccgggcgaucugguacaugugguugggcgcccgguaccuggaguuugaggcccuaggguuccugaacgaggaccauugguucagccgcgagaacaguuacagcggcguugagggggagggccugcacaaguugggcuacauccugcgggacaucuccaagauacccgggggcgccauguacgcugaugacacagcggggugggacacccgcaucaccgaggacgaccuccacaacgaggagaaaaucacccagcagauggacccggagcaccggcaguuggccaacgccaucuucaaguugacguaccagaacaaggucguuaaggugcagcgcccgaccccuaccggcacgguaauggacauaaucagccggaaggaccagcgcggcuccggccaggugggcacauauggccugaacaccuucaccaacauggaggcgcagcucauccggcagauggagggcgagggggugcugagcaaggccgaccuggagaacccgcaccucccggagaagaaaaucacucaguggcuggagaccaagggcgucgagcgccugaagaggauggcgaucuccggcgacgacugcguggugaagccuaucgacgacagauucgccaaugcccuccuggcccugaaugacauggggaagguccggaaggacaucccccaguggcagcccucuaagggcuggcacgacuggcagcaggucccguucugcucccaccacuuccaugagcucaucaugaaggacggacgcaagcuggugguccccugccggccccaggacgagcucaucggucgagcacggaucucacagggggcgggcuggucccuccgcgagaccgcaugccugggaaaggccuacgcccagauguggucacugauguacuuccaccgccgugaccuccgccuggcguccaacgccaucugcagcgccguaccagugcacugggucccgaccaguagaacgacauggagcauccacgcccaucaccaauggaugaccaccgaagacaugcugacgguguggaaccgaguguggaucgaagacaaccccuggauggaagacaagacccccgucaccaccugggagaacgugccuuaccucgggaaacgggaggaccaguggugcggauccuugaucgggcugacgucgcgcgccaccugggcgcagaacauuccgaccgccauucagcagguccgcagccucaucggcaaugaggaguuccuggauuauaugcccuccaugaagcgcuuccgcaaggaagaggagagcgagggggccaucugguaa

SEQ ID NO: 26050 - RNA, 9873 nt, Artificial Sequence
  derived and/or modified CDS sequence (opt11) from DENV-3__FJ639781__SS-prME
accagccugugcuuaaugaugaucuuacccgcagccuuagcguuccaccucacaagccgggauggugagccccgcaugaucguggggaagaacgagcggggaaagagccuacuuuuuaagacggccucggggauaaacauguguacccugaucgcgauggaccugggggagaugugcgacgacaccgugaccuacaagugcccccacaucacggagguugagcccgaggacaucgacuguugguguaaccugacgucuacgugggugacguacgggacgugcaaccaggccggcgagcaucggcgcgauaagcgcucgguggccuuggcgccccacgugggcaugggacuggauacgcgcacccagaccuggaugucggccgagggcgcauggagacaggucgagaagguggagacgugggcuuugcgccacccgggguuuacgauacucgcgcuguuccuggcccaauacauaggcacaagucucacccagaagguggugaucuucaucuugcugaugcucgucacucccagcaugacaaugcggugugugggugugggcaaccgcgacuucgucgagggccuguccggugccaccuggguggauguaguccuagaacacggcgggugcgugaccacgauggcaaaaaacaagcccacccucgauaucgagcugcagaagacagaggcuacccagcucgcgacgcucagaaaacugugcaucgagggcaaaaucaccaacaucaccacugacagccgcugcccgacgcaaggcgaggcugugcucccggaggagcaggaccagaauuaugucugcaaacacaccuacguggaccgcggguggggaaacgggugcggcuuguucggcaagggcagccuggugaccugcgcuaaauuccagugccuggagccaaucgagggcaagguggugcaguacgaaaaccucaaguacaccgucaucauuacaguccacaccggggaccagcaccagguuggcaacgaaacgcaaggagucaccgccgaaaucaccccucaggccuccaccaccgaggcgauucugcccgaguauggcacccucgggcucgaaugcucuccgcgcaccggacuggacuucaacgagaugauucugcucacgaugaaaaacaaagccuggauggugcaccggcagugguucuucgaucugccuuuacccuggaccaguggugccaccaccgagacgcccacguggaaccgcaaagaauugcucgugacuuucaagaacgcacacgcuaagaagcaggagguagugguucuggggucccaggagggcgcgaugcacacagcccucacgggugcuaccgagauccagaacagcggcggaaccuccauuuuugccggccaccugaaaugccgacugaagauggacaagcucgagcugaagggaaugagcuacgcaaugugcaccaacacguucgugcugaaaaaggaagugagcgagacccagcacgggaccauucuaaucaagguggaauacaagggugaggacgugccguguaaaaucccauucagcaccgaggacgggcaggggaaagcgcauaacggccgccugauuacggccaaccccguaguaaccaaaaaggaggaacccgucaacauagaggccgagccgccauuuggggagagcaacauaguuaucggcaucggggacaacgcccugaagaucaacugguacaagaagggcuccuccaucggaaagauguucgaagcgaccgcccggggcgcccgccggauggccauccuaggcgauaccgccugggauuucggguccgugggcgggguccucaacagccugggcaaaauggugcaccagaucuuuggguccgcguacacagcgcuguuuagcggcguaucuuggguuaugaagauuggcaucggcguacuccugaccuggaucggccugaacucuaagaacaucuccaugagcuucuccuguaucgccauugggaucaucacccucuaucugggcgccgugguccaggccgauauggggugcgugauaaacuggaaagguaaggaguuaaaaugcggaaguggaauuuuugugaccaacgagguccauacguggaccgaacaguacaaguuccaggcugacucucccaagcgccuagccaccgccaucgcaggcgccugggagaauggggugugcggcauccgcagcaccacgaggauggagaaccuucuguggaaacaaaucgcgaacgaacucaacuacauccuaugggagaacaauaucaagcugacaguuguugucggggacaccaucggcguccucgagcaggguaagaggacucugacuccccaaccgauggaacuuaaguacuccuggaagaccugggguaaggccaagaucgucaccgccgagacccagaacucuuccuucauaaucgacggccccaacacgccugagugccccucugccucccgugccuggaaugugugggaggucgaggacuacggguucggcguuuucaccaccaacaucuggcucaagcugcgcgagguguauacacagcugugcgaccaccggcuaaugagugccgccgugaaggacgagcgcgcaguccaugccgacauggguuacuggauugagagccagaagaacggaucuuggaaacuggagaaggcgagccuuaucgaagugaagaccugcaccuggccgaaaagccauacccucuggagcaacggcgugcuggaguccgauaugaucauacccaagucacuugccgggcccauuagucagcacaacuaucggccggguuaucacacccaaaccgcaggucccuggcacuuagguaaacuggaguuagacuuuaacuacugcgaggguacgaccgucgugauaaccgagaacugcgguacccgcggccccagccuccggacgacaaccgugucggguaagcugauccaugagugguguugccgcucgugcacccugcccccgcuccgguacaugggcgaagacgggugcugguacggcauggaaauccgucccaucuccgaaaaggaggaaaacauggucaagucacuugucuccgccggcagcggagaggucgacaacuucacgauggguguccugugccucgccauucuguucgaggaggugaugcgggggaaguucggcaagaagcacaugaucgcagguguguucuuuacauuugcccucuugcuguccggccagaucaccuggcgcgacauggcccacacccugaucaugaucggcagcaacgccagugaccggauggguaugggcguaacguaccucgcacugauagcaaccuucaagauacaacccuuucuggcccucggguuuuuccugcgcaaacugaccagccgggagaaccuacugcugggagugggccucgccauggccacaacgcugcagcugccagaggacaucgagcagauggcgaacgguauagcccucggacucauggcccugaagcucauaacucaguuugaaacguaccagcucuggaccgcccugaucagccucaccugcucuaacaccauuuucacccugaccguggcuuggcgcacggcgacacugauccucgccgguguuagccuucuuccggugugccaguccagcagcaugaggaaaaccgacuggcucccuaugaccgucgcggccaugggcguaccgccgcucccccuguucaucuuuagccucaaggacacgcugaagcgccgcuccuggcccuuaaacgagggagugauggccgucgggcuuguuagcauccuagcgucuagccuucuacggaaugacguccccauggccggcccccugguagccgggggccuacucaucgccugcuacguuaucaccgguaccucggccgaccugaccguggagaaggccgccgaugucacgugggaagaggaggccgagcagacgggcgugagccacaacuuaaugaucaccguggacgaugacgggaccaugagaauuaaggacgacgagacugagaacaucuugacgguccugcugaagaccgcccucuugaucguguccggcaucuucccguauagcauucccgccacccuccugguguggcacacguggcaaaagcagacgcagcgguccggcguccugugggacguccccagcccgccagagacccagaaggcggaguuggaggaggggguauaccgcaucaaacagcagggcaucuucgggaagacccaggucgggguuggggugcagaaggagggggucuuucacaccauguggcaugugacgcgaggcgccguauuaaccuauaaugggaagcgacuggagccgaacugggcauccgucaagaaggaccuuaucagcuauggcggugguuggcgucucuccgcccaguggcagaaaggggaggagguccaggugaucgcugucgagccaggcaagaaucccaagaacuuccagaccaugcccggcacguuccagacgaccaccggggaaaucggcgcuaucgcccuggacuucaagcccgggaccagcggcagccccauuaucaaccgcgagggcaagguggugggucuguacggcaacggaguagugacgaagaacggcggguacguguccgggauugcccaaaccaacgccgagccggacggcccgacccccgagcuggaggaagaaauguucaaaaagcguaaccucacaaucauggaccuacacccgggaucggggaagacgcggaaguaccucccagcgauagucagagaagccauaaagcggcggcuccgcacccugauccuggcgcccaccaggguuguggccgccgagauggaggaggcgcucaaaggacugcccauccgcuaucagaccacagcuaccaaguccgaacacacaggacgggagauugucgaccucaugugucaugcuaccuucaccaugcgccuccucagccccguccgggucccgaacuacaaccugauuaucauggaugaggcccacuucaccgaccccgcauccaucgcugcccgcggcuacaucagcacccgugucggcaugggcgaggccgcggcgaucuuuaugacagccacaccgcccgggaccgccgacgcauucccgcaguccaacgcccccauccaagacgaggagcgcgacauccccgagcgcucguggaacuccggcaaugaguggaucaccgacuuugcugggaagacugugugguucgugcccucgauuaaggccgguaacgauaucgccaacugucuccggaagaacggcaagaaggugauccaguuaagucgcaagacuuuugacaccgaguaccagaagaccaagcugaaugacugggacuucgugguaacaacugauaucucugagaugggggcaaauuucaaggccgaccgagucauagacccgcggcgaugcuugaagcccguuauauuaaccgauggccccgaacgcgugauccuggcggggccuaugccggucaccgcggccucagcggcccagcggcgcggccgggucgggcgcaacccccagaaggagaaugaccaauacaucuucacuggccagccccucaacaacgacgaggaccacgcgcacuggaccgaggccaagaugcugcuggacaacaucaauacgccagaggggaucaucccggcccucuucgagcccgagcgggagaaguccgccgcgaucgacggcgaguaucggcugaagggggaaucccguaagaccuucguggaacugaugcgccgcggggaccuccccgucugguuagcccacaagguagcaucggagggaaucaaguacaccgaccgcaaguggugcuucgacgggcaacggaauaaccagauccuggaagagaacauggacgucgagauauggaccaaggagggcgagaaaaagaagcuacgcccccgguggcuggacgcacguacguacagcgacccccuggccuugaaagaguucaaggacuucgcggccggccgcaagagcaucgcgcuggaucucgugacggagaucgggcgggugccuacccaccucgcccaccgcacccgaaacgcucuggacaaccuggucaugcuccacacgagugagcacggcggcaaggcguaccgccacgccguggaggaguuacccgagaccauggaaacccugcuccuucugggacucaugauccugcuaaccgggggagccaugcuguuucugaucagcggcaaagggauuggcaagacaagcaucggucugaucugugugaucgccaguagcggcaugcuuuggauggcggagaucccgcugcaguggaucgcguccgccaucguccuugaguuuuucaugauggugcuccugauccccgagcccgagaagcagcggacaccccaagacaaccagcuggccuauguggucaucgggauccucacccuggcugccaccaucgcggccaacgagaugggccugcuugagacgaccaaacgagacuugggcaugagcaaggagccggggguggugagccccacuagcuaccucgacguugaccuucacccagccuccgccuggacccuguaugccguugccacgacagucaucacacccaugcugcggcauaccauagagaacagcaccgccaacguaagccucgccgccaucgcaaaccaagccguagugcugaugggccuagacaaggguuggccgaucagcaagauggaccuuggcguuccccugcuggcccucgggugcuauucccaagucaaccccuuaacccugaccgccgccgugcuacugcugaucacccacuacgcgaucaucggcccgggccuccaagcuaaggccacgcgcgaagcccagaaaaggacggccgcggguaucaugaagaauccgaccguagacggcauuaugaccaucgaucuggaccccgugaucuacgacagcaaguuugagaaacagcugggacaggugaugcuccugguccugugcgcggugcaacuccuucugaugcgcacguccugggcguuaugcgaggcccugacgcuggcgaccggccccaucaccacacucugggagggaagcccagguaaguucuggaacaccaccaucgccguguccauggccaacaucuuccggggcagcuaccuggcuggggccggccuggccuucuccaucaugaaauccguggggacaggaaaacgcggaaccgggucccagggcgagacccucggagaaaaguggaagaagaaacuaaaccagcugagccggaaggaguucgaccucuacaagaaguccggcaucaccgagguggaucgcaccgaagccaaggagggacuaaagcggggggagaucacccaccacgccguuuccaggggcagcgcuaagcuccagugguucgucgaacggaauauggucaucccggagggacgcguaauugacuuggguugcgggcggggcgggugguccuacuacugcgccggccugaagaaggucacagaggugcgcggcuacaccaagggcgggcccgggcacgaggagcccgugcccaugagcacauacggcuggaacaucguaaagcugauguccgguaaagacguguucuaccuuccgccagagaagugcgauacccugcugugcgacaucggagagagcucccccagccccacgguggaggagucccggacgauccgaguccugaagaugguggagccguggcucaaaaacaaccaguucugcaucaaggugcuuaaccccuauaugccaacaguaauagagcaccuggagagacuacagcggaagcacggagggaugcuggugcgcaacccccugagccggaacuccacucacgagauguauuggaucagcaacggcacgggaaauaucguggcgucugucaauauggucagcagacugcugcucaaccgcuuuaccaugacccaccgccggccgaccaucgagaaggacguggaucucggcgccggaacccggcaugucaaugccgaacccgagacccccaacauggacgucaucggagagagaaucaagcgcaucaaggaggagcacaacuccaccuggcacuacgacgacgaaaacccguauaaaaccugggccuaccacggaagcuacgaggugaaggccacuggguccgcgagcucgaugaucaacggcgugguaaaacugcugacgaagcccugggacgucguaccuauggugacacagauggcuaugacagacacgaccccguucgggcaacagcgggucuucaaggagaagguggacacccgcacaccgcggucaaugccuggcacgcgccgggucaugggcauaacugccgaguggcucuggcgcacccuggggcggaacaagaagccacgucugugcacgcgcgaagaauucacaaaaaagguaagaaccaacgccgcgaugggcgccguguucaccgaggagaaccaaugggacagcgcaaaggcagccguggaagacgaagacuuuuggaagcugguugaccgagagcgagagcugcacaagcuagggaagugugguagcugcguauacaacaugauggguaaaagagagaagaagcucggcgaauucggcaaggcuaaggggucgcgggccauaugguacauguggcugggcgccagauaccuggaguucgaggcccucgguuucuuaaaugaggaccacugguucagccgggagaacagcuacuccggcgucgaaggggaaggccugcauaagcuuggcuacauccugcgcgacaucagcaaaauccccggaggcgcgauguacgcggacgacacagcagggugggacacccggaucaccgaggacgaccugcacaacgaggagaaaaucacccagcagauggacccggagcaccgccagcucgccaaugccaucuucaagcugacuuaccagaacaaagucgugaaggugcaacgccccacccccacggggacaguuauggacaucaucucccgcaaggaccaacgcggcagcggccaggugggcaccuacgggcugaacaccuucaccaauauggaagcccagcuuauccggcagauggagggcgagggggugcuguccaaggccgaccuggaaaacccccaccucccggagaagaagaucacccaguggcuggagaccaagggcgucgagaggcugaagcgcauggccaucagcggugaugauugcguugugaagcccaucgaugaccgguucgccaacgcguugcuggcuuuaaacgacauggggaagguccgcaaggacaucccccaauggcagcccuccaagggcuggcacgacuggcagcaggucccguucuguagccaccauuuccacgagcucaucaugaaggacggacguaagcuggugguccccugucguccgcaggacgagcugaucggccgggcgcguaucucccagggggccggcuggagccuacgggagaccgcgugccugggcaaggccuacgcgcagauguggucucugauguacuuccaccgucgagaccuccggcuggccagcaacgcaauauguagcgcuguccccgugcacuggguccccacgagccgcaccaccugguccauccacgcacaucaucaguggaugaccacagaggacaugcucaccguuuggaaucgaguuuggauagaggauaaccccuggauggaggacaagaccccgguuaccaccugggagaacgugccuuaccucgggaagcgcgaggaccaguggugcggcagccugaucgggcuaaccagccgggcgaccugggcgcagaauauuccgaccgccauacaacagguccgcucccucauugguaaugaggaguuucuggauuauaugcccagcaugaagcgguuccgcaaagaggaggaguccgagggcgccaucugguga

SEQ ID NO: 26051 - RNA, 9873 nt, Artificial Sequence
  derived and/or modified CDS sequence (opt11) from DENV-3__FJ639782__SS-prME
accucgcuguguuugaugaugauccuacccgccgcccuggcguuccaccuaaccucucgggacggggagccccggaugaucguggggaagaacgaacggggcaaguccuugcuguucaagaccgcgagcgggauaaacaugugcacgcucaucgccauggaccugggcgagaugugcgacgacaccgugaccuacaaguguccccacaucacggagguggagcccgaggacaucgacugcugguguaaccugacgagcaccugggugaccuacgggacgugcaaucaagccggcgagcaccggcgcgacaagcgguccguggccuuagcgccccaugugggaaugggucuggacacccgcacccagaccuggauguccgcagaaggcgcauggcgccaaguagagaaggucgaaacgugggcccugcgccauccgggguucaccauccuggcgcuauuccuggcccauuacaucggcaccuccuugacccagaagguggugaucuucaucuuacugaugcucgucacccccucgaugaccaugcggugcgugggcgucggaaaccgagacuucgucgagggccugagcggggcuaccuggguugacgucguccuggagcacggcgggugcguuaccacaauggccaagaacaagcccacucucgacaucgagcugcagaagacggaggccacucaguuagcgacucuccggaaguugugcaucgagggcaagaucacgaacaucaccaccgacagccgcugccccacgcagggcgaggccgugcugccggaggagcaggaucagaacuacguuugcaagcauaccuacgucgaucgggguuggggcaacggguguggucuguucgggaaggguucccuggugacgugugccaaguuccagugccuggagcccaucgaggggaaggucguucaguacgagaaccucaaguauaccguaauaauuacgguccacacuggggaccagcaccaagugggcaacgagacccaggggguuacggcggagauuacgccccaggccagcaccaccgaagcuauccugcccgaguacggcacccuaggccucgagugcuccccucgaaccgggcuggauuucaacgagaugauccuguuaacgaugaaaaacaaagccuggauggugcaccggcagugguucuucgaucuaccccugcccuggaccucaggagccacaaccgagacgcccaccuggaaccgcaaggagcuccuggucaccuucaagaacgcccacgccaagaaacaggaggucguggugcugggcucccaagaaggcgcgaugcauaccgcccucacgggcgccaccgagauccagaacagcggcgggaccuccaucuucgccggccaccuuaagugcaggcuuaagauggacaaacuugaacugaagggcaugagcuacgccauguguaccaacacguucgugcuaaagaaggagguguccgagacccaacacgggacuauccucaucaagguggaguacaaaggcgaggaugucccaugcaagauccccuucagcaccgaggaugggcagggcaaagcgcacaacggccgccugaucacggccaacccuguggucaccaagaaggaggagccggucaacaucgaggccgagccgcccuucggggagaguaacaucgugaucggcaucggggacaacgcccugaaaauuaauugguacaagaagggcagcagcauugggaaaauguucgaagcaaccgcccggggugcccgccggauggccauccugggagacaccgcaugggacuucggguccgugggcgggguccucaacagccuuggcaagauggugcaccagaucuucggguccgcguacacugcccuauucagcggggucuccugggucaugaagaucgggaucgggguucuccugacguggauagggcucaacaguaagaacacguccaugucuuucuccugcauugccaucggaauaaucacccucuacuuaggcgccguuguccaggcugacaugggcuguguuaucaacuggaagggcaaggagcugaaauguggaagcgggaucuucgugacgaacgagguccacacguggaccgaacaauacaaguuccaggcagacucccccaagcgccucgcaaccgccaucgccggcgcuugggaaaacggggugugcggcauccgcagcacgacccggauggaaaaccugcuguggaagcaaaucgcgaacgagcucaacuacauucugugggagaacaacaucaaacuuaccgugguagugggggauaucaucggggugcuggaacaaggaaagcgcacccugacgccucagccgauggagcuaaaauauuccuggaagacguggggcaaggcgaagaucguuacggccgagacgcaaaacuccuccuucaucaucgacggcccgaacacucccgagugcccgagcgccagucgggcuuggaacgugugggagguggaggauuacggauucgguguuuuuaccaccaacaucuggcucaagcugcgagagguguacacccaacugugugaucaccgccugaugagcgcugccgucaaggacgagcgcgcgguccacgccgacaugggcuacuggauagagagccagaagaacgggucuuggaaacuggagaaggcgagccugauagaggugaagaccugcacguggccgaagucccacacccucuggagcaacgggguacuggaauccgacaugaucaucccuaaaagucuggccggacccaucucccagcacaacuaccggccgggcuaccacacccaaaccgccgggcccuggcaccucggcaagcuggagcucgacuucaacuauugcgagggaacgaccguggugaucaccgaaaacugcgggacccgcggccccagccuccggacaaccaccgugagcgggaagcugauccaugaauggugcugucgcagcugcacacugcccccgcuacgcuacaugggcgaagacggaugcugguacgggauggagauccgucccauuuccgagaaggaggaaaauauggucaagucacugguguccgccggcaguggggaaguggauaacuucacaaugggcguccugugccuugccauccuguucgaggaggugaugcgggggaaguuugggaagaagcacaugauugcuggaguauucuuuacguuuguccuacucuugucaggacagaucaccuggcgcgacauggcccacacccugauaaugaucgguagcaacgccucggaccggaugggcaugggcgugacguaccuagcccucaucgccaccuucaaaauccagcccuuccucgcgcucggguucuuccugcgcaaacugaccagccgggagaacuuguuacugggugugggccucgccauggccaccacgcugcagcuucccgaggacaucgagcagauggccaacggaaucgcgcucggccugauggccuugaagcucaucacccaguucgagaccuaccagcuguggaccgcucugaucucgcucacgugcucuaacaccaucuucacccucaccgucgccuggcgcacggccacacugauccucgccggggugagccugcugccugucugccagucaagcaguaugcggaagacugacugguugcccaugaccguggccgccaugggcgugccaccccugccguuguucauuuucagucucaaggacacgcugaagcgccgcagcuggccccuuaacgagggggucauggcagugggccucguaagcauccuggccuccagccugcuacggaacgacguucccauggcuggcccucugguggccggcggccuguugaucgcgugcuaugucaucaccgguacuuccgcagaccucaccgucgagaaagcagcggauguaaccugggaggaggaagcagagcagaccggcgugagccacaaccuaaugauuaccgucgacgaugacgggaccaugcgcauuaaggacgacgagaccgagaauauccuuacggugcugcugaagaccgcccuccugaucgugagcggcaucuucccguacucgaucccugccacgcugcucgucuggcacacuuggcaaaagcagacgcagcgguccggagugcugugggacgugcccucgccacccgagacccagaaggccgagcucgaagaggggguauaccgcaucaagcagcaggguauauucgggaaaacacaggugggcguaggaguccagaaagaggggguguuccacaccauguggcacguaacgcggggcgcgguucucaccuacaacgggaagcgacuagagcccaacugggcuucagugaaaaaggauuuaaucagcuacggcggcggauggcggcucucggcccaguggcaaaagggggaggaggugcaagucauugcuguggagcccgggaagaacccuaaaaacuuucagacuaugcccggcaccuuccaaacuaccaccggcgaaaucggcgcuaucgcccuggacuucaagccagggaccagcgguagcccgaucauuaaccgugaaggcaagaucguggggcuuuacggaaacggugucgugacgaagaacggcggguauguuuccggcaucgcccagacgaacgccgagccagacggccccacccccgagcuggaggaagagauguucaaaaagcggaaccuuacgaucauggaccuccaccccgggagcggcaagacgaggaaguaccugccggccaucgugcgggaagcgauuaaacgccggcucaggacccugauccuggccccaacccgggugguggccgccgagauggaagaggcuuugaaggggcugcccauccgauaccagaccacggcgaccaaguccgagcacaccggacgggagauaguugaccugaugugccaugcaaccuucacgaugcggcuccugaguccagugcgggugccgaacuacaacuugaucauaauggacgaggcccacuucacugaccccgccuccauugccgcgcgcggguacaucagcacucgggucggcaugggagaggccgcugccauuuucaugaccgcgacgccacccgggaccgccgacgcuuucccgcaguccaacgcgccgauccaagacgaagaacgcgacauccccgaacgcagcuggaacuccggcaacgaguggaucacugacuucgcuggcaagaccgugugguucguucccagcauaaaagcgggcaacgacaucgcgaauugccucagaaagaacgggaagaaggucauccagcucucccgcaagacguucgacacggaguaccagaagacgaagcugaacgacugggacuucguggugaccaccgacaucagcgaaaugggcgccaacuucaaggccgaccgggucaucgacccgcgccguugucucaaacccgugauccuaaccgacggccccgagcgcgugauccuggccgggcccaugccggucaccgcggccagcgccgcacagcggcgcggccggguggggcguaauccccaaaaggagaacgaucaguacaucuucaccggccagccccucaacaacgacgaagaccacgcccauuggaccgaggcgaaaaugcugcuggauaauauaaacacgcccgaggggaucaucccggcccucuuugaacccgaacgggagaaguccgccgcuaucgacggcgaguaccgccugaagggcgaguccagaaagaccuucguugagcugaugcgccgcggggaccuccccgucuggcuggcucacaaaguggccagcgagggcaucaaauacaccgaccgaaagugguguuucgaugggcaacggaacaaucaaauccuggaggagaacauggacguugagaucuggaccaaggagggcgagaagaagaaacuucgcccgcgguggcuagacgcccgcacuuacuccgacccccucgcucucaaggaguucaaggacuucgcggcgggcagaaagaguaucgcccuggaccuggugacagagaucgggcgcgugcccacccaccucgcacaucggacccggaacgcccuugacaauuuggugauguugcacaccuccgagcauggggguaaggccuaccggcaugcgguggaggaacucccugaaaccauggaaacccugcuccugcugggccucaugauccuguuaacugggggcgccaugcuguuccugaucagcgggaaggggauagggaagacgagcaucgggcuuaucuguguuaucgccuccagcggcaugcucuggauggccgagauaccccugcaguggauagccuccgcgauaguccuggaguucuuuaugaugguacuccugauccccgagccugaaaagcaacggacgccccaagauaaccagcuggcguacguagucaucgggauccucacccuggccgccaccaucgccgcaaacgagaugggccugcucgagacgaccaagagagaccucggcaugagcaaggagccugggguggucuccccgacuagcuaccuggaugucgaccuccaccccgccuccgccuggacccuguacgccguggcuacgaccgugaucaccccgauguugcggcauacgaucgagaacucuacggccaacgucucccuggccgccaucgcaaaccaagcgguuguucugaugggcuuggacaagggguggccgaucagcaagauggaccucggagucccucugcuggcccucgggugcuacucccaggugaacccgcugacccugacagcugccguacuccugcugauuacgcacuaugccauuauuggucccggccugcaggcgaaggcuacgcgcgaggcccagaagcggaccgcugcagggaucaugaagaauccgaccgucgacgggaucaugaccaucgacuuggaccccgugauuuaugauagcaaguucgaaaagcagcugggccaggugaugcuccugguccugugcgcggugcaauuacugcuaaugcgcacguccugggcccuuugcgaagcccugacccuggccaccggaccaaucacgacgcugugggaggggucacccgggaaauucuggaacacgaccaucgcgguguccauggccaacaucuuccgggggagcuaccuagccggggcggggcuggcauuuucuaucaugaagucagucgggacaggcaagcgcggcaccgggagccagggcgagacgcucggggagaaauggaagaagaagcugaaccagcuaagccggaaggaguucgaccucuacaagaaguccggcauuacagaaguggaccgcacggaggcgaaggaagggcugaagcggggcgagauuacccaucaugccguaagucgugguuccgccaagcugcagugguucgucgagcggaacauggugaucccggaggggcggguuaucgaccugggaugcgggcggggugggugguccuacuacugcgccggccugaagaagguaacggaggugcggggcuacaccaaaggcgggcccgggcaugaggaacccgugcccaugucaaccuacggcuggaacaucguaaagcucauguccgggaaggacguguucuaccugccgcccgaaaagugugacacccugcugugcgacaucggcgagagcucucccucgccgaccguggaggagucccgaaccauuaggguccugaagaugguugagccguggcucaagaacaaucaguucugcaucaaggugcugaaccccuauaugccaaccgucaucgagcaccuggagcgccuccagcggaagcacggcgguaugcugguacguaaccccuugagccggaacuccacccacgagauguacuggauaagcaacgguacggggaacaucguagcaucuguuaacauggugagucgccuacucuugaaccgguucaccaugaccuacagacggccgaccauagagaaggacgucgauuuaggugcggggacgcgccaugucaacgccgagcccgaaacccccaacauggacgugauaggggagcggaucaagaggaucaaggaggagcacaacagcaccuggcacuacgacgacgagaacccguacaagaccugggccuaccacggcagcuacgaggugaaggccacggggagcgccucauccaugaucaacggcgucgugaaacuuuuaaccaagccuugggacguggugccuaugguaacccagauggcaaugaccgauacgacgccuuucgggcaacaacgggucuucaaggaaaagguggacacccgcaccccgcgaucgaugccgggcacgcgccgggugaugggcaucaccgccgaguggcucuggcgcacccugggccggaacaaaaagccccgccuuugcaccagagaagaguucacgaagaagguccgcaccaacgccgccaugggcgcgguguuuaccgaggagaaccagugggacagcgccaaagccgccgucgaggaugaggacuucuggaaacucguggaucgcgagcgggaguuacacaagcuggggaagugcggcagcuguguguacaacaugauggggaaacgcgagaagaaacuuggcgaguucggcaaagccaaggggagcagagcgaucugguacauguggcugggggcccgcuaccuggaguuugaggcccuaggguucuuaaacgaggaccauugguucucccgggagaacagcuacuccggcguggagggcgagggcuuacacaagcuaggguacauccuacgcgacaucagcaagaucccuggcggcgccauguaugcagacgacaccgcugggugggacacgcggaucacugaagacgaccugcauaacgaggaaaagaucacccaacagauggacccggagcaucgccagcucgccaacgccaucuucaaguuaaccuaccagaauaaggucgugaaagugcaacggccgaccccuacggguaccguaauggacaucauuagucgcaaggaccagcgcggcucuggccaggugggcaccuacgggcuaaacacuuucacgaacauggaggcccagcucauccgucagauggagggcgagggggugcuguccaaggccgaucuggagaacccgcaccucccggaaaagaagaucacccaguggcuggaaaccaagggcgucgaacgguuaaagcgcauggccauaaguggagacgacugcguggugaagcccauugacgaccgguucgcuaacgcccuccuggccuugaacgacauggggaaaguccguaaggauaucccucaguggcaaccuucuaagggcuggcacgacuggcagcaggucccguucugcagccaccacuuccacgagcucauaaugaaggacgggcggaagcugguggugccuugccgcccgcaggacgagcugaucggucgggcucgcauuucccagggggcgggcuggagccuccgggagaccgccugccugggcaaggcauacgcgcaaauguggucccugauguacuuucaccgccgggaccuacgauuagcgagcaaugccaucugcuccgcagugcccguccacuggguaccgacgagccgcaccacauggaguauccacgcgcaccaccaauggaugaccaccgaggacaugcugacggucuggaaccggguuuggaucgaggacaaccccuggauggaggauaaaacgcccgucaccacgugggagaacgugcccuaccuggggaaacgcgaggaccaguggugcggcagcuuaaucgggcugaccagccgggccaccugggcacagaacaucccgaccgccauacagcaggucagaucccucaucggcaacgaggaguuucuggacuacaugcccagcaugaagcguuuccgcaaggaggaggagucugagggagccaucugguga

SEQ ID NO: 26052 - RNA, 9873 nt, Artificial Sequence
  derived and/or modified CDS sequence (opt11) from DENV-3__FJ639785__SS-prME
accagccucugccucaugaugauccugccagccgcuuuagcuuuccaccucaccucucgggauggcgagccccgaaugaucguugggaagaacgagcgggggaaaagccuacuguucaagaccgccagcgggaucaacaugugcacccuaaucgcaauggaccugggugagaugugcgacgacacgguuaccuauaagugcccgcacaucaccgagguugagcccgaggauaucgacuguuggugcaaccugaccuccacuuggguaaccuacgggacgugcaaccaggccggugagcaccggcgcgauaaacgaagcguggcccucgcgccccacgugggcauggggcuggauacacgcacccaaaccuggauguccgcagagggcgccuggcgccagguugagaagguggaaacgugggcccugaggcaucccggguucaccauauuggcgcuguuucuagcccacuacaucgguaccucacucacacagaaagugguuaucuucauccugcugaugcucgucacgccaagcaugaccaugcggugcguaggggugggcaacagggacuucgucgagggucugucaggggccaccuggguggacguuguccuagagcacggcgggugcgugaccacgauggcgaagaacaagcccacacuugacauagagcugcagaagacggaggccacccagcuggcgacguuacggaaauugugcaucgaaggcaagaucaccaacaucaccaccgauagccgcugucccacgcagggggaggcugugcugccugaggagcaggaucagaacuacgucugcaagcacaccuacgucgaccggggcuggggcaacgggugcggccucuucgggaaaggcucgcuggugaccugcgccaaauuccaaugccuugaaccgaucgaggggaaaguggugcaguaugaaaaccugaaguauaccgugaucaucacgguccacacgggggaccagcaccaaguaggcaacgaaacacagggggucaccgccgagaucacgccccaggccagcaccaccgaggcgauacugcccgaguauggcacccuugggcuugagugcucaccgcgaacgggucuggacuuuaacgagaugauucuguugacaaugaagaacaaagcguggauggugcaccggcagugguuuuucgaucugccucugcccuggaccagcggcgcgaccacugagacuccaacguggaaccgcaaagagcuccugguaacguucaagaacgcccacgcaaagaaacaggagguuguuguauuggggucacaggagggcgcgaugcacacggcguugaccggugccacggaaauccaaaacucgggcgggaccuccauauucgccgggcaccugaagugccgguuaaaaauggacaagcucgagcugaaaggcauguccuaugccaugugcacaaacacuuucguccugaagaaagaaguguccgaaacucaacacgggaccauccuuaucaagguggaauacaagggagaagacgucccgugcaagaucccguucucaaccgaggacggacaggggaaggcgcauaacggccggcucauuacggcgaacccaguggugacgaaaaaggaggagcccguuaacaucgaggcugagccgccauuuggagagagcaacaucgugauaggaauuggcgacaacgcccugaagaucaacugguacaagaagggcucaagcauuggaaaaauguucgaggcgaccgcccggggcgcccgcagaauggccauccugggagacaccgcuugggacuucggcucagugggcggaguccugaacagccuggggaagauggugcaucaaaucuucggauccgcuuacacggcguuguucagcggcgucuccugggucaugaagauuggcaucgguguguuacuaaccuggauuggcuuaaauagcaagaacaccuccaugagcuucuccuguaucgccaucgggaucaucacccuauauuuaggcgcugugguccaggccgacauggggugcgugaucaacuggaagggcaaggagcugaagugcggaagugggaucuucguuacgaacgagguccacaccuggacggaacaguacaaauuucaggcggacagucccaaacgcuuagcuaccgccauagccggcgccugggagaacgggguaugcggcauccgaagcacgacccggauggagaaccuacuguggaagcagauagcuaacgagcucaacuacauuuugugggaaaacaacaucaagcugaccguugugguuggcgauacgaucggcguucucgagcaggguaaacggacgcugacaccccagccgauggagcuaaaguacucuuggaagaccuggggcaaagccaaaaucguaaccgcugagacgcagaacagcuccuucaucaucgacggcccaaacacccccgagugccccagcgccucgagggcauggaacgugugggagguggaggauuacggauuuggcgucuucacaacuaauauauggcucaagcugcgcgagguguacacccagcugugcgaucacaggcucaugagcgcagccguaaaggaugagcgcgccguccacgccgauaugggcuacuggaucgagagccagaagaacggguccuggaaacuggaaaaggcgagcuuaaucgaggugaagacguguacauggccgaagucccacacccucuggagcaacggcgugcuggaauccgacaugaucaucccaaaaagccuugcugggccaauaucccaacacaacuaccggccggguuaccacacccagacggccggccccuggcauuuaggcaagcuggagcuggauuucaacuacugugagggcaccacagucgugaucaccgagaacugcgggacaagaggccccagccuccgaacgacaaccgucuccggaaagcugauccaugaauggugcugucgaagcugcaccuugcccccguugagguacaugggugaggaugggugcugguacggcauggaaauuaggccgaucuccgagaaggaggagaacauggucaaaucgcucgucagugccggcagcggggagguggauaacuuuacuaugggagugcugugucucgccauucuguuugaagagguuaugcgggggaaguuuggcaagaaacacaugaucgccgggguuuucuucaccuucguacugcuccuguccggccagaucaccuggcgcgauauggcccacacucugaucaugaucggcaguaacgccagugaccggauggggaugggcgugaccuaucucgccuugaucgccaccuuuaagauucagcccuuccuggcgcucggguucuucuuacggaaacugacgagccgggaaaaccuacugcugggcgugggccuugccauggccacaacccugcaacugccggaagacauugagcagauggccaaugggaucgcguugggccugauggcccugaagcugauuacacaguucgagaccuaucaacuguggacagcucugaucagccugaccugcuccaacaccaucuucacccugacuguggccuggagaaccgccacucugauacucgcgggggugagucuccugcccgugugucagucuucaucgaugcggaaaaccgauuggcuccccaugacgguggccgccauggggguuccuccccucccgcuguucaucuucagcuuaaaggauacucugaagcgcagauccuggccuuuaaacgaaggggucauggccgucggacucgugagcauucuggccagcagccugcuccguaacgacguccccauggccggaccccugguggccgggggcuugcucaucgccugcuaugugaucaccgggaccuccgccgaccucacggucgaaaaagccgcggacgugaccugggaggaggaggcugagcagaccggcgugucucacaaccuaaugaucacagucgacgacgacgguaccaugaggaucaaggacgacgaaacugaaaacauucugacuguucugcugaagaccgcccuccuuauaguguccggcaucuucccuuacagcauccccgccacccuacuggucuggcacacguggcagaagcagacccagcggaguggggugcuuugggaugugcccagcccgcccgagacccagaaggcugagcuggaggagggggucuacagaauaaagcagcagggcaucuuugggaaaacccaagugggaguagggguccagaaggagggcguguuccacacuauguggcacgucacccggggagccguccucacauacaacgggaagcgccuagaacccaacugggcuuccgucaagaaggaccucauaagcuacggugggggcuggcggcucucagcccaauggcaaaaaggagaggagguucaggugaucgcgguggagccgggcaagaaccccaagaacuuccagaccaugcccggcacguuccagaccaccacgggugagauaggcgcgauugccuuggauuucaagccagggacgaguggcagccccaucaucaaccgcgaaggcaagguggucgggcuguacggcaaugggguugugaccaagaacggaggguacgucuccgggaucgcccagaccaacgccgagccugacggccccacccccgagcuugaggaagaaauguuuaagaagagaaauuuaacgaucauggacuuacaucccgggagcggcaaaaccaggaaguaucugcccgccauugugcgggaagcgaucaagcgccgucuccgcacacucauacucgcccccaccaggguggucgcagccgagauggaggaagcccucaaaggacugccgauucgcuaccagacaacggccaccaaguccgagcacaccggccgggagaucguggaccugaugugucaugccaccuuuacaaugcgccucuugagccccguacgggucccuaacuauaaccugaucaucauggacgaggcccacuucaccgaucccgccagcauagccgcgcgaggguacaucaguacccggguagggaugggcgaggccgccgccaucuuuaugacggcgacgccuccagguaccgcagacgccuucccgcaguccaacgcccccauccaggacgaagaacgcgauaucccugagcgcucguggaacuccggcaacgaguggaucaccgacuucgcagggaagacggugugguucgucccgagcauaaaagcggggaaugacaucgcgaacugcuugcggaagaacgggaagaagguaauccaacucucccgcaagaccuucgacaccgaguaccaaaagaccaagcugaacgauugggacuucguggucacgacggacaucagcgagaugggcgcuaacuucaaggcagaccggguaauugacccgcgacggugcuuaaagccggugauccugaccgacggccccgagcgcgucauacuggccgggcccaugccggugaccgcggcuagcgccgcccagcgacgaggccggguggggcgcaacccacaaaaggaaaacgaccaauacaucuucacgggucagccgcucaacaacgaugaagaccacgcccacuggacggaggccaaaaugcugcucgacaacaucaacaccccugaggggaucaucccggcccucuucgagcccgagcgagaaaagucugccgcgaucgacggcgaauaccgccugaaaggcgaauccagaaagaccuucguggaacugaugagacgaggggaccuccccguuuggcuggcgcauaaggucgccagcgagggaauaaaguacacagacaggaaguggugcuucgacgggcagcggaacaaccagauuuuagaggagaacauggacguggagaucuggacgaaggagggugagaagaagaaacuucggccacgguggcuggacgcccgcaccuacucugacccgcuggcccucaaagaguucaaagacuuugccgcggggcgcaaaagcauugcucuagaccuggugacugaaaucgggagggugcccacccaccuggcgcaccgcacgcggaaugcucuggacaaucucgugauguugcacaccuccgagcacggcgguaaagccuaucgccacgcgguggaagaacugcccgagacaauggagacccuccugcuacuuggcuugaugauccuguuaacgggcggcgcuaugcuguuccugaucagcgggaaggggaucgggaagaccagcaucgggcugaucugugucaucgccuccagcggcauguuguggauggcagagauaccccuccaguggaucgccuccgcuaucgugcuagaguucuuuaugauggugcuccugaucccggagccggagaagcagcggacgccccaggacaaccagcuagcguacgucgugauugguauccucacccuggccgcgacgauagccgcaaacgagaugggauuacucgagaccaccaagcgugacuugggcaugagcaaggagccaggaguuguuucccccacgagcuaccuagacguggaccuccaccccgccucggcguggacgcuguacgccgucgcgacgacggucauuacacccaugcuccggcacacgaucgagaacagcacggccaacgucucccucgcugccauugcuaaucaggcgguugugcugaugggacuggacaagggguggccgaucagcaagauggaccucggcgugccccugcucgcacucgguugcuauucccaagucaacccgcugacccuaaccgccgccguccugcugcugaucacgcacuacgcgaucauuggucccggccuccaagcgaaggccacccgcgaggcccagaagcggaccgccgccgguauaaugaagaaccccacuguggacggcaucaugaccaucgaccuggauccuguaaucuacgauagcaaguucgagaagcaacugggucagguaaugcugcugguacuaugcgcagugcaacuccugcugaugcguaccuccugggcccuaugcgaggcucugacucuggcuacuggacccauuacuacacuaugggaggguagccccgguaaguucuggaacacgaccauagcggucuccauggccaacaucuuccguggcagcuaucuagcgggggcuggcuuagcguucaguaucaugaaauccguggggaccggcaagcggggcacagggucccagggcgagacgcuaggggagaaauggaagaagaagcugaaccagcugagccggaaagaguucgaccucuacaaaaaguccggcaucaccgagguugaccgcaccgaagcgaaggaggggcugaagcggggcgagaucacgcaucacgccgucucacguggauccgccaagcugcagugguuuguggaacggaacauggugauaccggaggggcgcgucaucgaccucgguugcggcagaggagggugguccuacuacugcgccggccucaagaagguaacugaagugcgcggauauaccaagggcgguccaggucaugaggagcccguacccaugagcaccuauggauggaacauagucaaacugaugucugguaaggauguauuuuacuugccgcccgagaagugcgacacguuacugugcgacaucggugaaagcucacccagcccgaccguugaggagucccggaccauccgugugcugaaaaugguugaaccguggcucaagaacaaccaguucugcauaaagguccugaaccccuacaugcccaccgugaucgagcaucuggagcgccuucagcggaagcacggcggaaugcuggugcgcaaucccuuaucgcggaacucgacgcacgagauguacuggauuucaaacggcaccgggaacauagucgccucagugaacauggugagccgccuccugcuaaaccgguucaccaugacacaucgccguccuaccauugagaaggaugucgacuugggagcgggcacucgccacgugaaugccgaacccgagacacccaacauggacguaauaggggagcggaucaagcgcaucaaggaggaacacaacuccacuuggcacuacgaugaugaaaacccguacaagacgugggcguaccauggaagcuacgaagucaaggccaccggguccgccagcuccaugaucaauggcguggucaagcugcugacuaaacccugggacgugguccccauggucacccagauggcgaugaccgacacaacucccuucgggcaacaacguguuuucaaggaaaagguggauacaaggacgccgcguagcaugcccggaacccgccgggucaugggaaucacagcagaauggcuguggcgcacacuggggcgaaacaaaaagccccgccugugcacccgggaagaguuuacaaagaaggugagaaccaacgccgcuaugggagcuguguucaccgaggagaaccagugggacagcgcuaaggccgcggucgaagacgaggacuucuggaagcucguggaccgcgagagagagcugcauaagcuggguaagugcggcaguuguguuuacaacaugaugggaaagagggagaaaaagcucggcgaauuuggcaaggccaaggggagccgagcgauuugguauauguggcuuggcgccagguaucuagaguucgaagcucucggguuccucaacgaggaccacugguucucucgggagaacucauacuccggcgucgagggggagggccuacacaagcucggcuauauccugcgcgacauaagcaagaucccugggggcgccauguacgccgaugacacugcggggugggacacccggauaacggaagacgaccugcacaacgaggagaaaaucacccaacagauggacccugagcaccgccagcucgcgaacgccaucuucaaacugacguaccaaaacaagguuguaaagguccagcgacccacgcccaccgggacugugauggacaucauuucccgcaaggaccaacgaggcagcggucaggugggcaccuaugggcugaacacguuuacuaacauggaagcccagcucauucgccaaauggagggcgagggaguccuguccaaggccgaccuggagaacccccaccucccggagaagaaaaucacccaguggcuggagaccaagggcguagagcgcuugaagcgcauggcgaucaguggagacgacugcguggucaaacccaucgacgaccgauucgcgaaugcgcuacuugcguuaaacgacauggguaaaguccggaaggacaucccccaauggcagcccuccaagggauggcacgacuggcagcaggucccauucugcagccaucacuuccaugagcucaucaugaaggaugggcggaaacucgucguuccgugccgaccucaggaugaauugauugggcgggcgcgcaucucgcagggggccggcuggagucuacgagaaacggccugcuuggguaaggccuacgcucagauguggucgcuaauguacuuccaccgccgcgaccugcgacuagccagcaaugccaucugcucugccgugcccguacacugggugccuaccagccgcaccaccuggucuauacacgcccaccaccaauggaugacgaccgaagauaugcuaaccguguggaaccgcguauggauagaggacaaccccuggauggaggacaaaacucccgugacgaccugggagaacgugccuuaucucgggaagcgugaggaccaguggugcggcucguuaaucgggcugaccagccgggccaccugggcccagaacauaccgaccgccauacagcagguccguagcuugaucggcaacgaggaguuucuugacuacaugcccucuaugaagcgguuccgcaaagaggaggaaucagagggggccaucugguag

SEQ ID NO: 26053 - RNA, 9873 nt, Artificial Sequence
  derived and/or modified CDS sequence (opt11) from DENV-3__FJ639786__SS-prME
acuagccucugccucaugaugauccugcccgccgcccuggcguuccaccugaccucgcgggacggcgagccucgcaugaucguggggaaaaacgagcggggcaagagccugcuguucaagaccgcgagcggaaucaacaugugcacccucaucgcuauggaccugggcgagaugugcgacgauaccguuacguacaagugcccccacaucacugagguggaacccgaggacaucgacugcugguguaaccugaccagcaccugggugaccuacggcaccugcaaccaggcgggggagcaccgccgcgacaagcgguccgucgcucuagcgccccacgugggcaugggguuggacacccgcacccagaccuggaugagcgccgagggcgccuggcgacagguggagaaggucgagacgugggcccugcgccacccuggauucacuauccuagcgcuguuccucgcccauuacaucggcacaagucucacccaaaagguggugaucuucauccugcugaugcucgucacgcccucaaugaccaugcggugcgugggggugggcaaccgcgacuucgucgagggccuguccggggcgaccuggguggacguggugcuggaacacggcgggugcgugaccaccauggccaagaauaagcccacccuugacaucgagcugcagaagaccgaggccacccagcuggcgacgcuccggaagcugugcaucgagggcaaaaucaccaacaucaccaccgacagccgcugccccacgcaaggcgaggccguccuuccagaggaacaggaccagaacuacgucugcaaacacaccuauguggaucgaggguggggcaacgguugcgggcuuuucgggaagggaucccucgucaccugcgccaaguuucagugccuggagcccaucgagggcaaagucgugcaguacgagaaccucaaauacaccgugaucaucaccguucacacuggggaccagcaccaagugggaaacgagacccaaggagucaccgccgagaucacgccgcaggccagcacaacugaggcgauuuugccagaauacgguacccuggggcucgagugcuccccgagaacaggccuggacuucaacgagaugauccuucucacgaugaagaacaaagcauggauggugcaccggcagugguucuucgaccugccccuacccugggccagcggggcuaccaccgagacccccacguggaaucgcaaagagcuccuggugaccuuuaagaaugcccaugccaagaagcaggaagucguggugcuggggucccaggagggcgcaaugcacaccgcccugaccggggccacggagauccagaacucgggcgggaccucuaucuucgccggccaccugaaaugccggcugaagauggacaagcuggaguugaaggggaugagcuacgcgaugugcaccaacaccuuugucuugaagaaggagguauccgagacgcagcacgggaccauucucaucaagguggaguacaagggcgaagacgucccgugcaagaucccauucagcaccgaggacgggcaaggcaaggcccacaacggccgccugaucaccgccaaccccguggugacgaagaaggaggagcccguaaacaucgaggcggaaccgccguucggggagagcaauauagugauuggcauaggcgacaacgcacugaagaucaacugguacaagaagggauccagcaucgggaagauguucgaggcuaccgcccggggcgcccgccggauggccauacugggcgauaccgcgugggacuucggguccgugggcgggguccucaacagccugggcaagauggugcaccagaucuucggguccgccuacaccgcccucuuuucgggcgucagcugggucaugaagaucggcaucgggguguugcucacguggaucggccucaacagcaagaacacguccaugagcuucuccugcaucgccaucgggauaaucacccucuaccugggcgccgugguccaggcggacaugggcugcgucaucaacuggaagggcaaggagcucaagugcggcagcgggauuuuugugaccaacgaaguccacacguggacugaacaguacaaguuccaggcagacucccccaagcgccucgccaccgccaucgccggagcgugggagaacgggguguguggcauucgcagcaccacgcggauggagaaccuucuguggaaacagaucgccaacgagcucaacuacauccuaugggaaaacaacaucaagcugacagugguggugggggacaucaucggcgugcucgaacagggcaagcgcacccugacgccccagccgauggagcugaaguacucuuggaagacaugggggaaggccaagaucguuaccgccgagacccagaacagcagcuucauaaucgacggcccgaacacccccgagugccccagcgcgagucgggccuggaauguaugggagguggaggacuacgguuucggggucuucacgaccaacaucuggcucaagcugcgcgaggucuauacccagcugugcgaccaccggcucaugagcgcggccgucaaggacgagcgcgccguccaugcagacaugggcuauuggauagagucgcagaaaaacggaagcuggaagcuggagaaggccagcuuaaucgaggugaagaccugcaccuggccgaagucccauacgcucuggagcaacggcgugcuggaguccgacaugaucaucccgaagagucuggccgggcccaucucccaacacaacuaucggccgggcuaccacacgcagaccgccgggcccuggcaccuaggaaagcuggagcuggacuucaacuauugcgagggcaccacagucguuauaaccgagaacugugggacccgcggacccagcuugcggaccacgacagucuccgggaagcuuauccacgaguggugcugccgcagcugcacccugccuccgcucagguacaugggcgaggacgggugcugguauggcauggaaauacgccccauauccgagaaggaggagaacauggucaagagccugguguccgcgggcagcggggagguggacaacuucaccaugggcguccugugccucgcgauucuguucgaagaggugaugcgcggaaaguucggcaaaaagcacaugaucgccgggguguucuucacguucguccuucuccuguccggccagaucaccuggcgcgacauggcccacacccugaucaugaucggaagcaacgccuccgaucggaugggaaugggugugacguaccuagcccugaucgcgacguucaagauucagccuuuccuggcccugggguuuuucuuacgaaaguugaccagccgggagaaccuccugcugggcgugggccucgccauggccaccacccugcaguuaccugaggacaucgagcaaauggccaacgggaucgcacucggcuugauggcucugaaguuaaucacgcaguucgaaaccuaucagcuguggaccgcucuuaucagccugaccugcucaaacacgaucuucaccuugaccgucgccuggcgcaccgcgacgcugauccucgcaggggugagccugcugccggucugccaguccucuuccaugcggaaaacagacuggcuccccaugacaguggccgcgaugggcgugccgccccucccgcuguucaucuuuucucucaaggacacccucaagcgccgcuccuggccccugaacgagggggucauggccgugggccucgugagcauccuggccucgagcuuacucagaaacgacgugccaauggcaggcccccuuguggccgggggucugcugaucgccugcuauguuaucaccgggaccuccgccgacuuaacuguggagaaggcggccgacgugaccugggaagaggaggccgagcagacgggcgugucucacaaccugaugaucaccgucgacgaugacgggaccaugcgcaucaaggacgacgagaccgagaauauacucaccguucugcugaagacggccuuguugauaguguccggcaucuucccguacucgauccccgcgacccugcucgucuggcacaccuggcagaagcagacccagcgguccggcgugcugugggacgugcccagcccgcccgagacgcagaaggcggagcuggaggagggggucuaccgcaucaagcagcagggcaucuucgggaagacccagguuggcguggggguccagaaagagggcguauuccacaccauguggcacgugacccggggcgcaguccucacguacaacgggaagagacuggagccgaacugggcgucugucaagaaagaccugaucucauauggcgggggcuggcgucucuccgcccaguggcagaaaggugaggaggugcaggucauugcgguggagccgggcaagaauccgaagaacuuccagaccaugcccggcaccuuccagaccacgacuggggagauaggcgccauugcccuggauuucaagcccgggaccagcggcagcccaaucaucaaccgcgagggcaaaguagucggccuguacgggaacgggguggugaccaagaacggcggguacgucaguggcaucgcucagacgaaugccgagccggacggccccacccccgagcuggaggaggagauguucaagaaacggaacuugacgauuauggaccugcacccggggagcggcaagacucgcaaguaccuacccgcgaucgugcgagaggccaucaagagacggcuccgcacgcugauacuggccccaacucgggucguugcggcugaaauggaagaggcgcucaaggggcugcccaucagauaccagacaaccgcaacgaaguccgagcacaccggccgggagauaguggacuugaugugccacgccaccuucaccaugcgacuacugagccccgugcgggucccgaauuacaaccugauuauaauggaugaggcccacuucacugaucccgccuccaucgcggccaggggguacaucagcacccgggugggcaugggcgaggccgcugcgaucuuuaugaccgcuacaccgccugguacggccgacgccuuuccgcaguccaaugcccccauccaggacgaggagcgcgacauuccugaacgaucuuggaacaguggcaacgaguggaucaccgauuucgcggggaagaccgugugguucgucccaaguaucaaggccgguaacgacaucgccaacugucuccggaagaacgggaagaaggugauacagcuuagccgaaagaccuucgacacggaguaucagaagaccaagcuaaacgauugggacuuugugguuacaaccgauauuagcgagaugggcgccaacuucaagacggaccgugucaucgacccgcgcaggugccucaagcccgugauccuaacagaugggcccgagcgcgucauacuggccgggcccaugccaguuaccgcggccuccgccgcccagcgucgcggcaggguggggaggaauccucagaaggagaacgaccaguacaucuucaccggucagccccucaacaacgacgaggaccacgcccacuggaccgaggcgaagaugcugcuggacaacaucaacacgcccgagggcauaaucccugcccucuuugagcccgagcgggaaaaauccgccgccaucgacggcgaguaccgccugaagggcgagucccggaagaccuucgucgagcugaugcgccgcggggaccucccugugugguuagcgcacaagguugcaagcgaaggcaucaaguacaccgaccguaaguggugcuucgacgggcagcggaauaaccaaauccuggaggagaacauggacgucgagaucuggaccaaggagggcgagaagaagaagcuccgcccacgcuggcuggacgcccgcacguacuccgauccacuggcccucaaggaauucaaggauuucgccgcgggccgcaagagcaucgcgcuggaccugguaacugagaucgggcgagucccgacccaccucgcacaccgcacccggaacgcgcucgacaaccuggugaugcuccauaccucugagcacggcggaaaagcauaccgacacgcgguugaagaacugccagagaccauggaaacgcuccucuugcugggccucaugauccugcugaccgguggcgccaugcuguuucugaucucuggcaaggggaucggcaagaccagcauuggacugauuugcgucaucgccucgagcgguauguuauggauggccgagauuccccuacaauggaucgccuccgcgauagugcuggaguuuuucaugaugguguugcucauccccgaaccggagaagcagcggacgccccaagacaaccaguuggcauacgucgugaucgggaucuugacccuagccgccaucaucgccgccaacgagaugggccuguuagagaccacgaagcgcgaccugggcaugagcaaggagccgggggucgucaguccgaccaguuaccuggauguugaccuccacccggccuccgcauggacgcuguacgccgucgccacuacggucaucacccccaugcugcggcacaccaucgagaacagcaccgcuaaugugucgcucgcugccaucgccaaucaggcugucgucuugauggguuuggacaagggguggccaaucagcaagauggaccuuggcgugccccugcuagcccucgggugcuacucccaggugaacccccugacgcuuaccgccgccguucuccugcugaucacccauuaugccaucaucggcccuggccuccaagcgaaggccaccagagaagcccagaagcggacggccgcggggaucaugaagaacccuaccguagacggcaucaugaccaucgaccuggaccccgugauuuacgacagcaaauucgagaagcagcuggggcaggugaugcuccugguucugugcgcggugcaacuccugcugaugcgcaccuccugggcucucugugaggcccugacgcuggcuaccggcccuaucacaacccucugggagggcagccccggcaaauucuggaauaccacaaucgcugucuccauggcuaacaucuuucgggguucuuaccuggccggggccggccuagccuucuccaucaugaagucgguggggaccggcaagcgcggcacagggucgcagggugagacccucggagagaaguggaagaagaagcucaaccagcugagccgucgcgaguucgauuuauacaagaagaguggcaucacggagguggaccggaccgaagcgaaggaggggcuaaagaggggcgagaucacccaccacgcugucuccagaggcucggccaagcuccaaugguucgucgaacgcaacauggugaucccagaggggcgggucaucgacuugggcugcgggcgcggcgggugguccuacuacugcgccggccugaagaaaguaaccgaggugcggggcuauacgaagggugggccugggcacgaggagcccgugcccaugagcaccuacggcuggaacaucguaaagcugauguccgguaaggacgucuucuaccuucccccugagaagugcgacacccugcuaugcgacaucggggagagcuccccaagcccuaccgucgaggagucccgcacgauccgcgugcugaagaugguggagccguggcucaagaacaaccaguucugcaucaagguccugaaccccuacaugcccaccgugaucgaacacuuagagcggcuccagcgcaagcauggcgggaugcuggugcggaacccccuuagccgcaauuccacccacgaaauguacuggauauccaacggcaccgggaacauugucgccuccgugaacauggugagccggcuccugcugaaucguuucacgaugacccaccggcgcccgaccaucgaaaaagacguagaccucggcgcgggcacccggcacgugaaugccgagcccgagacgcccaacauggacgugaucggggagcgcaucaagcggauaaaagaagagcacaacuccaccuggcacuacgacgacgagaacccguauaagaccugggcuuaccauggcagcuacgagguuaaggccaccggaagcgccagcuccaugaucaacggcguggucaagcuucugacgaagcccugggacguggugcccauggucacccaaauggcuaugacggacaccacacccuucgggcagcagcgaguguuuaaggagaagguggacacccggaccccgcgccccaugcccgggacccggcguguuaugggaaucacggccgaauggcucuggcggacccuggggcggaacaagaagccgagacuguguacccgcgaggaguucacuaagaaagugcgaaccaaugccgccaugggugcgguguucaccgaggagaaccagugggacagcgccaaggccgccgucgaggacgaggacuucuggaagcucguugaccgggagcgcgagcugcauaagcuggguaagugcggcagcuguguguacaauaugauggggaagagggagaaaaagcucggcgaguucggcaaggccaaggggucccgcgcgaucugguacauguggcugggcgcccgauaccucgaguuugaggcccuaggguuccugaacgaggaucacugguucagccgagaaaauuccuacagcggcgucgagggggagggcuugcacaagcucggcuacauccugagagacaucuccaagauccccggcggggccauguacgccgaugacaccgcgggcugggauacccgcaucacggaggacgaccugcauaacgaggagaagaucacccagcagauggaccccgaacaccggcagcucgccaacgccaucuucaaacugacauaccagaacaagguggucaagguccagcgccccacccccaccgggaccgugauggacaucaucagccggaaggaccagcgcgguuccggccaagugggcaccuacggacugaacaccuucaccaauauggaagcacaacucauacgccagauggagggcgagggagugcugagcaaggcagaucuggaaaacccgcaucuccccgagaaaaagaucacgcaauggcuggagaccaagggcgucgagcgcuuaaagcggauggcgaucagcggcgacgacugcguggucaagcccaucgacgaccgcuucgccaacgcccuccuggcccugaacgacauggggaagguccgcaaggacaucccgcaguggcagccaucgaagggcuggcacgacuggcagcagguccccuucugcucucaccacuuccacgagcucauaaugaaagaugggcgcaaacugguagugcccugccggccccaggacgaacuaaucggacgcgcccggauuagccaaggugcgggcuggucccuccgcgagaccgcuugccugggcaaggccuacgcgcagauguggagccugauguacuuccacagacgggaccuacgccuggcgaguaacgccaucugcagcgccgugccgguccauugggugcccacgucacggacgaccuggagcauucaugcccaccaucaguggaugaccaccgaggacaugcugacgguguggaacagagucuggaucgaggacaaucccuggauggaggacaagacccccgugaccaccugggagaacgugccguaucucgggaaacgggaggaccaguggugcggcucccugauagggcugacuagccgcgccaccugggcgcagaauaucagcaccgccauccagcaaguccggucccucauuggcaacgaggaguuccuggacuacaugcccagcaugaagcgcuuccggaaggaggaggagucugagggcgccaucugguaa

SEQ ID NO: 26054 - RNA, 9873 nt, Artificial Sequence
  derived and/or modified CDS sequence (opt11) from DENV-3__FJ639787__SS-prME
accagccugugccucaugaugauacuacccgccgcacuggccuuccaccucaccucacgggacggagagccgcgaaugauaguggggaagaaugaacggggaaaaagccugcuuuuuaagaccgcguccgggaucaacaugugcacgcucaucgccauggaucugggcgaaaugugcgacgacacggugaccuacaagugcccccacaucacagagguggagcccgaggacaucgacugcuggugcaaccuaaccagcacuugggucaccuacggaaccugcaaccaagccggcgagcaccggcgagacaagcguagcgucgcccuugcgccccacgugggcaugggguuggauacgcgcacccagaccuggcuaagcgccgagggcgccuggcgccaaguggagaaggucgagacgugggcccuccggcacccaggguucaccauccuggcacuguuucucgcccacuacaucggcacgagccugacccagaaggugguaauauucauccugcucaugcuggucacgcccagcaugaccaugcgguguguuggggugggcaaccgcgacuucgucgagggccuguccggcgccacauggguggacgugguccuagagcacggcgggugcguuaccacgauggcuaaaaacaagcccacccuggacauugagcugcagaaaaccgaggcaacccagcucgcuacgcugcggaagcugugcaucgagggcaagaucaccaauaucaccaccgacucccgcugucccacgcagggugaggccgugcucccggaggagcaggaccagaacuacgucugcaagcacacguacguggaccggggguggggcaacgggugcggccuguucgggaagggaucccuggugaccugcgccaaguuccagugucucgagcccaucgagggcaagguaguccaguaugagaaccugaaguacaccguuaucauaacgguccacaccggggaccagcaccaggugggcaacgagacccagggggucaccgccgagaucacgccccaggccagcacuaccgaggcgauccuacccgaguacggcacccucggacuggaguguucaccgcgcaccggccuggauuucaacgaaaugauccuccucacgaugaagaacaaggccuggaugguccacagacagugguucuucgaccugccucuacccuggaccagcggcgccaccaccgagacgcccaccuggaaucgcaaggaacuacuggugaccuucaagaacgcccacgccaagaagcaggaggugguggugcucgggucccaggagggggcgaugcacaccgcacugacgggggccacugagauucagaacagcggagggaccuccaucuucgccggccaccugaagugucgucucaagauggacaagcuggaguuaaagggcaugagcuacgccaugugcaccaacacguuuguccucaagaaggagguguccgagacccaacacgggaccauccugaucaagguugaauacaagggcgaggacgucccguguaagauacccuucagcaccgaggacggccagggcaaggcgcauaacggccgccugaucacggccaaccccguaguuacaaagaaagaggagcccgucaacaucgaggccgagccgcccuucggagagagcaacaucgugaucggcaucggggacaacgcccucaaaaucaacugguacaagaagggcuccagcaucgggaagauguucgaggcgacagcccggggcgcacgaagaauggccauccuuggcgacacugcuugggacuucggguccguuggcgggguccuaaacuccuuaggcaagauggugcaccagaucuucggguccgccuacacggcucucuucucggguguguccugggucaugaagaucggcaucggggugcuucugaccuggaucggcuuaaacaguaagaacaccucgaugagcuucagcugcaucgcuaucggaaucaucacccuauaccuuggcgccguuguccaggccgacauggggugcguuaucaacuggaagggcaaggagcucaagugcggcagcggaaucuucgugacgaacgagguccacacguggaccgagcaguacaaauuccaggcggacucccccaagcgccuggccaccgccaucgcgggcgccugggagaauggggugugcggcauccgcucaacgacccguauggaaaaucugcuuuggaagcagaucgccaacgagcugaauuacauccugugggaaaacaacaucaagcucaccgugguugugggggacacuaucggggugcuagagcagggcaagcgcacgcugacgccacagccgauggagcucaaauacuccuggaagaccugggguaaggcuaagaucgucaccgccgagacgcagaacagcucuuucauaaucgauggccccaacacccccgagugucccagcgccucccgggcguggaacgugugggagguggaggacuacggauucggcgucuucaccaccaacauuugguuaaagcuacgcgagguguacacccagcucugcgaccaccggcugaugagugccgccgugaaggacgagcgcgccguccacgcugacaugggcuacuggaucgagucccagaagaauggcuccuggaaguuggagaaggcgagucucaucgaggugaagaccuguaccuggcccaagucccacacccuguggucuaacggcgugcuggaguccgacaugaucauccccaagagccucgccggacccaucucgcagcauaacuaccggccgggcuaccauacccagacggccggccccuggcaccugggcaagcuggaacucgacuucaacuacugcgagggcaccacaguagugauaacggaaaacugcgggacgaggggccccagccugcgaaccaccaccguguccgggaagcucauccacgaguggugcugccgcagcugcacccugccgccccugcgguacaugggcgaagacgggugcugguacggcauggagauucgccccaucucugaaaaggaggagaauauggucaagagccuggucucugccggcagcggggagguggacaacuucaccaugggcguccucugucuggccauccuguucgaggaggugaugcgggggaaguuugggaagaagcacaugaucgcggggguguucuuuacauuugugcuccugcuguccgggcagaucaccuggcgcgauauggcgcacacgcucauuaugaucggcucgaacgccuccgaccgaauggggaugggagugaccuaccuugccuugaucgccaccuucaagauccagcccuuccucgcgcugggguucuuucugcgcaagcucaccagccgggagaaccuguugcucggcguuggccuugccauggccacgacccugcagcuccccgaagacaucgagcagauggccaaugggaucgcgcuggggcucauggcccuuaaguuaaucacacaguucgaaaccuaccaacuuuggacggcccucaucagucugaccugcuccaacaccaucuucacccugacggucgcguggagaaccgccacccucauauuagcgggcgugagccuacuccccguuugucaguccucauccaugcggaagaccgacuggcugcccaugacggucgccgccaugggcgugccgccccucccacuguuuaucuucucguugaaagacacccugaagcgcagguccuggcccuuaaacgagggugucauggccgugggccuggugagcauccucgccagcagccuccugcgcaacgacguccccauggccggcccccuggucgccggagggcuccugaucgcauguuaugugauaaccggaaccuccgccgaucugacgguagagaaggccgcggacgugaccugggaggaggaagccgagcagacgggugugagccacaaccucaugauuaccgucgaugacgacgggacuaugcgcauaaaggacgacgagacagagaacauccucaccgugcugcucaagacugcccugcugaucguguccggcaucuuuccauacagcaucccagccacgcuccugguauggcacacguggcagaagcagacucagcgguccggaguguugugggacguccccuccccacccgagacccagaaggccgagcucgaggaaggggucuaucgaauuaagcagcagggcaucuucgggaagacccagguaggcguggggguccagaaagagggcguguuucacacgauguggcacguuacccgcggcgcgguccuaacuuacaacggaaagcgccucgagcccaacugggccuccgugaagaaggaccucaucagcuacggcgggggcuggcggcuguccgcgcaguggcagaagggggaagagguucagguaaucgccguggaacccggcaagaaccccaagaacuuccagaccaugccgggcacuuuucagaccacgacaggggagauaggcgcgaucgcccuggauuucaaacccgggacgagcggcagccccaucaucaacagagaggguaaggugguugggcuguacggaaacgggguagugaccaagaacggcggguauguuuccggcauugcccagaccaacgccgagccggauggccccacccccgagcucgaggaggagauguucaagaagcggaaccugacaauuauggaccugcaucccgggagcggcaagaccagaaaguaccucccagccaucguucgugaggcgaucaagcgccggcugcgcacccuaauccucgcccccacccgcguugucgccgcagagauggaggaggcccuaaaggggcuaccgauccgcuaccagacgaccgcgacuaagagcgagcacacuggccgggagaucguggaucucaugugccacgccacguucaccaugcgcuuacugagccccgugcgggucccaaacuacaaccucaucauuauggacgaggcccauuuuaccgaccccgccuccaucgccgcgcgaggguacaucagcacccgggugggaaugggcgaggccgccgccaucuucaugacggcgacuccgccagggaccgcagacgccuucccgcagaguaaugcucccauccaggacgaggagcgcgauauccccgaaagaagcuggaacuccggcaacgaguggaucaccgacuuugcgggcaagacggugugguucguccccagcauuaaggcgggcaacgacaucgccaacugccugagaaagaacggaaagaaggugauccagcugucccgaaagaccuucgacaccgaguaccagaagaccaagcucaacgacugggacuucguggucacgacggauaucagcgagaugggugccaacuucaaggccgaccgggugaucgacccgcgacggugccugaagcccgugauccugacugacggacccgagcgcguuauccuugccggccccaugccgguuaccgcggcguccgccgcccagcggcgcgggcgggugggucgcaacccccagaaggagaacgaccaguacaucuucaccggccagccccugaacaacgaugaggaccacgcccacuggacugaggcgaagaugcugcucgacaacauuaacacccccgaggggaucaucccagcccuguucgagcccgagcgggagaagagugccgccauagacggcgaguaucgccugaagggcgagucccgaaagaccuucguugagcucaugagaaggggggaccugcccgugugguuagcccacaagguugcgagcgagggaaucaaguacacugaccgcaaguggugcuucgacgggcagagaaauaaccagauucucgaggagaacauggacguggagaucuggacgaaggagggggaaaagaaaaagcugcgcccccgguggcuggaugccaggaccuauucugacccgcuagcucugaaagaauucaaggacuucgccgcgggccgcaaaagcaucgcccuggaccucgugacugagaucggacggguccccacccaccuggcucaccgcacgcgaaacgcccuugacaaccucgugaugcugcacaccuccgaacacggcggaaaagccuaccgccacgcuguggaggaacugcccgagaccauggaaacccuccugcugcucggccugaugauccugcucaccggcggggcuaugcuauuccuuaucagcgggaaggggaucggcaagaccagcaucgggcuaaucugcgucaucgccuccagcggaaugcuguggauggccgagaucccgcugcaguggaucgcgucagcgaucgugcucgaguucuucaugauggugcuccugauccccgagcccgaaaagcagcggacgccccaggacaaccagcucgcauacgugguuaucgggauccugaccuuagccgccacgaucgccgcgaaugagaugggccuccuggagaccacuaagcgcgaccugggcaugucgaaggagccuggggucgucucucccaccagcuaccucgacguggaccugcaucccgccuccgccuggacgcuguacgccguggcgaccaccgucauaacccccaugcuccggcacacgaucgaaaacagcaccgcgaauguguccuuggccgccaucgcaaaccaggcugugguccugaugggacucgacaagggguggccgauuagcaagauggaccugggugugccgcugcucgccuuagggugcuauucccaggugaauccccugacccucaccgccgccguccuguugcucaucacgcacuacgcaaucaucggccccggccugcaggcaaaggcgacucgugaggcacagaaacggaccgccgccgggaucaugaagaauccgacuguggacggaaucaugacgaucgaucuggaucccgugauuuaugacagcaaguucgagaagcagcucggccaagucaugcugcuggugcucugcgccgugcagcugcugcuaaugaggaccuccugggcccugugcgaagcccugacccucgccaccggccccaucacgacccugugggagggcagccccgggaaguuuuggaacaccaccaucgcgguuucuauggccaacaucuuccggggcucguaccuggccggggccgggcuagccuuuuccaucaugaagucgguggggacgggcaagcgcggcacggggucccagggggagacccugggggaaaaguggaagaagaaacugaaccagcucagccgcaaggaguucgacuuauauaagaaguccggcaucacugagguggaccgcaccgaggcuaaagaggggcugaagcggggcgagauuacgcaucacgcugucuccaggggcagcgccaagcugcagugguucgucgagcggaacaugguuauuccggaagggcgagucaucgauuugggcugcgggcggggcgggugguccuacuacugugccggauuaaagaagguuacggaagugcgcggcuacaccaagggcgggcccgggcacgaggagcccguacccauguccaccuacggcuggaacaucgugaagcucaugagcggaaaggacguguucuaucugccgccagagaagugcgacacgcuguuaugcgacaucggcgagagcagucccagcccaacugucgaggagucucggacuauucgcgugcucaagauggucgagccaugguuaaagaacaaccaguuuugcaucaagguucugaaccccuacaugcccacggugaucgagcaccucgagcgccugcaacgaaagcacggcgggaugcuggugcgcaacccccucagccggaacuccacgcacgaaauguacuggaucagcaacggcacggggaacaucgucgccucagugaacaugguaucccgcuuacuguugaaccgguucacaaugacccaccgccggccgaccaucgaaaaggacgucgauuugggcgccggcacccgccacgugaacgcagagcccgagaccccaaacauggacgucaucggggagcgcaucaagcgcaucaaggaggagcacaauuccaccuggcacuaugacgacgagaacccguauaagacuugggccuaucacggcagcuacgaggucaaagccaccggaagugcaagcuccaugauuaacggcguggucaagcugcucacgaagcccugggacguagugccaauggucacccagauggcgaugacggacaccacucccuucgggcagcagcggguguucaaggaaaagguggacacucgaacaccgaggagcaugcccggcacccgccgggucaugggcauaaccgccgagugguuguggcgaacgcugggacggaacaagaaaccccgccucuguacgagagaggaguucaccaagaaggugcguaccaacgccgccaugggagcuguguucaccgaggaaaaccagugggacagcgcaaaagccgccgucgaagacgaggacuucuggaagcugguggaccgcgagcgggagcugcacaagcucgggaagugcggcagcugcguguauaacaugauggggaagcgcgagaagaagcugggcgaguuuggaaaagcgaaggggucccgggcgaucugguacauguggcugggcgcccgauaccuugaguucgaagccuugggguuccugaacgaagaccacugguuuucccgggagaacucguacuccggcgucgagggggagggccuccacaagcugggcuacaucuuacgcgacaucucuaagauccccgggggcgcuauguacgcagacgacacggcggggugggacacccggaucacugaggaugaccuccacaacgaggagaaaaucacgcaacaaauggauccggagcaccgccagcuggccaacgcaaucuucaagcugaccuaucagaacaaggucguuaaggugcagcggcccacgccaaccggcaccgugauggacaucauaucccgaaaggaucagcggggcucaggccaggugggcaccuacgggcucaacacguucaccaacauggaggcccagcugauccgccagauggaaggcgagggcguacuguccaaggcagaccucgagaacccccaccuuccagagaagaagaucacccaguggcuggagacgaagggcguggagcgacucaagaggauggcgaucucaggcgaugacugcguggucaagcccaucgacgaccgguuugccaacgcccugcuggcacucaacgacauggggaaggugcgaaaagacauaccucaguggcagcccucaaaggguuggcaugacuggcaacagguuccuuucugcagccaccacuuccacgaacugaucaugaaggacgggagaaaacuggucgugccuugucgcccgcaggacgaacucaucggccgcgcccgcaucucccaaggggcgggcuggagccugcgggagacggccugccugggcaaggcuuaugcccaaauguggucccucauguacuuccaccgccgcgaccugcgacuggcguccaacgccaucugcuccgccguccccguccacugggugccaaccagcaggaccaccugguccauccaugcacaccaccaauggaugacgaccgaggacaugcuaaccguguggaaccgugucuggaucgaggauaaccccuggauggaggacaagaccccggugacgacgugggagaacgugcccuaccuggggaaacgcgaggaccaauggugcggcagccuuaucggacuaaccagccgggccaccugggcgcagaacaucccgacggccauccagcagguccgcucgcugaucggcaacgaagaguuucuggacuacaugcccagcaugaagcgguuccgcaaggaggaggaguccgagggggcgaucugguga

SEQ ID NO: 26055 - RNA, 9873 nt, Artificial Sequence
  derived and/or modified CDS sequence (opt11) from DENV-3__FJ639790__SS-prME
accucucugugccucaugaugauccugccugccgcccuggcguuccaccuuaccucccgggacggcgagccucggaugaucguggggaaaaacgagcggggcaagagccugcuuuucaagaccgccuccgggaucaacaugugcacccucaucgccauggaccugggcgagaugugugacgacaccgugaccuacaaguguccccacaucacugagguggagccggaggauauugacugcuggugcaaccuaaccagcaccuggguuacguacgguaccugcaaccaagccggcgagcaucggcgcgacaagcguucuguagccuuggcgccccacgugggcauggggcuggacacacgaacccagaccuggaugagcgccgagggggccuggcgccagguggagaaggucgagacuugggcccuacgccacccgggguucaccauccucgcgcuguuccuagcccacuauaucggcaccucccucacacaaaagguuguuaucuucauccugcucaugcuggucacgcccucaaugaccaugcggugcgugggggugggcaaccgcgauuucgucgaaggccuauccggggcuaccuggguggacgugguccuggagcacggcgggugcgugaccacgauggccaagaacaagcccacucucgacaucgagcugcagaagacugaggccacgcagcuggcgacguuacggaagcugugcaucgagggcaagaucaccaauaucaccacugacucccgcugccccacgcaaggcgaggccgugcucccggaggagcaggaccagaacuacgucugcaagcauaccuacguggaccgggggugggguaacggaugcggccuauuugggaagggcucccugguuacaugcgccaaguuccagugccuugagcccauagagggcaaggucgugcaguacgagaaccucaaguacaccguuaucaucacgguccacacgggggaccagcaccaggugggaaacgagacccagggcgugacggccgagaucacgccccaggccagcaccaccgaggcgauccugcccgaguacggcacccuggggcucgagugcuccccgcgcaccggccuggacuucaacgagaugauccugcucacgaugaagaacaaggccuggaugguacaccggcagugguucuuugaccugccccugcccuggaccagcggcgccaccaccgagacgcccaccuggaaccgcaaagagcuccuggugaccuucaagaacgcacacgccaaaaagcaggaggucguggugcugggcucccaggagggcgcgaugcacacagccuugacgggcgcaaccgagauccagaacagcggagggaccuccaucuucgccggccaccugaagugccggcugaagauggauaaguuggaguugaagggcaugagcuacgccaugugcaccaacacguucguccucaagaaagagguuucagagacacagcacgggaccauccuaaucaagguggaguacaagggagaagacgucccgugcaagauacccuucagcaccgaggacgggcagggcaaagcgcacaacgggcgccugaucacggcuaaccccgugguaaccaagaaggaggagcccgucaacauugaggccgagccacccuucggggagagcaacauugucaucggcauaggggacaacgcccuuaagauaaacugguacaagaagggcuccagcaucgggaagauguucgaggcaaccgcccggggcgcccgcaggauggcuauccugggcgacacugcgugggacuuuggauccguuggcggaguccucaacucuuugggcaagaugguucaccagaucuuuggguccgcuuacacggcccuguucaguggaguguccugggucaugaagaucgggaucgggguccuccugaccuggauaggccugaacagcaagaacaccucgaugagcuucucgugcaucgccaucgggaucaucacacucuacuuaggagcggugguccaagccgacaugggaugugugaucaacuggaagggcaaggaacugaagugcgggagcgggaucuucgugacuaaugagguccacaccuggacggagcaguacaaguuccaggcggacagucccaagcgccucgcgaccgccaucgccggagccugggaaaacggcgugugugggauccgcagcacgacccggauggagaaccugcuguggaagcagaucgcgaacgagcugaacuacauucugugggagaauaacaucaagcucaccguggucgugggcgacaucaucggcgugcucgagcagggcaaaagaacccuaacgccgcagccgauggagcugaaguacuccuggaagacuugggggaaggccaagaucguaacggcugagacccagaacagcucauucaucaucgacggccccaacacgcccgaaugcccuagcgcuucacgggcguggaacgugugggagguggaagacuacggguucgguguauucaccacgaacaucuggcucaaguugagagaaguguacacccagcugugcgaccaccggcucaugagcgccgccgugaaagacgagcgcgccguccacgccgacaugggauauuggaucgagucucagaaaaacggguccuggaaacuggagaaggcgagccugauugaggugaagacgugcacauggccgaagagucacacccucuggagcaacggcgugcuggaguccgacaugaucauucccaagucacuggccgggcccaucucccagcacaacuaccggccgggcuaccacacccagacggccgggccuuggcaccucgggaaguuagaacuugacuuuaacuacugcgagggcacgaccgucgugaucaccgagaacugcgggacccgcggccccagccucagaacgaccaccguuagugggaagcugauccacgaguggugcugccggucuugcacccugcccccgcugcgguacaugggcgaggaugggugcugguacggcauggagauccgccccaucucggagaaggaggagaacauggucaagagccugguuuccgccggcagcggggagguggacaacuucacgaugggcgucuuaugccuggcgauccuguuugaggagguuaugcgcgggaaauucggcaagaagcacaugaucgcggggguguuccugaccuucguccuccugcugucuggccaaaucaccuggcgcgauauggcccacacccucauaaugaucggcagcaacgccuccgaucggauggggaugggcgugacauaccuugcccugauugcgaccuucaagauccagcccuuccucgcgcugggguuuuuccugaggaagcucaccagccgggagaaucugcugcucggagugggccuugccauggccacaacgcugcaacuccccgaggacaucgagcaaauggccaacgggaucgcgcugggccugauggcacucaagcugaucacccaguucgagaccuaucagcuauggaccgcucuuaucagcuuaacgugcucaaauaccauuuucacucuuacagucgcuuggcgcacggccaccuugauacuggcgggggugagccugcucccggucugccaguccucuuccaugcggaagacagacuggcugcccaugaccguggccgccaugggcgugccgccccuuccccuguucaucuucaaccugaaggacacgcugaagcgccgcagcuggccccucaacgagggggucauggccgugggccugguguccauacuagccucgucccuccugcggaaugauguccccauggccggcccacuggucgccgggggcuugcugaucgccugcuacgucaucaccgggacuagcgccgaccugaccgucgagaaggccgcugacgugacgugggaggaggaagccgagcagaccggcgugucgcacaaccucaugaucacagucgacgacgacgggaccaugcgcaucaaggacgaugagaccgagaacauccuaacggugcugcucaagaccgcccugcugauugugagcggcaucuucccguauuccauucccgccacccuucugguauggcacaccuggcagaagcagacucagcggagcgguguucucugggacgugccauccccgcccgagacacagaaggccgagcucgaggagggggucuaccgcauuaagcaacagggaaucuuugggaaaacccaggugggcguugggguccagaaggaaggcguguuucauaccauguggcacguuacgcggggcgcgguccugaccuacaacgggaaacgccuggagcccaauugggccucugugaagaaagaccucaucuccuauggcgggggcuggcgguuaagcgcucaguggcagaagggggaggaggugcaggucaucgccgucgagccgggcaaaaaccccaagaacuuucagaccaugcccggcaccuuccagacgaccaccggggagauuggcgcgaucgcccuggauuucaagcccgggaccuccgguagccccauaaucaaccgcgaaggcaaaguggucgggcuguaugggaacgggguggugaccaagaacggcggguaugucagcggcauugcucagaccaacgccgagccggacggccccacccccgaacucgaggaggagauguuuaaaaagcggaaccugaccaucauggaccugcaccccggguccggcaaaacgcgcaaguaccuaccggccaucgugcgggaggcgauuaagcgccggcugcgcacccugauccucgcccccacgcgaguggucgccgccgaaauggaggaggcccugaagggacugccaaucagauaucagacaacugcgacaaagagcgaacacaccggccgggagauugucgaccuaaugugucaugccaccuucacuaugcgccugcuuagccccguucgggucccgaacuacaaccucaucaucauggacgaggcccacuucaccgaccccgccagcaucgcggcccgcggguacaucucgacccgggugggcaugggugaagccgccgccaucuucaugaccgcgacuccgcccgggaccgccgacgccuucccgcagucuaaugcccccauacaggacgaggagcgcgacauucccgagcgcuccuggaacagcggcaacgaguggaucaccgacuuugccgggaagaccgugugguucgucccauccaucaaggcgggcaaugacaucgccaacugccugcggaagaacgggaagaaagugauccaguuaucacgcaagacguucgacaccgaguaccagaagaccaagcucaacgauugggacuucguuguaacuacggacauuuccgaaaugggugcaaacuucaaggccgaccggguuaucgauccgcgccggugucugaagcccgugauccugaccgacggccccgagcgcguuauccuagccggacccaugccugugacagcggccagcgccgcccagcggcgcggccggguggggcggaauccccagaaggagaacgaucaauacaucuucaccggccaaccccugaacaacgacgaagaccaugcccacuggaccgaggcgaagaugcugcucgacaacaucaacacgcccgaagggaucaucccggcccuguucgagcccgagcgggagaaguccgccgcaaucgacggcgaguaucgcuuaaaaggcgagagccggaagaccuucguggagcucaugcgcagaggggaccuucccguguggcuggcccacaaagucgcguccgagggcauaaaguauaccgaccgcaaauggugcuucgacgggcagcggaacaaucaaauucuugaggagaacauggacgucgagauuuggaccaaggagggagagaagaagaagcuccgcccccgguggcucgaugcccgcacguacagcgacccgcucgcccugaaggaguucaaggacuucgccgcgggccgcaagucgaucgccuuagaccucgugacagaaaucgggaggguccccacccaucuggcccaccguacccgaaacgcgcuugauaaucucgugaugcugcacacuucggaacacggcgggaaggccuaccggcaugcaguggaggagcugccagagaccauggagacccuccuucuucuuggccugaugauccuacucaccgggggcgccaugcuguuccugaucaguggcaaggggaucgggaagacaagcaucggguuaaucugcguuaucgccucgagcggcaugcuguggauggcggaaaucccgcugcaguggaucgccagcgcgaucgugcuugaguucuucaugaugguucuccugauccccgagccugagaaacagcggacaccccaggacaaccaguuagccuacgucgugaucgggauccugacccuggccgccaucaucgccgcuaacgagaugggccuauuggaaaccacgaagcgcgacuuggggauguccaaggagccgggcguggucucuccgaccuccuaccuggacguggaucugcaccccgccuccgccuggacccuguacgccguggcgaccacggucaucacccccaugcuccgccacacaauugaaaauuccaccgccaacgugagccuggccgccaucgccaaccaggcggugguccugaugggccucgacaagggguggccgaucuccaagauggaccuuggcgugccucugcucgccuuaggaugcuacagccaggugaacccccugaccuuaaccgccgccguguuacugcuaauuacccacuacgcaaucaucggccccggacugcaggcgaaggccaccagagaggcccagaagcggacugccgcggggauuaugaagaacccuaccguggacggaaucaugaccaucgacuuagacccggugaucuacgauucaaaguuugagaagcagcucgggcaggucaugcugcugguguuaugcgcagugcagcugcugcucaugcgcacgucuugggcacugugcgaggcucugacgcucgcuaccggccccaucaccacccuuugggagggcucccccggaaaguucuggaacacgacgaucgcggucuccauggccaacaucuuccgcggcuccuaccuggccggggcuggccucgccuucagcaucaugaaguccguggggaccggcaaacgcggcaccggcagccagggcgagacccugggggagaaguggaagaagaagcugaaccagcucagccggaaagaguucgaccuguacaagaaauccggcaucacagagguggaucgcaccgaagcgaaagaggggcugaagcggggcgagaucacccaccacgccgucucacggggcagugcaaagcuccagugguucguggagcggaacauggugaucccggaggggcgggucaucgaccugggcugcgggcguggcggguggagcuauuacugcgccggcuuaaagaaggugaccgaggugcgcggcuauaccaaaggcgggcccgggcacgaggagcccguccccaugucgaccuacggcuggaacaucgugaaacucaugagcggcaaggacguauucuacuugccgcccgagaagugcgacacccugcugugugauauaggcgaauccagccccucccccacagucgaggagagccgaaccauccgagugcucaagaugguagagcccuggcugaagaacaaccaguucugcaucaaaguccucaacccguacaugcccaccgugaucgagcaccuugagcgcuuacagcggaaacauggcgggaugcuagugcgcaacccccucucgagaaacagcacccacgagauguacuggaucuccaacggcaccggcaauauaguggccagcgugaacaugguaucccgccugcucuugaaccgguucacgaugacccaccgcagaccgaccaucgagaaggacgucgaccuaggcgccggcacucgccacgugaacgcggagccagagacgcccaacauggacgugaucggggagagaaucaagcgcaucaaggaggagcacaacagcaccuggcacuacgacgaugagaaccccuacaagaccugggcguaccacggaagcuacgaggucaaggcuaccgggagcgccuccagcaugaucaacggaguggucaagcugcuuacgaagccgugggauguggugcccaugguuacccagauggcgaugaccgacaccacacccuuugggcaacagcggguguucaaggagaaggucgacacgcgcacuccucggucgaugcccggcaccaggagagucaugggcaucacagccgaguggcuguggcgcacccuggggcggaacaagaagccccgccucugcacccgggaggaguuuaccaagaaggugcgaacuaacgcggccaugggcgcgguguucaccgaggagaaccagugggacagcgccaaggccgccgucgaggacgaggacuuuuggaagcugguggacagggagcgggagcuccacaagcucgggaagugcggcuccugcguuuacaacaugaugggaaagcgcgagaagaagcugggugaguucggcaaggccaaggggucccgggcaaucugguacauguggcugggugcucgcuaccuugaguucgaggcccugggguuccucaacgaggaucacugguucagccgggagaacuccuauagcggcgucgagggggagggccuucacaaacugggcuacauccugcgcgacaucuccaaaauccccgggggcgccauguacgccgacgacaccgccggaugggacacaagaaucacggaggacgauuuacauaacgaagagaaaauuacucagcagauggacccggagcaccgccagcuggcaaacgccaucuucaagcugaccuaccagaacaaggucguuaaggugcagcggcccacccccgccggcaccgugauggacaucaucucccgaaaagaccagcggggguccggccaggugggcaccuacggacucaacaccuucacgaacauggaggcccaacugaucaggcaaauggagggagaggggguacugagcaaggcggaccucgagaacccccacuugccagagaagaagaucacccaguggcuggagacgaagggcguggagagacucaagcgcauggccaucuccggcgacgacugcguggugaagcccauugaugaccgguuugccaacgcccugcuggcacucaacgacauggggaagguacgcaaagacaucccccaguggcagcccaguaagggguggcacgacuggcagcaggucccguucugcucccaucacuuccacgagcuaaucaugaaggacgggcggaaacucguuguacccugccgcccccaggaugagcucauuggcagagcgcgaaucagccagggggccggcuggucccugagggagaccgccugccugggcaaggcguacgcgcagauguggagccucauguacuuccacagacgagaccugcggcuugccuccaacgccaucugcagcgccgugcccguccacugggugcccaccucccgcaccacguggucgauccacgcgcaccaccaguggaugaccaccgaggacaugcucacuguguggaauagagucuggaucgaggacaaccccuggauggaggacaagacacccgugaccaccugggagaacgugcccuaccuggggaagcgcgaagaucaguggugcgguucccucauagggcucacgagucgagcgacgugggcccagaacaucccgaccgccauccagcagguccgcucucugaucgggaacgaggaguuccuggacuacaugccgucgaugaagagguuccgcaaggaagaggagucggagggggccauuugguaa

SEQ ID NO: 26056 - RNA, 9873 nt, Artificial Sequence
  derived and/or modified CDS sequence (opt11) from DENV-3__FJ639791__SS-prME
accucgcucugucucaugaugauacuccccgccgccuuggcauuccaccucacuagccgggacggugaaccgcggaugaucguggggaaaaacgagcgcggcaagagcuuguuguucaagacggccuccgggauaaacaugugcaccuugaucgcuauggaccucggugagaugugugaugauacugugaccuacaagugcccccacaucacggaggucgagccagaggacauagacugcuggugcaaccugaccuccacaugggugacguaugggacgugcaaccaggcgggugaacaccggcgcgacaagagguccgucgcccucgcgccgcauguggggauggggcuggacacccgcacccagacguggaugagcgcugagggugccuggagacaggucgagaaggucgagacgugggcuuuacgccacccgggguucaccauccuugcgcuguucuuggcccacuauaucggcaccucccucacccagaagguggugaucuucauacugcucaugcucguaacgcccaguaugaccaugagaugcguaggggugggcaaccgggauuucgucgaaggucuguccggggccaccuggguggacguggucuuagagcacggcgggugcguaaccacgauggccaagaacaaacccacccucgacaucgaacugcagaagaccgaagccacacagcuggcgacguugcguaagcugugcaucgagggcaagaucacuaacaucaccaccgauagccguugcccuacgcagggcgaggcgguacugccggaagaacaggaccagaacuacguaugcaaacacaccuacguggaccggggguggggcaaugggugcggacucuucgggaagggcucccuggugacaugcgccaaguuucagugccuugagcccgucgaaggcaaggugguucaguacgagaacuugaaguauaccguuaucaucacggugcacaccggggaccagcaucaggucggcaacgagacccagggggugaccgccgagauuacuccccaggccagcaccacugaggcuaucuugcccgaguaugggacccugggccucgaaugcuccccgcguacgggguuggacuucaaugagaugauccugcucacaaugaagaacaaggccuggauggugcacaggcagugguucuucgaccuaccccugccguggacgucuggcgccaccacagagacgcccaccuggaaccgcaaggagcucuugguaacauucaagaacgcccacgcaaagaaacaggaagugguggugcuugggucacaggagggcgcgaugcauacggcccucacgggugcuaccgagauccagaacagcggcgggaccuccaucuucgcggggcaccugaagugucggcugaagauggacaagcucgagcugaaggguaugucauacgccauguguacaaacacguucgugcugaagaaagaaguaagcgagacccagcaugggaccauccucaucaaggucgaguacaaaggggaagacguaccgugcaagauucccuucuccaccgaagaugggcaggggaaggcccacaacggccgccugaucacggccaaccccguggucaccaagaaggaggagcccgugaacauagaggcugagccacccuucggggagagcaauauuguuaucggcauaggggacaacgcacuuaagaucaacugguacaagaagggcucgagcauagggaagauguuugaggcuaccgccagaggcgcccgccggauggcgauccuuggugacaccgccugggacuuugguuccgucggcggggugcucaacagccugggaaagauggugcaccagaucuuuggcuccgcguacacggcccuauuuagcggcguaucgugggucaugaagaucggaaucggcguacuccugaccuggaucggccugaauagcaaaaacacgaguauguccuucucuuguaucgcuaucggaaucaucacccucuacuugggcgcgguagugcaggcggacauggggugcguuauaaacuggaaaggcaaggaguuaaaaugcggcuccggcauauucgucacuaacgagguucacaccuggaccgagcaauacaaguuucaggcggacucucccaagcgccucgccacagccauagccggcgccugggagaacggggucugcgguauccggucgacaacccggauggaaaaccuccuguggaaacagauugcgaacgagcucaauuacauccugugggagaacaacaucaaacucacggucguugugggcgacaucaucggugucuuggagcagggcaagcgcacccuaacgccccagccgauggagcucaaguacuccuggaagaccugggggaaggcaaagauugugaccgccgagacacagaacucaucuuucaucauugacggccccaacacucccgagugccccagcgcgucccgugcguggaacgugugggagguagaagacuacggguucggcguguucacaaccaauaucuggcucaagcugcgcgagguguauacccaacugugcgaccaccggcuuaugagcgcagccgugaaggacgagcgcgccgugcacgccgauauggguuauuggaucgaaagccagaagaacggguccuggaagcuggagaaggcgagccugaucgaagugaagaccugcacguggccgaagucccacacccucuggagcaacggcguacuggaguccgacaugaucauacccaagagccuggccgggcccaucucccagcacaacuaucggccgggauaccacacgcagaccgccgggcccuggcacuugggcaagcuggagcuggacuucaacuacugugagggcacgaccguggugaucaccgaaaacugcgggacucggggccccagucuccguacuacuaccgucuccgggaaacuuauccaugaauggugcugccggucuugcacgcugccaccgcuccgguacaugggcgaggacgguugcugguacggcauggagauccgcccaaucuccgaaaaggaggaaaauauggugaaaucccuggugagcgccgguagcggggaggucgacaauuucacgaugggcgugcuaugccucgcgauccuguucgaggaggugaugcggggaaaguuuggcaagaagcacaugaucgcgggugucuuuuucaccuucguguuacuccuguccggucagauaaccuggcgcgacauggcccauacccugaucaugaucggcagcaacgccuccgaccggauggggaugggcgugacguaccucgcccugaucgccacuuucaagauacagccuuuucuugcgcucgguuucuuccuucgaaaacugacaagccgggagaaccuguuacugggcgucggucucgccauggcaaccacccugcagcugcccgaagacauugagcagauggccaacgggaucgcgcucggucugauggcccuuaagcucaucacccaguucgaaaucuaccagcuguggaccgcacugauuagucugaccugcuccaacacgaucuucacucugacgguugccuggcgcaccgccacgcugauccucgcgggggucucacuucuuccggugugccaguccucauccaugcggaagaccgacuggcuucccaugaccguggccgccaugggcgugccgccccucccgcuguucaucuucaaucuuaaggacacccuaaaacgcagaagcuggccccuuaaugagggcguaauggccgugggcuuggucuccauccuggcuucaucccugcuccggaacgacgugcccauggcgggccccuuaguggccgggggacugcucaucgcgugcuacgucaucacgggaaccagugccgaucugaccgucgagaaagccgcggaugugaccugggaagaggaggcagaacagacuggcgugucacacaaccuuaugauuaccguggaugacgacggaaccaugcguaucaaagacgacgagaccgaaaacauucucaccgugcuguugaaaacagcccuucugaucgucagcggcaucuucccguacuccauucccgccaccuuacugguuuggcacaccuggcaaaagcagacccagcggagcggcgugcuuugggauguccccucacccccggagacgcaaaaggcugaacuggaggagggcguauacagaaucaagcagcagggcaucuucgggaaaacccagguuggcgucgggguacaaaaggagggcguguuucacaccauguggcaugugacccggggcgcggugcucacguacaacgggaagcggcucgagcccaacugggccagcgugaagaaggaccugaucucauauggcgggggcuggcgccucagcgcccaguggcagaagggagaggagguccaggugaucgccguugagcccggcaagaaccccaagaacuuccagacgaugccgggcaccuuccagacaacgaccggagagauuggcgcaauagcucuugacuucaaaccggggaccuccggcucucccaucaucaaccgagagggcaagguaguggggcuguacgggaacggaguggucacaaagaauggcggguacgugagcggcaucgcccaaaccaacgcggagccggacggccccaccccagagcuggaagaggagauguucaagaagcggaaccucaccauaauggaucugcaccccggguccggcaaaacccgcaaauaucugcccgcgauugugcgggaggccaucaagcgccggcuccgcacacugauucuggcaccgacccggguagucgcagccgagauggaggaagcacucaaagggcuaccgauccgcuaccagaccaccgcgaccaagucagagcacacgggcagggagaucgucgaccugaugugccacgccacauucaccaugcgucuccugucccccguccgcgugccgaacuacaaccugaucaucauggacgaggcgcacuucacggaccccgccagcaucgccgcgcgcggguauaucucuacccgcgugggaaugggcgaggccgccgccaucuucaugaccgccacgccaccgggcacggcagacgcuuucccacagagcaacgcccccauucaggaugaggagagggauaucccugagcgguccuggaacagcggcaacgaguggaucaccgacuucgccgggaagaccguaugguuugugcccaguauuaaggcgggcaacgauauugccaacuguuuacggaagaaugggaagaaagugauacaguugucucgcaaaaccuucgacacggaguaccagaagaccaaacuuaacgacugggauuucgucguuaccaccgacaucuccgagaugggcgcuaacuucaaggccgaccggguuaucgacccgcggcggugccucaagccggucauuuuaacggacggccccgagcgugugauccuggccgggcccaugcccgugaccgccgcuagcgccgcccagcgacgcggccgggucggucgcaacccccagaaggagaacgaccaguauaucuuuaccggccagccacuaaacaacgacgaggaucacgcccacuggaccgaagcaaagaugcugcuggacaacaucaacacccccgaggguaucaucccggcccucuucgagccggaacgggagaaguccgcugccaucgacggcgaguaccgccugaagggcgagagccggaagacuuucguggagcugaugcgccgcggggaccucccggucuggcuggcgcacaaggucgccucggaaggcaucaaguacaccgaccgcaaguggugcuucgaugggcagcggaacaaccagauccuggaggagaacauggacguggagaucuggacgaaggagggugagaaaaagaagcucagaccccgauggcuggacgcccgcaccuacagcgauccgcuggcgcucaaggaguucaaggacuucgcggcggggcgcaaguccaucgcccuggaccuggucacggagaucggcagggugccuacccaccucgcucaccgcacaagaaaugcccuggacaaccuggucaugcuccacacgagcgagcauggcgggaaggccuaccggcacgcaguggaggagcuacccgagacgauggaaacccuguugcugcugggacucaugauccugcuaacagggggcgccaugcuauuccugaucuccggcaaggggauugggaagaccagcaucgggcuuauuugcgugaucgccucguccggaaugcucuggauggccgaaauaccgcugcaguggaucgcgagcgcgaucguguuggaguucuucaugauggugcugcugauccccgagccagagaagcagaggacaccacaggacaaccagcuggcguacgucgugauagggauccucacccuggcagccaucaucgccgcgaacgagaugggccuacuggagaccaccaagcgcgaccugggcauguccaaggagccgggggucgugagccccacaaguuaccuggauguggaccuacaucccgccucugccuggacgcuauaugccguagcgaccaccgucaucacgccuaugcugcggcacaccaucgaaaauuccaccgccaacgucagccucgccgccauugcgaaccaagcggucguucugaugggucuggacaagggguggccgauauccaagauggaccuuggcguaccacuccuggcccucgggugcuauagccaggucaacccucugacguugacggccgccguacuccugcuuaucacacauuaugccaucauuggccccggacuccaggcgaaggccacccgcgaggcgcagaaacggaccgcggccgggaucaugaagaacccgacgguggacggcaucaugacgaucgaccuggaccccguaaucuaugacucgaaguucgagaagcagcugggacaagugaugcuccuggugcugugcgcgguccagcuccugcugaugcgcaccagcugggcccuaugcgaggcccugacacuggccacgggcccuauaaccacccucugggaaggcucccccggaaaauuuuggaacaccacgauugcggugagcauggccaauaucuuucggggaucauacuuggccggggccggcuuagccuucucaaucaugaaaagcguggggaccggcaaacgcggaaccgggagccaaggagagacccuuggggagaaguggaagaagaaauugaaccagcugucucguaaagaguucgaccuuuauaagaagucaggcaucacggaaguggaccgcacggaggcgaaagaggggcugaaacggggcgagaucacccaccacgccgugucgcgcggauccgccaaacugcagugguucguggagcgcaacauggucaucccggaggggcgcgugaucgaccucggcugcgggaggggaggguggagcuauuacugcgccggacugaaaaaggugaccgagguucgaggcuacaccaaaggagggccugggcaugaggagccuguccccauguccacguauggcuggaacaucgucaaacugaucagcgggaaggacgucuucuaccucccgcccgagaagugcgacacccugcugugcgacaucggcgaguccagccccucccccacgguggaggaaagccggaccaucagagugcuuaaaauggucgagccguggcucaagaacaaccaguuuugcaucaaggugcugaaucccuacaugcccacgguuauagagcaccuggagcgccuccagaggaaacacgguggaauguuaguccgcaaccccuugagccggaacucuacacacgagauguacuggaucucgaacggcagcgggaacaucguggcauccgugaauaugguaagcagauuacugcugaaccgauucacaaugacccacagacggccgacaaucgagaaagacguugaccucggcgcggguacacgccacgucaaugccgagccugaaacccccaacauggacgucauuggggagcggaucaaacgcaucaaggaggagcacaacagcaccuggcacuacgacgacgagaaccccuacaagacgugggcguaucacggcaguuacgaagugaaggcaaccgggagugccagcuccaugaucaauggcguagugaagcuccugaccaaacccugggaugugguuccgauggugacucagauggcgaugacggacaccacccccuucggacagcagcgcguauucaaggagaaggucgacacgaggaccccacgaagcaugcccggcacacgccgugugauggguaucaccgcagaguggcucuggcgcacccucgggcggaacaaaaagccccgccugugcacgcgggaggaguuuacgaaaaagguacguaccaacgcagccaugggugcggucuucaccgaggagaaccagugggacagcgccaaggccgccguggaggacgaggacuucuggaagcucguugaccgcgagcgggagcugcauaaguugggaaagugcggcuccuguguuuauaacaugaugggcaagcgcgagaagaaacuuggugaguucggcaaggcuaaggggagcagagcgaucugguacauguggcugggggcgcgcuacuuggaguucgaggcccucggguuccugaaugaggaccacugguucucucgggagaacucuuacuccggcgucgagggggagggccuccacaagcucggauacauccugcgcgauaucagcaagaucccaggaggggccauguacgccgacgacacugccgggugggauacccggaucaccgaagacgaccugcacaacgaagagaagaucacccaacagauggacccggagcaccgccagcucgccaaugcuauauuuaaacuaacguaccagaacaagguggucaaggugcagcggcccacccccacagggacugugauggacaucaucucccgcaaggaccagcggggcagcgggcaggucggcacguacggucugaacacguuuaccaacauggaggcccagcucauccgucagauggaaggcgaggggguccuguccaaggccgaccuggagaacccccacuugccggagaagaagaucacccaguggcuugagaccaaaggcgucgagcggcugaagagaauggcuauaagcggagacgacugcguagugaagccaaucgacgaccgguucgccaacgcccuccuugcccugaacgacauggggaaggugcgcaaggacaucccccaauggcagcccuccaagggcuggcaugacuggcagcaggucccguucugcucucaccacuuccacgagcucaucaugaaggacggucgcaagcugguggugcccugccgcccccaggacgaguuaaucggccgggcaaggaucucccagggggcaggcuggucucuccgcgagacggccugccugggcaaagccuacgcccagauguggucccuaauguauuuucaccgacgcgaucuccgacuggcgucgaacgccaucugcuccgccguccccgugcacugggugccgaccagccgcaccaccuggagcauccacgcccaccaucaguggaugacgacagaggacaugcuaaccgucuggaaccggguauggauagaggacaauccguggauggaggauaagacccccgugacaaccugggaaaacguucccuaucucggcaagcgcgaggaccagugguguggcagccugaucggucuuaccagucgggcgacgugggcgcagaacaucccgaccgccauccagcagguccgcucguugaucggcaaugaggaguuccuggacuauaugcccagcaugaagcgcuuccgcaaggaggaggaguccgagggggccaucugguag

SEQ ID NO: 26057 - RNA, 9873 nt, Artificial Sequence
  derived and/or modified CDS sequence (opt11) from DENV-3__FJ639792__SS-prME
accagccugugccucaugaugaucuugcccgccgcccuggccuuccaccucacaagccgggauggggaaccccggaugaucguggggaagaacgagagagguaagucgcugcuauucaaaacagccagcgggaucaacaugugcacccucauagccauggacuugggcgagaugugcgacgauaccgugaccuacaagugcccacacaucacagagguggagcccgaggacaucgacuguuggugcaaucuaacaucuaccuggguuaccuacgggacgugcaaccaggccggcgagcaccggcgggacaagcggucagucgcccucgcgccgcacguggguaugggucuggacacccgcacgcagacauggaugagcgcggaaggcgcguggcgccaggucgaaaaggucgagacgugggcccugcgccacccgggguucaccauccucgcauuguuccuggcccacuacauaggaacuucccuaacccagaaggugguaaucuucauccuccugaugcuagucaccccgagcaugacuaugcgguguguggggguggggaaccgcgacuucgucgaaggccuguccggggcaaccuggguggacgugguccuggagcacggcgggugcgugacgacgauggcaaaaaacaaacccacccucgacaucgagcugcagaagaccgaggcgacucagcuggcuacgcugcggaaguuaugcaucgaggguaagauaacuaacaucacgacagacagucgcugccccacgcagggcgaggccgugcugccugaggagcaagaccagaacuacguuugcaagcacaccuacguggaccgggggugggggaacgggugcggucucuuugggaagggcucguuggugaccugcgccaaguuccagugccuggaacccaucgagggcaaggucgugcaauacgagaaccucaaauacaccgugauuaucacggugcauaccggggaucagcaucaggugggcaacgaaacccagggggucaccgccgagaucacgccgcaagccuccaccaccgaggcuauccugcccgaauacggcacgcugggucucgaauguuccccgcgcacuggacuggacuucaacgagaugauccugcucaccaugaagaacaaggccuggauggugcacagacagugguucuucgaucugccccugcccuggaccaguggcgccaccaccgaaacccccacauggaaccgcaaggagcuccuggugaccuucaagaacgcccacgcgaagaaacaggagguugugguccuggguucccaggagggggcgaugcacaccgcccucaccggggccaccgagauccagaacucaggcgggaccuccaucuucgccggccacuuaaagugccgccugaaaauggacaagcucgagcugaaggguaugagcuaugccaugugcacgaacacguucguucugaagaaagagguguccgagacucagcacgggacuauccucaucaaggucgaguacaagggcgaggacguacccugcaagauaccuuuuagcaccgaggacgggcaggggaaggcgcacaacggacgauuaaucacggccaaccccguugugacgaagaaagaggagccgguaaacaucgaggccgagccgccauucggugagucgaauauagugauaggcaucggggacaacgcccugaagauaaacugguacaagaagggcuccagcaucgggaaaauguucgaagcgaccgcccggggcgcccgccggauggcuauccugggugacaccgccugggacuucggguccgucggcgggguccuuaacagucugggcaagauggugcaucagaucuucgguuccgcguauacugcccuguuuucuggcguguccuggguaaugaagaucggaaucggggugcuccucaccuggaucgggcugaacaguaagaacacuuccaugagcuucucuugcaucgccaucgggaucauaacccucuaccugggcgccgugguccaggccgacauggggugcguaaucaacuggaaggggaaggagcucaagugcgguagcggaaucuucgugacgaaugagguccacacauggacagaacaauacaaguuccaggcggacagucccaagcgccucgccaccgccaucgccggugccugggaaaacggggugugcgggauccgcagcacgacccggauggagaaccugcuguggaagcagaucgccaacgagcucaacuauauccugugggagaacaacaucaagcugaccgugguugugggggacaucaucggaguccucgagcaggggaagcgcaccuuaacaccccagccaauggagcugaaauacucauggaaaaccugggggaaagccaagauugucaccgccgagacacaaaauucuaguuuuaucauugacggccccaacacgcccgaaugccccuccgccucccgggcguggaacgugugggaaguggaggacuauggguuuggcgucuucaccaccaacaucuggcuaaaguuacgagagguguacacccaguugugugaccaccggcucaugagcgccgcggugaaggacgagcgugcgguccacgccgacaugggcuacuggaucgagagccagaaaaacggguccuggaagcuggagaaggcgagcuuaaucgaggucaaaacgugcacguggccgaaaucccacacccucuggagcaacggcguguuagagagugacaugauuauccccaagagccuggccggacccaucucccaacauaacuaccggccgggcuaucacacccagaccgccggucccuggcaccucggcaaacuggagcuggauuuuaauuacugcgagggcaccaccgucgucaucaccgagaacugugggacacgcggcccaagccuacggacgaccaccguguccggcaaguugauccacgaguggugcugccgcucaugcacccugcccccacuccgguacaugggcgaggacggaugcugguacgguauggagauuaggccuauuuccgagaaagaggagaacauggucaaaagccugguuuccgccggcagcggggagguggacaacuucacgaugggcguucugugccucgccauccucuucgaggaggucaugagagggaaguucggcaagaaacacaugaucgcgggugucuucuucaccuucguucugcuccugucuggccaaauaacauggcgcgacauggcucacacccugauaaugaucggauccaaugcaucagaccguauggggaugggcgugaccuaccucgcucugaucgccaccuucaagauccaacccuuccuggcucucggauucuuucugcggaagcugaccucccgugaaaaccuucuacugggcgucggccucgccauggccacgacucugcagcugcccgaagauaucgagcagauggccaacgggaucgcguuaggccugauggcacugaagcucaucacccaauucgagaccuaccagcuuuggaccgcccugaucagccucacgugcucuaacaccaucuucacccucaccguagccuggcgcacggccacccugaucuuagcgggggugagccugcugccggucugccagaguagcaguaugcggaaaacagacuggcuccccaugaccguggccgccaugggcguuccgccacucccucuguucaucuucucacucaaggacacucugaagagacgcuccuggcccuugaacgagggugucauggccgugggccucguuucuauacuggccuccagccugcugcggaacgacguacccauggcuggcccgcuuguggccgggggccuucucauagcuugcuacgugaucacagguaccagugccgacuugaccguggaaaaggccgcggacgugacuugggaagaggaggccgagcagacaggcgugucgcacaaccugaugaucacggucgaugaugaugggacuaugcgcauaaaggacgacgagacggaaaacauccucacggugcugcugaaaaccgcccuccuaaucguguccggcaucuucccguauucgauacccgccacucugcucgucuggcacaccuggcagaagcagacgcagagauccggcgugcugugggacgugccgucgccgcccgagacccagaaggccgaacuggaagagggcguuuaccgaauaaaacagcagggcaucuucgguaagacccaggugggcgugggggugcagaaggaggguguguuccacaccauguggcacgugacacguggagcgguccucacccacaacgggaagcgccuggagcccaacugggccucugugaagcgagaccuuauuagcuacggcgggggcuggcgccucucggcccaguggcaaaagggggaggaagugcagguuaucgccguggagcccggcaagaaccccaagaacuuccagacuaugcccgguaccuuccagacgacuaccggcgaaauuggcgcaauagcccuggacuucaagcccgggacgaguggcucucccaucaucaacagggagggcaaagugguaggucuuuacggcaacgggguggugacgaagaacgggggauacguauccggcaucgcucaaaccaacgccgagccggacggcccuaccccggagcuggaggaggagauguuuaaaaaacgcaaucuuaccaucauggaucugcaccccgggucaggcaaaacgcggaaauaucugccggccaucgugcgcgaggcgaucaagcggcgccuccggacccugauccuggccccuacccgcguggucgccgcggagauggaggaggcccugaaagggcugcccauccgguaccaaaccacggcgaccaaauccgagcauaccggccgcgagaucguggaccugaugugccacgccaccuucacgaugcggcuccugagccccgugcgagugccgaacuacaaccugauaaucauggaugaggcccacuucaccgaucccgccuccaucgccgccagggguuacaucagcacccgcgugggcaugggcgaagcugcugcuaucuucaugaccgcgacaccgcccgggaccgcagacgcuuucccgcaguccaaugcccccauccaggaugaggagagggacauucccgagcggagcuggaauuccggcaacgaguggaucacugacuucgcugggaagacagugugguucguacccagcaucaaggcaggcaacgauauagccaacugucugcgcaagaacgggaagaaggugauacagcugucccggaagacguucgauacugaguaccagaagaccaagcugaacgacugggauuuuguggucaccaccgacaucucagagaugggcgcuaacuucaaggccgaccggguuaucgacccgcggcgcugccugaagccugugauccugaccgacggcccagagcggguuauccuagcggggcccaugccggugaccgcggcgucagcagcccagcgccgagggaggguggggcggaacccucagaaggagaacgaucaguauaucuucaccggccagccauugaacaacgacgaggaccacgcccauuggaccgaggcgaagaugcugcuggacaacauuaacacgcccgaggggaucaucccggcucuguuugagcccgagcgcgagaaguccgccgccaucgauggcgaauaccggcugaagggcgagucgagaaagacguuugucgagcugaugcggcgcggagaucuccccguauggcuggcauacaaggucgccucugagggcaucaaauacaccgaccggaaauggugcuucgacgggcagcgcaacaaccaaauccuggaggaaaacauggacguggagauuuggaccaaggagggcgagaagaagaagcucaggccacgcuggcuggaugcuagaacguacuccgacccucuggcguugaaggaguuuaaggacuucgccgcgggucgcaagagcaucgcgcuggaccuggugaccgagaucgggcgcguccccacucaccucgcccaccggaccaggaacgcgcuggacaaucucgugaugcuccacacguccgagcacggcgggaaggcauaucggcacgcaguggaggagcugcccgagaccauggagacccugcuccuguuagggcucaugauucuucucacugggggcgccaugcuguucuuaaucucagggaaggggauugguaagacgagcaucgguuugaucugugugaucgccuccagugggaugcucuggauggccgagaucccgcugcaguggaucgccucugcaauugugcuggaguucuuuaugaugguacuccugauccccgagcccgagaagcagaggacuccccaggacaaccagcuggcguacgucgucaucgggauacucacucuggccgccauuaucgcugcaaacgagaugggccugcuugaaaccacgaaacgggaccugggcaugagcaaggaaccaggcguggucuccccuacgagcuaucuggacguggaccuccaccccgccuccgccuggacacuauacgccgucgcgaccacagucaucacccccauguugcgccacaccaucgaaaauagcaccgccaacgugucucucgccgcgaucgccaaccaagcggugguccugaugggauuagacaagggguggccgaucagcaagauggaccucggcgugccccugcuggcucucggcugcuacucucaggugaacccccugacgcugaccgccgccguacuccugcugauuacccacuacgccaucauaggccccggccugcaggcgaaggccacccgggaagcccagaagcggacggcugccgggaucaugaagaacccgaccguggacggcauuaugacaaucgacuuggaccccguaaucuacgacaguaaguucgaaaagcaacuggggcaggugaugcuccuagugcugugcgcggugcaacucuugcugaugcggaccuccugggcccuuugcgaggcccugacgcuggcgaccggacccaucacgacccucugggagggcagccccgggaaauuuuggaacacgaccaucgcggucagcauggccaacaucuuccgcggcagcuaccuugccggcgccggccuugccuucuccaucaugaagagugugggcaccggcaaaaggggcaccggaucccagggcgagacucucggggagaaguggaagaagaagcugaaccagcugagccgcaaggaauucgaccuauacaagaagucgggcaucacggagguggaccggacagaagcgaaggagggguugaagcgcggcgagaucacccaccacgccgucagucggggcagcgccaagcugcaaugguucguagaacgcaacaugguuauaccggagggccgggucauagaccugggcugcgggcgcggcggguggaguuacuacugcgccggcuuaaagaaagugacugaggugcggggauacacgaaaggcgggcccgggcacgaggagcccgucccuaugagcaccuacgguuggaacauagugaagcugaugucugggaaggacguguucuaccucccgcccgagaagugcgacacccugcugugcgacauaggugagagcuccccgagccccacugucgaggagucccgcaccauccgcgugcugaagaugguggagccuuggcucaagaacaaccaguucugcaucaagguccugaaccccuacaugcccacgguaauugagcaccuggagcggcuccaaagaaaacauggugggaugcuggugcggaacccccugucacgaaacuccacgcacgaaauguacuggauuagcaauggaaccgggaacaucgucgccuccgugaacauggugucccggcuccugcugaaccgcuuuacgaugacgcaccggagaccgacaaucgagaaggacguagaucuuggagcggggacccgucacgugaacgcagagcccgagacgccuaacauggacgugaucggggaacgcauuaagcggaucaaggaggaacauaacuccaccuggcacuacgacgaugagaaccccuacaagacuugggccuaccacggcagcuacgaggucaaggccacagggucggccagcuccaugaucaacggcguggucaaguuacugacgaagcccugggacgucguacccauggucacucaaauggcgaugaccgacaccacgccuuucgggcagcaacgcguguuuaaggaaaagguggauacccggaccccccgcagcaugcccggcaccaggcgcgucaugggaaucacggcugaguggcucuggcggaccuugggacgcaacaagaaaccgcggcugugcacccgcgaggaguucaccaaaaaggugagaacuaacgccgccaugggcgcgguguucaccgaggaaaaucaaugggacagcgccaaggccgccgucgaggacgaagacuucuggaagcucguggaccgagagcgcgagcuacacaaacugggaaagugcggcucaugcguguauaacaugauggguaagagagagaagaagcucggcgaguucggcaaagccaaggggucaagagcgaucugguacauguggcugggugcccgguaccuggaguucgaggcccucggguuccugaaugaggaccacugguucucccgcgagaauucuuacucaggagucgaaggggagggccugcacaagcucggcuauauccugcgggacaucucgaagauaccuggcggugcaauguacgcugaugacaccgcggggugggauacccgcauaacggaagacgaccuucacaacgaggagaagaucacccaacagauggaucccgagcaucggcagcucgcgaacgccaucuucaagcuuaccuaccagaacaagguggugaaaguccagcgcccgacccccaccggcacggugauggacaucaucucccgaaaggaccagcgcggcuccggccagguggguaccuacggccugaacaccuuuacaaacauggaagcccagcucauucgccaaauggaaggggaaggcguuuugaguaaggccgaccuggagaauccccaccuuccggagaagaagaucacgcaguggcuggaaacaaaaggcguggaacgccugaagcggauggcgaucaguggagacgacugcguggucaaacccaucgacgauagguucgccaaugccuuguuggcccugaaugauauggggaaggugcggaaggacaucccacaguggcagccgagcaagggcuggcacgacuggcaacaggucccauucuguagucaccacuuccacgaguugaucaugaaggaugggcgcaaacuggucguccccugucgcccccaggacgagcugaucggcagagcccggaucucccagggagcgggcuggucgcuccgcgagaccgccugcuuaggcaaggccuacgcgcagaugugguccuugauguacuuccacaggagggaccuuagacuggcgucaaacgccaucugcuccgccguaccuguccacugggugccgaccagccggacgaccugguccauccacgcacaccaccaguggaugaccaccgaggacaugcuaaccguguggaacagagucuggaucgaggacaaccccuggauggaggacaagacccccgucacgaccugggagaacguacccuaccucgggaaacgagaggaucaguggugcggcagccugaucggcuuaacgucgcgcgccaccugggcgcagaacauuccaaccgccauccagcaaguccggucgcucaucggcaaugaggaguucuuggacuauaugcccagcaugaagcgcuuccggaaggaggaggaauccgagggggccauaugguga

SEQ ID NO: 26058 - RNA, 9873 nt, Artificial Sequence
  derived and/or modified CDS sequence (opt11) from DENV-3__FJ639793__SS-prME
accucccuaugccucaugaugauuuuacccgcgacccucgcuuuccaccucaccagccgugacggcgagccucggaugaucguggggaagaacgagcggggcaagagccugcuguucaagaccgcgagcgggaucaacaugugcacacucaucgccauggaccugggggagaugugcgacgacaccgugaccuacaagugcccccauaucaccgagguggagcccgaagacaucgacuguuggugcaaucugaccagcacgugggugaccuacgguaccuguaaccaggccggggagcaccggcgcgacaagcgcagcgucgcuuuggcgccucacgugggcauggggcuagacacucgcacccaaacauggaugucggcggagggcgccuggcgacagguagagaaggucgagacuugggcccuccgccacccgggguucaccauccucgcccuguuccuggcgcauuacaucggcaccucccuaacgcagaagguggugauuuucauccuucugaugcucguaacccccagcaugaccaugcguugcgugggggugggcaaccgcgacuucguggagggccuguccggcgccaccuggguggacguuguccuugagcacggcgguugcgugacgaccauggccaaaaacaagcccacgcucgauaucgagcugcagaagacagaagccacgcaacuggccacacuccgcaagcugugcaucgaggguaaaaucacaaacauaaccacggacagccgcugccccacacagggcgaggcggugcugccggaggagcaggaccagaacuacgucugcaagcacacguacguagaccggggcuggggcaacgggugcggucucuucgggaagggcuccuuggugaccugcgcaaaguuucagugucuggagcccaucgaaggcaagguggugcaguacgagaaccugaaguauacggugaucaucaccguacacaccggggaccagcaccaggugggcaacgaaacccaggggguaacggcggagaucacgccccaggccagcaccaccgaggccauacugcccgaguacggcacccuggggcuugagugcuccccgaggacgggccuggacuucaacgagaugauacugcucaccaugaagaacaaggcguggaugguccaccggcagugguuuuucgaccugcccuugcccuggaccagcggcgccaccacggagaccccgacauggaaucgcaaggagcucuugguaaccuucaagaacgcccacgccaaaaagcaggaagucguggugcugggaucccaggagggugccaugcacacggcgcugaccggcgccaccgagauccagaacagcggcgggaccuccaucuucgcgggucauuugaagugccggcugaaaauggacaagcucgaacucaagggcaugagcuacgccaugugcacgaacaccuucgucuuaaagaaggagguguccgagacucagcacgggacaauccucaucaagguggaauacaagggcgaggaugucccgugcaaaauccccuucagcacggaagacggccagggcaaggcccauaauggucgccuaaucaccgcgaaccccguggugaccaagaaagaggagcccgucaauaucgaagccgagccgcccuucggggagucgaacaucgucaucggcaucggggacaaugcccugaagaucaacugguacaaaaaggguucaagcaucggaaagauguucgaggcaaccgcgcggggcgcucgucggauggccauccucggcgauacggccugggacuucgggucugugggcgggguacucaacagccuugggaagauggugcaccaaaucuucgggucggccuacaccgcgcuguucagcggcguuuccuggguaaugaagauugguaucgggguguugcucaccuggaucggccucaacagcaagaacacauccaugucauucuccugcauagccaucgggaucaucacgcuuuaccugggagccguaguccaggcagacauggggugugugaucaacuggaagggcaaggagcugaagugcggcagcgggaucuucgugaccaacgagguccacacuuggaccgagcaauacaaguuccaggccgacucccccaagcgccuugcaacggcgauagcgggcgccugggagaacggggugugcggcauccgaagcaccacccggauggagaaccuucuguggaagcagaucgccaacgagcucaacuacauccucugggagaacaacauuaagcugaccguuguugugggggacaucaucggcgugcucgagcagggcaagcgcacacugacgccacagccgauggagcugaaauacuccuggaagaccugggggaaggcgaagaucgucaccgccgagacgcagaauagcuccuucaucaucgacggcccgaacacacccgagugccccagcgccucccgggccuggaacguuugggagguggaggacuacggguucggcgucuucaccaccaacaucuggcucaaacuuagggagguguacacccagcugugcgaccaccggcucaugagcgcugcagugaaggacgagcgcgccguccacgcggacaugggcuacuggaucgagucgcagaagaaugggucauggaaguuagagaaggcgagccugauagaggucaaaacguguaccuggccuaagucgcacacacucuggagcaauggagugcuggaguccgacaugaucauccccaagagccuggcaggacccaucucccaacacaacuaccggccgggcuaccacacccagacugccgggccguggcaccugggcaagcuggaacuggacuuuaacuacugcgaggggacuaccgucgugauuaccgaaaacugcgggacgcgcggccccucgcuccggaccaccaccguguccggaaagcugauccaugaguggugcugccgcagcugcacgcugcccccgcuccgguacaugggcgaggaugggugcugguacggcauggagauccgccccaccucugagaaggaggagaacauggucaagagccuggugagcgccggcagcggggaaguugacaacuucaccaugggcguccuuugccucgcaauccuguucgaggaggugaugcggggcaaguucggcaagaaacauaugaucgcuggaguguuuuucaccuucgugcuucuccuguccggccagaucacguggcgcgauauggcgcacacccugaucaugaucggcucuaacgccuccgauaggauggggaugggcgugaccuaccuggcacucaucgccacguuuaagauccagcccuuucuggccuugggguucuuccugcguaaacugacuucccgggagaaccuccuacugggcgugggccucgcuauggcaaccacacugcagcugcccgaggacaucgagcagauggccaacgggaucgcccucggcuugauggcgcugaagcucauaacccaauucgagacguaccagcuguggaccgcccugaucagcuuaaccugcagcaacaccaucuuuacgcuaaccgucgcuuggaggaccgcgacccugauccucgccggggugagucuauugccggucugccaguccagcagcaugcggaagacggacuggcuccccaugacgguggcugccaugggggugccgccccucccucuauucaucuucucucucaaggauacgcugaagcgccgcucauggccccugaaugagggggucauggcuguggggcucgugagcauccuggccuccagccugcugcggaacgacguccccauggccgguccccuuguggccggcgggcugcucaucgcgugcuacgugaucaccgggacguccgccgaccugaccgucgagaaagccgccgacgugaccugggaagaggaggcggagcaaaccggggugagccacaaccugaugaucaccgucgacgaugacgggacgaugcgcaucaaggacgacgagacagaaaacauucucaccguacugcugaagaccgcccuccugauaguauccggcaucuucccauacagcauccccgcgacccuccuaguuuggcacaccuggcagaagcagacgcagcggucugggguguugugggacgugccaaguccacccgagacccagaaggccgagcuggaggagggcgucuaccgcaucaagcagcaggguaucuucgggaagacccaggugggcguggggguacagaaggaggguguguuccacaccauguggcacgugacacggggcgcgguucucaccuauaacgguaaacgccuggagccgaacugggcguccguuaagaaggaccugaucucuuacggagggggcuggcgguuguccgcccaauggcagaagggggaggaggugcaggucauugccguugaacccggcaagaaccccaagaacuuccagacgaugcccggcaccuuccagaccaccacgggggagaucggggccaucgcccuggacuucaagccugguacgagcggcagcccgaucaucaaccgcgagggcaagaucguggggcuuuacgggaacgggguagugaccaagaacggaggguacguguccggcaucgcccagaccaacgcggaaccggauggcccaacgcccgagcuggaggaggagauguucaagaagcgcaaucugaccaucauggaucugcaccccgggagcgguaagacccgcaaguaccucccugccaucguccgggaggccaucaagcgcaggcuccgcacccugauccuggcgccgacaagagugguggccgccgaaauggaggaggcccucaaggggcugcccauucgcuaccaaaccaccgccaccaagagugaacacacgggacgggagaucgucgaccugaugugccacgcgacguucaccaugcgccuccugagccccgugagagugccuaacuacaaccugaucaucauggacgaggcccacuucaccgaccccgccuccaucgccgccagaggguacaucucaacacgggucgggaugggcgaggcggccgccaucuuuaugaccgcuacaccgcccgggaccgcggacgccuucccgcagucuaaugcgcccauccaggacgaggagcgcgacauccccgagaggagcuggaacaguggaaacgaguggaucacugacuucgccggaaagaccgugugguucgugcccucaaucaaggcgggcaaugacauagcgaacugccuccggaagaacggaaagaaggucauccaguuaucucgcaagaccuucgacaccgaguaccagaagacgaagcucaacgacugggacuucguggugaccaccgauaucagcgagaugggcgccaacuuuaaggccgacagggucauagacccgcggcggugccucaagcccgugauccugacggacggucccgagcgcgugauccuggcggggcccaugccagucacagcagcgucagcggcccaacggaggggacggguggggcguaacccccagaaggagaacgaccaguacauauucacgggccagccccucaacaacgacgaggaccacgcccacuggacggaggccaagauguugcuggacaacaucaauaccccugaggggaucauuccggcccucuucgaacccgaacgcgagaaguccgcggccaucgacggcgaguaccgccugaaaggagagucccggaagaccuucguagagcucaugcgccguggcgaccuccccgucuggcuggcccacaaaguggcgucugagggcauaaaguauacggaccgcaaguggugcuuugacgggcagcggaacaaccagauccuggaggagaacauggacgucgagauauggaccaaggagggcgagaagaagaagcuccgcccccgguggcuggacgcucgcacuuacuccgacccccuggcucucaaagaguucaaggacuucgcugccggccgcaaaagcaucgcucuggaccuggugaccgagaucgggcgugugcccacgcaccucgcccaucgcacccggaaugcccuggacaaccuggucaugcuccacaccagcgagcauggcgggaaagccuaccgccacgccguugaggagcugcccgagaccauggagacgcuguuacugcugggcuugaugauccugcuuaccgggggcgcgauguuguuccuaaucagcggcaaggggaucggcaagaccaguaucggacugaucugcguuaucgccagcagcggcaugcuguggauggccgaaaucccgcugcaguggaucgccagugccaucguccuggaguuuuucaugauggugcuccugauccccgagcccgagaagcagagaacgccccaagauaaucagcuggcguacguugucaucgguauccucacguuggcugccauaauugcagccaacgagaugggccucuuagagaccacuaagcgugaccugggcaugagcaaggagccgggaguggugucccccaccagcuaccuggacguagaccuccaccccgcuuccgccuggacgcuguacgcgguugccaccaccgugaucaccccaaugcugcggcauacgaucgaaaacagcacggcuaacgucagccucgccgcaaucgccaaccaggccguuguacugaugggccucgacaagggguggccgaucagcaagauggaccugggcgucccccuacuggcgcuuggaugcuacucccaggugaacccccugacccugaccgccgccgugcuccugcugauuacgcacuacgccaucaucggccccggccuccaggccaaggcgacacgcgaggcacaaaagcgaacggcagccgggauaaugaagaaccccacaguagacggcauuaugacgauugaccuggaccccgugaucuaugacagcaaguucgagaagcaacugggccaaguuaugcuccugguccugugcgccgugcaguuacugcugaugcgcacguccugggcccucugcgaggcccugacucuggcuaccgggcccauaacgacgcucugggagggcucccccgggaaguucuggaacaccaccauugcagugaguauggcuaacaucuuuaggggcaguuaccuggccggggcuggccucgccuucucagugaugaaguccguggggaccggcaagcgcggcacggggucucagggcgagacuuugggggaaaaguggaagaaaaaguugaaccagcugaguagaaaagaguucgaccucuacaagaaguccggcaucacagagguggaccgcaccgaggccaaggagggucuaaagcgcggcgagaucacucaccacgcggucucccgaggcagcgccaagcugcagugguucguggagcggaauauggugaucccggaggggcgcguaaucgaccugggcugcggacggggcgggugguccuacuauugugccggccugaaaaaggugaccgaaguccgcggcuacaccaagggcgggcccgggcacgaggagcccguccccaugucaaccuacggcuggaacaucgugaagcugauguccgggaaggacguguuuuaucuuccgcccgagaaaugugacacgcugcuuugcgacaucggcgagagcucccccagccccaccgucgaggagucccggaccauccgcguguuaaagaugguggaaccgugguugaagaacaaccaguucugcauuaagguccugaaccccuacaugcccacggugaucgaacaccuggagcgccuccaacggaaacacggagggaugcucgugcgcaaccccuuaagcagaaacuccacacaugaaauguacuggauuagcaacgguaccgggaacaucgucgcgucugugaauauggugagccgccuccugcugaacagguucacuaugacacaccgccggccgacgaucgagaaggacguggaccugggcgccggcacccgccacgugaacgcggagcccgagaccccuaauauggaugugaucggggagcggaucaagagaaucaaggaggagcauaacuccaccuggcacuaugacgacgagaacccauacaagacaugggccuaccacggcagcuacgaggucaaggccacuggguccgccucguccaugaucaacggcguggugaagcuccugaccaagcccugggacguggugcccauggucacacagauggccaugacggacaccacccccuucgggcagcaacguguguucaaggagaagguggacacacguacgccgcggagcaugccgggcacccgccgggucaugggcaucaccgcggagugguuauggcgcacccugggccggaacaagaaaccaagacugugcacgcgggaggaguucaccaaaaaggugcgcaccaacgccgcaaugggcgccguuuucaccgaggagaaccagugggauagcgcuaaggccgcgguggaggaugaggacuucuggaagcucguagaucgcgagcgggaauugcacaagcucgguaagugcggcucuuguguguacaacaugauggggaagcgcgagaagaagcucggcgaguucggcaaagccaaagggagccgggccaucugguacaugugguuaggugcgcgauaccuggaguucgaagccuuggguuuucuaaacgaggaucacugguucucccgggagaacagcuacuccggcgucgagggggaggggcugcacaaguugggcuauauccugcgcgacaucagcaagaucccagguggagcaauguacgccgacgacacggccgggugggacacccgaauaaccgaggacgaccugcauaacgaggagaagaucacccagcaaauggacccugagcaccgccagcucgcgaacgccauuuuuaaacugaccuaccagaacaagguggugaaaguccagcgccccacgcccaccggcaccguuauggacaucaucagccgcaaggaccagcggggaagcggacaggugggcacauacgggcuaaauacguucaccaacauggaggcucaguuaauccgccagauggagggcgaggggguacuguccaaggcagacuuagagaacccucaccucccggagaaaaagaucacccaguggcucgagaccaagggcguggagcggcugaagagaauggccauuagcggcgacgacugcguggucaagcccauagacgaccgguucgcuaacgcccucuuggccuuaaacgacauggggaaaguccgcaaggacaucccccaguggcagcccuccaagggcuggcacgacuggcagcaggucccguucugcagccaucauuuccaugaguugaucaugaaggacgggagaaagcuggucguaccaugcaggccccaggacgagcugauaggccgggcccgcaucucgcaaggugccggcuggucgcugagagagacggcgugcuugggcaaggccuacgcccagauguggucccuuauguacuuccaccgccgcgaccuccggcuggccagcaacgcgaucugcucagccguucccguccauugggugccgaccagccgcaccaccugguccauccacgcccaccaucaguggaugacgacagaagacaugcugaccguguggaaucgggucuggaucgaggacaacccguggauggaagacaagacccccguaacgacuugggagaacguccccuaucucggaaagcgcgaggaccaguggugcggcagccugauaggcuuaaccagccgggccaccugggcccagaacaucccgacggcgauccagcaaguccgcucccucaucggcaacgaagaguuccuggauuacaugcccaguaugaaaagauuucgcaaagaggaagaguccgagggggcaaucugguga

SEQ ID NO: 26059 - RNA, 9873 nt, Artificial Sequence
  derived and/or modified CDS sequence (opt11) from DENV-3__FJ639795__SS-prME
acuagcuuaugccuuaugaugauucuaccagcugcguuagccuuucaccugacgucacgggauggggaaccacgaaugauuguugguaaaaacgaaagagggaaaagccuacuguucaaaaccgcuuccgggauaaauaugugcacauuaauagcgauggaccugggugaaaugugcgacgauacuguaacauacaaaugcccacacauuacagaagucgaaccugaagauauugauugcuggugcaauuugacgagcacauggguaaccuacggaaccugcaaccaagcaggcgaacauagacgagacaaacggucaguagcccuagccccucacgugggaaugggccucgacacucgcacccagacguggaugucggcagaaggggccuggcggcaaguggaaaaaguggaaacgugggcgcugcggcauccaggauuuacaauacuggccuuauuccuggcucacuacaucggaaccagcuugacacagaaaguugugauauuuauccuccucaugcucguaaccccaucgaugacgaugagaugcguaggcguuggaaaccgggauuucgucgagggacuaagcggcgcaacauggguggauguaguauuagaacacggcgguugcguaacuaccauggccaaaaauaaacccacccuggacauagaacuucagaaaacagaagcaacgcagcucgccacucuacgcaaacucuguauugaaggaaaaauaaccaauauaacaacggauuccagauguccaacacaaggcgaagccguucuccccgaggaacaggaucagaauuacgucugcaaacacacguacguagaccgcggauggggcaacggaugcggccuguucgguaaaggcagccugguuacuugugcaaaauuccaaugucucgagccaauagagggcaaaguaguucaauacgagaauuugaaauacaccguaaucauaaccguccacacaggcgaccaacaccaagucgguaacgaaacucaaggcguaaccgcugaaauaaccccucaggcuucaaccacggaggcaaucuuacccgaauacggcacacuaggccucgaaugcuccccuaggacagggcuggacuucaacgaaaugauacuccugacgaugaaaaacaaggcuuggauggugcaccgccaaugguuuuucgaccuuccgcuacccuggacgucaggcgccaccacagaaacaccgaccuggaaccgaaaagaacuacuggucacauuuaaaaacgcccaugcgaagaaacaggagguaguagugcuuggaagccaagaaggggcaaugcacacagcacuaacaggggcaacagagauacagaacucgggcggaaccucaaucuuugccgggcaccuaaaaugucgacucaagauggacaaauuggaacugaagggaaugaguuacgccauguguacaaacacguuuguucucaagaaggagguaagcgaaacccagcacgguaccauacucaucaaaguggaauacaaaggggaagacguacccuguaaaauuccguucuccacagaagacggacaagggaaggcacacaacggaaggcuaaucacggccaacccaguaguaaccaagaaagaagaaccagucaacaucgaggcagagccuccuuucggagaaucaaacauagucaucggcauuggcgauaacgcccucaaaauuaacugguauaagaaaggcagcucgauaggcaaaauguuugaggcgacggcuagaggagcacguaggauggccaucuuaggcgacaccgcgugggacuuuggcucaguagguggggugcugaacucacucgguaagaugguccaucaaaucuucgguucugccuacacggcucuauuuagcggggugucaugggugaugaagaucggcauaggcguucuacuuacauggauaggguuaaauuccaagaauacuagcaugagcuucagcugcauagccaucggaauaauaacguuauaucuaggagcagugguacaagccgauauggguuguguaaucaacuggaaaggcaaagaacucaagugcggaagcggaauauucgucacaaacgagguccauacauggacggagcaauacaaguuccaggcggacuccccuaaacgccucgcaaccgcaauagcaggagcuugggaaaacggcgugugcggaauacggucaacgaccagaauggaaaaccugcuauggaaacaaauagcaaacgagcucaacuacauacuaugggagaacaacauaaagcucacugucguagugggagauaccauaggaguacuagagcagggcaaacgcacguugacgccacagccaauggaacucaaauacucuuggaaaacgugggguaaggcgaaaaucgucacagcggagacacaaaacagcuccuuuauaauagacggcccuaacacaccugagugccccuccgcaucccgcgcauggaacguaugggaaguagaggacuacggcuucggagucuucacaacgaacauuuggcugaagcuccgagaggucuacacucaacucugugaucaccggcuaaugagcgccgccguuaaggacgagagagccguucacgcagauaugggcuauuggauagaaucccaaaagaauggaucauggaagcucgaaaaagccucccuaauugaggugaaaacgugcaccuggcccaagagccacacacuauggucaaacggcguguuagaaucggauaugauuauacccaaaucccucgcgggccccaucucgcaacacaacuauagaccgggguaccacacacaaacagccggaccguggcaccuaggcaaacuggagcucgacuuuaacuacugcgaagggacgacugugguaaucacagaaaauugugggacgagaggccccagccuacgaaccacuacugucucgggaaaguuaauccacgaauggugcuguagaucgugcacacuaccaccgcuacgguacaugggcgaggacggcugcugguacggcauggaaauccggcccaucuccgagaaagaagagaauaugguuaaaucgcuuguaagcgcaggcucaggcgaaguggacaauuuuaccauggggguacucugcuuggcgauccuguucgaagaaguuaugcgaggcaaguucggaaagaaacauaugauagcaggggucuucuucaccuucguacuauuacugagugggcaaaucaccuggcgagacauggcgcacacgcuaauaaugauaggguccaaugcuagcgauaggaugggcauggggauaacguaccuagcacuaaucgccacguucaagauucaaccauuccuagcguugggauucuuucugcgcaaacugaccagccgggaaaaccuucuacucggaguggggcuggcaauggccacuacccuccaauugcccgaagacauagaacaaauggcaaacggaaucgcguuaggccucauggcacuaaaauuaauaacucaauuugaaacauaccagcucuggaccgcccugaucagcuuaacaugcuccaacaccauauuuacucuuacagucgcguggcggacggcaacguuaauccucgcgggcguaucucuacuaccuguaugccaguccucgucuaugcgaaagaccgacugguuaccaaugacagucgcagcgaugggagucccaccguuaccucuguucauauucucguugaaagacacucuaaaacggaggagcuggccgcuuaacgaaggagugauggcugugggucuagucagcauacuagcuucaucgcuacuacgaaaugacgugccuauggcuggaccccugguagccggcggccuauugaucgcauguuacgucaucacaggaaccagcgcggaccugaccguagaaaaagccgcagacgugacaugggaggaagaggccgagcaaaccggcguuagucauaaccuaaugaucacgguugaugaugacggaaccaugcgaaucaaggaugaugagacggagaacauccuuaccguacuacucaaaacggcucuacuaaucgugucaggaauauuuccauacagcauacccgcaacccuacugguguggcacacauggcagaaacagacgcaacgcuccggaguccugugggacgucccauccccgcccgagacacaaaaggccgaacuugaagagggaguguaccgcaucaaacaacagggaauauucggcaaaacccaaguaggaguggguguacaaaaagagggagucuuccacacaauguggcaugugacacggggagcuguacucacauauaacggaaaacgacucgagccgaauugggcaucagucaagaaagauuuaauaucguacggcgggggcuggaggcugucagcgcaauggcaaaagggagaagagguacaggucauagccguagaacccggcaagaaccccaagaacuuccaaacgaugccugguaccuuucaaacaacaaccggcgagauaggagcaauagcacuggauuucaagccgggaacaagcggaucccccauaauaaacagagagggaaaggucguaggucuauacggcaauggaguaguuacgaaaaacggaggguacgugagcggcauagcacagacaaacgcagaaccggauggcccuacuccggagcuggaagaagaaauguucaagaaaagaaaucuaaccauaauggaccuacacccgggaucgggcaagacacggaaguacuuaccggccaucguuagagaagcgauaaagcgcaggcugaggacguuaauucuagccccaacacgggucguagcggcagagauggaagaggcauugaaaggacuacccauucgcuaccaaacaacugcaaccaaaagugagcauacgggccgagagauagucgaucucaugugucacgcgacuuucaccaugcgccugcuuagcccggugagaguuccaaacuauaaccuaauaaucauggacgaggcucacuucaccgauccggcuagcaucgcggcacggggcuacauuagcacacgaguaggcaugggagaagcagcagcgaucuucaugacggccacacccccaggaacugcggacgcuuucccacaaucgaaugcccccauacaagaugaagaaagagacauacccgaacgaagcuggaacucaggcaacgaauggauaaccgacuucgccggaaaaacaguaugguuugugccaagcauaaaagcgggcaacgacaucgccaacugcuugcgaaagaaugggaagaaaguaauucaacugagccgaaaaacauucgacaccgaauaccagaaaacaaagcuaaacgacugggauuuugugguuaccacagacauaagcgaaaugggagcaaacuuuaaagccgaccggguaaucgaccccagaaggugccuaaagcccguuauacucacagacgggccagagcgcgucauccuggcggggccaaugccaguaacugcggcgagcgcggcccaaaggcguggcagagucggaaggaauccacagaaggaaaacgaucaguacauauucacagggcaaccccuuaacaacgacgaagaccacgcacauuggaccgaggcgaaaaugcuguuagauaauauaaacacacccgagggcauuauccccgcacucuuugagccggagcgugagaaaagcgcagccaucgacggcgaguaccgacugaagggugaaucgaggaagacguuuguugagcucaugagaagaggggaucucccggucuggcucgcccauaaaguugcaucagaaggcauaaaguacacggaccgcaagugguguuucgacggacaaagaaacaaccaaauccuggaagagaauauggacgucgaaauauggacaaaggagggagaaaagaagaaacuaaggccgcguuggcuagaugcacgaacguacucagacccccuggcccuaaaggaguucaaagacuucgcagcgggccgaaaauccaucgcgcucgaccugguaacugaaaucgggcguguacccacacaccuagcacaucgcacgcgaaacgcacuagauaaccucguuauguuacacaccucagaacacggcggcaaagcauaucgccacgcuguagaggaacuccccgagacaauggaaacgcuacuacuacucggacuaaugauccugcuaaccgggggagccaugcuguuccucauaagcgggaagggcauaggaaaaacauccaucggccucauaugcgugaucgccucgucugguaugcuguggauggcagaaaucccccuccaauggaucgcgucagcuaucguguuggaguucuucaugaugguguugcuaaucccagaaccggaaaagcaacggacaccccaggacaaccaauuggcuuacguugugauagguauacuaacauuagcagcaacaauagcugcgaacgaaaugggacuccuggaaacaacaaaacgcgaccugggcaugucaaaagagccgggggugguaucgccuacgucuuaccuagauguagaccuucauccggcuucggcauggacguuguacgcgguagcaacaaccgugauaacaccaaugcugaggcacaccauagaaaacucuaccgcgaacgugucucuggcagcaaucgccaaccaagcaguggugcucauggggcuagauaaaggguggcccaucucaaaaauggaccucggcguuccccuccucgcgcucggcugcuacucacagguaaauccauuaacacugacagcagcaguacuccuguuaauaacacacuacgccauaaucggcccgggacuucaggccaaagcgacccgcgaagcacagaaaagaaccgcugcgggaaucaugaaaaaccccaccguugacggaauaaugacaaucgacuuggauccugucauauaugacucuaaauucgaaaaacagcuaggccaagucaugcuucuugucuuaugcgcagugcagcuacugcuuaugagaaccagcugggcacuaugcgaggcgcugacauuggccacugggcccauaaccacgcuuugggagggaagcccggguaaguucuggaacacgacaaucgccgugagcauggcaaacauauuucgcggcuccuauuuagcgggagcgggacucgccuuuagcaucaugaaauccgugggaacugguaaaagggguaccggaagccaaggagaaacccuaggugaaaaguggaagaagaaauugaaccagcucaguagaaaggaguucgaccuuuauaagaaauccggaauaacagagguggaucgaaccgaggccaaagaagggcucaaacgaggagaaaucacacaucacgcugucuccagagggucagccaagcuccagugguucguagagcgaaauaugguaauacccgagggacggguuaucgaccuaggaugcggacgcggcggguggagcuacuacugcgcaggacuaaagaaagugacagaagucaggggguauaccaagggcggcccgggacacgaagaaccggucccaaugucgacuuacggauggaacauuguuaagcugaugagcggaaaggauguguucuacuugccacccgaaaaaugcgauacccuccugugcgacauaggugaaagcagcccgucaccaaccguagaggaaucgcgcacgaucagaguacugaagaugguugaacccuggcucaaaaauaaccaguucuguaucaagguacugaauccuuacaugccaacggugauagaacaccucgaaaggcuccagcggaaacaugguggaaugcuugugagaaacccucuuucacggaacagcacgcacgaaauguacuggaucagcaaugggacaggaaacaucgucgcaagcgugaacauggucagccgccugcuacugaacagguucacaaugacgcaccgacgaccaacaauagaaaaggacguggaccuaggagcagguacucgccacgucaacgcagaaccggaaacaccgaauauggacgucaucggcgagaggaucaagcgcauaaaagaggaacacaacuccacauggcacuacgacgacgaaaaccccuacaagacaugggcauaccauggcuccuacgaagugaaggccaccggcucagccagcagcaugaucaacggcgucgucaagcuccuuaccaaaccgugggacguagugccaauggugacccaaauggcaaugacagacaccacccccuucggacagcaacgagucuucaaggaaaaaguugacacacgcacaccacgcuccaugccggguacccggcgagugaugggcauaaccgcagaaugguuguggcggacauugggcagaaacaagaaaccccgacugugcacgagggaggaguucaccaagaaaguccggacgaacgcagccaugggcgccgucuuuaccgaagaaaaccaaugggacagcgccaaagccgcagucgaagaugaggauuucuggaaacugguagacagggaacgggaacuccacaaguugggaaagugcggaucgugcguguauaacaugaugggcaaaagagaaaagaaacucggagaguuuggaaaggccaaggguucacgagcaauaugguacaugugguugggugcgcgcuaccuggaauuugaagcccugggauuccugaacgaggaucacugguucucacgggaaaacaguuacuccgggguagagggcgaaggacuacacaaacucggauacauuuuaagggauauuagcaagaucccgggcggugcaauguacgccgacgacaccgcggggugggacacucgaaucaccgaagacgaccuacacaaugaagagaaaaucacccaacagauggaccccgagcacagacaacuggccaacgccauauucaaacucaccuaccaaaacaaaguagucaagguacagcggccaacccccaccgguaccguuauggacauuaucucaaggaaagaccaacgugggagcggccaagucgggaccuacggauuaaacacauucacuaauauggaggcgcaacucauacgacaaauggagggagagggcgugcucuuaaaagcggaucucgaaaauccccaccuccccgagaagaaaaucacacaguggcuagaaacgaaaggggucgaacgauugaaacgaauggcuaucagcggcgacgauugcguaguuaagccgauugacgauagauucgccaaugcauuacuagcgcuaaacgacauggggaaaguaagaaaagacaucccgcaauggcagcccucaaaaggcuggcacgacuggcaacaaguacccuucugcagccaccacuuccacgaacuaaucaugaaagacggcagaaaacuugucguuccgugccgaccucaggacgagcucauaggcagagcccgcauaucacaaggggcgggguggagucugcgcgaaacagcuugcuuaggcaaagcguacgcgcaaauguggucgcugauguauuuccacaggcgagaucuacgccuggcaucuaacgcaaucugcucggccgucccaguucauuggguaccaacgucgcgaacaaccuggagcauacaugcacaccaucaguggaugacgacggaagacaugcucacgguauggaaucgagucuggauagaggacaacccuuggauggaagacaaaacaccuguaacaacgugggaaaauguccccuaucuaggaaagcgcgaagaccaaugguguggaucccugauagggcugaccucccgagccacuugggcacaaaacauaccuaccgcaauucaacaagugcgcucucugauaggcaaugaggaguuucuugacuacaugccgucaaugaagcgauucagaaaagaagaagagucggaaggagccaucugguaa

SEQ ID NO: 26060 - RNA, 9873 nt, Artificial Sequence
  derived and/or modified CDS sequence (opt11) from DENV-3__FJ639798__SS-prME
accagucuaugcuugaugaugaucuuaccagccgcccucgccuuucaccucacgucgcgugacggagaaccccgaaugauagucggcaaaaacgaaagagggaaaucuuuacuauucaaaacagcaagcggaauaaacaugugcacgcucaucgccauggaccuaggagaaaugugcgaugacacggugacauacaaaugcccccacauaacggaagucgaaccggaagacaucgacugcuggugcaaccugacaagcacaugggugacguacggcaccuguaaucaagcgggagagcacagacgagauaaacgaagcguggcccucgcaccccacguaggaaugggacucgauacacgaacacaaacguggaugagcgcggaaggagcguggaggcaaguagaaaaaguagaaacaugggcccugcgacaccccggcuucacaauucucgcgcuguuucuagcgcacuacauagggacgucacugacccaaaaagucguaauauucauccucuugaugcuagucacaccgagcaugacaaugagauguguagggguaggaaaccgugacuuuguagaagggcucagcggggcgacuuggguggauguaguucucgagcacggcggaugcgucaccacaauggccaaaaacaaacccacccuagauauugagcuucagaaaacagaagcuacucaauuggcgacgcugcgaaaacuauguaucgaaggcaaaauuacaaacauuacgacagacagccgaugucccacgcagggggaggcgguacucccggaagaacaagaccagaacuacgucugcaaacacaccuacguggauaggggaugggggaacggcugcgggcuauucgguaaaggaucacugguaacaugugccaaauuccagugccuggaaccaguagaagggaaagucgugcaguaugaaaaccugaaauauacaguaauuauuacaguccacacaggggaccagcaccagguaggaaacgagacccaaggagucacagccgaaaucacaccccaagccucaacgacagaagccauacucccagaauacgggacacuuggguuggagugcucaccacggacaggucuagacuucaaugagaugauacuccucaccaugaaaaacaaggcguggaugguccauaggcagugguucuucgaccuaccgcucccauggacaucgggagccacaacggaaacgcccaccuggaaccguaaagagcuacucgucacauucaaaaacgcacacgccaagaaacaggagguaguagugcucggaucgcaagagggagcaaugcacaccgcgcucacaggugcuaccgagauucaaaauucaggaggaacgagcauuuucgccggccaccuuaaaugccgccuaaaaauggacaaacuugagcuaaaagggaugagcuacgccauguguacaaauacguuuguacuaaagaaggaaguuucugagacacaacacggaacaauacuaaucaaagucgaauauaagggagaagacgucccgugcaagauaccuuucaguaccgaagacgggcaaggaaaagcacauaacggacgacuaauaaccgcaaacccggucgucaccaagaaagaagaaccgguaaauauagaggcggagccacccuucggcgagagcaauauuguaauugguaucggagacaacgcgcuaaagauaaacugguacaagaaaggaagcaguaucgguaaaauguucgaagcgacggcccgaggagcccgaagaauggcgauacugggugacacagcuugggauuucgggucagucggcggcguacuaaacagccucgggaaaaugguccaccaaaucuucgggagcgccuauacagcacuauucaguggggucaguugggugaugaagauugggauaggaguccuccuuacauggaucgggcugaacucaaagaauacaaguaugaguuuuagcugcaucgcgauugggaucauaacacuauaccucggugcggucguccaggcugauaugggcugcgucauaaacuggaaaggcaaagaacucaaaugugguucaggcauauucgucacgaacgaaguccacacguggacagagcaguacaaauuccaagccgacagucccaagcgccuagccacagccaucgccggugccugggaaaacgggguuugugguauacgcucaacgacgcggauggaaaauuuguuguggaaacagaucgccaacgagcucaauuacauccucugggaaaacaauauaaaacugacggugguugugggcgauauaauaggaguguuggagcagggcaaaaggacacuaacaccucaaccaauggagcucaaguacucauggaaaacgugggggaaggcaaagauagucacggcggaaacacaaaacaguagcuucaucauagacggaccuaauacuccugaaugcccauccgcgagccgagccuggaacgugugggaggucgaagauuauggcuucggcgucuucaccacgaauauuuggcuaaaacuccgagaaguguacacgcagcuaugcgaucaccgauuaauguccgcugcuguuaaggacgaacgcgccguacaugcugacaugggauacuggaucgaaucacagaaaaacggaaguuggaagcuagaaaaagcgagccuaaucgagguaaagacguguacauggccaaagagccacacgcuuuggaguaauggagucuuggaauccgacaugaucaucccaaaaucacuagcgggcccgauaagccaacacaacuaccgaccgggcuaccauacacagaccgcagggcccuggcaccugggaaagcucgaauuagacuuuaacuacugcgaaggaacuacagucguuauaacagaaaacugcggcacccgaggcccuagccuccggacgacgacggucucuggcaaacuaauccaugaauggugcugucgaucgugcacccuaccaccccuuagguauaugggagaagacggaugcugguacggcauggaaauacgacccauaagcgagaaagaagaaaacauggucaagucgcuagucagcgcaggcucgggggaagucgauaauuucacgauggggguccuuugccuugcgauacuuuucgaagaagugaugcgagggaaauucggaaagaaacacaugaucgcuggagucuucuuuacauuuguucuucuccugucaggccaaaucaccuggcgagauauggcacacacacuaaucaugauugggucaaacgccuccgauagaauggggauggguguaacuuaccuagcccugauagcaacauuuaaaauccaacccuuccuagcccucggauucuuucuaagaaaacuuaccagccgcgaaaaccugcuauugggcguugggcuugcuauggccacaacacuacaauuaccggaagacauugagcaaauggcaaacgggaucgcgcucggcuuaauggcacugaagcugaucacgcaauucgaaacauaccagcuguggacggcgcugaucucgcucacgugcagcaacaccaucuuuacgcucaccguagccuggcgcacagccacacucauccuggcaggagugucacuacugccgguaugucagagcucguccaugagaaagacagacuggcuccccaugaccguagccgccaugggcguacccccucugccgcuguucauauucagccucaaggacacacugaagcgacgguccuggccgcuaaacgagggaguuauggcaguaggccuaguauccauacuagcgagcucacuacuacgcaaugauguaccgauggcggggccgcugguagcuggcggucuacucauugccugcuacgucauuacgggcaccucggccgaucuaaccgucgaaaaagcagccgacguaacgugggaagaagaagcagaacaaacgggaguaagccauaaccucaugauaacggucgacgacgacgguacuaugagaaucaaagacgacgaaacagaaaacauccuaacuguccuccugaaaacugcauugcugauagugagcgguaucuucccguacuccauuccagccacauuacucgucuggcauacauggcaaaagcaaacucagcguagcggcguacugugggacgugccaagcccuccagagacacaaaaagcugaacuugaagaagggguauacaggaucaaacagcaggggauauucggaaagacccaaguaggggugggaguucagaaggaagggguauuccacacaauguggcacguuacgcggggagcaguacucaccuacaacgggaagcgacuugagccaaacugggccucggucaagaaagaccucauaagcuacggaggaggauggcgccugagcgcccaauggcaaaaaggcgaggaaguucaagugauugccgucgaacccgguaaaaauccaaagaacuuccagacaaugccaggaaccuuccaaacgacaacaggcgaaauaggggcaaucgcccuagauuucaagccaggcacaucaggguccccaaucauuaaccgugagggcaagguggucggcuuauauggaaauggugugguuacgaaaaacggagguuacguaagcgggauagcacagaccaacgcagaaccggauggcccgacacccgaguuggaagaagagauguucaaaaagagaaaccuaaccauaauggaccuucauccggggagcggcaaaacaagaaaauaccuacccgccaucgucagggaggccauaaagaggcgcuuacggaccuuaaucuuggcgcccacaagagucgucgccgcagaaauggaggaagcacugaaaggccugccuauacgauaccagaccaccgccaccaagagcgagcacacaggaagagaaaucgucgauuuaaugugccacgcgacauucaccaugcgauuauuaagccccguacgcgucccaaacuauaaccugaucauuauggacgaggcgcauuucacagacccggccaguauagcagcacggggauacauaagcacccgaguugggaugggugaagcggcagcaauuuucaugacggcgaccccaccgggcaccgccgacgcguucccccaaagcaaugcuccaauccaagacgaagaaagggacauaccagagcgcuccuggaacuccggaaacgaauggaucaccgauuuugcuggcaagacaguaugguucguaccgagcaucaaggcugggaacgacaucgcgaacugucuccgcaagaacgggaagaaagucauacaacuaagcaggaaaaccuuugacacugaguaucagaaaacaaaauuaaaugauugggacuucguugucacgacggacaucucugaaaugggugcgaacuucaaggcugaccggguaaucgacccccggcgaugcuugaaacccgucauacuuaccgacgggccagagcgagugauauuggcuggacccaugccagugacggcggcuucugccgcgcaacgcagaggccgugucggccgcaacccgcagaaagaaaacgaccaauauaucuucacagggcaaccacucaacaacgaugaagaccacgcgcacuggacggaagccaaaaugcugcuugacaacauaaacacgccggagggaauaauacccgccuuguucgaacccgaacgcgagaaaagugcagcaauagacggggaguacaggcugaaaggagagucccgaaagacguucgucgagcugaugcgcagaggcgaucuacccguguggcuggcacacaaaguggcuuccgaagggaucaaguacacagaccggaaauggugcuuugacggccagcgaaauaaucagauacuggaagaaaacauggacguggaaauauggacgaaggagggagagaagaagaaacuccgcccucgcuggcuagacgcacguacauauagcgacccacuagcccugaaggaguucaaggauuuugcggccggaagaaagaguauugcgcuggaccucgugaccgagauaggccgcguacccacacaccucgcccaccgaacccguaacgcccuggacaaucucguuauguuacacacuagcgaacaugguggcaaagcauacaggcacgccgucgaagaacucccggaaaccauggaaacccuacuacuauuaggauuaaugauucugcuaacaggaggagcuaugcuuuuccucauaucaggaaaaggcauugggaaaaccucuauuggucucauaugcgucauagccucgagcggaaugcucuggauggcggagaucccucuccaauggauugcaagugccaucguacucgaauuuuucaugaugguucuacucauaccagaaccggagaaacaacggacuccacaagacaaccaauuagcuuacguggucaucgguauacuaacccuagccgcaaccauugccgcaaacgaaauggguuugcuggagacuacaaagagagaucuggggaugagcaaagaacccggcguugugagcccgaccuccuaucucgacgucgaccuacacccagcaagcgcuuggacccucuacgcaguggcuacgacagucaucacuccaaugcuacgacacacgauagaaaacagcacagcgaauguaucacuagcggcuauagccaaccaagcugugguucucaugggguuagacaaaggguggcccauaagcaaaauggaccuaggugugccucuacuagcgcuuggaugcuacucacaagucaauccccucacguugacggcagcugugcugcuacugaucacacacuacgcaauaauaggcccagggcuacaggcaaaagccacccgagaagcucagaaacgcacggcugcaggcaucaugaaaaacccgacaguagacgguaucaugacgaucgaucucgacccggugauuuacgacaguaaauucgagaaacagcucggacaagucauguugcuaguacugugugcuguccaguugcuguuaaugcguacuuccugggcacuaugcgaagcccuaacgcuagcaacugggcccaucacaacgcuaugggaagguagcccggggaaguucuggaauacuacaauagccguaaguauggccaacauauuccgcggaagcuaucucgcgggagcuggccuagcauucuccauaaugaaaucaguaggaacagguaagcgcgggacaggcagucaaggcgagacacuuggcgaaaaguggaagaagaaacuaaaccaacucagccggcgggaauuugaucucuacaaaaaguccggcauuaccgagguggaccgaacagaagccaaagaggggcuaaaaaggggagaaaucacacaccaugcgguaucgcguggaagcgcgaaauuacaaugguuugucgagcgcaauauggucaucccagaaggucgcgucaucgaccucggauguggucgcggaggauggucguacuauugcgcaggccuaaagaaagucacugaaguccgaggcuacacaaaaggaggacccggccaugaagaacccgucccgauguccacauacggauggaauauaguaaaacuaaugagcggcaaggacguauucuaccuacccccagaaaaaugcgacacacuguugugcgacauuggagagagcagccccaguccgaccguagaggaguccagaaccauaaggguccucaaaaugguugaacccuggcuuaaaaauaaucaauuuugcaucaaagucuuaaauccauauaugccaacggucauagaacaccuagaacgacuccaacggaagcaugggggaauguuagucagaaauccccuuuccaggaacucgacccacgagauguacuggauaagcaacggaacaggcaauauaguagcaagugugaauauggucagucgccuauugcucaacagauuuacuaugacacacaggaggcccacaauagaaaaagacguagaccuaggagcgggaaccaggcacaucaacgccgaaccggaaaccccgaauauggacguuaucggcgagaggauuaaacguauuaaggaagaacacaacagcacauggcauuaugacgaggaaaacccauacaagacgugggcauaucacggcagcuacgaagugaaagcuacggggagugccucgucgaugaucaacggagucgucaagcugcuuaccaaaccgugggacgugguacccaugguaacacagauggccaugaccgacacuacgccauuugggcaacagcgaguauuuaaggagaagguggacacaaggacgccgcgaccuaugccgggaacgcggcggguaaugggaaucacagcggaguggcuauggcguacgcuagggcgcaacaagaaaccgcggcuguguacgagagaggaauuuacgaaaaaggucaggacgaacgccgccaugggagccguguucaccgaggaaaaucaaugggauagcgccaaggcggccguagaagacgaagacuuuuggaagcucgucgacagggagcgugaguuacacaaacuaggcaaaugcggaucaugugucuauaauaugaugggcaagcgggagaagaaacuaggagaguucggcaaggccaaggggaguagagcaauaugguacauguggcuaggcgcccgauaccuugaguucgaagcauuaggguuccucaaugaagaccacugguuuagccgggaaaauagcuauuccggggucgagggggagggacugcacaagcucggguacauacugcgcgacauaucuaaaaucccgggaggagcgauguacgccgacgacacagccgguugggacacacggaucaccgaggacgaccuccacaaugaggagaaaaucacccaacagauggacccagaacaccggcagcuagcaaaugcgauauucaaacuaacauaccaaaauaaaguggucaaagugcagagacccacuccgacagggacgguuauggacauaaucuccaggaaagaccaacggggcucagggcaagucggaacguacggccugaauacguucacaaacauggaagcacaacuaauccgacaaauggaaggugaagggguacugagcaaggccgacuuagagaacccccaucugcccgagaagaaaauaacgcaauggcucgagacgaagggggucgaacgacuuaaaaggauggcgauuagcggcgacgauugcgucguaaaaccuaucgacgauagauucgccaacgcccugcuagcgcuaaacgauaugggaaaaguacguaaagacauaccucaauggcagccgagcaagggguggcacgacuggcaacaaguuccauucuguagccaucacuuccaugaacucauaaugaaggaugggcgcaaacucgucguaccauguagaccacaagaugagcugaucggccgagcccggaucagccagggcgcaggcuggucauugcgcgagaccgccugcuuaggcaaggcauacgcccaaauguggagucucauguacuuccaccggagagaucuccgacuggcaucaaaugcaauaugcuccgccguaccaguacacugggucccaacaucaaggaccacuuggagcauccacgcucaccaccaauggaugaccacggaggacaugcucaccgucuggaaccgaguauggauagaggauaacccguggauggaagauaagacacccguuacuaccugggaaaaugucccauauuugggaaaacgggaagaucaauggugugguagccugauaggucuuacaagucgcgcgacgugggcccaaaacauuccgacggcgauacaacagguaagaucacuaauaggaaacgaggaauuucuggacuacaugccaagcaugaaacgcuuccggaaagaagaagaauccgagggagccauaugguga

SEQ ID NO: 26061 - RNA, 9873 nt, Artificial Sequence
  derived and/or modified CDS sequence (opt11) from DENV-3__FJ639799__SS-prME
accucacugugucucaugaugaucuuacccgcugcgcuggcguuccaucucacaucccgcgacggcgaaccccggaugaucguggggaaaaaugagcggggcaagagccugcuguucaaaaccgcuagcgggaucaacaugugcacccuaaucgccauggaucugggagaaaugugcgacgacaccgugaccuauaagugcccccacaucaccgagguggagcccgaggacauugauuguuggugcaacuugaccuccaccugggugaccuauggcacgugcaaccaggcaggcgagcaccgacgcgacaagcggagcgucgccuuagcgccccacguuggcauggggcuggacacgcggacucagaccuggaugagcgccgagggcgccuggcggcaggucgaaaaagucgagacgugggcacugaggcacccgggguucaccauccucgcgcuuuuccuggcccacuacauuggcaccucccucacccaaaagguggugaucuucauucuguuaaugcuagucacgcccagcaugaccaugcggugcguuggggugggcaaccgcgacuucgucgagggccugucgggcgcaaccuggguagacgugguccuggagcacggcgggugcgugacgacgauggccaaaaacaagccgacucuggacaucgagcuccagaagaccgaggcgacccagcuggcuacacuccggaaguuaugcaucgagggcaagaucaccaacguuacaaccgauagcagaugcccgacccaaggcgaggccguccugcccgaggagcaagaucagaacuaugugugcaaacacaccuauguggaccggggguggggcaacggguguggccucuucgggaaaggaucgcugguaacgugcgccaaguuccagugccuggaacccaucgagggcaaggugguccaguacgaaaaccucaaguacaccgucaucaucacagugcacaccggggaucagcaccaggucggcaaugagacgcagggggugaccgccgagauuacgccccaagcuagcacgaccgaggcgauccugccugaguacggcaccuuagggcucgagugcagcccgcgaacuggucuugacuucaacgagaugauccugcucacgaugaagaacaaggcauggaugguccaccggcagugguucuucgaccugccucugcccuggacuucaggcgccaccacggagacgcccaccuggaacagaaaggagcuccuggucaccuucaaaaaugcccacgccaagaagcaagagguggugguccuggggucgcaagagggcgcgaugcacaccgcccucacgggggccacggaaauccagaacucaggcgguaccagcaucuucgcuggccaccugaagugccgguugaaaauggacaagcucgagcugaaaggcaugagcuacgccauguguacaaauacguucguguugaagaaggagguguccgagacucagcacgggaccauccucaucaaagucgaguacaagggggaggauguaccgugcaagauucccuucagcacagaggauggacagggaaaggcgcacaacggccgccugauaacggccaacccaguggucacuaagaaggaggagcccgugaauaucgaggccgagccccccuucggggagucuaacaucgugaucggcauuggggacaaugcgcucaagaucaacugguauaagaaaggcucuagcaucggcaagauguucgaggcgacugcccguggggcucgccggauggcaauccucggcgacacagccugggacuucgggagugucggcggggugcucaacagccuggguaagauggugcaucagauauuugguucugcguacacggcucuauucagcggcgucuccugggugaugaagaucggcaucgggguuuuacugacuuggaucgggcugaacagcaagaacacauccaugagcuuuuccugcaucgccaucgguaucauuacccucuaucucggagcgguaguacaggccgauaugggcugcgugaucaacuggaagggcaaagagcugaagugugguagcggcaucuucgucacgaacgaagugcauaccuggacggagcaguacaaauuccaggcggacucccccaagcgccucgcaaccgccaucgccggcgcgugggagaauggggugugcggcauccgcagcacgacucggauggagaaucuccuguggaaacagaucgcgaacgagcucaacuacauccugugggagaacaauauaaagcugaccgucguagugggggauaucauuggcguccucgagcagggcaagcgcaccuuaacgccccagccgauggagcucaaguacuccuggaagaccuggggcaaggcaaagauagugacggccgagacccagaacagcuccuuuauaauagacggccccaacacuccugagugcccgucggcgucccgcgccuggaacgugugggagguggaggacuacggguucggcguauucacuaccaauaucuggcucaagcuccgugagguguauacccagcugugcgaccaccggcucaugagcgcugccguuaaggacgagcgugccgugcaugccgacaugggcuacuggaucgaaucgcagaagaacggcuccuggaagcuggagaaagcgagccugauagaagugaagaccugcacguggccgaagucccacacccuguggaguaacggcguccuggaguccgacaugauaaucccuaagagccuggcaggccccaucagucagcacaacuacaggccgggauaccauacccagaccgccggacccuggcaucuuggcaaguuagaacuggacuucaacuacugugaaggcacgacuguggugauuaccgagaacugcgggacccgcggacccucacuccggacgaccaccgucuccggcaagcugauccaugagugguguugccgcagcuguacccuacccccgcuccgcuacaugggcgaggacggguguugguacgggauggagauuagacccauaagcgaaaaggaggagaauauggucaaauccuugguguccgcuggcaguggggaggucgacaacuucacgaugggcguucugugcuuggccaucuuauucgaggaggugaugcggggaaaguucggaaaaaaacacaugauugcggggguuuuuuucaccuucgugcugcuccuguccggccagauuacauggcgcgacauggcccacacccugaucaugauaggcagcaacgccucugaccggaugggaaugggugugacguaccucgcacugaucgccaccuucaagauccagcccuuccuugcccucggguucuuucugcgcaaguugaccagccgggagaaccuccuguugggcguaggccuggcaauggcaaccacgcuacaacugcccgaggacaucgaacagauggccaacgggaucgcgcucggccugauggcucuaaagcuaaucacacaguucgagaccuaucagcuguggaccgcucugauaagccucaccugcuccaacaccaucuucaccuugaccguggccuggagaacggccacccugauucucgcgggcgucucacugcugccggugugccaauccagcaguaugcggaagaccgacuggcucccaaugaccguggccgccaugggcgugccgcccuugccgcuguucauauucagucucaaggacacccugaagcgccgcucguggccccugaacgaaggagugauggcugugggccucgucagcauacuggccucgagccugcucaggaacgaugugccuauggcggguccccuagucgcggggggacugcucauagccugcuacguuaucaccgggaccuccgccgaccugaccgucgaaaaggccgcggacgugacuugggaggaggaagcggagcagaccggcgucagccauaaccugaugauuacggucgacgacgacgggacaaugcgcauaaaggaugaugagaccgagaacauccucacagugcugcugaagacagcccugcugaucgucuccggcaucuuuccauacagcauccccgccaccuuauugguguggcacacauggcaaaagcagacgcagagaucgggaguccuaugggacguccccaguccccccgaaacccagaaggcggaacuggaggaggggguguaccgcauuaagcagcagggcaucuucgggaagacccagguaggcgucggcgugcaaaaagagggcguauuccacaccauguggcaugucacacgcggcgcggugcucaccuauaauggaaagcgucuagagcccaacugggccucagugaagaaggauuugaucagcuacggcggcggcuggcgccucucggcccaguggcaaaagggugaggagguccaggugaucgcaguggagcccgggaagaaccccaaaaacuuccaaaccaugcccggaacguuucaaacgaccaccggagagaucggugcuaucgcucuggacuucaaacccgggaccucuggcagccccaucaucaaccgcgagggcaaggucgugggccuguacggcaacgggguagucacgaagaacggaggguacguuuccggcauugcacagaccaacgccgagccggacggacccacccccgaguuagaagaggaaauguucaaaaagcggaaccucacuauuauggaccugcauccggggagcggcaagacacgcaaauacuuaccggccauuguucgagaggcgaucaagagacggcugcgcaccuugauacuggcacccaccagaguaguggcugcggagauggaggaggcccugaaggggcugccaauacgcuaccaaacaacggcgaccaagucugagcacacaggccgggaaauuguugaccugaugugccaugccaccuucacaaugcgcuuacucagccccguccgggugccgaacuacaauuugauuauuauggacgaggcgcacuucacugaucccgcgucaaucgccgcgcgcggguacauuagcacccgugugggcaugggcgaagccgcagcgaucuucaugaccgcgacgccgcccggcaccgccgacgcauucccgcagagcaacgccccaauccaggacgaagagcgcgauauccccgagcguagcuggaacuccgggaacgaauggaucaccgauuucgccgggaaaaccguaugguucguacccagcauuaaagcugguaacgacaucgccaacugccuccggaaaaaugggaagaaagucauacaacuaucccggaagacguuugacaccgaauaccagaaaaccaagcugaaugacugggacuuugucgugacuacagacaucucagaaaugggcgccaacuucaaggccgaccgagugaucgacccgcgacggugucugaaacccgugauccugaccgacggccccgagcgaguuauacuggccgggccaaugccggucaccgcggcauccgccgcccagcgccgcggucgggucgggcgcaauccgcaaaaggaaaaugaucaguacauuuucaccggccagccacugaacaacgacgaggaccacgcccacuggaccgaggcgaagaugcugcucgauaacaucaauacgcccgagggaauaaucccagcgcucuucgagcccgaaagagagaagucagccgccaucgacggcgaguaucggcugaagggugaaucgcggaagaccuuuguagagcugaugcgccgcggggaccugcccguauggcuagcgcauaagguggccagcgagggaaucaaguacacagaucgcaaguggugcuuugacgggcagcguaauaaucaaauccuggaagagaacauggacguggagaucuggacgaaggagggcgaaaaaaagaagcuccgcccccgauggcuugacgccaggaccuacuccgaccccuuggcacugaaggaguucaaggauuucgcggcggggcggaaaagcaucgcccuggaucuggucacggagaucggucgggugccaacucaccucgcccaccgcacucggaacgcuuuagacaaucuggugaugcuccacacguccgaacacggcgggaaggccuaccgccaugcgguagaggagcuccccgagacaauggagacgcugcuccugcugggucuaaugauccuucugacugggggugcuaugcuauuccugaucucuggaaaagggaucggcaagaccagcauuggacucauaugugugaucgccucaucaggcaugcuauggauggcagagauuccacugcaguggaucgccuccgcaaucguccuggaguuuuucaugaugguccuccugauacccgaaccagaaaagcagcgaacgccccaggacaaucagcucgcauauguggugaucgggauccucacgcuggccgcuauaauagccgcgaacgagaugggccugcucgagaccacuaagcgcgacuugggcaugagccgggaaccggggguuguguccccaacuagcuaccuggacguggacuuacaccccgcaucggccuggacgcuguacgccgucgccaccacugucaucacgcccaugcugcggcacaccaucgagaauucuacagccaacgugucccucgcugcaaucgcaaaccaggcgguugugcugaugggacuggacaagggguggccaaucagcaaaauggaccucggugugcccuugcuggcccucggaugcuacucgcaggucaaccccuugacucugaccgccgccgugcucuuacugaucacccacuacgccaucaucgggcccggccuacaggcgaaggccaccagggaggcccaaaagcggacggccgcggggaucaugaaaaacccgaccguggacggcauuaugaccauagaccuggaucccgucaucuacgacagcaaguuugagaagcaguugggccaggugaugcuccuggugcugugugcgguccagcugcugcuuaugcggaccaguugggcccuuugcgaagcccugaccuuggccaccgggcccaucacaacccuuugggaggggagccccgggaaguucuggaacacuaccauagcuguguccauggcuaacauuuuucgaggaucuuaccuggccggagccgggcuggccuucuccaucaugaaauccguagggaccggcaagcggggcaccggcagccagggcgagacccucggggagaaguggaagaagaaguuaaaccaauuaagccgcaaggaauucgaccuguauaagaaaucaggcaucacggaggucgacaggacagaggcgaaggaggguuuaaaacgaggcgagauaacccaucacgccgugucccggggaagcgccaagcuucaaugguuuguggagcggaacauggucaucccggaagggcgggugaucgacuuaggaugugggagaggcgggugguccuauuauugcgcuggccugaagaaggugaccgaaguccggggcuacacuaagggcgggcccgggcacgaggagccugugccaaugagcaccuacggcuggaacauugucaagcugauguccgguaaggacguguucuaccucccucccgaaaagugugacacauuacugugugacaucggcgagucgucaccaagccccacuguggaagagucccgcacgauccgugugcugaagaugguggagccguggcugaagaacaaucaguucugcaucaaagugcugaaccccuacaugcccgccgugauagagcaccuggaacggcuccagcgcaagcacggcgggaugcuggugcggaacccgcugucccgcaauuccacccacgagauguacuggauuagcaacggcaccgggaauaucguggcuuccgugaauauggucagccggcuccugcugaaccgcuucaccaugacucaccggcgacccaccaucgagaaggacguggaccucggggcuggcacccggcacgugaacgcugaacccgagacccccaacauggacgucaucggggagagaaucaagcgcaucaaggaggaacacaacuccacuuggcacuacgacgacgagaacccguacaagaccugggccuaccauggcucguacgaggugaaggccacaggcagcgcgagcuccaugaucaacggcgucguaaagcuguugaccaagcccugggacguaguucccauggugacucagauggccaugaccgacacaacgcccuucggccagcagcgcgucuuuaaagagaaggucgacacaagaaccccccggagcaugcccggcaccaggcgagugaugggaaucaccgcggaguggcucuggagaacgcucggacgcaauaagaaaccccggcugugcacacgcgaggaguuuacuaagaagguccgcacuaacgcggcgaugggcgccgucuuuacagaagagaaccagugggacagcgccaaggcagcgguggaggacgaggauuucuggaagcuuguggaccgggaacgcgagcugcauaagcucggcaaguguggcuccuguguguacaacaugauggggaagcgggagaaaaagcugggcgaguucggcaaggcuaaggggucgcgcgcgauuugguacauguggcugggcgcccgguaccuggaguuugaggcccuugguuuucuaaacgaggaucacugguucuccagagagaacagcuacuccgggguagagggggagggccugcacaagcugggauacauccugcgcgacauuagcaagaucccgggaggcgccauguacgcggaugacaccgcugggugggacacccgcaucaccgaagaugaccugcacaacgaggagaagaucacgcagcagauggacccugagcaccgacagcucgcuaacgcgaucuuuaagcugacauaccagaacaaaguggucaaggugcagcgcccuacucccaccggcaccguaauggacaucauaucucggaaggaccagcgcggaucugggcagguaggcacguaugggcugaacaccuucaccaacauggaagcccaacucaucagacagauggaaggagaaggggugcugucuaaagcggaccucgagaacccccaucugccggagaaaaagaucacccaauggcuggagacuaaaggcguggagagacugaaacggauggccaucagcggcgacgacugcguaguuaagccaaucgacgacagauucgccaacgcgcuacuggccuuaaacgauaugggaaaagugaggaaggauaucccacaguggcagcccagcaagggcuggcaugacuggcagcaggucccguucugcagccaccacuuccacgaacucauaaugaaggacggacgcaaacuggugguucccugcaggccacaggacgaacugaucggccgcgcccggaucucacagggggccggauggagucucagggagaccgcgugccuagggaaggccuacgcgcagauguggucgcugauguacuuccacagacgagaucuccgccuggccagcaacgcgauauguuccgcggucccgguucacugggugccuaccaguaggacuacaugguccauacacgcucaccaucaauggaugaccaccgaagauaugcuuacagucuggaacaggguauggaucgaggauaaucccuggauggaggacaagacgccggucaccacuugggagaacguccccuaccuagggaaacgggaggaccaguggugcggcucccugauaggguugaccagccgcgcgacuugggcccagaacaucccgaccgccauacagcaggugcggucccucaucggcaaugaggaguuccuggacuacaugccuagcaugaaacgcuuccggaaagaggaggagucugaaggugcuaucugguga

SEQ ID NO: 26062 - RNA, 9873 nt, Artificial Sequence
  derived and/or modified CDS sequence (opt11) from DENV-3__FJ639800__SS-prME
accagcuugugccugaugaugauccugcccgcagcgcuggcguuccaccucaccaguagggacggcgagccucggaugaucguggggaagaacgagcgcggcaagagccugcuguucaagacugcaucgggaaucaacaugugcacccucaucgccauggauuugggcgagaugugugaugacacuguaacauacaaaugcccccacaucaccgaaguggaaccugaagacaucgacugcugguguaacuugaccagcaccuggguaacguacgggacgugcaaccaggccggagagcaucggagggacaagcguagcgucgcccucgcaccgcacgugggcaugggucuggacacccgcacucaaacauggaugucagccgaaggcgcauggaggcagguugaaaaggucgagaccugggcccuucgacacccgggguucaccauccuagcgcuguuccuggcccauuacaucgggaccucgcucacucaaaaagugguuauuuucauccugcugaugcucgucacgcccucuaugaccaugcggugugucggcguuggcaaccgagacuuuguugagggcuugagcggggccaccuggguggacgugguguuagagcauggcgggugcgugaccacgauggccaagaacaagcccacacucgacaucgagcugcagaagaccgaggccacccagcuggcgacgcuccgcaagcuguguaucgagggcaaaaucaccaauauuaccacggacagccgcugccccacccaaggcgaggccgugcugccggaggagcaggaccaaaauuacgucugcaagcacaccuauguggaccggggcuggggcaacgggugcggacuuuucgggaagggcucccugguaaccugugcgaaauuccagugccuggaacccaucgaggguaagguggugcaguacgagaaucuaaaguacacggugaucaucacgguccauaccggagaccagcaccaggugggaaacgagacccagggggugacugccgaaaucacaccccaggccaguacaacggaggccauccuuccagaguauggaacccuggggcucgagugcagcccgcgcaccggccuggacuucaacgagaugaucuuacucacgaugaagaacaaggccuggauggugcacaggcagugguucuucgacuuaccucugcccuggaccuccggugccacuaccgagacgccuacauggaaccgcaaggaguugcuaguaaccuucaagaacgcccacgccaagaagcaagaagucguagugcugggaucccaggagggcgccaugcacaccgcccucacuggggcaaccgaaguacagaacucaggcgguacuaguaucuuugccgggcaucuaaagugccgguuaaagauggacaaacucgagcucaagggcaugaguuaugccaugugcaccaauacguucguucuuaaaaaggaggugagcgagacccaacacgggaccauccucaucaagguggaguacaagggggaggaugugccgugcaagaucccauuuuccacagaggacgggcagggcaaggcgcacaacggccgccugaucacagccaaucccguggucaccaaaaaggaggagcccguuaacauugaagcagagccgccuuucggggagucgaauaucgugaucggcaucggugacaaugcacugcggaucaacugguacaagaaaggcuccagcaucgggaagauguucgaagcgacagcccgcggagcccggcgcauggccauccugggcgacacggccugggacuucgggucugucggcgguguacucaacagccucggcaagauggugcaucaaauuuucgggucugcguauacggcccuuuucucuggcguauccugggugaugaagauuggcauuggggugcugcuaacguggaucggcuuaaacagcaagaacacgucgaugagcuucuccugcauugcgauugggaucaucacacuuuaucugggagccgucgugcaggcggauauggggugcgucauuaacuggaagggcaaagaguuaaaauguggaagcgggaucuucgucaccaaugaggugcacaccuggacugagcaguacaaguuucaggcugacucucccaagagauuagccaccgccaucgcaggagccugggagaacggggugugcggcauccggagcaccaccagaauggagaaccugcucuggaagcaaaucgcuaacgagcucaauuacauacugugggagaacaauaucaaguuaaccgucguugugggagacaccauugggguacuagagcagggaaagcggacguuaacgccucagccgauggagcuaaaauacuccuggaagacaugggggaaggcgaagauugugacggcugagacgcagaacaguuccuucaucaucgacggucccaacacacccgagugccccagcgccagucgagcguggaaugugugggaggucgaggacuauggcuucggcguguucacgacuaacaucuggcucaagcuucgggaaguguacacucaguuaugcgaccaucgcuuaaugagcgcggccgucaaggacgagagggccguucacgccgacaugggauacuggauagagagccagaagaacgguucguggaaguuggagaaggcuagccuaaucgaaguaaaaaccugcaccuggccgaaaucacacaccuuauggucuaacggaguccuggaaucggacaugaucauccccaagagccuggccggccccaucucccagcauaauuaccguccgggcuaccacacucagacggcaggacccuggcaccucggcaagcucgaauuggacuucaacuacugugagggcacuaccguagucaucacugagaacugcgggacucggggcccgagccugcguaccaccacuguuuccgggaaacuaauccacgaauggugcugccggagcugcaccuuaccuccccugagauacaugggggaagauggcugcugguacggcauggagaucaggcccauuuccgaaaaggaggaaaacaugguaaagucgcuuguguccgccggcagcggggaaguugacaacuuuaccaugggcguccugugccucgcuauccuguucgaggaggugaugcgcggaaaguucgggaagaagcacaugaucgccggggucuucuucacguucguacuacuccugucuggccaaaucacuuggcgggacauggcccacacgcugaucaugaucggcucaaacgcaucggaccgcaugggcaugggcgugaccuaccuagcgcugauugccacauucaagauacaacccuuuuuagcguuaggguucuuccugcggaagcugacuagccgcgagaaccuccuccugggaguggggcuggcgauggccaccacccugcagcugcccgaggauaucgagcagauggcaaacggcaucgcgcucggccugauggcccuaaaacugaucacacaguuugagacauaccagcuguggacggcccugaucagccugaccugcuccaacaccaucuuuacccuaacgguggccuggagaaccgcgacacugauccuagcgggggucucguuacuaccugugugccaguccagcaguaugcgaaagacugacuggcuccccaugacggucgcugcuaugggcguuccuccgcucccgcuguucauauucaaccuuaaagacacgcugaagcgcagaaguuggccacugaacgaaggggugauggcagugggccucgucagcauccuggccagcucccugcuccgcaaugacgugccgauggcgggcccacugguggcgggcggccuguuaaucgcuugcuacgucauuacugggaccagcgccgaccugaccguggagaaggccgcggacgugacaugggaggaggaggccgagcagacuggggucucccacaaccugaugaucaccguagacgacgacgggacgaugcggaucaaggacgacgaaacggaaaauauccucaccguucugcugaaaacagcuuugcugaucgucagcggcaucuucccguacagcauucccgcgacgcuuuuaguauggcacacauggcaaaagcagacacagcggagcggggugcuaugggaugucccuucgccgccugagacucagaaggccgaacuugaagaagggguguaccggaucaaacagcagggcaucuucggaaagacccagguuggcguugggguucagaaagagggcguguuccacacgauguggcacgugacccgcggcgcagugcucaccuauaacgggaagcggcuugagcccaacugggcgagcgugaagaaagaccucauuuccuacggcggggguuggaggcucucagcccaguggcagaaaggagaagagguccaggucaucgccguggagccagggaagaacccuaagaacuuccagaccaugccggguacguuccagaccacgaccggggaaaucggcgcgaucgcccuggauuucaagcccgggacuucggggaguccuaucaucaaccgggagggcaaggucguggggcuguacggcaacggcgucgucaccaaaaacggcggauacgugucuggaaucgcccagaccaacgccgagccagacggccccaccccagagcucgaggaagagauguuuaagaagcggaacuuaacuaucauggaccugcaccccgguaguggcaagacccggaaauaccuuccggccauugugagggaggcgauuaaacgacgccuccggacccuaauacuggcacccacccgcgucguugccgccgagauggaggaagcccuaaaaggccuacccauccgauaccagacgaccgcgaccaagagcgagcauaccgguagggagauaguggaccugaugugccacgcgacguucaccaugcggcuucugucccccguccgcgugccgaacuacaaucugauaaucauggaugaggcccacuucaccgaucccgccaguauagcagcgcggggguacaucagcacacgcgugggcaugggcgaggccgccgccaucuucaugacggcgacuccacccgggaccgccgacgccuucccgcagagcaacgcuccuauccaggacgaggagcgugacauccccgagagguccuggaacucaggcaacgaguggaucacggacuuugccgggaagacggucugguucgugcccucaauaaaagcgggcaacgacauagccaauugccuccggaagaacgggaaaaaagucauccagcugucgcggaaaaccuuugacacugaguaccagaaaacgaaacugaacgauugggauuuugucgugacgacugacaucuccgagaugggggccaacuuuaaggccgaccgcgugauagacccgcggcggugccugaagccugucauucugacagacggccccgagcgggugaucuuagccgguccaaugccugugacugcugccucugcagcccagcgccgggggcgcgucgggaggaacccacaaaaagagaaugaccaguacaucuucaccggacagccccucaacaaugaugaagaccacgcccacuggacggaggccaagaugcugcuggacaauaucaacacuccagaggggaucaucccggcgcuguucgagcccgagcgcgagaaguccgcugccaucgacggcgaguaccggcugaagggcgagagccgcaagacuuucguggagcugaugcggcgcggggaccuccccgucuggcuggcgcacaaaguggcguccgaggguauuaaguacaccgaccggaaauggugcuuugacggucagcgcaacaaucagauacuggaggagaacauggacguggagaucuggacaaaggagggagagaagaagaagcuccggccccgcuggcuggacgcccgcacauacagcgacccgcuagcccugaaggaauucaaagauuucgccgcggggcguaagucaaucgccuuagaccugguaaccgaaaucggucgcgugccuacucaccuagcccacaggacuagaaacgcccucgacaacuugguuauguuacacaccagcgaacacggugggaaggcuuaucggcacgcggucgaggaacugcccgaaaccauggagacucuccuccugcuggggcucaugauuuuacugaccggcggggcaaugcuauuccugauauccggcaaggggauaggcaaaacuagcaucggguuaauauguguuaucgccucuucuggcaugcucuggauggccgagaucccgcugcaauggaucgcaucagcuaucguguuagaguucuucaugaugguccuccuaauccccgagccagagaaacagcggacgccccaggacaaucaguuagcguacguuguaaucggcaucuugacccuagccgcuaucauugccgcgaacgagaugggccuccucgagacgaccaaacgggaccugggcaugaguaaagagccaggggucgugagccccaccucauaucuggauguugaccuccacccggcgucagcuuggaccuuauaugcgguugcgacgaccgucaucacccccaugcugcgccauacgauagaaaacucuacggccaacgugucguuagccgcuaucgcuaaccaagcugugguacugauggggcuggacaagggguggccgaucaguaaaauggaccucggcgugccccugcuggcucucggcugcuacagccaggucaauccgcuaacccuuaccgccgcugugcuccugcugauaacgcacuacgcgauuaucggacccggauuacaggcgaaggcgacacgcgaggcacagaagcgcaccgccgcugguaucaugaagaacccaacaguggacgggaucaugaccaucgaccuugaccccguaaucuaugacucaaaguucgagaagcaacuuggccaggugaugcuccugguguugugcgcgguccaguuacuguugaugcggacaagcugggcacucugcgaagcccuuacccuggccaccgggccgauaacgacgcucugggagggcucccccggaaaauucuggaacaccacgaucgcugucaguauggccaauaucuuucgcgguuccuaccuggcgggugccggccucgcauucagcauaaugaaguccguggggacgggcaagagaggcaccgggagccagggcgaaaccuuaggggagaaguggaagaagaaguugaaccagcugucccgcaaggaguucgaccucuacaagaaguccgggauaacugagguagauagaacugaggcuaaagaggggcugaagcgcggcgagaucacgcaucacgcagugagccggggcucugcaaaacuucagugguucguggagcgcaacaugguuaucccggaaggaagaguaauugaccuaggcugcgggcgaggcggguggagcuacuacugugccggccuaaagaaagugacggaaguccgcggcuacacgaagggcggaccggggcacgaagaaccggugccaauguccaccuacggcuggaacauaguuaaacugauguccgggaaagacguguucuaccucccgcccgagaagugugacacgcugcuuugcgacaucggcgaauccucucccucccccacgguggaggaaucccgcacgauucgcgugcugaaaauggucgagccguggcucaaaaacaaccaguucugcauuaagguguugaacccuuacaugccgaccgucauagagcaccuagagcgacuccagcgcaaacacggcgggaugcugguccggaauccucucucgcgcaacucuacacacgagauguacuggaucuccaacggcagcggaaauaucguagccuccgugaacauggucagccgccucuuacuuaaccgcuucacgaugacccaccgucgcccgaccaucgagaaggacguggaucugggcgcgggcacccggcacgucaacgcagagcccgagacgcccaacauggacgucaucggggagcgcaucaagcggaucaaggaggagcacaauagcacuuggcacuacgacgacgagaacccguauaagaccugggcuuaccacggaucauaugaggugaaggcgacggguagugcuucaucuaugauaaacggcgucguaaagcuguugacaaagccgugggauguugucccgauggugacucagauggcgaugaccgauaccacgccuuucgggcagcagagaguauucaaggagaaagucgauacccgcaccccgaggagcaugcccggcacccgucgcgugauggggaucaccgccgaguggcuguggcggacacuugggcguaacaagaagccucggcugugcacacgggaggaguuuaccaagaaaguucgcacuaacgcagcgaugggcgcgguauuuacagaggaaaaucaaugggacagugccaaggccgcaguugaggacgaggauuuuuggaagcucguggaucgggagcgcgaacugcauaagcucgggaagugcggaucgugcgucuacaacaugauggggaagcgggaaaagaagcucggcgaauucggcaaggccaaggggucucgcgccaucugguauauguggcuaggcgcccgguaucuggaguucgaggcauuaggcuuccugaaugaagaccauugguucucccgggaaaacagcuacagcgggguggagggggagggccugcacaagcuuggauauauuuuacgcgacaucagcaagauucccggcggcgccauguaugccgacgauacagcggggugggacacccgcaucacggaggacgaccugcacaacgaggagaagauuacacagcagauggacccggaacacagacagcuggcuaacgccauuuuuaaacugacuuaccagaacaagguagucaaggugcaacgccccacccccaccggcacggugauggacauuaucucccguaaggaccaacgcgguucaggacaggucgggacuuacggucugaacaccuucaccaacauggaggcccaguugauccggcagauggaaggggagggagugcugucaaaggccgaccuggagaacccccaucuaccggagaagaagauaacacaaugguuggagacaaagggcguggaacgccugaaaagaauggccaucucuggcgacgacugcgugguuaagcccaucgacgaucgcuucgcaaacgccuuacuggcccuuaacgacauggggaagguucggaaagacaucccccaguggcaacccuccaaggguuggcacgacuggcagcaggucccguucuguagccaucacuuccacgagcucaucaugaaggaugggcgcaagcuggugguaccgugccgcccgcaggaugagcugaucggccgcgcccguaucucccagggggcgggauggagccugcgcgagacugcuugucugggcaaggccuaugcccagauguggucccugauguacuuucaccgccgggaccuccgacuagccagcaacgccaucugcuccgccguccccgugcauugggugccgaccagccggacgaccugguccauccacgcucaccaccaauggaugaccaccgaggacaugcugacggucuggaaccgcguuuggaucgaggacaaccccuggauggaggacaagacccccguuaccaccugggagaacguucccuaucucgggaagcgggaggaucaauggugcggcagucugaucgggcugacgagccgcgcaacaugggcccaaaacaucccgaccgcaauccagcaggugcggucccugaucggcaacgaagaguuccucgacuacaugccguccaugaagcgcuuucggaaagaggaggaaagugagggggccauaugguag

SEQ ID NO: 26063 - RNA, 9873 nt, Artificial Sequence
  derived and/or modified CDS sequence (opt11) from DENV-3__FJ639801__SS-prME
accagucuuuguuugaugaugauccuuccugcugcccuggcauuucaccuuaccagccgggacggcgaaccaaggaugaucguggggaagaaugaacggggcaagagccugcuguucaagaccgcgucggggauuaauaugugcacgcucauagccauggaccugggcgagaugugcgacgacaccgugaccuauaagugcccucacauuacagaggucgagcccgaggacaucgacuguuggugcaaccugaccagcaccugggucacguaugguacgugcaaccaagcgggcgagcaccggagggacaaacgguccgucgcgcuugcgccccacgugggcaugggccuggacaccagaacccagaccuggaugagcgcggagggagccuggcgucagguggagaaaguagagacuugggccuuacgccacccgggguuuaccauccucgcccuguuccuggcgcacuacaucggcacgucccucacccaaaagguggucauauuuauucuucucaugcucgucacgcccagcaugaccaugcgcugcguaggggugggaaaucgcgacuuugucgagggccuauccggggcaacuuggguggacgugguucuggaacauggcgggugcgucaccaccauggcgaagaacaagccuacucuggacauagaguuacagaaaacugaggcaacgcagcuugcgacgcuacguaaacuuugcauagaggggaagauaaccaacauaacgaccgacucgcgcugccccacgcagggugaggcagugcugcccgaagagcaggaccagaauuacgucugcaagcacaccuauguggaccggggauggggaaaugggugcgggcucuucgggaagggcagucugguaaccugcgccaaguuccagugcuuggagcccaucgagggaaaagucgugcaguacgagaaccucaaguacacuguuaucaucaccgugcacacaggcgaccagcaccaggugggaaacgagacacagggggucaccgcugagauaacgccccaggcaagcaccaccgaggcgauuuugcccgaguacggcacccugggguuggaaugcucgccucgaaccggcuuagacuucaacgagaugauccuguuaacgaugaagaauaaggccuggauggugcacagacagugguucuucgacuuaccccuacccuggacgagcggcgcuaccaccgaaacgccuacguggaaucgcaaggagcuccuggugaccuucaagaacgcacacgccaagaaacaggaggucgucguguuagggucgcaggagggcgcuaugcacacagccuugacgggggccacggagauccaaaacuccggggggacuuccaucuucgcaggccaccugaaaugccguuuaaaaauggacaaauuagaguuaaagggcaugagcuaugccaugugcacaaacacguucguccugaagaaggaggucuccgaaacccaacaugggacgauccucaucaagguagaguacaaaggagaggacgucccaugcaagaucccuuucagcaccgaagacgggcaaggaaaggcucacaauggacgccuuauuacggcuaacccagucgugaccaagaaggaggagcccguuaauaucgaggcagaaccgcccuuuggcgagucuaauauugugaucggcauuggugacaacgcacugaaaaucaacugguacaagaaggguuccucgauugggaagauguucgaggcgaccgcccggggcgcccgccggauggcaauccugggagacaccgcuugggacuucggguccguaggggguguccucaacucguuaggcaagaugguccaccagaucuucgggucggcguacacagcccuguucagcggcgugucuugggugaugaaaaucggcaucgggguguugcucaccuggaucggcuugaacagcaagaauacguccaugagcuucuccuguauagccauagggaucaucacccuguaccucggagcaguggugcaggccgacaugggcugcguaaucaauuggaagggcaaggaauuaaagugcggcagcgggauauucgugacgaaugagguccacaccuggaccgagcaguacaaguuucaagcggacuccccaaagcgccucgcaacagcuaucgccggggcgugggagaauggggucugcggcauccgcucuacgacucggauggaaaaccugcuguggaagcaaaucgcuaacgaauuaaauuacauucucugggaaaacaauauuaagcugacagucgucgugggcgacaccaucggcgugcucgagcagggcaagagaacacuaacgccgcagccgauggagcuuaaguacucguggaagaccugggggaaggcuaagauuguaaccgccgagacgcagaacucuuccuucauaaucgacggccccaauacccccgagugccccagcgccucccgagcauggaauguaugggaaguggaagacuacggguucggagucuucaccaccaauaucuggcucaaguugcgcgaaguguacacacaguuaugcgaucaccggcugaugagcgcagccguaaaggacgagcgcgccguccaugcggauaugggcuacuggaucgagagucagaaaaacggguccuggaagcuggagaaggcgagccugaucgagguuaagacguguacuuggcccaagagccauacccucuggaguaacggagugcuggaguccgacaugauuauccccaaaagccuggccggucccaucucccagcacaauuaucgcccgggcuaucacacgcagacagccgggccauggcaccuuggcaaacuugaguuggacuuuaacuacugcgagggcaccaccgucgugauuaccgagaauugcggaacgcgcggaccuucccuacguacuaccacugucucagggaaacugauucacgaguggugcugccguaguuguacgcugccuccgcucagauacaugggagaagacggaugcugguacggcauggaaauccgucccaucuccgaaaaggaggaaaauauggucaaaagucuggucuccgccggcuccggggagguggacaacuucacaauggggguccucugcuuggccauccuguuugaagaggugaugcgcggcaaguucgggaagaagcauaugauagcgggugucuucuucaccuucguacugcuccuuucggggcagaucaccuggcgggacauggcccacacgcugauuaugaucggcagcaaugccuccgaccggauggggaugggcgugacguaccucgcacugaucgccaccuucaagauccagcccuuucuggcucucggcuucuuucugcgcaagcuuaccagucgugagaaccuccuuuuaggcgugggccuagcuauggcgacgacccugcagcugcccgaggacaucgagcagauggcuaacgggauugcgcuaggccuaauggcauugaaacucaucacucaguucgagacguaccagcuguggacggcacugaucagucugacuugcaguaacaccauuuucacucugacgguagccuggcgcaccgccacccuaaucuuggcgggggugucacuucugccgguaugucaguccagcuccaugcguaaaaccgacuggcuccccaugacgguggccgcuaugggcgugcccccccucccccuguucaucuucagcuugaaagacacccuuaaacgcaggaguuggccgcuaaacgaggggguaauggcgguaggccucguuucaauccuggcauccagccugcuccguaaugauguccccauggcgggcccccugguagccggaggccugcucaucgccugcuacgugaucacugggaccucagccgauuuaacuguagagaaggccgccgacguaaccugggaggaggaggccgagcagacgggugugagucacaaccugaugaucaccgucgacgaugacgggacaaugcgaaucaaggaugacgagacugagaacauccucacggucuugcugaagacagcccuccugaucgugaguggcaucuucccguacagcauccccgcaacgcugcucgucuggcacacauggcaaaagcagacccaacgguccggcguucugugggacguuccgagcccgcccgagacccagaaggcagaguuagaggaggguguguauaggaucaagcaacagggaauuuucgggaaaacucagguaggagucgguguccaaaaggagggcguguuccacacuauguggcacguuacccggggcgcgguacugaccugcaaugggaaacgccuagagccaaacugggcauccguaaagaaagaccugaucuccuauggggggggcuggaggcucuccgcccaguggcagaagggggaagaggugcaggugauagccgucgaacccggcaagaaucccaagaacuuccagaccaugcccggcacguuccagaccacuacgggugagauuggagcgauugcccuagacuucaagcccgggacgagcggcucaccaaucaucaaccgcgaaggcaagguggucgggcuauacggcaacgggguggugacaaagaacggcgguuacgucucuggcaucgcccagaccaacgcggagcccgaugguccaacaccagaguuggaggaggagauguucaagaagcggaaccucacuaucauggaccugcacccagguucugggaagacgagaaaguaccuuccagcgauaguucgggaggcgauuaagagacggcuacguacccugauccuggcccccacccguguuguugccgcagagauggaagaagcacucaaagggcugccuaucagauaccagacgacggcgacgaaauccgagcacaccggccgggagauaguggaccugaugugccacgcaacuuucacgaugcgccuccugucccccguucgagucccgaacuacaaccugaucaucauggaugaggcacacuucaccgacccggccuccauugcagcucgcggauauaucagcacacgaguuggcaugggggaggcagccgccaucuuuaugacggcgacgccccccggcacagcugacgccuucccucaauccaacgccccuauucaagacgaggagcgcgacauccccgagcgcucuuggaacagcggcaaugaguggaucaccgauuucgcuggcaagacgguuugguuuguccccuccauaaaggcgggcaacgacaucgcuaacugccugcggaaaaaugggaagaagguaauacagcugucccgaaagaccuucgauacagaguaccagaagaccaaguuaaacgauugggacuuugugguaacgaccgacaucucagaaaugggugcaaauuucaaggccgaccgugugauagacccccgccgaugccugaagcccguuauccuuacagacggccccgagcgcgucauucuggcgggacccaugcccgugaccgcagcuuccgccgcccagagacgcggccgcguugggcgcaacccccaaaaggagaacgaccaguacaucuuuacuggucaaccccucaacaacgacgaggaccacgcacacuggaccgaggcgaaaaugcugcuggacaacaucaacacucccgagggaaucaucccagcucuguuugagcccgagcgggagaagucagccgcaaucgacggcgaguacaggcugaagggcgaguccaggaagaccuucguugagcugaugcgccgcggcgaccugcccguguggcuggcucauaagguagcaagcgagggcaucaaauacaccgaccgcaaauggugcuucgacgggcaacggaacaaucagauccuggaagaaaacauggacgucgagaucuggacaaaagaaggagagaagaagaagcugcguccccgcugguuagacgcacgcaccuacuccgacccccucgcucucaaggaguucaaggauuuugcagcuggccgcaagagcaucgcauuagaccugguaacagagaucgggagaguccccacucaccucgcccaccgcacgcggaaugcccucgacaaccuggugaugcuccacaccagugagcaugguggaaaggccuaccgccacgcaguagaggaacugcccgagaccauggagacccuauuacugcuggggcucaugauucuguuaacgggcggggccaugcuguuccugauuagcggcaaaggaauaggcaagaccaguauagggcuaaucugcgucauugccuccagcggcauguuguggauggccgagauaccacuucaguggaucgccuccgcgaucguacucgaauucuucaugaugguacuccuaauccccgagcccgaaaagcagcggacgccgcaggacaaccaguuagccuacgucgucauagggauccucaccuuagcagccacgaucgccgcaaaugaaaugggccuucucgagacgacaaagcgcgaucuaggcaugagcaaagagcccgggguggucucgccuaccagcuaccuggauguugaccuacauccggcauccgccuggacguuguacgccguggcgaccacugucaucacgcccaugcugcgacacacgaucgagaacagcacggccaacguguccuuggcggccaucgccaaccaggcagugguacugaugggucuggauaaggguuggccuauaucgaagauggaucucggcgugccacugcuggcacucggguguuacucccaggugaacccgcugacgcuuacagcagcaguguugcugcuaauuacucacuacgccaucaucggccccggccuccaggcaaaggcaacccgugaagcccagaagcgcacagccgcugguaucaugaagaacccgaccguugacggcauaaugacgaucgaucuagauccagugauuuacgacagcaaguuugagaagcaacuagggcaagugaugcuacuuguucucugcgcugugcaauugcugcugaugcgcaccucaugggcccuaugugaagccuuaacucuggccacuggccccauuacaaccuuaugggagggcagccccggcaaguucuggaauaccaccaucgcggucuccauggccaauaucuuccggggcuccuaccuggccggagcagggcuggcguucuccaucaugaaguccguggggacagguaagcgcgguaccggaucccagggagagacuuuaggcgagaaguggaagaagcggcugaaccagcugagccgcaaggaguucgauuuauacaagaagucagggaucaccgagguggacagaacagaggcgaaagagggacugaagcgcggcgagauuacccaucaugccgugucuagaggcagugcuaagcugcagugguucguagagcgaaacaugguaaucccugagggacgggucaucgaccucggguguggccgcggcggguggucguacuacugugccggcuuaaagaaggugacugagguucggggcuacacgaagggugggccagggcacgaggagccugucccuaugagcaccuacggcuggaauauagugaaacugauguccggaaaagacguguucuaccuuccucccgagaagugcgacacguuacuaugugacaucggugaaucuucgccaagcccgaccguagaggagaguagaacaauccggguguugaagaugguggagccuuggcucaagaauaaccaauucugcaucaagguccucaaccccuacaugccgacagugauugaacaucuugagcgacuccagaggaagcacggcggcaugcuggucaggaauccacucagccgcaacagcacgcaugagauguauuggaucuccaacgggaccgggaacauaguugccuccgugaacauggucagccgccuccuacugaaccgguucaccaugacccauagaagaccgacgaucgagaaggaugucgaccucggagcuggcacccggcacguuaacgccgagcccgaaacuccgaacauggauguuaucggggaacggaucaagcgcauaaaggaggagcauaacaguaccuggcauuacgaugacgagaacccuuauaagacgugggccuaccauggcagcuaugaggucaaggccacgggguccgccagcuccaugaucaacgggguggugaaauugcugaccaagccaugggacgucgugcccaugguaacccagauggcgaugacggacaccaccccguucgggcaacaacggguuuucaaggaaaagguggauacucggacgccgagaaguaugccaggcacucggcgcguaaugggcaucaccgcugaauggcucuggcggacccuagggcgcaauaagaagccccggcugugcacucgugaggaguucacuaagaaggugcgcaccaacgcggccaugggcgcgguguucaccgaggagaaccagugggacucggccaaggccgccguugaggacgaagacuucuggaaacucgucgaccgggaaagggagcugcacaaacuugggaagugcggcuccugcguguacaauaugaugggcaagagagagaagaaguuaggcgaauucgggaaggcaaaagggagccgagcgauuugguacaugugguuaggcgcgcgcuaucucgaguuugaggcccucggguuccuuaacgaagaccacugguucucucgggagaauucuuacuccggcgucgagggagaggggcugcauaaacuaggcuauauacuucgggauaucaguaagauaccggggggcgccauguacgcggacgacacggcugggugggacacucgcauuaccgaagacgaccugcacaacgaggagaagaucacccagcaaauggacccggagcaccgacagcuagccaacgccaucuuuaagcugacguaucagaauaagguggugaagguccaacgaccgacucccacuggcacggugauggacaucauuucacggaaagaccagagaggcagcggccaggugggaacguacggguugaauaccuuuaccaacauggaggcccagcucauccggcagauggagggcgagggugucuugucuaaggccgaccuggagaacccucacuuaccagagaagaagaucacccaguggcuggagaccaagggcguggaacgccugaaaagaauggccaucagcggggaugacugcguggucaagcccaucgacgaccgguuugccaacgcgcucuuggcccugaacgauauggggaaggugcggaaggauauuccgcaguggcagcccucgaagggcuggcacgacuggcaacaggucccguucuguucacaccacuuccaugaacugaucaugaaggaugggaggaagcuugugguaccaugccgaccucaggaugagcucauaggcagagcccggauuucucagggggcgggcuggagccuacgcgagacugccugucuagguaaggcauacgcccagauguggucccuaauguacuuccaccgccgcgaucugcgccuggcuucuaacgccaucugcuccgccgugccuguccauuggguucccaccucccggaccaccuggaguauacacgcccaucaccaguggaugacgaccgaggauaugcugacagucuggaaccgcgucuggaucgaggacaacccauggauggaggacaaaacacccgugacgaccugggaaaaugugcccuacuuggggaagcgcgaggaccaguggugcgguucucucaucgggcugaccagccgcgcaaccugggcgcagaacauaccgacggccauccagcagguacggucccuuauagggaacgaggaauuuuuggacuacaugcccucaaugaaacgguuucggaaagaagaggaguccgaaggcgccauaugguga

SEQ ID NO: 26064 - RNA, 9873 nt, Artificial Sequence
  derived and/or modified CDS sequence (opt11) from DENV-3__KF955471__SS-prME
accagccugugccucaugaugauacugcccgccgcccuggccuuccaccucaccucccgggacggggagccccgcaugaucguggguaagaacgagcguggcaagagccugcuguucaagacggccuccgguaucaauaugugcacccuaaucgccauggaccugggcgagaugugcgaugauaccgugacuuacaaguguccacacauuaccgagguagagccugaggacaucgacugcuggugcaaccuuaccagcacuugggugaccuaugggacaugcaaucaagccggugagcaccgacgcgacaagagauccguagcccuugcaccccacgugggcaugggucuggauacgcgcacucaaaccuggaugagcgccgagggcgccuggcgccagguggaaaaggucgagacgugggccuugcgacacccgggguucaccauccuggcacuguuuuuggcccacuacaucggcaccucccucacccagaagguugugauuuucaucuuguuaaugcucgucacgccuucuaugaccaugaggugcguggggguuggcaaucgcgacuucgucgagggccuguccggggccaccuggguggacgugguacuggagcacggcgggugcgugaccacgauggccaagaauaagccuacccucgacauagaguuacagaagacugaggccacccagcuggcgacgcuccggaagcugugcaucgaaggcaagaucaccaacaucacaacagacagccgcugccccacucaaggcgaagccgugcugccagaggagcaggaccagaacuaugucugcaagcacaccuauguggacagggggugggggaacggguguggccucuucggcaaagguucccuggucacgugcgccaaguuucagugccuggagcccauugaggguaaggucgugcaauacgaaaaccucaaguacaccguuauaaucacuguccacaccggggaccagcaccaggugggaaaugagacacaaggggucacggcugagaucacgccccaggccagcaccaccgaagcgauccugcccgaguacggcacccugggguuggagugcucgccgcgaaccggccuugacuucaacgaaaugaucuuacucacgaugaagaacaaggccuggauggugcaccggcagugguucuucgaccugccgcugcccuggaccuccggcgccaccaccgagacccccacauggaaccgcaaggaguugcuggugacuuuuaaaaacgcccacgcuaagaagcaggaggucguugugcucgggucccaggagggcgcgaugcauacggcccucacgggggccaccgagauccagaacagcggcgggaccucgaucuucgcaggccaccugaagugucggcugaagauggacaagcucgagcugaagggcaugagcuacgccaugugcacaaacacauucguccugaagaaggaggugucagagacccaacaugggaccauccucaucaagguggaguacaaaggagaagacgugccgugcaagauccccuucucuacagaggacggacaaggcaaggcgcauaauggccgccugaucacggccaaccccguuguuacaaagaaagaggagcccgucaauauugaggccgaaccgcccuucggggagagcaacauagucauuggaauuggggauaacgccuugaagaucaacugguacaagaaaggcucuagcaucgggaaaauguucgaggcgacggcccggggagcccgccggauggccauacuaggcgauaccgcaugggacuuugggucggugggcggcguccucaacucccugggcaaaauggugcaccaaauauucggguccgccuauacugcccucuucagcggggucuccugggucaugaagaucggcaucggggugcuccugaccuggaucggccugaacagcaagaacaccucaaugucguucuccugcauagccauagggaucaucacccucuaccugggcgccguaguucaggccgauauggguugugugaucaacuggaaaggcaaggagcugaagugcggaagugguaucuucgugacgaacgagguacacaccuggaccgagcaguacaaguuccaggcggacuccccgaaacgccucgcaaccgccauagcaggcgccugggagaacggggugugcggcauccgcagcacgacucggauggagaaccugcuguggaagcagauagcaaacgaacucaacuacauccugugggagaacaauaucaagcugaccguuguagugggggauaucaucggcgugcucgagcagggcaagagaaccuuaacgccacagccgauggaacuuaaguauuccuggaagacaugggggaaggccaagaucgucaccgccgagacucagaacagcuccuucauaaucgacgguccuaacacgccggagugccccagcgccucccgggcguggaacgugugggaggucgaggacuacgguuucggagucuucaccaccaacauuuggcucaagcugcgcgaaguguacacucagcugugcgaccaccgguuaaugagcgccgccgugaaggacgagcgcgccguccacgcagacaugggcuacuggaucgaaagccagaaaaacggauccuggaagcuugagaaggcgucgcugaucgaagugaagaccuguacguggccgaagucccacacacuuuggucaaacggcguucuggaguccgacaugaucauccccaagagccuggccgggcccaucagccagcacaacuacagaccgggcuaucauacccagacggcgggacccuggcaccugggcaaauuagaguuggacuucaacuacugcgaggggacgacuguggucaucacggagaacugcgggacccgggggcccucgcuucggaccaccaccguguccgggaaauugauccacgaaugguguugccgcagcugcacccugccaccgcuccgguauaugggcgaggacgggugcugguauggcauggaaauacgcccuaucuccgagaaggaggagaacaugguuaagagccuggucuccgccgguuccggggagguggacaacuucacuaugggcguccugugucucgccauacuguucgaggaggugaugagagggaaguucggcaagaaacacaugaucgcggguguguucuucacauucguccuguuacuguccggccagaucacauggcgggauauggcacacacucuaauuaugauaggcagcaacgccuccgacagaauggguaugggcgugacguaccucgcccuuaucgccacguuuaagauacagccguuccuggcauugggcuucuuccugaggaagcugacgagccgggagaaccuccugcugggcgugggccucgccauggccacgacucugcaacuccccgaagauaucgagcaaauggcgaacgggaucgcucucggccugauggcacugaaacucauaacccaguuugagaccuaccaguuguggaccgcccugaucucucucacguguuccaacaccaucuuuacacugacugucgccuggcgcacggcuacccugauccucgcgggggugagccuccuuccagucugccagaguagcuccaugcggaagaccgacugguugcccaugaccguggccgccaugggcguaccgcccuuaccucuuuucaucuucaaucucaaggacacgcugaagcgacgcuccuggccccugaaugagggagucauggccgugggccucgugucuauucuggccuccucccucuuacguaacgacgugccgauggcgggcccgcugguggcagggggccuacucaucgccugcuacgugauaaccgggacaucugcagaccugaccgucgagaaggccgccgacgugacgugggaggaggaggcagagcaaacuggcgugucgcacaaucugaugaucaccguugacgacgacgggacaaugcgcaucaaggacgacgaaaccgagaacauucugacgguccugcugaagaccgcccuccugaucgucagcggcaucuucccguacuccauccccgccacccuguuggucuggcacaccuggcaaaagcagacgcagcggagcggagugcugugggacgugcccagcccgccagagacgcagaaggcggaguuagaagaggggguuuaccguauuaagcagcaaggcaucuucgggaagacucaggugggcguggggguccagaaggaaggcgucuuccacaccauguggcaugugacgcggggcgcgguauuaaccuacaaugggaagcgccuggagccaaacugggccagcgucaagaaagaccugaucuccuauggggggggcuggcgucucuccgcccaauggcagaagggggaagaggugcaggucaucgccguggagcccggaaagaaccccaagaauuuccagacuaugccuggcaccuuccagacuaccaccggggagauuggcgcaauagcacucgacuucaagcccgggaccuccggcucacccauuaucaaccgcgagggcaagguggucgggcuguacggcaaugggguggugacgaagaacggcggguacgucagcgguaucgcccagaccaaugccgagccggacggucccacuccugagcuggaggaggagauguucaagaagaggaaccucacuaucauggaccugcaccccgguucgggcaaaacgcgaaaguaccugccggcaauagugcgggaggcgaucaagcgccggcuucggacccuaauccucgcccccacccggguggucgccgccgagauggaagaggcccucaaagggcugcccauucguuaccaaaccacggcgacgaagagcgagcacaccggucgggagaucguagaccugaugugucacgccaccuucacgaugcgccuacucucccccgugcgugucccgaacuacaaucugauaaucauggacgaggcccacuucaccgaccccgccagcaucgcugcgcgcggguacauuuccacccggguaggaaugggcgaggccgccgccaucuucaugaccgcgacgccccccgggacugccgacgcguuuccucagagcaacgcccccauucaggacgaagaacgcgauauacccgagcgcuccuggaacagcggcaacgaguggauaaccgacuucgcggggaagaccgucugguucguccccuccauuaaggcgggcaacgacaucgccaacugccugcgcaagaacgggaagaaggugauucaacugagccgcaagacauuugacaccgaguaccagaagaccaagcugaacgacugggacuuuguggucaccacugacaucuccgagaugggcgccaacuucaaggccgaccgggugaucgacccccgcaggugccucaagcccgugauccuaaccgauggacccgagcgggucauccuggccgggcccaugccggugaccgcggccagcgccgcccagcgucgcggccggguggggcgcaacccccaaaaggagaacgaucaguacauuuuuacaggucagccacucaacaacgaugaggaccacgcccacuggaccgaggcgaagaugcucuuagacaacauaaacacaccagaggguaucauaccggcccucuucgagcccgaacgggagaaguccgccgcuauagauggagaguaucgucugaagggcgagagccggaaaacauuugucgagcugaugcgacgcggggaccuccccguguggcuggcgcacaaggucgccucugagggcaucaaguacaccgacaggaaguggugcuucgacggccagcggaauaaccagaucuuagaggaaaauauggacguggagauauggaccaaagagggggaaaagaagaagcucagaccccgcuggcuggaugcgcgcacguacagcgauccgcuugccuuaaaagaguuuaaggacuucgccgcgggccgcaaauccaucgcccuggacuuggugaccgaaaucgggcggguccccacccacuuagcccaccgcacccgcaacgcccuggacaaccuggugaugcuccacacgucugagcacggcgggaaggcauauaggcacgcgguggaggagcuacccgagaccauggagacccuguuacuacugggccucaugauccugcugaccgggggugccauguuauuccuuaucuccggcaaggggaucgguaagacgagcaucgggcugaucuguguuauugccagcucaggcauguuguggauggccgagauaccgcugcaguggauagccuccgcgaucguucuggaguuuuucaugauggugcuccugaucccugaacccgagaagcagcggacgccccaggacaaccagcuggcguacguuguuauagggauacucacacuggccgccaucaucgccgccaacgagaugggccuguuggagaccacuaagcgcgaccucgguauguccaaggaaccggggguggucucacccaccuccuacuuagacguggaucuucacccagcaagcgccuggacccucuacgccgucgcaaccacggucaucacgcccaugcuaaggcacaccauagagaauuccaccgccaaugugagccucgccgccaucgccaaccaggcggugguccugauggggcuggacaaaggguggccuaucuccaaaauggaccucggcgugccgcuacuggcccucgggugcuacagccaggugaauccccuaacacugaccgccgccguccuccuguuaauuacucacuacgccaucaucggccccggccuucaggcgaaggcaacccgcgaagcccaaaagcguacggcugccgguaucaugaagaauccgaccgucgauggcaucaugaccaucgaucuagaccccgugaucuaugauuccaaguucgagaagcaacugggccaggucaugcuucuggugcugugcgcggugcagcuccugcugaugcgcaccagcugggcccuuugcgaggcccugacguuagcaacgggccccauuaccacccucugggagggcuccccagggaaguucuggaacacgaccauugcggucuccauggccaauaucuuccgcggguccuacuuagccggggccggccuggcguucucuaucaugaaguccguggggaccggcaagcgugggaccggaagccagggggagacacucggcgagaaauggaagaagaagcugaaccagcucucccggaaggaguuugaccucuacaaaaaguccggcaucacggagguagaccgcaccgaagccaaggaggggcugaagcggggugagaucacccaccacgccgucucacgcgguuccgcaaaguugcagugguucguggagcggaauaugguaaucccggaggggcgcgucaucgaucucggcugcgggcggggcggguggagcuacuauugcgccggccugaagaaggugaccgagguucgcggcuacacuaagggcgggcccgggcacgaggagcccguccccaugucaaccuauggcuggaacauugugaagcugaugagcgggaaggacguguucuaucucccgccggagaagugcgacacacugcugugcgacaucggcgagucuagcccuaguccuaccgucgaggagaguaggacgaucagagugcugaaaaugguggaaccguggcucaagaauaaccaguuuugcaucaagguccugaaccccuauaugcccacggugaucgagcaccuggagcgucuccagcggaagcauggagggaugcuggugaggaacccccuguccaggaacagcacccacgagauguacuggauuuccaacggcagcgggaacauagucgcguccgugaacauggugagccgccugcugcugaaccgguucaccaugacgcaccggcggccgaccaucgagaaggacgucgaccucggcgcgggcacccgccacguaaacgccgagcccgagacccccaacauggacgugauuggggagcggauaaagcggaucaaagaggagcacaacagcacguggcauuacgacgacgagaacccguacaaaaccugggcguaccacggcucguacgaggucaaggccaccgguucagcaagcucaaugaucaacggcgugguaaaacugcugaccaagcccugggacguggugccaauggucacccagauggcgaugaccgacaccacccccuucgggcaacaacggguguuuaaggagaagguggacacgcgaaccccgcggagcaugcccggcaccagacgggucaugggcaucaccgcagaguggcuguggcgaacgcugggccggaacaagaagccccggcugugcacccgagaggaauuuaccaagaagguaaggacaaacgccgccaugggagcuguuuucacggaggagaaccagugggacagcgccaaggccgcaguagaggacgaagacuucuggaagcucguggaucgcgagcgcgaguuacauaagcuagggaagugcggcucgugcgucuacaacaugauggggaagcgcgagaaaaagcugggcgaguucggcaaggcgaaggggagccgugcgauuugguauauguggcuuggagcccgguauuuggaguucgaggcccucggguuccugaacgaggaccacugguucucgagggagaacagcuauucuggcgucgagggggagggccugcacaagcugggcuacauccugcgcgauaucuccaagaucccggggggcgccauguacgccgaugacaccgccgggugggauaccaggaucaccgaggacgaccugcacaacgaggagaagaucacgcagcaaauggacccggagcaccgccagcucgcgaacgccaucuucaagcugaccuaucagaauaaggugguuaagguccagcggcccaccccgaccgggaccgugauggacauuaucucccgcaaggaccagcggggcagcgggcaggugggcacguacggccuuaacacguucaccaacauggaggcgcaacugauccgccagauggagggcgaggggguguuauccaaggccgaucuugagaacccccacuugccggaaaagaagauuacgcaguggcuugagacgaagggcguugagcggcugaagaggauggcgauaagcggcgacgacugcguggucaaacccaucgacgaccgcuucgccaacgcccuccuugcccugaacgacaugggcaaaguccgcaaggacaucccccaauggcagccaucgaagggguggcacgacuggcagcaggugccguucuguucucaccacuuccacgaacucauaaugaaggacggacggaaacuggucgugccaugccguccgcaggacgagcugaucggccgcgccaggaucucccaaggggccggauggagccuccgggagaccgcgugccugggcaaggcuuacgcccagauguggucccucauguacuuccaccgccgugaccugcgccuggcgaguaacgccaucugcuccgccguccccguacauugggugccgaccucacgcacuacaugguccauccacgcgcaccaucaauggaugaccacggaagacaugcugaccguguggaaucggguguggaucgaggacaaccccuggauggaggacaagacccccguuacgaccugggagaacgugcccuaccucgggaaaagggaggaucaauggugcggcagucugaucggccugaccucgcgggccacgugggcccaaaacaucccgaccgcgauccagcaggugcguucccucaucgguaacgaggaauuccuggauuauaugcccagcaugaagcgguucaggaaagaggaggaguccgaaggggcuaucugguga

SEQ ID NO: 26065 - RNA, 9873 nt, Artificial Sequence
  derived and/or modified CDS sequence (opt11) from DENV-3__FJ639803__SS-prME
accagcuugugccucaugaugauacugcccgcugcacuggcguuccaccucaccucacgggacggagaaccccggaugaucgucgggaagaacgagcgcggcaagucacuacuguucaagacagcguccgggaucaacaugugcacacuuaucgcaauggaccugggcgagaugugcgacgauacgguuaccuauaaguguccgcacauuacggagguagagccugaggacaucgacuguuggugcaaccucaccagcacgugggucaccuauggcacaugcaaccaagcgggcgagcaccggcgcgacaagcggucuguggcacucgcgccccaugucggaaugggacuggacacacggacccaaacuuggaugagcgcugagggcgcuuggcgccagguggagaaaguagagacgugggcacuucggcacccgggcuucaccauucucgcuuuguuccuggcacacuacaucggcacuucacuuacacaaaagguggugaucuucauccugcugaugcucgucacgccgagcaugacuaugcggugcgugggggugggcaaccgcgacuuuguggagggccucaguggggccacuuggguggacgugguacuggaacacggagggugcguaaccacgauggcaaagaacaagcccacgcuugauaucgagcuacagaagaccgaggcuacccagcucgcaacgcuccggaaacuuugcaucgagggcaagauuacaaacaucacgacggacuccagguguccuacgcagggcgaggccguacucccagaggagcaggaccagaacuacguuugcaaacauacguacguggacagaggcuggggcaauggguguggccuauucggcaaggggucccugguaaccugcgccaaauuucagugccuagagcccauagagggcaagguugugcaguaugagaaccucaaguacaccgugaucauuacgguccacacgggggaccagcaccaggugggcaacgagacccaagguguuaccgcugaaauaacgccccaggcaagcacgacagaggcgauacugccggaguauggaacgcugggacuggagugcagcccccgcaccggccuggacuucaacgagaugaucuugcucacgaugaagaacaaagccuggauggugcacagacagugguucuucgaccugccguuacccuggacgucgggugccacaaccgaaacgcccaccuggaaucggaaagagcugcuggugacauucaagaacgcccaugcgaagaagcaggagguagucgugcucgggucccaggagggcgcgaugcacaccgcccuuacgggagccaccgagauacagaacagcggcgggacgaguauauucgccggccaccuaaaaugucggcugaagauggacaagcucgagcuaaaagggaugucguaugcaauguguacaaauacuuucguccugaagaaagaaguuuccgagacccagcaugggacaauauuaaucaaaguggaguacaaaggcgaagacgucccgugcaagaucccuuucaguacggaagacgggcagggcaaggcucacaacggccgcuuaauuacggcaaaccccguggugacaaagaaggaggagcccgucaacauugaggccgagccuccuuuuggggagagcaauaucgugaucggcauuggggauaacgccuugaagaucaacugguacaagaaaggcuccucgauaggaaaaauguuugaggcaaccgcccguggggcucgccggauggccauccugggagacacagcgugggacuucggaagugugggagggguccuaaacucgcuugggaaaaugguucaucaaaucuucggcuccgcauauacggcguuauuuagcggcguguccugggucaugaagaucggcaucggcgugcuccugacuuggaucggccugaacagcaagaacaccucuauguccuucagcuguaucgcgaucgguauaauuacccucuaccuuggggccgugguucaggccgacauggggugcgugaucaacuggaagggaaaggagcugaagugcgguucggggaucuucgugacaaaugagguccacaccuggacugagcaguacaaguuccaggcggacucucccaagcgcuuagccaccgccaucgccggcgcaugggagaacggagucuguggcauucgaaguacgacccgcauggagaaccugcuguggaaacaaauugcgaacgagcucaacuacauacugugggagaacaacaucaagcugaccgugguagugggggacaucaucggcgugcucgaacagggcaagcgcacccuaacaccccagcccauggaguuaaaguacagcuggaagacgugggggaaggcaaaaauuguaacggcugagacccaaaacuccuccuuuaucauagacggaccaaacacaccagagugcccaagcgccagcagagcguggaacguaugggagguggaggauuauggcuucggcgucuuuaccaccaauaucuggcugaaacuucgcgagguuuauacccagcuuugcgaccaccgccugaugagcgccgcuguuaaggacgagcgcgcgguucaugccgacaugggauauuggaucgagucacagaagaauggguccuggaagcuagaaaaggccagccugauugaagugaagacuuguaccuggccgaagucgcacaccuuaugguccaauggcguucuugaguccgacaugauuauccccaagagccuggcugggccuaucucccagcauaauuaucggccuggauaccauacucagacugccgguccguggcaccucggcaagcuggagcuggacuucaacuacugcgagggcacgacggucguuaucaccgagaacugcggaacgcguggcccgucccuccggacuacgacgguuaguggcaaacugauucaugaguggugcugucgcaguugcacucugccaccgcuacgguacaugggcgaggauggguguugguacggcauggagauccgccccaucuccgagaaggaagagaacaugguaaagucgcugguaucagcuggaucaggggaaguggacaacuucacgaugggcguacugugccuagccauccuguuugaggaggucaugcggggcaaauucgggaagaagcauaugauugcggggguguucuucaccuucguccuauuguuaagcggccagauuacauggcgcgauauggcccauacccugauuaugauaggcaguaacgcguccgaccggauggguaugggggugacguacuuggcgcugauagccacuuuuaagauacagcccuuucuggcacucggguucuuuuugcgcaagcugaccagccgggagaaccucuuauuaggcguugguuuggcaauggcaacgacgcuccagcucccggaggauauugaacagauggcuaacgggaucgcuuugggccugauggcccugaagcucaucacacaguuugagacguaucaguuguggacugcccugauuucccugacaugcucgaacacgaucuucaccuuaacaguagccuggagaaccgccaccuuaauccucgcaggggugagcuuacugccggucugccagucuagcuccaugaggaagaccgauuggcuaccaaugaccguagcggccaugggcgugccgccccucccacuauuuaucuuuaauuuaaaggacacgcugaaaagacgcagcuggccccugaaugagggggucauggccgugggacucgugagcauacuggcuagcucccugcuccggaaugacgucccuauggccggcccccugguggccggagggcugcucauagcgugcuauguaaucacgggaacgagcgccgaucugaccgucgagaaggcugccgacguuacaugggaggaggaggccgagcagaccggcgugagucacaaucuuaugaucaccguugacgacgacgggacgaugcgcauaaaagacgacgaaaccgaaaacaucuugacugugcugcugaaaacggcgcuccuuauagugagcggcaucuucccguacucuauaccugccacacuucucgucuggcauaccuggcaaaagcaaacccagcggagcggcgugcuuugggacgugccgagcccgcccgaaacccagaaagccgaacuggaggaaggggucuaccgcauuaagcagcagggcaucuucgggaagacccaagugggaguggggguacagaaggaggggguuuuccauacgauguggcacgugacgcguggcgcggugcucacguauaacgggaaacggcuagagccuaacugggccagcgugaagaaagaccugauauccuacggcgggggcuggcggcucagcgcccaguggcaaaagggggaggaaguacagguuauugcgguggagcccggcaagaaccccaagaacuuccaaaccaugcccggcaccuuccagacaaccaccggggaaaucggcgccauagcucuugacuucaagccagguaccuccggcagccccaucaucaaucgcgaaggcaaggucgucgggcuuuacggaaacgggguggugacaaagaacggcggguacgucucggguauagcccaaacgaaugcugagcccgaugggccaacccccgagcuugaagaggaaauguuuaaaaagcggaaucucaccaucauggaccuucauccggggagcgguaagacccgcaaguaccugccugcaaucgugcgggaggcgaucaagcgccggcuacgaacacugauacucgcuccaacucgaguggucgcagccgagauggaggaggcacucaaggggcuccccauucgauaccagaccaccgcgaccaagagcgagcacacaggccgcgagauuguggaccugaugugccaugcaacauucacaaugcgccuccuaucccccgugcgggucccgaauuacaaccugauuaucauggacgaagcacacuucaccgaccccgccagcaucgccgcgcgcggguacaucagcaccaggguggguaugggggaggcugcugcuaucuuuaugacggcaaccccaccggggaccgcagacgcuuuuccgcaaagcaacgccccuauccaggacgaggagcgcgacauucccgagaggagcuggaacagugguaaugaauggaucaccgauuucgcggggaaaaccgugugguucgucccuuccaucaaggcggggaaugacaucgcuaauugccuaaggaagaacgggaagaaagugauccagcuaagccgcaagacguucgacacugaguaccagaaaaccaagcugaaugacugggacuucguugugacgacggauauuucugagaugggugccaacuucaaggcugaccgggucaucgacccgagacggugcuuaaaacccgugauucugaccgacggccccgagagggucauccucgccgggccgaugccgguaaccgcugcuagugccgcacaacggcgcggacggguggggcgcaacccccagaaagagaaugaccaauacauuuuuacugggcagccacucaacaacgacgaggaccacgcccacuggacagaggcaaagauguugcucgauaacaucaacacacccgaagggaucaucccggccuuguucgagccagagcgcgaaaaauccgccgcuaucgacggcgaguaccgccugaagggcgagagccggaaaacguucguggaacuaaugcgccgcggcgaucuccccguguggcuggcccacaaggucgccucagaaggaaucaaguacacggaccgcaaguggugcuucgacgggcagcggaacaaccagauacuugaggagaacauggacguagagaucuggaccaaggaaggcgaaaagaagaaacuccgcccgcgguggcuggacgcucgcacuuacucugacccacucgcauugaaagaguucaaagacuucgccgcgggacggaaguccaucgcacuggaccuggugacugagaucgggcggguacccacgcaccuagcccaccgaacccggaacgcccuggacaacuuggugaugcuccacacgucagaacacggcgggaaggcuuacaggcacgcgguggaggaacugcccgagacaauggaaacauuacuucugcucggccucaugauccuguuaaccggaggggcuaugcuguuccucaucuccggcaaggggaucggaaagacgagcauaggccugauaugcguuaucgugagcucggguaugcucuggauggccgagaucccgcugcaguggaucgccagcgccaucgugcucgaguuuuucaugauggucuugcugauccccgaacccgaaaagcagcggacgccacaggacaaccaacuggcguacguggugauagguauccuaacucuggccgcgaucauagcggcgaaugagaugggccugcucgagaccacaaaacgcgaucucggcaugucuaaagaaccgggggucgugagccccaccucauaccuggacguggacuuacacccugcaagcgccuggacacuguacgcaguagcaaccacggugaucacuccaaugcugcgacacacaaucgagaacucaaccgcgaauguuagcuuagccgccaucgcgaaccaggccgucgucuugaugggucucgacaagggguggccaauaucaaaaauggaccucggcguaccccugcuggcguuaggcugcuacagccaggucaauccccuaacucugaccgcugccgugcugcugcugauuacccacuacgcuaucaucggccccggacuccaagcgaaggcgaccagggaggcgcagaagcggacggccgccgggaucaugaagaacccgacgguagacggaaucaugaccaucgaccuggacccgguuaucuaugacucaaaguucgaaaaacagcucgggcaagugaugcuucuggugcugugugccguccagcuccugcucaugcgcaccagcugggcgcucugcgaagcauuaacguuagccaccggccccaucaccacucucugggagggcuccccagggaaguucuggaacacgaccauagccgugagcauggcgaacaucuuccggggcucauaccuagcaggggcgggucuugcguucagcaucaugaaguccguggguaccggaaaacgcggcaccggcucgcagggcgaaacccucggggaaaaauggaaaaagaaacuuaaccagcugucccgcaaggaguucgacuuauacaagaaguccggcaucacggaaguagaccgcaccgaggcgaaggagggguugaagcggggcgagaucacgcaucacgcggugagccggggcucagccaagcugcagugguucguggagcggaacauggugaucccggagggacgcguuaucgacuuaggcugcggaagaggcggguggagcuacuauugcgcuggccugaaaaaggucaccgagguacgcggcuacacgaagggagggcccggucacgaggagccagugcccauguccacuuacggcuggaacaucgugaaguuaaugagcgggaaggauguauucuaccuaccgcccgagaagugcgauaccuugcuaugcgacauaggcgagucaagccccuccccuaccguggaggagagccggacgauccgcguucugaagauggucgagccguggcugaaaaauaaccaguucugcauuaaggugcuaaacccauacaugccaacugucaucgagcaccuggagaggcuccagcggaagcacggcggaaugcugguccggaacccucucucacggaacagcacccacgaaauguacuggaucagcaacggcagcgggaacaucguggccagcguaaacauggucagccgccuccuccugaaccgguucaccaugacgcaccgccggccaaccaucgagaaggacguagaccucggagcugggacccgacacgugaaugcggagcccgagacccccaacauggacgugaucggggagcggauuaaaagaaucaaagaggagcacaacuccacguggcacuacgacgacgaaaaccccuacaaaaccugggccuaccacggaucguacgaggugaaagccacugggagugcgucuagcaugaucaacggugucguuaaguugcugaccaagcccugggacgugguaccgauggugacgcagauggccaugacagacacuaccccauucggacagcagagaguauucaaagaaaaagucgauacgcgaacaccgcggagcaugcccggcacucgacgggugaugggcauaaccgcggaguggcucuggaggacgcuggggagaaacaagaagccccgccugugcacccgggaggaauuuacuaagaagguucgcacuaaugccgccaugggcgcagucuucaccgaggagaaccagugggacagugcaaaggcagccguggaagacgaggacuuuuggaaauuaguggaccgcgaacgggaguuacacaaauuagguaaauguggcagcugcguguacaauaugauggguaagcgcgagaaaaagcucggcgaguuuggcaaggcgaagggcucgagagccaucugguauaugugguugggagcaagguaccuggaguucgaggcacuuggguucuugaacgaggaucacugguuuucccgggaaaacucauacuccggcguggagggggagggcuuacauaagcucggcuacaucuuacgugacaucagcaagauccccgguggagccauguaugcugacgauacggcggggugggacacaagaaucacggaggaugaccugcacaacgaggagaagaucacgcagcagauggacccggagcaucgccaacucgccaaugcaaucuucaagcugaccuaucaaaacaagguugucaaagugcagcggcccacccccacgggcaccgugauggacauuaucucccgcaaggaccagagggguagcgggcagguaggcacuuaugggcugaacaccuucaccaauauggaggcgcagcuuauccgccaaauggagggugagggggugcugaguaaggcagaccuggaaaacccccacuuaccagagaagaagaucacgcaguggcucgagacgaaaggagucgagcggcuaaagcgcauggccauaaguggcgacgacugcgugguaaagccaaucgacgacagauucgcgaacgcccuccuggcucugaaugacauggggaaagugcgcaaggacaucccucaauggcagccuucgaagggcuggcacgacuggcagcagguucccuucugcagccaucacuuccacgagcugaucaugaaggaugggcggaagcugguaguacccugccgcccgcaggaugagcugaucggccgagcccgcaucucccaaggggcgggcuggaguuugagggagacugcgugucuuggcaaggcuuacgcccagauguggucacuaauguacuuccaccgacgggaccuccggcucgcgucuaaugcgauaugcuccgccguucccguacauugggugccgaccucccgcaccacaugguccauccaugcccaccaccaauggaugaccaccgaggacaugcugaccguauggaacagggucuggaucgaggacaaucccuggauggaggauaaaacgcccgugacaaccugggagaaugugcccuaccucggcaagcgugaggaccaauggugugggagccugaucggacugacuagccgggccacgugggcucagaauaucccgaccgcgauccaacaagugcgcagccugaucgguaacgaagaguuccuagauuacaugccuuccaugaaacgguuccgcaaggaggaagaguccgagggggccaucugguag

SEQ ID NO: 26066 - RNA, 9873 nt, Artificial Sequence
  derived and/or modified CDS sequence (opt11) from DENV-3__FJ639804__SS-prME
accagccugugcuuaaugaugauucugcccgccgcccuggcguuccaccugaccucccgagacggggagccccggaugaucgucgguaaaaacgaacggggcaagucucugcuguucaagaccgccagcgggaucaacaugugcacacucaucgccauggaucugggggagaugugcgaugacaccgugaccuacaagugcccgcacaucaccgaggucgagcccgaggacaucgacugcugguguaaccugaccaguaccugggucaccuacgggacguguaaccaggccggcgagcaccggcgugacaagcgguccguggcccuugcaccccaugugggcauggguuuagacacccgcacccagacauggaugagcgccgagggcgccuggcgccagguggagaagguagagacgugggcccugcgccaccccggguucaccaucuuagcguuauuccuggcccacuacauuggcaccucacucacccaaaagguggugaucuucauccuguugaugcucguuacgcccagcaugaccaugcggugcgugggggugggcaaccgcgauuucgucgagggccugucaggggccaccuggguggacguuguguuggagcacggcggcugcguuaccacgauggccaagaacaagcccaccuuggacaucgagcugcaaaagaccgaggccacccagcuggcaacgcuccggaagcugugcauagagggcaagauuaccaauauaacaaccgacaguaggugcccgacacagggugaggccgugcugcccgaggagcaggaccagaacuacgucugcaagcacaccuacguggaccggggcuggggcaacgggugcggccucuucgggaaggggucccugguaaccugcgccaaguuucagugccuggagcccauagagggcaaggucgugcaguacgagaaccucaaguauacagugauuaucaccguccacaccggggaccagcaucaggugggcaacgagacccagggggucaccgccgagaucacgccccaggccucuaccaccgaggcgauucugcccgaguacgggacgcuggggcucgagugcuccccgcgcaccggccucgacuucaacgagaugauccugcuaacuaugaagaauaaggccuggauggugcacaggcagugguucuucgaccugccccucccuuggaccagcggcgccacaacugagacucccaccuggaaccgcaaggagcuccuggugacguucaagaacgcccacgccaagaagcaggaggucgucguacuggggucacaggagggcgcgaugcacaccgcccucacgggggccaccgagauacagaacucaggagggaccuccauuuucgcaggccaucugaaaugccggcugaagauggacaagcuagagcuuaagggcaugagcuacgccaugugcaccaacacguuuguccugaagaaggaggugagugagacccagcaugggaccauccucaucaagguggaauacaagggcgaggacguaccgugcaagauccccuucagcaccgaggacgggcagggcaaggcacacaauggccgccuaaucacggccaaccccguggugaccaagaaggaagaaccugugaacaucgaggccgagccgcccuucggggagagcaauaucgugauaggcaucggggacaacgcccuaaagauaaacugguauaagaaaggcuccagcaucgguaagauguucgaggcgaccgccagaggggcucgccggauggcuauccugggcgacacagcuugggacuucggguccgugggcggggucuuaaacagccugggcaagauggugcaccagaucuuugggucagcauacacggcgcuguucagcggcgugagcugggucaugaagaucggcaucgggguccucuuaacguggauaggacugaacagcaagaacacaaguaugagcuucuccugcaucgcgauugguaucauuaccuuguaccugggcgcggugguucaggccgacaugggaugcguuaucaacuggaagggcaaggagcugaaguguggcagcgggauuuucguaacgaacgagguccacaccuggaccgagcaguacaaguuccaggcggacucccccaagcggcucgcgaccgcgaucgccggcgccugggagaacggggugugcggcauccgcagcacuacccgcauggagaaccugcuguggaagcagaucgcgaacgagcucaacuauauucugugggagaacaacaucaagcugacgguugucgugggggacaucaucggcgugcucgagcagggcaagcgcaccuugacgccgcagccuauggaguuaaaguauuccuggaagaccugggggaaggccaagaucgucaccgccgagacccagaacucaucguucaucauagacgguccgaauacgcccgagugccccagcgccucccgggcguggaacgugugggagguagaagacuacggguucggcguuuucaccacuaacaucuggcucaagcugcgcgagguguacacccaguugugcgaccaccggcugaugagcgccgccguuaaggacgagcgcgcuguucacgcggacauggguuacuggaucgagucgcagaaaaaugggucuuggaaguuagagaaggcgagccugauagagguuaagaccugcacguggccgaagucccacacccucuggagcaauggcguguuagaguccgacaugauaauacccaagucccuggccggcccuauaucccagcacaauuaccggccgggcuaccacacccagaccgccgggcccuggcaccucggcaagcuagagcuugacuucaacuauugcgagggcacgaccguaguaaucacggagaacugcgggaccaggggacccagccuccggacgaccaccgugucuggaaagcuaauccaugaauggugcuguagguccugcacacugcccccgcuccgauacaugggcgaggacgggugcugguacggcauggagaucagacccaucuccgagaaggaggagaacauggucaagagccugguauccgccggcagcggggagguggauaauuuuacgaugggcguccugugccucgccauccuguucgaggaggugaugcggggaaaauuuggcaagaaacacaugaucgcggggguguucuucacguucgucuuacuauuguccggccaaauaaccuggagagacauggcccacacacugauuaugaucggaaguaacgcauccgaccggauggggaugggagugacguaccucgcccugaucgccacauucaaaauccagcccuucuuggcgcucggauucuuuuugcgcaagcugaccagccgggagaacuugcugcugggcgugggccucgccauggccaccacgcugcagcugccggaggauaucgaacagauggccaacgggaucgcgcuuggccugauggcacugaagcucaucacccaguucgagaccuaccagcuguggaccgcccuaaucucguuaacgugcuccaacaccaucuucacccugaccgucgccuggcgcacggccacccugauccucgcgggggugagccugcugccggucugccagaguuccuccaugcgcaagacggacuggcucccuaugaccguggccgcaaugggugugccaccccucccgcuguucauuuuuagccucaaggauacgcugaagcgccgcuccuggccguuaaacgagggggugauggccgucggccuggugagcauccuggccuccagccuguugcguaacgacguccccauggcgggcccccuaguagccgggggccuguuaaucgcuugcuacgugauuaccgggacauccgccgaccugacagucgagaaggccgcggacgugacgugggaggaggaagccgagcagaccggcgugagccacaaccugaugauaaccgucgacgacgaugggaccaugcgcaucaaagacgacgagaccgagaacauucuuacggugcuguugaaaacggcccuccugaucguguccggcaucuuuccuuacuccaucccagcuacccuucucgucuggcacaccuggcagaagcagacgcagcgguccggugugcugugggacgugccaagcccgcccgagacccaaaaagccgagcuggaagagggggucuaccggaucaagcagcagggcaucuuuggaaaaucccaggugggcguggggguccaaaaggagggcguguuccacaccauguggcacgugacucggggcgcggucuuaacguacaacgguaagcgccuugagcccaacugggccagcgugaagaaggaccugaucuccuacggcgggggauggcggcucagcgcccaguggcagaaaggggaggaggugcaggucauugcuguggagcccgggaagaaccccaagaacuuucaaaccaugcccggaaccuuucagaccacgaccggggagaucggcgcaaucgcccuggacuucaagccugggaccagcggcucccccaucauaaaccgcgaaggcaagaucgucgggcuguacggcaacggggucgugaccaagaacggcggguacgugagcggcauugcccaaacgaacgccgagccggacggccccacacccgaguuggaggaggagauguucaagaaacggaaccucacgaucauggaccuccaccccggaucuggcaagacccgcaaguaccugccggccaucguccgugaggcgauaaagcgccggcucagaacgcuaauacuggcaccaacccgggugguggccgccgagauggaggaggcccucaaggggcuacccauacgcuaccagaccaccgcuaccaagagugagcauacgggccgggagauagucgaccugaugugccacgcuaccuucaccaugcgucuccucucccccguacgugugccgaacuacaaccugaucauaauggacgaggcgcacuucacggaucccgcuagcaucgccgcccgcggguacaucuccacccgggucgguaugggcgaggccgcugccaucuucaugacugcgacgccuccagggacagccgacgccuucccgcagagcaacgcccccauccaggacgaggagagagacauccccgagcgauccuggaacagcggcaacgaguggaucaccgacuucgccgggaagaccgugugguuugugccuuccaucaaggcgggcaacgacaucgccaacugccuccggaaaaacgggaagaaagucauccagcugagccgcaaaaccuucgacacggaauaccagaaaacgaagcugaacgauugggacuuuguggugaccacggacaucuccgaaaugggcgccaacuucaaggccgacagggucauugacccgagacggugccugaagccagucauauuaacggacggccccgaacgagugauucuggccgggcccaugccggucaccgcggccagugccgcgcagcggcgcggucggguggggcgcaacccccaaaaggagaacgaccaauacauauucaccgggcaaccccucaauaacgacgaagaccacgcccacuggaccgaggcgaagaugcugcuggacaacaucaacacccccgaggggaucaucccggcccucuucgagcccgagcgggagaaguccgccgccauugacggcgaauaccgccucaagggcgaaagccggaagacguucguugagcugaugcgcagaggggaccuacccguuuggcucgcgcauaagguggccucagagggcaucaaguacacagaccgcaaauggugcuucgacgggcagaggaacaaccagauacuggaggagaacauggauguugagauauggacaaaagagggcgaaaagaaaaagcuacgcccccgcuggcuggacgcgcgcacauacucagacccgcuggcccucaaggaguucaaggacuucgccgcgggccgaaagagcauugcccuggaccuggucacggagaucggacgggugcccacccaucucgcccaccgcacgcggaaugcccuugauaaccuggugaugcuccacaccagcgagcacggcgggaaggccuaccgccacgcaguggaggagcugcccgagacgauggagacccugcuccugcugggucucaugauccugcugaccggaggggcgaugcuguuccugaucuccgguaagggaaucgguaagacuucuauuggguugaucugcgucaucgccucgucuggcaugcuguggauggccgagaucccgcugcaauggaucgccagcgcaaucguccuggaguucuuuaugauggugcugcugauccccgagcccgagaagcagcggacgccccaggacaaccaacuggccuacgucgugaucgggauccugacccuggccgccacgauugccgcgaacgagaugggccuucucgagaccacgaagcgcgaccugggcauguccaaggagccgggaguaguguccccaacuuccuaccuggacguagaccuccacccugcgagcgccuggacgcuguacgccguggccacgacggugauaacucccauguugcggcauaccauugagaacucuaccgccaacgucagccucgccgccaucgccaaucaagcgguaguguuaaugggccuugacaagggguggccgaucuccaaaauggaccuaggggucccccugcuggcccuuggcugcuacagccaggugaauccccugacacugacggccgccguucuccugcugauaacccacuacgcgaucaucggccccggucuccaggccaaagcgacccgcgaggcccaaaagcggacggcagcggggaucaugaagaacccgaccguggacggcaucaugaccaucgaccuggacccugucaucuacgacuccaaguucgagaagcaguuaggccaggugaugcuccugguccugugcgcggugcagcuccucuuaaugcgcacgagcugggcccucugugaagcccucacgcuggccaccggccccaucaccacccucugggaaggcucccccgggaaguucuggaacacaaccaucgcagugagcauggccaacaucuuccggggcuccuaccuggccggggcaggccuggccuuuagcaucaugaaaucagucgggaccggcaagcgcggcaccgggagccagggcgaaacacucggggaaaaguggaagaagaagcugaaccagcugagccggaaagaguucgaccucuacaagaaauccggcaucacggaaguggaucguaccgaggcgaaggaagggcugaagcgaggagagaucacccaccaugcgguuagccgcggcucugccaagcugcaaugguucgucgagcguaacauggugauccccgaggggcgcgugaucgaccucggcugcgggcgcggcgguuggucuuacuacugcgccggccugaagaagguuaccgaggugcgcggauauacgaagggcggccccggucacgaggaaccugugcccauguccaccuauggcuggaacaucgucaagcugaugagcgggaaggauguguucuaccucccaccagagaagugcgacacccugcugugcgacauuggugagucuagccccucucccaccgucgaggagagccggaccauccgcguccugaaaaugguggagccguggcugaagaacaaccaguucugcaucaagguacuaaaccccuacaugcccaccgucaucgaacaucuggagcgcuugcagcgcaagcacggcggcaugcuggugagaaauccgcugucgcgaaacagcacccacgaaauguacuggaucuccaacggcaccgggaacaucguagccagcgugaacauggugagucgucuccugcugaaccgguucacgaugaccuacaggcguccgacgauagagaaggacguggaucucggggcgggcacccgccacguuaacgccgagcccgagacgcccaacauggacgugaucggggagcgcaucgagaggaucaaggaggaacacaacagcaccuggcacuacgacgacgagaacccguacaagaccugggccuaucacggcucauacgaggucaaggccaccggcucggccuccagcaugauaaacggcgucguuaagcuguuaacgaaacccugggacguaguucccauggugacccagauggcgaugacugacaccacgccuuucgggcagcagcggguuuucaaggagaagguggacacccggauuccgcggagcaugccgggaacccggcgggugaugggcaucaccgccgaguggcucuggcgcacgcuggggcggaacaagaagccccgccuaugcacucgggaggaguucaccaagaagguccgcaccaacgccgccaugggcgcgguauuuacugaggagaaccagugggacucagccaaagcggccguugaggacgaggacuucuggaagcuggucgaccgcgaacgggaacugcacaaguuaggcaagugcggcucgugcguguacaauaugauggguaagcgcgagaagaagcucggcgaguucggcaaggcuaaagggucccgggcgauaugguacauguggcugggcgcucguuaccucgaguuugaggcccucggguucuugaacgaggaccacugguucucacgggaaaacucguacagcggcguggagggugagggccugcacaagcucggguacauccugcgcgacauuuccaagauccccgggggcgcuauguaugccgacgacacugcggggugggacacgcggaucaccgaggaugaccugcacaacgaggagaagaucacccagcagauggacccggaacaccgccagcucgccaacgccauauuuaagcugacauaucagaauaagguagugaaggugcagcggcccacccccaccggaaccgucauggacaucaucagccgcaaggaccagcggggcuccggccaggucggcacauacgggcugaacaccuucacgaacauggaggcccaguuaauccgccagauggagggcgaaggggugcugagcaaggcugaccuggagaacccccaucuuccggaaaagaagaucacccaguggcuggagacgaagggcgucgaacggcugcgcaggauggcgaucuccggcgacgacuguguggugaagcccaucgacgaccgcuucgccaacgcccuccuggcgcugaacgacauggggaaaguccggaaggacaucccccaguggcagcccagcaagggcuggcacgacuggcaacaggucccguucugcucacaccacuuccaugaacucauuaugaaggacggacgcaaacucgugguccccugccggccccaggacgaguugaucggccgcgcccguaucagccagggggcgggcuggucccuccgcgagaccgccugccuggggaaagccuaugcgcagauguggagucuaauguacuuccaucgacgcgaccugcgccuggcguccaacgcuaucuguagcgccgugcccguacacugggucccgaccucccggaccacguggagcauccaugcccaccaucaguggaugaccacagaggacaugcugaccguguggaaccgcguguggaucgaggacaaccccuggauggaggacaagacacccguuaccaccugggagaacgugcccuaccuggggaagcgggaggaccaguggugcgggucacugaucgggcugacgucccgcgccacgugggcgcagaauaucccgacagccauccagcagguccggagccucaucgggaaugaggaauuucuggacuacaugcccaguaugaagcguuuccggaaggaggaggagagcgaaggggccauuugguga

SEQ ID NO: 26067 - RNA, 9873 nt, Artificial Sequence
  derived and/or modified CDS sequence (opt11) from DENV-3__FJ639805__SS-prME
accagccugugcuuaaugaugauccugcccgccgcccuggcguuucaccucaccuccagggacggggagccgcggaugauaguagggaaaaacgagcgcggcaagagccugcuguuuaagaccgccuccgggaucaauaugugcaccuugaucgccauggacuugggcgagaugugcgacgacaccguaaccuacaagugcccucacaucaccgagguagagcccgaggacaucgacugcugguguaaccugaccagcacuugggugacuuacgguacuugcaaccaggccggugagcaccgaagggacaagcgguccgucgcccucgcgccccauguggguauggggcucgacacccgcacccagacauggaugagcgccgagggcgcauggcgccagguggagaagguugagacgugggcccugaggcacccgggguucaccaucuuagcacuguuccuggcccacuacauaggcacaucgcucacccagaagguggugaucuucauccugcugaugcucgugacgcccucuaugaccaugcggugcguggggguugguaaccgugacuucguggagggccuguccggggcuaccuggguggaugugguccuggagcacggcgguugcgugaccacaauggccaagaacaagcccacccucgacaucgaacuccaaaagaccgaggccacacagcuggcgacacuccgaaagcucuguauugagggcaagauaaccaauaucacaacugacagccgaugccccacgcaaggagaggcugugcugccggaggagcaagaccagaauuacgugugcaaacacacguacgucgaccggggguggggcaacgggugcggccucuucgggaagggguccuugguuaccugcgccaaauuccagugcuuagaacccaucgaggguaaggucgugcaguacgaaaaccucaaguauaccgugaucaucacugugcauacuggggaccagcaucaggugggcaacgagacccagggagucaccgccgagaucacgccccaggccagcaccacugaggcgauucuccccgaguauggcaccuuaggacuggagugcuccccgcgcaccggccuagacuuuaaugaaaugauccugcucacgaugaagaacaaagcguggauggugcaccggcagugguucuucgaccuuccccugcccuggacuagcggugcgaccaccgagacaccuacguggaaccggaaggaacuacuggugacguucaagaacgcacacgccaagaagcaggaagucguggugcugggaucccaggagggcgcgaugcacaccgcgcucaccggggcgaccgagauccaaaauagcggcggcacauccaucuucgcgggccaccugaagugccgguuaaagauggacaagcucgaacugaagggcaugagcuacgcuaugugcaccaauacguucguacugaagaaggagguguccgagacucagcacgggaccauccucaucaagguggaguacaagggggaggacgugccgugcaaaaucccguuuucaacggaggacgggcaaggaaaggcucacaacggccgccugaucacggcuaacccggucgugaccaagaaggaggagccugucaacaucgaggccgagccgccuuucggggagagcaacauugucaucggcaucggggacaacgcgcugaaaaucaauugguacaagaaaggauccagcauagguaagauguucgaggcgaccgcgcggggcgcccgacggauggccauccugggcgacaccgccugggacuucgggagcgugggcgggguccugaacucgcucggaaagauggugcaucagaucuuuggguccgcauacacggcuuuguucagcggcguuuccugggucaugaaaaucggcaucggggugcuccugaccuggaucggccugaacaguaaaaacaccuccaugaguuucuccugcauugccaucggcaucaucacccuuuaccugggcgccgugguccaggcagacauggggugcgugauuaacuggaaaggcaaagagcugaagugcggcagcgggaucuucgugacgaacgaaguccacaccuggaccgaacaguacaaguuccaggcggacucgccgaagcgccuggcgaccgccaucgcgggcgccugggagaacggggugugcggaauccgauccacgacgcggauggaaaaccuguuguggaagcaaaucgcgaaugagcucaacuacauacugugggagaauaacaucaagcucacuguaguggucggggacaucaucggcgugcucgagcaaggcaagcgcacguuaacaccccagccgauggaacugaaguacuccuggaagaccugggggaaagcuaagaucgucaccgccgagacccagaacagcucguuuauaaucgacggccccaauacuccggagugccccuccgcuucccgggcuuggaauguaugggagguggaggacuacggguuuggagucuucacuaccaacaucuggcucaagcugcgagagguguacacccagcuaugcgaccaccggcuaaugagugccgccguaaaggacgagcgagcuguucacgccgacaugggcuacuggaucgagagccagaaaaacgguucauggaaacuggagaaagcgagccuaauagaggugaagacaugcacguggccgaagagucacacccucuggagcaacggcgugcuggaguccgacaugauuaucccgaagagccuggccgggcccauuucccagcacaacuaccgcccggguuaucacacgcagaccgcagggcccuggcaucucgggaagcucgagcuggacuucaacuauugcgagggcacgaccgucgugaucaccgaaaacugugggacccgcggccccucgcuccggaccaccacggugaguggcaagcuaauccacgaguggugcugccgcagcugcacacugcccccgcuccgguacaugggugaggacgguugcugguauggaauggaaauucgacccaucagcgaaaaggaggaaaacauggucaagucacugguguccgccggcagcggugagguagauaacuucacgaugggcguccugugccuugccauccuuuucgaggaggucaugagagggaaguuuggcaagaagcacaugauagcggggguauuccuuaccuucguccuccuucuguccggccagauaaccuggcgcgauauggcucacacgcucaucaugauagguaguaacgccuccgaccggaugggcaugggcgugacauaccuggcccugaucgccacguuuaagauccagcccuucuuggcgcugggcuucuucuugcgcaagcugaccagccgggagaacuugcugcucggcgugggccuagccauggcaaccacgcuucagcuccccgaggacaucgagcagauggccaacggaauugcgcugggccuuauggcccucaagcugauaacccaguucgagaccuaucagcuguggaccgcccucaucucccugacgugcuccaacacuaucuucacccucaccgucgccuggcggacugcgacccucauacuggcggggguaagccugcucccggugugccaguccucgucaaugcggaaaaccgacuggcugccuaugaccguggccgccaugggcgugccgccccugccccuguucaucuuuaaccugaaggacacgcugcgccgccggagcuggccccucaacgaaggggucauggcagugggccucgugagcauucuggccagcagucuacuucgcaacgacguccccauggcgggcccccugguggccgggggccuccuaaucgcaugcuacgugaucacggggaccagcgccgaccugacuguugaaaaggcagcagacgugacaugggaggaggaggccgagcagacaggcgucucccacaacuugaugauaacgguugacgaugacgggaccaugcggaucaaagacgacgagaccgagaacauccugacgguccugcucaaaaccgcccugcugauugugagcggcaucuuucccuauuccaucccagccacgcuccuggucuggcauaccuggcagaaacaaacccagagguccggcguccugugggacguacccagcccucccgagacgcagaaggccgagcucgaggagggggucuaccggaucaagcagcagggcauuuucgggaagacucaggugggcguggggguccagaaggaggguguguuucacaccauguggcaugugacgcgcggcgcuguccucaccuauaaugggaagcggcucgagcccaauugggcgagcguaaagaaggaccucaucuccuacgggggcggcuggcgcuuaagcgcucaguggcaaaagggggaggaagugcaagucaucgccguggagcccgggaagaaccccaagaacuuccagaccaugcccggcacauuccagacuaccaccggagagauaggcgcgaucgcacuggacuucaagccagggaccucugggagccccaucaucaaccgggaggguaagguggucgggcucuacggcaacgggguggugacgaagaacggaggcuacgucagcgggauugcccagaccaacgccgaaccggacggccccacccccgagcuagaggaggagauguucaagaagcgcaaccugacuauuauggaccuacaccccggguccggcaagacgcggaaguaccucccugcaaucgugcgggaggcgaucaagcggcgccugcggacccugauacucgcccccacccgcguggucgccgccgagauggaagaagcccucaagggacugcccauccgguaccagaccacggcgaccaagagcgagcacacuggccgggaaaucguggaccucaugugucacgccaccuucacgaugcggcugcucucccccguucgcgucccgaacuauaacuugaucaucauggacgaggcccacuucaccgaccccgccagcaucgcggcucgcgguuacaucagcacacguguaggcaugggggaggccgccgccauauucaugaccgcgacgccgcccggaaccgccgacgccuuuccgcaaagcaacgccccaauccaggaugaggaacgcgacauccccgagcgcagcuggaacaguggcaacgaguggaucaccgauuucgccgggaaaaccgugugguucguccccuccaucaaggcgggaaacgacaucgccaacugccugcgcaagaacgggaagaaggugauacagcugucccgcaagacguucgauacugaguaccaaaagaccaagcucaacgacugggacuucguagucaccacggacauauccgagaugggcgccaacuuuaaggccgaucgcgugaucgacccgcggcgaugccuaaagcccguuaucuuaaccgacgggccugagcgggucauccuagccgggccgaugccugugaccgcagccagcgccgcccaacgccggggcagggucggucgaaacccccagaaggagaaugaccaauacaucuucaccggccagccccugaacaacgacgaagaucacgcccacuggaccgaggcgaagaugcugcucgacaacaucaacacgccugaggggaucaucccggccuuguucgagcccgagcgcgagaaguccgccgcuaucgacggggaguaccggcugaagggcgagagccgcaagaccuuugucgagcugaugcggcgcggugaccuccccguguggcuggcgcacaagguagccuccgaggguaucaaguacaccgaccggaaguggugcuucgacgggcagcgcaauaaccagauccucgaggagaacauggacguggagaucuggaccaaggaaggcgagaaaaagaagcugcggccccgcugguuggacgcccgcacguacagugacccgcucgcgcuuaaggaguucaaggauuucgccgcaggccggaaguccaucgcgcuggaccucgucaccgagauagggcgcgucccgacccaccuggcccaccggaccaggaacgcacuggauaaccucgugaugcugcacacgagugagcacggcgggaaggcuuacaggcacgcgguggaggagcugcccgagaccauggagacucuccugcugcucggacuuaugauccugcucaccgggggggccaugcuguuccugaucucagggaagggguugggcaagacgucuaucgggcugauuugcgucaucgcuagcagcggcaugcuauggauggcggagaucccgcuccaguggauugccucugcgauugugcuggaauucuuuaugaugguguuacuuauccccgagcccgagaagcagcgcacgccccaggacaaccagcuugccuacguuguuaucgggauucugacccuagcagcuaucauugccgcgaacgagaugggccugcuggagaccacgaaacgugaccucggcauguccaaagaaccggggguggugagccccaccuccuaccuggacguggaccugcacccugccagcgccuggacgcuuuacgccguggcuaccacggucauaacccccaugcugcgccacacaauagagaacucgaccgcgaacgugagcuuagccgccaucgccaaccaggcggugguauuaaugggccuggacaaggguuggccgaucuccaagauggaucugggcguuccccuccuggcgcugggguguuacagccaagucaacccucucacgcuaaccgcugccguccuucucuuaauaacccacuacgcaauuaucggaccgggacugcaggcaaaggccacccgugaagcccagaagcgcacggcagcggguaucaugaagaacccgacgguugacggcaucaugaccaucgacuuggaccccgugaucuacgacuccaaguuugaaaagcaacucgggcaggucaugcugcucguguuaugcgcggugcaguuacuccugaugcgaacaaguugggcccugugcgaggcgcucacgcucgcaacgggucccaucacgacacugugggagggcucgcccgggaaguucuggaacaccaccaucgcggucagcauggcuaacaucuuccggggcuccuacuuggccggggccggccuggccuucagcaucaugaagucgguggggaccggcaaacggggcaccgggucgcaaggugagacccucggugagaaauggaaaaagaaguuaaaccaacuaucccgcaaagaguucgaccuguacaagaagaguggcaucacugagguagaucggaccgaggcuaaggaggggcucaaacgaggagagaucacgcaccacgccgucagccgaggcuccgccaagcugcagugguucguggagcgcaacauggucauccccgagggacgggucaucgaucugggcugcgguagaggcggguggagcuacuacugcgccgggcucaagaaggugaccgaggugcggggcuacacgaaaggcgggccgggucacgaggagcccgugcccaugagcaccuacggcuggaacaucguuaagcucaugagcggcaaggacguguuuuaucugccgccggagaagugcgacacccuccuuugcgacaucggagaguccucucccucccccaccgucgaggagagccguacgauccgcgugcugaaaaugguggagccguggcuaaaaaacaaccaauucugcaucaagguccucaauccauauaugcccacugugaucgagcaucuggagcgccugcagcgcaagcacggagggaugcucguccggaacccccugucccgcaacagcacgcacgagauguacuggaucuccaacggcacagguaacaucgucgccagcgugaauauggucucacgacuucuccugaaccgcuuuacaaugacccaccggcgaccaaccaucgagaaggacgucgaccugggcgcaggcacccggcacgucaacgccgaacccgaaacgcccaacauggacgugauaggcgagcgaaucaagcgaaucaaggaggagcacaacagcaccuggcauuacgacgaugaaaaccccuacaagacuugggccuaucacggcagcuaugaggucaaggccaccggcucugccuccuccaugauuaacggcgucgucaagcuccucacgaaacccugggacgucguccccaugguuauccagauggcuaugaccgacaccacacccuucgggcaacagcgcguguucaaagagaagguggacacgcggaccccgcgcucaaugccgggcaccaggcgcgucaugggcauuaccgccgaauggcuguggcggacgcuggggcggaauaagaagccccgucugugcacccgcgaagaguucaccaaaaaggugcgcacuaacgccgccaugggcgcuguguucacggaagaaaaccagugggacuccgccaaggcugcuguugaggacgaggacuucuggaagcugguggaccgggagcgcgagcuccacaagcuggggaagugcggaucgugcguguacaauaugaugggaaagcgggagaagaagcugggagaguucggcaaggccaaggggagccgcgcgaucugguacauguggcucggcgcccgguaucuugaguucgaggccuuaggguucuugaacgaggaccauugguuuagccgcgagaacucguacagcggcgucgagggggagggucuacacaagcuggguuacauucuucgagacaucuccaaaauacccgggggggccauguacgccgaugacaccgcggggugggauacuaggaucacugaggaugaccugcacaacgaggagaaaaucacgcagcagauggauccugagcaccggcagcuggccaacgccauuuucaagcucaccuaccagaauaaggucgugaaggugcagcgccccaccccaaccggcacugugauggacaucauaagcaggaaggaccagcgcggguccggccaggugggcacuuacgggcugaacaccuuuaccaacauggaggcccagcuuauccggcagauggagggcgagggaguguugagcaaggccgaccuggagaacccccaccucccggagaaaaagaucacccaguggcucgagaccaaggggguggagagacugaagcguauggcgaucucaggcgacgacugcguggucaagcccauugaugaccgguucgccaaugcccuccuagcccuaaaugacauggggaaggugcggaaggacaucccccaguggcagcccagcaagggcuggcaugacuggcagcaagucccguucugcucccaccacuuucacgagcugaucaugaaggacggacgcaaguugguggugcccugcaggccacaggacgagcugaucggccgcgcccggaucagccagggggcgggcuggucccugcgcgagaccgccugccucggcaaagcauacgcccagauguggaguuuaauguacuuccaccgcagggaccugcgccucgcuuccaacgccauaugcagcgccgugcccguucacugggugccgacuucccggaccacguggagcauccacgcccaccaccaauggaugaccaccgaggacaugcuaacagucuggaaccgcgucuggaucgaggacaacccguggauggaggacaagacacccguaaccaccugggaaaacgugcccuaccuggggaagcgggaggaccaguggugcggcucccucaucgggcucaccagccgcgccacgugggcgcaaaacaucccgaccgccauacaacagguccggagucugauuggcaacgaggaguucuuggacuacaugcccuccaugaagcgcuucaggaaggaggaggagagcgagggggcgaucugguaa

SEQ ID NO: 26068 - RNA, 9873 nt, Artificial Sequence
  derived and/or modified CDS sequence (opt11) from DENV-3__FJ639807__SS-prME
accucacucugccucaugaugauccuacccgccgcccuggcguuccaucucaccucucgggacggcgaaccccggaugaucguagggaaaaacgagcggggcaagagccugcuguuuaaaaccgccagcggcaucaauauguguacccucaucgcaauggaucugggcgaaaugugcgacgacaccgugaccuauaagugcccccacaucaccgagguagaacccgaggacaucgacugcuggugcaacuugaccagcaccugggugacuuacggcacgugcaaccaagccggcgagcaccggcgcgacaaacggagcgucgcacucgcuccucacguggguauggggcuggacacccgcacccagaccuggaugagugcagagggcgcuuggcgccagguggagaagguggaaacuugggcccuccggcacccuggguucaccauccuggcccucuuccuggcccacuauaucggcaccucccucacgcagaagguggucaucuuuauccugcugauguugguaacgcccagcaugaccaugcggugcguugggguuggcaaccgcgauuucgucgagggccugucaggggcgacguggguugauguugugcucgagcacggugggugugugacuacuauggcgaagaacaagcccacacucgacaucgagcuucagaagaccgaagccacgcaacuggcgacgcuccgcaagcugugcauugaaggcaaaaucaccaauauaacgacagacagccgcugucccacgcagggugaggccgugcuaccagaggagcaggaccagaacuacgucuguaagcacaccuauguagaccguggguggggcaacgggugcggacucuucgggaagggcuccuugguaaccugcgcgaaguuccagugucuggagcccaucgaggggaagguugugcaguacgagaacuugaaguacaccguuauuaucacgguccauacgggggaccagcaccagguugggaaugaaacgcagggggucaccgccgaaauuacgccccaggcuagcaccaccgaggcgauccugcccgaguacggcacguuggggcucgaguguuccccacgaaccggucuggacuucaacgagaugauccugcucacgaugaagaauaaggccuggauggugcaccggcagugguucuuugauuuacccuuacccuggaccagcggcgccacgacugagacgcccaccuggaaucgcaaggagcuccugguuacauucaaaaacgcccacgcuaagaagcaggaggucgugguacuggggucccaggaaggggccaugcauaccgccuugacgggggcaaccgagauacaaaacagcggugggacaaguaucuucgccggccaccugaagugccgguugaagauggacaagcuggagcuaaagggcaugagcuacgccauguguacuaacaccuucguccugaaaaaggagguguccgagacccagcacggcacuauccugauuaagguggaguacaagggcgaggacguaccgugcaagauccccuucagcaccgaggacgggcaaggaaaggcgcacaacgggcgccugaucacggccaaccccguggugaccaagaaagaggagcccgucaacaucgaggccgagcccccguucggggagagcaacaucgugaucggcaucggggacaaugcccugaagaucaacugguacaagaagggcuccaguaucggcaagauguucgaagcgaccgcucggggcgcgcguagaauggcaauacugggggacaccgccugggacuucggcagugucggcgggguccucaacagccugggcaagauggugcaccagaucuucgggucagcauacacggccuuguucagcggcguguccugggucaugaagauaggcaucgggguacuccuaacuuggaucggccugaacagcaaaaacaccuccaugagcuucucuugcaucgccauuggcaucaucacacuuuaucugggugccgucguccaggcagacauggggugcgugaucaacuggaaagggaaggagcuaaagugcggcagcgggauauucgugacgaacgaggugcacaccuggaccgagcaauauaaauuccaggcggacuccccaaagcgccucgccaccgccaucgccggcgcaugggaaaacgggguauguggcauccgcuccacgacucggauggagaaccugcuuuggaagcaaaucgcaaacgaguuaaacuacauuuuaugggagaacaacauaaagcugaccguggucgugggggauacaaucggcguccuugagcaggguaagcgcacgcucacgccucagccgauggaacugaaguauuccuggaagacaugggggaaggccaagauaguuacggccgagacgcaaaauucuuccuucauaaucgacgggcccaacacccccgagugccccagcgccucgcgggcguggaacgugugggagguggaagacuacggguucggggucuucaccaccaacaucuggcucaaguugcgggaggucuacacccaguuaugcgaccaccgguuaaugagcgcugccgucaaggacgagcgcgcgguucaugccgacaugggcuauuggaucgagucgcagaaaaacgggucauggaagcuagaaaaagcgagccugaucgaggucaagacguguaccuggccgaagucccauacccuguggagcaauggcguucuagagucugacaugauuauccccaagagccuagccgggcccaucucccagcacaacuaccggccggguuaccacacccaaacggccgggcccuggcaccucggcaagcuggagcuggacuucaauuauugcgaaggcaccaccgucgugauaaccgagaacugcgggacccgaggcccgucgcuccgcaccaccaccgugucugggaagcugauccacgaguggugcugcagaagcuguacguuacccccgcuucgguacaugggcgaagacggguguugguacgggauggagauccgccccaucucugagaaggaagagaacauggucaagagccuggucuccgcugggagcggggagguggauaacuucaccaugggcguccuaugucuggccauucuguucgaagaggugaugcgggguaaguucgguaagaagcacaugaucgcagggguauucuucacauucgucuugcucuuguccggccagaucacauggcgagacauggcccacacguuaaucaugaucggaagcaacgcguccgaucgaauggggaugggcgugaccuaccucgcccugaucgccaccuucaaaauccagcccuuccucgcgcucggguucuuucuccgcaaacuuacuagccgagagaacuuacuguugggcgugggccuggcgauggccacgacucugcagcugccugaggacauugagcagauggccaacggaaucgcgcucggccugauggcacuaaaacucaucacccaguucgagacuuaccaacuuuggacggcccugaucagccugaccugcuccaacaccaucuucacccugaccgucgcauggcgcaccgccacauugaucuuggccggggugagccugcugccggucugccagagcagcucuaugagaaagaccgacuggcucccgaugacggucgcagccaugggagugccuccucucccgcuguuuaucuucagccucaaggacacccugaagcgccguuccuggccuuuaaacgaaggggucauggccguaggacucgugucaauacuggcguccagccuccuccggaacgaugucccuauggcuggaccccucguggccgggggccugcucaucgccugcuacguaauaaccgggaccagugccgaccugaccgucgagaaggccgcggacguuacaugggaggaggaggccgagcagaccggcgugagccacaaccugaugaucaccguagacgacgacgggacaaugcgcaucaaggacgacgaaacggagaacauucucaccgugcuguuaaagaccgcccuccugaucguguccggcaucuucccguacagcauccccgcgacucuccuagucuggcacacguggcagaagcagacccaaagguccggugugcuuugggacguacccucgccgcccgagacccagaaggccgaauuggaagagggugucuaccgcaucaaacagcaggggaucuucgggaagacccaggugggcguggguguacagaaagagggcguauuucacaccauguggcacgugacacguggcgcgguuuuaaccuacaacgggaagcgacuggagcccaacugggccuccgugaaaaaggaccugauuagcuacggcgggggauggcgccucucugcccaguggcagaagggggaggagguucaggucaucgcaguggagccugguaagaaccccaagaacuuccagaccaugccaggcacguuccagaccaccacuggggaaauaggcgcgaucgcccuggacuucaaacccgggacgagcggcagcccuauaauuaaccgcgaaggcaagguggucgggcuguaugguaacggcgucgucaccaagaacggcgguuaugucuccggaauagcgcagaccaacgccgagcccgacggcccgaccccagaacuggaggaggaaauguucaagaagcggaacuuaacuaucauggaccugcacccugggagcggaaagacccgcaaauaccugccggcaauaguacgggaggccaucaagcgucggcuacgcacccugauucuggcaccuacgaggguugucgccgccgaaauggaggaagccuugaaggggcuccccauucguuaccagacgacugcuaccaaguccgagcacaccggacgggagaucguagaccuaaugugccacgcaacuuucaccaugcgccuccuaucgccggugcgggucccgaacuacaaccuaaucaucauggacgaggcccauuucaccgauccagccuccaucgcagcgcgcggguacauuuccaccagagugggcaugggcgaggccgccgccaucuucaugacggcaacgccgcccgggaccgccgacgcuuucccacaauccaaugcucccauccaggacgaagaacgcgacauccccgagcgcagcuggaacagcggcaacgaguggauuaccgauuuugccgggaagacggugugguucguucccucaaucaaggccggcaaugauaucgccaacugccuccggaaaaacgggaagaaggucauccagcugucccgaaaaaccuuugacaccgaguaucagaaaaccaaguugaacgacugggacuucgugguaacgacugacaucagcgagaugggagcgaacuucaaagcggaccggguuaucgacccccgccgcugccucaagccagugaucuuaaccgauggucccgagagagucauccuggcggggcccaugccuguuaccgcggccucagccgcccagcgccguggccggguugggaggaacccccagaaggagaacgaccaguauaucuucacuggacaaccccucaacaacgaugaggaccacgcccauuggacggaggcaaagaugcuccuugacaacaucaacacccccgaaggcaucaucccugcccucuucgagcccgagcgagaaaaauccgccgccaucgacggcgaguaccgccugaagggcgaaucacggaagacauucgucgagcugaugaggcgcggggaucucccugugugguuggcgcacaaagucgccuccgagggcaucaaguacaccgaccggaaguggugcuucgacgggcagcggaacaaucagauccuggaggagaauauggauguagaaaucuggacgaaggagggcgagaagaagaagcuccgcccacguugguuagacgcccgaaccuacagugauccgcuggcccuaaaggaauuuaaggacuuugccgcgggccgcaagucuaucgcccuggaccuugugaccgagaucggaaggguccccacccaccuggcgcaucgcacgcggaacgcccuggacaaccuggucaugcuccacaccuccgagcacggcgggaaggcguaccgccaugcgguggaggaacuccccgagacaauggagacucugcuccuccuagggcugaugaucuugcugacgggcggcgccaugcuguuccuuaucucgggaaaggggauaggcaagaccagcaucggguugauuugcgucaucgccucaagcgggaugcucuggauggccgaaaucccucugcaguggaucgccuccgcaauugucuuggaguucuucaugaugguacuccuaauacccgagcccgagaagcagcggacgccccaagacaaucagcucgccuacgucgugaucgggauccuuacccuggccgcaacgauagccgcgaacgagaugggccuguuagagacuacuaagcgcgaccuggguaugagcaaagagccggguguagucucccccacuagcuaccuagacguggaccuccaucccgcguccgccuggacacuguaugcaguggcgacaacggucaucaccccuaugcugcggcacacaaucgaaaacagcaccgccaauguguccuuggccgcaauugccaaccaggcgguaguccuuauggggcuggacaaagguuggcccauuagcaagauggaccucggggugccccugcucgcgcucgggugcuauucucagguuaacccccugacacuuacugcagccguucuccuccuuaucacgcauuacgccaucaucggccccggccuucaggcgaaggccacccgagaggcgcaaaagcguacugcagccgggaucaugaaaaaucccaccguggacggaauaaugacgauugacuuagaccccgugauauacgacagcaaguuugagaagcaguuaggacaggucauguugcugguguugugcgcgguacagcuccuguugaugcgaaccucaugggcgcuuugcgaggcacucacgcuugccacgggcccuaucacgaccuuaugggagggcagucccgggaaguucuggaacaccaccaucgcggugucaauggccaacaucuuccggggcucguaccuggcgggggccggccuagcauuuuccaucaugaaguccguggguaccggcaaaaggggcacggggucccagggcgagacucucggagagaaguggaagaagcgguuaaaccaguuaagcaggaaagaguucgacuuauacaagaagucugggauuaccgagguggaccggaccgaggcgaaggaggggcugaagaggggcgagaucacgcaccaugccguaucccgcggcagcgcgaaacugcaaugguucguggagcgcaacauggucauccccgaagggcgggucauagauuuagguugcggccgcggagggugguccuacuacugcgccggccugaagaaagucaccgaggugcggggcuacaccaagggcgggcccggucacgaggagcccguucccaugagcaccuauggguggaacaucgucaagcugauguccgggaaggauguguucuaccucccgccugaaaagugugacacgcugcugugcgacaucggcgagucguccccgagcccuaccgucgaggagucccgcaccauacgcgugcugaagaugguggagccguggcucaagaacaaccaguucugcaucaagguccuaaaccccuacaugccuaccguaaucgagcacuuggagcggcuccagaggaagcacggcggcaugcugguucggaauccgcugagccggaacucaacgcacgaaauguacuggaucucuaacggcaccgggaauauugucgccuccguaaacauggugucgcggcuccugcugaaccgcuucaccaugacccaucggaggccgacgaucgagaaggacgucgaccucggugcgggcacccgacacguaaaugcugagcccgagacacccaacauggaugugaucggggagcgcauaaagcggauuaaggaggagcacaacuccacguggcacuacgaugaugagaauccguacaagacgugggccuaccacggcucguacgaagucaaggccacaggguccgcgagcagcaugauuaacggcgugguaaagcugcugacgaagccgugggacguaguacccauggucacgcagauggcgaugacggacacaacccccuuuggacagcaacgcguguucaaggaaaagguggacacgcguaccccgcgcagcaugccgggcaccagacgcguaaugggcauaaccgcggaguggcucuggcguacacuagggcgcaacaagaagccccggcugugcacgcgcgaggaguucacaaagaaggugcgaacaaaugccgcuaugggagccguguucaccgaagagaaccagugggacagugccaaggccgccguggaggacgaggauuucuggaagcucguggaccgggaaagggagcugcacaagcuggggaagugcggcucgugcgucuacaacaugauggguaagcgugagaagaagcucggcgaguucggcaaggcuaaagggagccgugccaucugguacauguggcucggcgcccgcuaccucgaauuugaggccuuaggguuccugaaugaggaccacugguuuucucgcgaaaacagcuacagcggcgucgagggggagggccugcacaagcucgguuauauccugcgggacaucagcaaaauucccgggggcgccauguacgccgacgauacggcagggugggacacccgcaucacggaggacgaccugcacaacgaggagaagaucacccaacagauggacccggaacaccggcagcucgccaacgcaaucuucaagcucaccuaccagaauaaggugguuaagguccagcgccccacgcccacgggcacggugauggacaucaucucuagaaaggaccagcgaggcagcggccaggugggcaccuacgggcugaauacguucaccaacauggaggcccagcucauccggcagauggagggagagggugugcuuucuaaggccgaccuggagaacccccacuugccugagaagaagauuacccaguggcuggagaccaagggcguggaacgccugaagcggauggcuaucucuggcgaugacugcguggucaaacccaucgacgaucgauucgcuaacgcccuccuggcccucaacgacauggggaagguucggaaggacauuccgcaguggcagcccuccaagggguggcacgacuggcagcagguucccuucugcucucaccauuuucaugaguugauaaugaaggauggccguaagcuggucgugccaugucggccccaggacgaguugauaggccgcgcucggauuucccaaggcgcgggcuggagccuccgcgagacggcuugccugggcaaagccuacgcccagauguggucccugauguacuuccauagacgggacuuacgcuuagcgagcaaugccaucugcucagccgugcccgugcauugggucccgacaagccggaccaccuggagcauccaugcccaccaccaguggaugacgaccgaggauaugcugaccguguggaacagaguguggaucgaggauaaccccuggauggaggacaaaacccccguaacgacuugggaaaacguucccuaccucggaaaacgggaggaccaguggugcgggagccugaucggacuaaccagccgcgccacuugggcgcagaacauaccaaccgccauccagcagguccgaucccugaucgggaacgaggaguuccuggacuacaugccaucgaugaagcgcuuccguaaggaggaagaauccgagggagccaucugguga

SEQ ID NO: 26069 - RNA, 9873 nt, Artificial Sequence
  derived and/or modified CDS sequence (opt11) from DENV-3__FJ639810__SS-prME
accuccuuguguuuaaugaugauccuacccgcagcguuggcauuccaccuaaccucaagagacggagagccgaggaugauuguuggcaaaaacgaaaggggcaaaagccuacuuuuuaaaacugcaagcggaauaaacaugugcacacucaucgccauggaccucggagaaaugugcgacgacacggugaccuacaaauguccccacauuacggaaguagaaccugaggacaucgauugcugguguaaccucacgaguacguggguaaccuauggcacaugcaaccaagccggagaacacagacgagacaaacguagcguggcccuggccccacacguagggauggggcuggauacgaggacacaaacauggaugucagcggaaggagccuggcgucaagucgagaaagucgaaacgugggcccuacgucauccgggguucaccauacuagcacuauuccuagcccacuacauaggcacgucacucacucaaaaagugguaauauuuauacuucucaugcuugugaccccaucaaugacaaugcgcugcgugggaguuggaaaccgugacuuugucgaagggcucucgggggcaacgugggucgacguaguccuagaacauggaggaugcgucaccacaauggccaaaaacaaaccgacuuuggacauagaacuucagaaaacggaagcaacccaacuagcaacauugaggaaauuaugcauagaaggaaaaaucacaaacaucaccacagacagcagaugcccgacccagggggaagccguacucccagaggaacaagaucaaaacuacguaugcaaacacacauacguggaccggggcuggggcaacggauguggucuauucggaaaaggcucccuaguaaccugcgccaaguuccaaugcuuagagccgaucgaaggcaaagucguccaauaugagaaccugaaauacacuguaauaaucacaguccacacgggcgaccaacaccagguaggaaaugaaacccaagggguuacggcggagauaacaccgcaggcgagcacuacagaggcuaucuuacccgaauacggcacuuuaggccucgaguguucaccccgaacagggcuggacuucaacgagaugauacuacuaacgaugaaaaacaaagcauggaugguacacaggcagugguucuucgaucuuccucuuccguggacgucgggcgcgaccaccgaaacgcccaccuggaauaggaaagagcucuuaguaacguucaagaaugcccacgccaagaaacaagagguggugguacuugguucgcaagagggggcaaugcacacggcccucacaggggccacggagauccaaaacuccgggggaacaagcaucuuugccggccaucuaaagugcaggcugaagauggacaaacuggagcugaagggaaugagcuacgcaaugugcacuaacacauucguacugaagaaagaaguuucagaaacgcagcauggcacaauccugauaaaaguugaauacaaaggggaagauguaccaugcaaaauaccauuuagcacggaggacggucaaggaaaagcucacaacggucgucugauaacagcaaacccaguugugaccaagaaggaagaaccgguuaacauagaggcugaaccaccguucggcgagagcaacaucgugauaggcaucggcgacaacgcuuugaaaaucaauugguacaagaaaggaucuagcauuggaaaaauguucgaagcaacagcacgcggcgccaggcguauggcaauacuuggcgauacugcgugggacuuuggcagcguaggcgguguacuaaacucgcucgggaagaugguccaucagauauucgguucagccuacaccgcccuuuuuaguggagugagcugggucaugaaaaucggcauaggcgugcuucucacuuggauaggacucaacucuaaaaauaccagcaugaguuucagcugcauagcgauagggauaaucacacucuaccuaggcgcaguagugcaggcagacaccgggugcgucauuaauuggaagggcaaggaacugaaaugcgggucaggaaucuucgucacuaaugagguccacacguggacugaacaauauaaauuccaagccgacagccccaagcgauuagccacggccauagccggggccugggagaacggaguaugcgguauucggucuacaacgcguauggaaaaucuuuuauggaaacaaaucgcaaacgaacuuaauuauauccugugggagaacaacaucaaacugacgguaguuguuggcgacaucauaggaguucuagagcaagggaaacgcacccuaacaccucaaccaauggaauuaaaauauucauggaaaacgugggggaaagcacgaauagucacugcugaaacccaaaauagcuccuucaucauagacggacccaacacacccgagugcccuaacacgucacgcgcguggaacgucugggaagucgaggacuacggauucgggguuuucacaacaaacaucuggcuaaagcucagagaagucuacacgcaacugugugaccaccgccucauguccgcagccgucaaagacgaacgggcagugcacgccgacaugggguauuggauagaaucccagaaaaauggaucauggaagcuagagaaagcaagccucauagaagugaagaccugcaccuggccuaagucccauacccuuuggucaaacggagucuuagaaucagauaugaucauaccaaagucgcuagccggccccauuucgcagcacaacuaccggccaggcuaccacacccaaacagcgggcccuuggcacuugggcaaacuagaacuagacuucaauuacugugaagggaccacggucgugauuacagaaaacugcgggacgcguggaccauccuugcggacaaccacaguauccggcaagcugauccacgaauggugcugccgaucuugcacguuacccccacuaagguauaugggggaagacggaugcugguacgguauggaaauacgacccauuagugagaaagaagaaaauauggugaaaucacuuguauccgcaggaucgggcgaaguagacaacuucacaaugggugugcuaugucuugccauccuguuugaggagguaaugcgggggaaauucggcaagaaacauaugauagcuggaguccuguucacauucguauuacuacucagcggacagauuacguggagagacauggcucacacgcuuauaaugauaggcagcaaugccagugauaggauggguaugggcgucaccuauuuggcacuuaucgccaccuucaaaauccaacccuuccucgcccuggguuucuucuuaaggaaguuaaccucucgcgaaaaccuucuccuagggguuggccuugccauggcgacuacacugcaauuacccgaagacauagaacaaauggcaaacggaauagcgcucggccuaauggcacuuaagcugauuacccaguucgaaacguaucaauuauggaccgcacuaauaucacuuacguguuccaauacaauuuucaccuuaacuguagcauggcgcaccgcgacgcuaauccucgcuggcguaagccuccuaccagucugucaaucuucaagcaugaggaaaacggacuggcugccaaugacgguggccgcgaugggcguuccaccccuaccacucuucaucuucugccuuaaagauacacuaaaacgccgaagcuggccacuaaacgagggaguaauggcggugggacuggucucgauuuuagcaucaucucuacuaaggaacgacgugccgauggcaggcccauuggucgcaggaggccuauuaaucgccugcuacguaaucacagggacaucagcagacuuaacuguagagaaggccgcagacgugacaugggaggaggaggcggaacaaacagguguaucacacaauuuaaugauuaccguggacgacgacggaacgaugagaauuaaagaugacgagacggaaaacauacuaacagugcuacuaaaaacggcguuacuuauugucaguggcaucuuccccuacucgauucccgcgacgcuauugguguggcacaccuggcaaaaacaaacacaacggagcggaguacuuugggacgugccaagcccaccggaaacgcaaaaagcagaacuggaggaaggcguauaucguaucaaacaacaaggcauauuugggaaaacccaagucggggucggcguccaaaaagaaggcguuuuccacacuauguggcaugucacccguggggcaguccugaccuauaacgguaagcgacuagaaccaaacugggcaagcgucaagaaagaccuaauaucuuacggcggcggauggcgacucucagcacaauggcagaaaggggaagaaguacagguaaucgcaguggaacccggaaagaaucccaagaacuuucagacgaugcccgggacuuuucagaccaccacaggugaaauaggggcgauagcuuuagacuucaagccaggcacgagcggcucaccaaucauaaaccgcgaaggaaaaguggucggucuuuaugggaacggaguugucaccaaaaacggcgguuacguauccggaauagcacagacgaacgccgagcccgacgguccuaccccugaauuagaggaagaaauguuuaagaagcggaaccugacaaucauggaucuucaucccggauccggcaagacgcggaaauaucucccggcaauaguacgagaagcaauuaaacggcgccuccgcacgcucauauuagcccccacccgggucgucgcagcugagauggaagaggcgcuuaaagggcuuccaauacgguaccaaacgacggcaaccaaaucugaacauacagggagagagauaguggaucugaugugccacgcgacuuuuacaaugaggcugcucagccccgugaggguccccaauuacaaucucaucaucauggacgaagcccacuucaccgaccccgcgucgauagccgcacgaggcuauauaucuacaagaguaggaaugggcgaagcagcagcgaucuucaugacggcaacgccgcccggaacagccgacgccuucccgcaauccaacgcaccuauacaagaugaggagcgcgacaucccggaacgaagcuggaauagcggaaaugaauggauaaccgacuucgcuggaaaaacaguuugguuugucccauccaucaaggcaggaaacgacauugccaacugccugaggaaaaacggaaagaaagugauccaguuaagccguaaaaccuuugacaccgaauaccagaaaacuaaacugaacgacugggacuuuguggucaccaccgacauuucagagaugggagccaacuucaaggccgacagggucauugacccccgucgcugccucaagccggucauucuaaccgauggcccagaacgcgucauacuugcgggacccaugccaguuacggcagccagcgcagcgcaaaggcggggaagagucgggcgcaacccccaaaaagaaaaugaucaauacauuuuuacgggacaaccguuaaauaacgacgaagaucacgcacacuggacggaggccaaaaugcuucuagacaauauaaauacaccggaagggauaaugccagccuuauuugagcccgagagagagaagucggcagcgauagacggggaguaccgccucaaaggagaaagucgaaaaaccuucgucgagcucaugcggcgcggcgaccuaccaguguggcuagcccauaaaguagcguccgaggggauaaaguacacagaccggaaauggugcuucgacggccaacggaauaaccaaauccuggaggagaacauggacguggagaucuggacaaaagaaggugagaagaagaaacugaggccccgauggcuagaugccagaacguacucggacccgcucgcccucaaggaguuuaaggacuucgcagcuggccggaaaagcaucgcgcuagacuuaguuaccgaaauagggcggguccccacccaccuagcacaccguacaagaaacgcccuggacaaccuagugaugcuccacacguccgagcacggcgggaaggcguacaggcaugcuguggaagaacuaccggaaacgauggaaacccuacuucuauuaggccucaugauacuacuaaccggaggggcaaugcuguuccuuauauccggcaaagguauagggaagaccucuaucggccuaaucugugugauagccagcucaggaaugcucuggauggcagagauaccccuacaauggauagcaucagccauagucuuggaguucuuuaugaugguccuccuaaucccggaacccgaaaagcaacgaacaccgcaagacaaccaacuagccuacgucguaaucgggauccuaacccuagcugcaauaaucgcggcaaacgaaaugggccugcuagaaacaacuaagagagaucuaggcauguccaaggaaccgggaguuguuagccccacaagcuacuuagacguggaccuacauccggcaagugcguggacacuguacgcgguagccacaacaguaauaacaccaaugcuuagacacaccauagaaaauucaacagcgaacgucagcuuggccgcaauugcaaaccaggccgugguucuaaugggacuugacaaaggauggccaaucuccaaaauggaccuaggcguaccacuccuagcacugggaugcuacucucaagucaaucccuuaacacucacagcggccgugcugcuacugaucacgcacuacgccaucaucggcccaggccuccaagcgaaggcgacgcgagaggcacagaaacguaccgccgcaggcauuaugaaaaacccuacggucgaugggauaaugacaaucgaccuggacccggucauauacgauuccaaauuugagaaacaacuaggucaagugaugcuacuuguauugugcgcaguucaauuacuauugaugcgaacuuccugggcacuaugugaagcacucacccuggccacagguccuauaacuacccugugggagggcagcccgggcaaguuuuggaacaccacgaucgccgugagcauggcaaacauauuucgcgguaguuacuuagcuggagcagggcuagccuuuucaauaaugaaaucaguaggaaccgguaaacgaggaaccgggagccagggggaaacacugggcgagaaauggaaaaagaaacugaaccaacucagcagaaaggaauuugaccucuacaagaaaucaggcauaaccgagguagacagaaccgaggcgaaagaaggcuugaaaagaggcgaaaucacgcaccaugcagucagcagggggagcgccaaacuucagugguucguagagcgcaacauggucaucccggaaggucgcgucauagaucuggguugcggacgcggcggguggagcuacuacugcgccggccucaagaaaguaacagaaguccgaggcuauacgaaaggcggcccagggcacgaagaaccggucccgaugagcacguacggauggaacauaguaaagcugaugagcggcaaggacgucuuuuaccugccacccgaaaaaugugacacacuacuaugcgacaucggcgaaucaucuccuucaccuaccguugaggagucuagaacaauacggguacuuaagaugguggaaccauggcucaaaaacaaccaauuuuguauuaagguacucaauccauacaugccggcagucaucgaacaccuggaaagacuccaacgaaagcacggcgguauguuggugcggaacccccugagccggaacagcacccacgagauguacuggaucagcaaugggacagguaauauagucgcgaguguaaacauggucagccgacucuuguugaaccgcuuuacgaugacucacaggagaccgacgauagaaaaggacguagaccucggugcaggcacgcgccacguuaacgccgaaccagagacaccgaacauggaugucaucggcgagcgcauaaaacgcaucaaggaggaacacaacucaacguggcauuacgaugacgaaaauccauacaagaccugggcauaccacggcucauaugaagucaaagcuacgggaagcgccagcagcaugaucaauggagucgucaagcugcuaacaaaaccgugggacguagugccgaugguaacacagauggcgaugaccgacaccacucccuuugggcaacagcggguguucaaagaaaaagucgacacccggacgccgcgaagcaugccugggacucggcgagucaugggaaucacggccgaauggcucuggagaacgcucggacgaaacaaaaagccucgccucugcacccgggaggaguucacgaagaaaguccggaccaacgccgcgaugggggccgucuuuacagaagaaaaccaaugggacucggcgaaagccgcagucgaggacgaggacuucuggaagcucguggaccgcgagagagaacuacauaagcugggcaagugcgguagcugcguuuacaacaugaugggaaaaagagagaagaaacugggagaguucggcaaagcgaagggaucgcgggccaucugguacauguggcuuggggcgagauaccucgaguucgaggcacugggcuuccucaaugaggaccacugguucucgcgggaaaauucauauagcggcguggagggcgagggacugcacaaacucggauacauccuccgcgauauaagcaaaauccccgguggagccauguacgccgaugauaccgcaggcugggacacucgcauaacagaggacgaccuauacaacgaggagaaaauaacgcagcagauggaccccgaacaccgccagcuugccaacgcgaucuuuaagcuaacauaucagaauaaggucguaaaaguccaacgacccacucccacuggaacagucauggacauaauaaguaggaaggaccaacgagggagcggccaagugggaaccuauggccuaaacaccuucaccaacauggaagcacaacuaauccggcaaauggaaggagaaggaguauuaagcaaggcggaccuugaaaauccacaccuuccggagaagaaaauaacgcaauggcucgagaccaaaggaguugagaggcuaaagaggauggcgaucagcggagacgauugcgucgucaagcccaucgacgaccgauucgcuaacgcucuccuggcucugaacgauaugggcaaagucagaaaagacaucccccaauggcaacccaguaagggauggcacgauuggcaacagguccccuucuguagccaccacuuccacgaacucauaaugaaggaugggaggaagcuagucgucccgugccggccccaagacgagcucauuggucgcgcgcgaauuagccaaggggcaggauggucgcuacgugaaacggcaugccuuggcaaggcauaugcccaaauguggucccugauguauuuucacagacgagaccuaagacuggccagcaacgccauuugcucagcggucccgguucacuggguccccaccagcagaacaacgugguccauacacgcgcaccaccaauggaugacaacggaagacaugcugacagucuggaacagaguguggauagaagacaacccauggauggaagacaagacaccagugaccaccugggagaacguaccguaucucgggaaaagggaagaccaguggugcggcucucuaauaggcuuaaccagccgugcgacaugggcacaaaacauccccacggcaauccaacaaguucgcagccuuauagggaacgaagaguuccuagacuacaugccaagcaugaaaagguuccgcaaggaagaagagucagaaggggcaauuugguaa

SEQ ID NO: 26070 - RNA, 9873 nt, Artificial Sequence
  derived and/or modified CDS sequence (opt11) from DENV-3__FJ639816__SS-prME
accagccucugccucaugaugauacugcccgccaccuuagccuuccaccucaccagccgugacggcgaaccccggaugaucgugggcaagaacgagaggggcaagagccugcucuucaagacggcgagcgggaucaacaugugcacccucaucgccauggaccugggcgaaaugugcgacgacaccgugaccuacaagugcccccauaucaccgagguggagcccgaggacaucgacuguuggugcaaccugacaagcaccugggugaccuacgggacgugcaaccaggccggcgagcaccggagggacaagcggagcguggccuuagcgccccacgugggcauggggcuggacaccaggacccagacauggaugagcgcggagggcgccuggcgccagguggaaaaggucgagacgugggcccugcgccacccgggguucaccauucucgcccuguuccuggcccacuacaucggcaccucccucacgcagaagguggugaucuucauacugcugaugcucgucaccccgagcaugaccaugcggugcgugggugugggaaaucgcgauuuugucgagggccuauccggggccaccuggguggacgugguccuggagcacggcggaugcguuaccaccauggcuaagaacaagcccacacuggacaucgagcugcagaagacugaggccacgcaacuagccacccuacggaaguugugcaucgagggcaaaaucaccaacaucaccacggauagccgcugccccacccaaggcgaggcaguucugccagaggagcaggaccagaacuauguaugcaagcacaccuacguggaucggggguggggcaacgggugcggccucuucgggaagggcucccuggugaccugugccaaguuccaaugccuggagcccaucgagggcaagguagugcaguacgagaaccuuaaguacacugugaucauuacaguccacacuggggaucagcaccagguggggaaugagacacagggagucacggcugagaucacgccccaggccagcacuaccgaggccauucugcccgaauacggcacacucggacucgagugcuccccgcgcacggggcuggacuucaacgagaugauccugcuuaccaugaagaauaaggcguggauggugcaccggcaaugguucuucgacuuacccuuacccuggaccucgggugccaccacggagacccccaccuggaaccgcaaagagcucuuggugaccuucaagaacgcucacgcuaagaagcaagaggucguggugcuggguucccaggagggcgccaugcacacggcguuaaccggugccaccgagauccaaaacagcggcgggacauccaucuucgcaggccaucugaagugccggcuaaagauggauaagcucgagcugaaaggcaugagcuacgccaugugcacgaacaccuuugugcugaagaaggagguguccgagacccagcacgggaccauccucaucaagguggaguacaagggcgaggacgucccuugcaagauccccuucagcacugaggacgagcagggaaaggcccacaacggucgucugaucaccgcgaaccccguugucacuaaaaaggaggagcccgucaacaucgaggccgagccgccuuuuggcgagucaaacauugugaucggaaucggcgauaacgcgcuaaagaucaacugguacaaaaagggauccucgaucggcaagauguucgaggccaccgcgcgcggggcccgccggauggccauccugggcgacacagccugggacuucggcuccgucgguggcguccucaauagucuggggaagauggugcaccaaaucuucggcagcgccuacacggcgcuguucagcgggguguccugggucaugaagaucggcaucggcgugcuccugaccuggaucggccucaacagcaagaacaccuccaugucauuuucuugcauugccaucgggauuaucacgcucuaccugggggcugugguccaggccgacaugggaugcgugaucaauuggaaggguaaagagcugaagugcgggagcgggaucuucgugacgaacgagguccacaccuggacggagcaguacaaguuccaggccgacucaccgaagcgccucgcgacugccaucgccggggcuugggagaacggcgugugcgggauccgcuccacaacccggauggagaaucugcuguggaagcagauagccaaugagcucaacuacauucuuugggagaacaacauuaagcugaccguggucgugggagacaucaucgggguccucgagcaggggaagcgcacgcugacuccccagcccauggaacugaaguacagcuggaagacuugggguaaagcacggaucgucacagccgagacgcagaacagcuccuuuaucaucgacgggcccaauacaccugagugccccagcgcuucucgcgccuggaacgugugggagguggaagacuacggcuucggaguauucaccacaaacauuugguuaaagcugcgugaaguuuacacccagcugugcgaucaucgccucaugagcgcggcgguuaaggaugagcgggccgugcacgccgacaugggcuauuggaucgagucucagaagaacggcuccuggaagcuggaaaaggccagcuuaaucgaggugaagacgugcaccuggcccaagucucacacccucuggagcaacggagugcuugaguccgacaugaucauaccgaagucacuggcgggcccgauaucccagcacaacuaccgcccgggguaccacacccagaccgcuggccccuggcaccuugggaagcuugagcuggacuuuaauuacugcgagggcacaaccgucgugaucaccgagaacugcggcacgcgggggcccagccuucgcacuaccacaguuuccggcaagcugauccaugaguggugcugccggagcugcacccugccgccacuccgcuacaugggggaggacggaugcugguacggcauggagaucagacccaucuccgaaaaggaggaaaacauggucaagagccuggugucagccggcagcggagaaguugacaacuucaccauggggguccugugccuagccauccuguucgaagaggugaugcgcggaaaguucgggaagaagcacaugaucgccggcguguucuucaccuucguccuucuauuaagcgggcagaucaccuggcgggauauggcgcauacgcugauuaugauaggcagcaacgccuccgaccgcaugggcaugggagugaccuaccucgcccugaucgcuaccuuuaagauccagcccuuccuggcccucggcuucuuccugcggaagcugacgagcagagagaaccuccugcugggggugggccucgcgauggccacgacccugcaguuaccugaggacaucgagcagauggccaacggcaucgcccuugggcugauggcgcugaaacucaucacccaauucgaaaccuaccaacuuuggacggcccugaucucccugaccugcuccaacaccaucuucacguuaacagucgccuggcggaccgccacccuuauccuugccggugugagccuucugccggucugccaauccagcuccaugaggaagaccgacuggcuccccaugacgguggcggccauggggguuccgccccugccgcuuuucaucuucagccucaaggacacacuuaagcgccgaaguuggccccugaacgagggcgucauggccgugggccugguaagcauccuggccuccagcuuacugcgcaacgacguccccauggcaggccccuuaguagcgggugggcugcucaucgccugcuacgugaucaccggaacauccgcagaccugacggucgagaaagccgcagacgugacgugggaggaggaggcggagcagacgggggugagccacaaccugaugaucacgguagaugacgauggcacuaugcggauuaaggacgacgagaccgagaauauccucaccgugcuccuaaagaccgccuugcuuaucgugucagggaucuucccguacagcauccccgccacccugcucgucuggcacacuuggcagaaacaaacccaacgguccggcguccugugggacgugcccagcccgccugagacccagaaggccgagcuggaggagggggucuaucggaucaagcagcaggggaucuuugggaagacccagguggggguuggcguccagaaggaggggguuuuccacacgauguggcacgugacccgcggagccguccuuaccuacaacggcaagagacuggagcccaacugggcguccgugaagaaggaccugaucagcuacggcggcggguggcgccucuccgcccaauggcagaagggcgaggaagugcaggucaucgccguggagcccgggaagaaccccaaaaacuuccagaccaugccuggcacguuccagaccacaaccggcgagaucggggcuaucgcucucgacuucaagcccggcacgagcgggucacccaucaucaaccgggagggcaagaucgugggccuguaugggaacggcgucgugaccaagaacgggggcuacguguccgggaucgcccagaccaacgccgaaccggacggucccacccccgagcucgaggaggagauguucaagaagcgcaaucucacgaucauggaucuucaccccggcagcgguaagacccggaaguacuugccggccauuguacgcgaggccaucaagcgacgacuccggaccuugauacuggcgcccacacgcgugguggcggccgaaauggaggaggcccucaaaggccugccuaucagauaccagacgacugccaccaagucugagcacaccgggcgcgagauagucgaccugaugugccacgcgacguucacaaugcggcuccugagccccgugcgcgugccgaacuacaaccuuaucaucauggacgaggcgcacuucaccgacccggcauccaucgccgcccggggcuacaucuccacccgcguggggaugggcgaggccgccgccaucuucaugacggccacgccgccgggcaccgcggacgccuucccgcaguccaacgcccccauucaggaugaggagcgcgacauccccgagcgcagcuggaacuccgggaacgaauggaucaccgacuucgccggcaagacggugugguucgugcccagcaucaaggccgguaacgacaucgcaaacugccuccgcaagaacggaaagaaggucauccagcugucccggaagaccuucgacaccgaguaccagaagacuaagcucaacgacugggauuucguggugacgaccgauauuagcgaaaugggugccaauuuuaaggcagaccgggucaucgacccgagacgcugccucaaacccgugauccuaaccgacggucccgagcgugugauuuuagccggccccaugcccgucaccgccgcguccgccgcccagcgccggggacgcgugggccggaacccccagaaggagaacgaccaauauaucuucaccgggcagccccucaacaacgacgaagaucaugcccauuggacggaggccaagaugcugcuagacaacauaaauacccccgagggcaucaucccggcucucuucgagcccgagcgcgagaaaucugccgccaucgacggggaguaccggcugaaaggugagucccgcaagacauucguugaacugaugaggcgcggugaccucccuguauggcuggcucauaagguggccagcgaggggauuaaguacaccgaccggaagugguguuucgacggccagcgcaacaaccagauccuggaggagaacauggacgucgagauauggacgaaggagggggagaagaagaaguugcggccccgcuggcucgacgcucgcaccuauucggacccgcuggcccucaaggaguuuaaggacuuugcugcuggccgcaagagcaucgcacuggaucuggugaccgagauaggccgcgugcccacccaccucgcccaccggacgcgcaacgcccuggacaacuuggucaugcuccacaccuccgagcauggcggcaaggccuacaggcacgccguggaggaacugcccgagaccauggagacccugcuccugcuggggcuuaugauacugcugacgggcggggcgaugcuguuccucauaucaggcaagggcaucgggaagaccagcaucggccugaucugcgugaucgccucgagcgggaugcucuggauggccgagaucccgcugcaguggaucgccuccgccaucguccuagaguucuucaugauggugcuccugauccccgaacccgagaagcagaggacgccccaggauaaccagcuggcguacgugguaaucggcaucuugacccuggccgccacaaucgccgccaacgagaugggguuacuagagaccaccaaacgagaccuuggcaugagcaaggaaccgggggugguaucccccacaagcuaccuagacguugaccuccaucccgcguccgccuggacguuguacgcuguggcgacaaccgugaucacccccaugcugcgucacacaauagagaacucaaccgcgaacgucuccuuggcugcuauagccaaccaagcgguggugcugauggggcucgacaagggcuggccgaucagcaagauggaccucgggguuccucugcuggcgcucggcugcuacucucaagugaacccccugacccugaccgccgccguacugcugcugauaacgcacuacgcgauuaucgggccuggccuccaggccaaggcgacuagggaggcccagaagcgcaccgccgccggcauaaugaagaacccaaccgucgacggaaucaugacaauugaucuggaccccgugaucuaugacaguaaguucgagaagcagcugggccaaguaaugcugcugguccugugcgccguucaacuccugcugaugcggaccuccugggcgcucugcgaagcucugacccuggccacagggccuaucacgacccucugggagggcagccccggcaaguucuggaacaccaccaucgccguguccauggcgaacaucuuccgagggagcuaccuggccggcgccggguuggccuucuccgucaugaagucugugggcaccgggaaacggggcacggggucccagggggagacccucggcgagaaguggaagaagaagcugaaccagcugagccgcaaggaguuugacuuguacaagaagagcgggaucaccgagguugaccggaccgaagccaaggagggccugaagagaggggagauaacgcaucacgcggucucccggggcagcgccaagcugcagugguucguggagcgcaauauggugaucccggaaggcagagugaucgaucucgggugcggccgcggagguuggucguacuacugcgccggucugaaaaaggugaccgaggugcggggcuacaccaagggcgggcccggccacgaagagcccguccccaugaguaccuauggcuggaacauugugaagcuaauguccggcaaagacguguucuaccucccgcccgagaagugcgacacacugcugugcgacaucggagaguccuccccuagccccaccguagaggagucucgcacgauccgcgugcugaagaugguggagccgugguuaaagaacaaucaauucugcauuaagguccugaaccccuacaugcccaccgugaucgaacaccuggagcggcuccagcgcaagcacggcggcaugcuggugcggaacccucugagccgcaacuccacgcacgagauguauuggauuaguaacgggaccgggaacaucgucgcauccgugaacauggugucgagacuucugcugaaccgcuucacgaugacacaccgacgccccaccaucgagaaggacgucgaccucggggccggcaccaggcacgugaacgcugagccggagacccccaacauggacgugauaggcgaaaggaucaagcggaucaaggaggagcauaauuccacguggcacuacgacgaugagaacccguacaagacgugggccuaccacgggagcuacgagguuaaggccaccggcuccgcuagcuccaugaucaacgguguugucaagcugcugaccaagcccugggacguggugccgauggucacccaaauggccaugacugacaccacccccuucggccagcagcgcguguucaaggagaagguggacacccggacgccgaggagcaugccugggacccggcgggucaugggcaucacagcggaguggcuguggcggacucugggccgcaacaaaaaaccccggcugugcacgcgcgaggaguucaccaagaaggugcgaaccaacgccgccaugggggcaguguucacagaggaaaaccagugggauagcgcgaaagccgccgucgaggaugaggacuucuggaagcuuguggaccgggagcgcgaacugcacaagcuagguaagugcgggucgugcguguacaacaugaugggcaagcgcgagaagaaguuaggggaauucggcaaggccaagggcucucgcgccaucugguacaugugguuaggggcgcgguaucuggaguucgaggcccucggcuuccuaaacgaggaccacugguucagucgcgagaacagcuacuccggggucgagggagagggacugcauaagcucggcuacauccugcgggauaucagcaagauaccaggcggugccauguacgccgacgacacggcgggcugggacacuaggaucaccgaggacgaucugcacaacgaggagaagaucacgcagcagauggacccggagcaccggcagcucgcgaacgccaucuucaaguugaccuaccagaacaaagucgugaagguucagcggcccacucccaccgggaccguaauggauaucaucucccggaaagaucagcgcggcagcggccaagugggcacguacggucugaacacguucaccaacauggaggcgcagcucauccggcagauggaaggggagggcguacugaguaaggccgaucuggaaaacccccaccucccagagaagaagaucacccaguggcuggagaccaaggggguagagcgccuaaaaagaauggccauaagcggcgacgacugcguggucaagcccaucgaugaccgcuucgcgaacgcgcuacuggccuuaaacgacaugggcaagguccggaaggacaucccacaguggcagcccuccaagggguggcacgacuggcaacaggucccguucugcagccaccacuuccacgaguuaaucaugaaggacggucgcaagcuagucguaccaugcagaccccaagacgagcugaucgggcgcgcacggaucucucagggcgccggguggagccuccgcgagacggcgugucugggcaaggccuacgcccagauguggucccugauguauuuccaccggcgggaccuccgccuggcaagcaacgccaucugcuccgcugugcccguccacugggugccaacuagccggaccacuugguccauccacgcccaccaccaguggaugacgaccgaagacaugcuuaccgucuggaaccgcguguggaucgaggacaaucccuggauggaggacaagacuccugugacgaccugggagaacgugccguaccugggcaagcgcgaggaccaguggugcgggagcuuaaucgggcugaccagccgugccaccugggcccagaacauuccgacagcgauccagcaggucaggucccucaucgggaacgaggaauuccuggauuacaugcccaguaugaagcgcuuccggaaggaagaggaauccgaaggagccaucugguga

SEQ ID NO: 26071 - RNA, 9873 nt, Artificial Sequence
  derived and/or modified CDS sequence (opt11) from DENV-3__FJ639817__SS-prME
accucacugugccucaugaugauucugcccgcggcccuggcguuccaucucacuucucgcgacggugagccccggaugauaguggggaagaacgagcgaggcaaaucucuacuguuuaagaccgccagcgggaucaacaugugcacacucaucgcgauggaccuaggggagaugugcgacgacaccguuaccuacaagugcccccacaucacggagguggagcccgaggacaucgacugcuggugcaaccuaaccucuaccugggugacuuacgggacgugcaaccaggccggugaacaccggcgcgauaaaaggagcgucgcccuagccccucacgugggcaugggccuggacacccguacccagacguggaugagcgccgagggcgccuggagacagguggagaaagucgaaacgugggcccugcgccaccccggguucaccauccucgcacucuuccuggcccacuauaucggcaccucgcuaacucaaaaggucgucaucuucauccucuugaugcucgugacgccuuccaugaccaugcggugcgugggggugggcaacagggacuucgucgagggccugucgggggcuacguggguggacgugguucuggagcacggcgguugcguuaccacgauggccaagaacaagcccacccucgacaucgagcugcagaagaccgaggccacccagcuggcuacacuccggaagcuaugcaucgagggcaaaaucacaaacguuaccaccgacuccaggugccccacgcaaggugaggccguucugccggaggaacaggaucagaacuaugugugcaagcacacauacguggaccggggcuggggcaacgggugcggccucuuugggaaaggcucccugguuacaugcgccaaguuccagugucuggagccuauugaggguaaagugguacaguacgagaaccucaaauacacaguaauuaucacggugcacacuggggaucagcaccaggucggcaacgaaacccaaggggugaccgccgaaauaacgccgcaggcuuccaccacggaagcgauccugcccgaguauggcacucucggucucgaguguagcccccggaccggucuggauuucaacgagaugauccuucucacgaugaaaaacaaggccuggauggugcaccggcaaugguucuuugaucugccucucccguggacgucuggcgccacuacugagacgcccacauggaaccgcaaggaguuacuggugaccuucaagaaugcgcacgccaagaagcaggagguggugguucuggggucccaggagggcgcgaugcacacggcgcucacgggggcgaccgagauucagaacagcggcggaacguccaucuucgccggccaccugaagugccgccugaaaauggacaaguuagagcugaaaggcaugagcuacgcaaugugcaccaauacguucgugcucaagaaagagguauccgagacgcagcacgggacuauccucauaaaagucgaguacaagggagaggacgugccgugcaagaucccguucucgacggaggacgggcaggggaaggcgcacaacggccgccugauaacggccaacccugucgucacgaagaaggaggagcccgucaacauugaggccgaaccgcccuucggugagagcaauaucgugaucggcaucggggacaaugccuuaaagaucaacugguacaagaaagguuccagcaucgggaagauguucgaagcuaccgcccguggggcucgacggauggccauccugggcgauacagcuugggacuucgguuccgucgggggcguacucaacagccuaggcaagaugguacaccagaucuuuggguccgcguauaccgcacuguucagcggcgucuccugggugaugaagaucgguauuggggugcugcugacuuggaucggccugaacagccgcaacacuuccaugagcuucuccuguauagccaucgggaucauaacauuauaucugggcgccgugguacaggccgacauggggugcgugaucaacuggaaggggaaggagcugaagugcggcagcggcauuuucgucacgaacgagguacacaccuggaccgagcaguacaaguuucaggcggacucuccgaagcgccucgcaaccgccauugccggcgccugggaaaacggggugugcggcauccggagcaccacccgcauggagaaucugcuguggaaacagauagcaaaugagcucaacuauauccucugggagaacaacaucaaacuaacaguaguuguuggggacaucauaggaguguuagagcagggcaagcggacacugacgccccagccgauggagcugaaauacuccuggaagaccugggggaaggccaagaucgugaccgcggagacucagaacagcuccuucaucaucgacggccccaacacgcccgagugcccgagcgccucucgcgcguggaacgugugggaagucgaggauuacggguucggcguuuucaccaccaacaucuggcucaaguuacgggaggucuacacccaacugugcgaccaccgccucaugagcgccgccguuaaggacgagcgggccgugcaugccgacaugggcuacuggauugagagccagaagaacggauccuggaagcuggagaaggcaagccugauugaggugaagaccugcacguggccgaagucucacacccucuggagcaauggcguccuggaguccgauaugauaauccccaaaagccuggcggggccaaucucccagcacaacuaccggccuggcuaccacacacagaccgccgguccguggcaccucggcaagcuggaguuagacuuuaacuacugcgaaggcacgaccgugguuauaaccgaaaacugugguacucggggccccagccuccgcacgaccaccguguccgggaaguugauccacgagugguguugccggagcugcacccugcccccgcuccgcuacaugggcgaagacgggugcugguauggcauggagauccguccgaucuccgagaaggaggagaacauggucaaaagccuuguguccgcugggagcggggaggucgacaacuucacgaugggggugcucugccuagcuauccuguucgaagaggugaugcgggggaaguucggcaagaaacacaugaucgcagggguauucuucaccuucgugcugcuccugucuggccagaucaccuggcgggacauggcccacacccucaucaugaucgguagcaacgcaucggaccgcauggggaugggcgugaccuacuuggcccugaucgccaccuucaagauucagccguuccuugcgcuaggguucuuccuucggaagcugaccucacgcgagaacuuacuguugggaguaggcuuagccauggcuacuacucugcagcugcccgaggauaucgagcaaauggccaacgggaucgcgcucggccugauggcgcucaagcucaucacccaguucgagaccuaccaguuguggaccgcacugauuagccuaacgugcuccaauacaauuuucacccuuacgguggccuggcggacggccacccugauccucgcugggguaucgcugcugcccguaugccagagcagcucuaugcgcaagacugacugguugcccaugaccguggcugcaaugggcgugccuccuuugccacuguuuauuuucagccucaaagauacucugaagagacgguccuggccccugaacgagggggugauggcaguggggcucgucagcauccuggcuuccagccugcuccgcaacgacgugccuauggcuggcccccugguggccgggggccuguugaucgcuugcuacgucauaaccgggaccuccgccgaccugacgguggagaaggccgcggacgucacaugggaagaggaggccgagcagaccggcguaagccacaaccugaugauuaccguagacgacgacgggaccaugcggaucaaggacgacgagaccgaaaauauccuuacggucuugcugaagacagcacuccugaucguauccggcaucuucccguacuccauaccagccacccugcucguauggcacaccuggcagaagcagacgcagcgcuccggcguguuaugggauguaccuagcccgcccgagacccagaaggcggagcuugaggaggggguguaccggaucaagcagcagggcaucuucgggaagacccaaguggggguugggguccaaaaagagggaguguuucacaccauguggcacgugacgcgcggcgcggugcucaccuacaacgggaagcggcuggagcccaauugggccagcgugaagaaggaccugauaagcuacggcggcggguggcgccucagugcccaguggcagaaaggggaggaggugcaagugauagcggucgagccugggaagaaucccaagaacuuucagaccaugccuggcaccuuccagacgacaacgggagagaucggugcgaucgcgcuggacuucaagccagggaccagcggcagcccuaucaucaaccgggagggaaagguaguggggcuguacgggaacgggguggucacaaagaacggcggguacguguccgguauugcccaaaccaaugccgagcccgacggaccuacacccgagcuggaggaggaaauguucaagaagcgcaaccucaccaucauggaucugcaccccgggagcgggaaaacgcggaaguaccugccugccaucgugcgcgaagcgaucaagcggcgccuccggacgcugauacuugcccccacuagagucguggcagcggagauggaggaggccuugaaggggcugccaauccgguaccagaccacggcgaccaaguccgagcauaccggccgcgagaucguagaccugaugugccacgccaccuucacgaugcgacugcugagcccaguccgcguaccaaauuacaaccugauuaucauggacgaggcacacuucacggaccccgcuucaaucgccgcgcggggguacaucuccacucgugugggcaugggcgaagccgccgcgaucuucaugacagcgacgccgcccgggacggcggacgccuucccgcaguccaacgcgcccauccaagacgaggagcgcgacauacccgaacggagcuggaacuccggaaacgaguggaucaccgacuucgccgggaagaccgucugguucgugccgucgaucaaggcgggcaacgacaucgccaauugcuuaaggaagaacgggaagaaagugauucagcugucccgaaaaacguucgacaccgaguaccagaaaaccaaacugaacgacugggacuucgucguuacgacggacaucagcgagaugggggccaauuucaaagcagaccgcgugaucgacccgcggcgcugccucaagcccgucauccugaccgacggccccgagcgggugauccuggccgguccuaugccggugaccgcggccuccgcagcccagcgccggggccgcgucgggcggaauccgcagaaagagaaugaccaguauaucuucaccggccagccucucaacaacgaugaggaccacgcacacuggacugaggcgaaaauguugcuggacaauaucaacacgcccgaggggaucaucccggcccuguucgagccagagcgugagaaguccgccgccauagacggcgaguaucggcugaaaggagagucccggaagaccuucguggagcuaaugaggcgcggggaccucccggucuggcuggcucauaaggucgccagcgagggcauuaaguacaccgaccggaaguggugcuucgacgggcagcgcaacaaucagauccuggaggagaacauggacguggaaauuuggaccaaggagggcgagaagaagaaacuccggccccgcuggcuugaugcucgcacguacuccgacccauuggcccuuaaagaguucaaagauuucgccgccggcaggaagaguaucgcccuugaucuggucaccgagauugggcgcgugcccacccaccucgcccaccguacacgcaacgcccuggacaaucugguuaugcuccacacauccgagcauggcgggaaagccuaccggcacgcggucgaggagcugcccgaaaccauggagaccuuacuccugcugggccuuaugauccugcugaccgggggcgccauguuauuccugaucagcgguaagggaaucggcaaaacaagcaucgggcugauaugcgugaucgccuccagcggcauguuguggauggccgaaaucccgcugcaauggauugccuccgcgaucgugcuagaguucuucaugauggucuuacugauccccgagcccgagaagcagcgcacgccccaagacaaccagcuggccuacguggugaucggcauccucaccuuggcagccaucaucgcggcgaacgaaaugggccugcucgagaccaccaaaagagaccugggcaugucaagggagccggggguaguguccccaaccucauaucuggacguugaccuccaccccgccucggccuggacccuguaugccguggccacuacggugaucacccccaugcugcggcacacuaucgagaacagcaccgcuaacgucucgcucgcagcgaucgccaaccaggcggucgugcugaugggccuggacaagggguggcccaucagcaagauggaccucgguguuccccuccuggcccucggguguuacucccaggucaacccgcugacacugaccgcggccgugcuccuccugaucacccacuaugccaucaucggccccggccuccaggcgaaggccacccgcgaggcccaaaagcggacggcagcugggaucaugaagaauccgaccguugacggcaucaugaccaucgaccuggaccccgucauauaugacagcaaguucgaaaagcagcugggccaggucaugcucuugguguuaugcgcugugcagcuccugcugaugcgcacgaguugggcacuuugcgaggcacuaacgcuggccaccggccccauuaccacgcucugggagggcagccccggaaaguuuuggaacacgaccaucgcgguguccauggccaacaucuuccguggcagcuaccuggccggagccggccuggcauucaguauuaugaaguccgugggcacuggcaagcgcggcaccgggucccagggcgagacccucggagagaaguggaagaagaagcugaaccagcuuagcaggaaagaguucgaccucuacaagaaaagcggaaucacggagguggaccgcacugaggcuaaggaggggcuuaagagaggggaaauaacccaccacgccgugucaagaggcagugccaagcugcagugguuugucgagcggaacauggucauaccggaggggcgcgugauugaccugggcugcgggcggggcgggugguccuacuacugugccggccugaagaaggugaccgagguccggggcuauacgaagggcggaccgggucacgaagaacccgucccuaugagcaccuacggcuggaauaucgugaagcugauguccgggaaggauguauuuuaccuaccgcccgagaagugcgacacccugcugugcgacauuggcgaaagcucccccucacccaccguugaggagucccgcacgauucgggugcuuaagaugguagagccguggcucaagaacaaccaguucuguaucaaggugcugaaucccuacaugccggccguuaucgagcaucuggagcgccuccagagaaagcacggagguaugcugguccggaacccccugagcagaaacuccacccacgaaauguacuggaucagcaauggcaccgguaacauugucgcguccguuaacauggucagccggcuccugcugaaccgauuuaccaugacgcaccgccgcccgaccaucgaaaaggauguggacuuaggcgccgguaccaggcaugugaaugccgagccagagacuccuaacauggacgucaucggugagcggaucaagaggaucaaggaggagcacaauuccacguggcacuacgacgacgagaacccguacaaaaccugggcuuaucauggcagcuacgagguuaaggcgaccggguccgcguccuccaugaucaacggggucgugaaacugcugaccaagcccugggacgugguccccauggugacgcaaauggcaaugacagacaccaccccauucgggcagcagcgaguguucaaagagaaggucgacacgcgcaccccgcggagcaugcccggcacccgccgggugaugggaaucaccgcagaguggcucuggcgcacacuggggcggaacaaaaagccucgucuguguacccgcgaggaguuuaccaagaaagugcggaccaacgccgcgaugggcgccgucuuuacggaggagaaccaaugggacucggccaaggcagccguggaggacgaggacuucuggaagcuaguggaccgcgagcgggaguuacacaaauuggggaagugcggguccugcgucuacaacaugaugggaaaacgcgagaagaagcugggcgaguucggcaaggcgaaggggagccgagcgaucugguacauguggcugggcgcccgcuaccucgaguucgaggcgcucggguuccugaaugaggaccacugguucucccgggagaacagcuacuccggaguggagggggagggccugcacaagcucggcuacauccugcgcgacauuagcaagaucccaggaggggccauguaugcugacgacaccgccggaugggacacccggaucaccgaggacgaccugcacaacgaggagaagaucacgcaacagauggauccggagcacagacagcucgccaaugccaucuucaagcugacuuaccagaacaaaguggucaaggugcagcggccaaccccuacuggcaccgugauggacauuauuucccgcaaggaccagaggggaucuggacagguggggacguaugggcuaaacaccuucaccaacauggaggcccaauugaucagacagauggagggggagggcguguugaguaaggcggaccuggagaacccccaucucccggagaagaagaucacccaguggcuggagacgaagggcguugagcggcugaagcgcauggccaucuccggcgacgacugcgucguaaaacccaucgacgaccgguucgccaacgcccuccuggcccugaacgacauggggaagguacgcaaggauaucccgcaguggcaacccuccaaggguuggcacgacuggcagcagguaccguuuugcagccaccacuuccacgagcuuaucaugaaggauggacgcaagcuagucgucccuugcaggccucaggacgaacugaucggccgggcgcgcaucucgcagggggcgggguggagucugcgagagacagccugccugggcaaggccuacgcgcaaauguggucccugauguauuuccacagacgcgaccuccgacuggcuagcaaugcgaucugcuccgcaguccccgugcacugggugccuacaagucgcaccacauggagcauccacgcacaccaccaguggaugaccaccgaggacaugcugaccgucuggaaccgcguguggaucgaggacaaucccuggauggaggacaagacgccggugacgaccugggagaacguuccguaccuagguaaacgcgaggaccagugguguggaagccugaucgggcugacgaguagggcgacuugggcgcagaacaucccgaccgccauccaacaggucaggucccucaucgggaacgaggaguuccuggauuacaugccgagcaugaagcgguuccgcaaagaggaggaauccgagggggccauaugguga

SEQ ID NO: 26072 - RNA, 9873 nt, Artificial Sequence
  derived and/or modified CDS sequence (opt11) from DENV-3__FJ639825__SS-prME
accagccugugccucaugaugauccugcccgccgcccuggcguuccaccucaccucccgggacggggagccgcgcaugaucgucggaaaaaacgaacguggcaagagccugcuguuuaagaccgccuccgggaucaauaugugcacccucaucgccauggaccugggcgagaugugcgacgacaccguuaccuacaagugcccgcacaucaccgagguugagccagaggacauugacugcugguguaacuugaccagcaccugggugaccuacgggaccugcaaccaggccggcgagcaucggcgcgacaagcgguccguugcucucgcgccacacgugggcauggggcuagauacccgcacccagaccuggaugagcgccgagggggcguggcggcagguggagaaagucgagacgugggcccugcgccaccccggguucacuauccuugcgcuguuccuggcccauuauaucggcaccucccucacccagaagguggugauauucauccugcugaugcuagucacgcccagcaugaccaugcggugcguaggggugggcaaccgugacuuugucgaagggcuguccggggccaccuggguggacguggucuuggagcacggcgggugugugacuaccauggcgaagaacaagccuacccucgacaucgaacugcagaaaaccgaggcaacccaacuggcgacgcuccggaagcugugcaucgaaggcaagaucaccaacaucaccaccgacagccgcugccccacgcagggcgaggccguccugccggaggaacaggaucagaacuacgucugcaagcacacuuauguggaccggggguggggcaacgggugcggccucuucgggaaaggcucccuggugaccugcgccaaauuccagugccuggagcccauugagggcaaggucguucaguacgagaaccuaaaguacacagugaucauuacgguacacaccggggaccagcaucaggucggaaacgagacccagggggucaccgcugagaucacgccucaggccagcaccacggaggcaauccugcccgaguauggcaccuugggucucgagugcagcccccgcaccggccuggacuucaacgagaugauccugcuaacgaugaagaacaaagccuggauggugcaccggcagugguucuucgaccugccccuacccuggaccagcggcgccaccacggagacgccaaccuggaacaggaaagagcuucuggucaccuuuaagaaugcccaugccaaaaagcaggaggucguggugcuggguagucaggagggcgcgaugcacaccgcccucacgggggccaccgagauccagaacagcggcgggacgaguaucuuugccggccaccugaagugucgccugaagauggacaaguuagagcugaagggcaugagcuacgcuaugugcaccaacacguucguacugaagaaagagguguccgagacccagcacgggaccauucucaucaagguggacuacaagggcgaggacguucccugcaagauccccuucagcaccgaggacgggcagggcaaggcgcauaacggacgccugauaacugcgaaccccguggucacuaagaaagaggagcccgucaacaucgaggccgagccacccuuuggggagagcaauaucgugaucggcauuggugauaacgcccugaaaauuaacugguacaagaagggaucgagcaucggcaagauguucgaggcgaccgcccggggcgcgcgccggauggccaucuuaggcgacacggccugggacuucggguccgugggugggguccucaacagccugggcaagauggugcaccagaucuucggguccgcguacacggcccuauucagcggagugucuugggucaugaagaucggcaucgguguacuccugaccuggaucgggcugaauagcaagaacaccuccaugagcuucuccugcaucgccaucgggaucauuacccuguaccugggcgcggugguacaggccgauacggggugcguuaucaacuggaagggcaaggagcugaagugcggcagcgggaucuucgugaccaacgagguucacaccuggaccgagcaguacaaguuccaggcggacuccccuaaacgccucgccacggccaucgccggagccugggagaacgggguaugcgggauacgcagcaccacacggauggagaacuugcuguggaagcagaucgcgaacgagcucaacuacauccugugggagaacaacaucaaguugaccguggucguuggggauaucaucggcguauuggagcagggcaagcgcacgcugacgccccaaccgauggagcugaaguacuccuggaaaaccugggggaaggccaagaucgucaccgccgagacgcagaauagcuccuucauaaucgacggccccaacacccccgagugccccagcgccucacgggccuggaacguuugggagguggaggacuacggguucggcgucuucaccacuaacaucugguuaaagcugagagagguauacacccagcagugcgaccaccggcugaugagugccgccgugaaagacgagcgcgccguccacgccgauaugggcuacuggaucgagagccagaagaacggcucuuggaagcucgagaaggcuagccugauagagguaaagacgugcaccuggccgaagagccauacccugugguccaacggagugcuagagucugacaugaucauccccaaaagccuggccgggccuaucucucagcacaacuaucggccgggcuaucacacacagacugcugggcccuggcaccugggcaagcucgagcuggacuucaacuacugcgagggcaccaccgucgucaucaccgaaaacugugggacgaggggucccucgcugagaaccaccaccguauccgguaaacucauacacgaguggugcugcaggagcugcacccugcccccguuacgauacaugggcgaggacgggugcugguacggcauggagauucgucccaucagugagaaggaagagaacauggucaagagccuggucuccgccggcucuggggagguggacaauuucaccauggguguccugugccuggccaucuuguucgaggaggugaugcgggguaaguucggcaagaagcacaugaucgcggggguguucuucaccuucguccugcugcucagcggccagaucacauggcgcgauauggcucacacccuaaucaugaucggcuccaacgccucagaccggauggggaugggcgugaccuacuuagcccucaucgccacuuucaaaauccagcccuucuuggcgcugggauucuuucuccgcaaguugaccagccgggaaaaccuguuacugggcgugggccuggccauggcuacgacccuacagcugcccgaggauaucgagcagauggccaacggaaucgcgcucgggcucauggcccugaaacuaaucacacaguucgagacauaccagcucuggacggcacucauaagccugaccugcuccaacaccaucuucacccucacggucgccuggcgcacggccacccugaucuuggcugggguuagccuccugcccgucugccaguccagcuccaugcggaagaccgacuggcugcccaugacgguggcggccaugggcgugcccccccucccgcuguucaucuucucgcucaaggacacccucaagcggcgcuccuggccacuaaacgaggggguaauggcaguaggccuggugagcaucuuagcgucaucacugcugcggaacgacguaccuauggcuggcccccucguggccgggggccugcugaucgccugcuacgugaucacggggaccuccgccgaucucacggucgagaaggccgcggacgugaccugggaggaggaggccgagcagacgggugucagccacaaccugaugaucaccgucgacgacgacgggaccaugcgcauaaaggacgacgagacggagaacauccugacagugcuacugaagaccgcccugcucauugugucgggcaucuucccguacagcauccccgccacacuccuggucuggcacacguggcagaaacagacccagagauccggcgugcucugggacguccccaguccgcccgagacccagaaggcugaguuggaagagggagucuacaggaucaaacagcagggcauuuucgggaagacccaagugggcguagggguacagaaggagggcguguuucacacgauguggcacgugacccggggcgcgguccugaccuacaacgggaagcgccuggagcccaacugggccuccgugaagaaggaccugaucagcuacggcgggggcuggcggcugucagcccaguggcagaaaggggaggaaguccaggucaucgccguugagcccggcaaaaaccccaagaauuuccaaaccaugcccggcacguuccagacuaccaccggggagauaggcgcgauagcccucgacuucaaacccgggacgagcggcagccccaucauuaaccgcgagggcaagguugucgggcuuuacggcaacgggguggugaccaagaacgggggguacgucaguggcaucgcccagaccaaugcagagccggacggaccuacccccgagcuggaagaggagauguucaagaagcggaaucucaccauuauggaccuucacccagggagcggcaaaacccgcaaguaccugccugccaucguccgggaggcgauaaagcgccggcugcgcacccucauccuggcccccacccgcgugguagcggccgagauggaggaggcccucaagggacuccccauacgcuaccagacgaccgcaacaaagagugagcacaccggccgggagauuguggaccucaugugucacgccacuuucaccaugcgacugcuaagucccgugcgggucccgaacuacaaccuaaucauaauggacgaggcccauuucaccgaccccgccuccaucgccgcgcgcggguauaucuccacccggguggggaugggcgaggccgccgcgaucuucaugacggcgacgccaccaggaaccgccgacgccuucccgcaguccaacgcccccauccaagacgaggagcgagacaucccagagcgcaguuggaacucgggcaacgaguggaucaccgauuuugcagggaaaacgguaugguuuguuccaaguauuaaggcgggcaacgacauagccaacugcuugcggaagaauggcaagaaggugauccagcucucucgcaagaccuucgacaccgaguaccagaagaccaagcugaacgacugggacuucguggucacgacggacaucucggagaugggcgcaaacuucaaggccgaccgggugaucgauccccgacggugcuugaagccagugauccucaccgacgggcccgagcgcguaauccuggccgggcccaugccggugaccgcggcaagcgccgcacagcgacgcggccggguggggaggaacccccagaaggagaacgaccaguauauuuucaccggccagccccucaacaacgacgaggaccacgcccacuggacagaggcgaagaugcuccuggacaacaucaauacccccgaggggaucaucccggcccuguucgagcccgagcgggagaaaucagcagccaucgacggcgaauaccgcuugaagggcgagucccggaagaccuucgucgagcugaugcgccgcggagaccuucccguguggcucgcccacaaggucgccagcgagggcauaaaguauaccgacagaaaguggugcuucgacgggcaacggaacaaccagauccuggaagagaacauggacguggagauauggacgaaggagggcgaaaaaaaaaaacugcgcccccgguggcucgacgcccgaaccuacuccgacccgcuggcccugaaagaguucaaggacuucgccgcgggccgcaagaguaucgccuuggaccuaguaaccgagaucgggagaguaccuucccaucuggcccaccgcacccggaaugcccucgacaaucuggugaugcuucauacgagcgagcacggcgggaaggccuaccgucacgccguggaggaacuccccgaaacaauggagacccuguuacuccuaggucuaaugauccuccugacugggggcgccaugcuguuccucaucagcggcaaggggauuggcaagacguccauagggcugaucugugucauagccucaucaggcaugcuguggauggccgagaucccgcuucaguggauugccuccgcgaucgugcuggaguucuucaugauggugcugcucauccccgagcccgagaagcagcggacaccccaagauaaccagcuggcuuacgucguuauagggauccugacacucgccgccauuauugcugcaaacgagaugggacugcuggagaccacgaagcgcgaccucggcauguccaaggagccggggguagucucccccaccucguaccuggacguggaccugcacccggcaagcgccuggacucucuacgccguggcgacgacggucaucacccccaugcugcggcacaccaucgagaacucaacggcgaacgucagccuugccgccaucgcgaaccaggcgguaguccucaugggcuuagacaagggguggccgaucuccaagauggaucugggggugccccuccuggcccuggggugcuacagccaggugaacccccucacgcugacugccgccguccuguuauuaaucacccacuacgccaucaucggcccagguuuacaggcgaaggccacacgcgaggcccagaagcggacggccgccgggauuaugaaaaacccaaccguagacggcauaaugaccaucgaccucgaccccgugauuuaugacucuaaauucgaaaagcagcuggggcaggucaugcuccucgugcugugcgcggugcagcugcuccugaugcgcaccucaugggcccugugugaggcccucacgcucgccaccggccccaucaccacccugugggagggcucccccgggaaauucuggaacacgaccaucgcaguaagcauggccaacaucuuccggggguccuaucucgccggggccgggcuggccuucaguaucaugaaguccguggggacaggaaagcgcgggaccgggagucagggcgagacccugggggagaaguggaagaagaagcucaaucaacugucaagaaaggaguuugaccuguacaagaaguccggcaucacggaaguggaccgcaccgaagcgaaggagggguugaaaagaggggagaucacucaccacgcagucagccgcggaagugccaagcugcagugguucguggagagaaauauggugaucccggaggggcguguaaucgaccugggcugugggcggggcggguggagcuacuacugcgccggccucaagaaggugaccgaagugcgcggauacacgaagggcgggcccgggcacgaggagcccguccccauguccaccuacggcuggaacauaguaaagcucaugagugggaaagauguguucuacuuaccgcccgagaagugcgacacccuccugugcgacaucggcgaguccagccccagccccaccgucgaggaaagccggacgauccgcguucugaagaugguggagccuuggcuuaagaacaaccaguucugcaucaagguacucaaccccuacaugccgaccgugaucgagcaccuugagcgucugcagaggaagcacggcgggaugcucgugcgcaacccccuaucccggaacucgacgcacgaaauguacuggauuuccaacggcaccgggaacaucguggccagugugaacauggucucccgccugcuccuaaaucgguucacgaugacgcaccgcagaccgacaauugagaaggacguggaucugggcgcgggcaccagacacgugaacgccgagccagaaacgcccaacauggacgugaucggugagcggaucaagcgcaucaaggaggaacacaacagcaccuggcacuacgacgacgagaacccguacaagaccugggccuaccacgggucauaugaaguaaaggcgacggggagcgccagcagcaugaucaacggcgugguaaaauugcugacgaagcccugggacguugugcccaugguuacccagauggcgaugaccgacaccacgcccuucgggcagcagcgaguguucaaggagaagguggacacccgcaccccgcgcagcaugccaggcaccagacgagucauggggaucacggccgaguggcuuuggcgcacccucgggcggaacaagaagcccagacugugcacccgggaagaauuuacgaagaaggugcgcacgaacgccgccaugggcgcgguguucaccgaggaaaaccaaugggacucggccaaggccgcugucgaagacgaggacuucuggaagcugguggaccgcgagcgggagcuccacaagcuggggaaaugcggaucgugcguguacaacaugauggguaaacgcgagaaaaagcugggcgaguucgggaaggccaaggggucacgggcgauuugguacauguggcucggagcccgcuaccuggaguucgaggcccuggguuuccugaacgaggaucacugguucucgcgggagaacuccuacagcggaguggagggggaaggcuugcauaagcuuggguacauccucagggacaucagcaagauccccgggggcgccauguacgccgacgacacagcgggaugggacacccggaucacagaggacgacuugcacaacgaggagaagaucacacaacagauggacccggagcacaagcagcuggcuaacgccaucuucaaacugaccuaccaaaacaagguggucaagguccaacgccccacccccacaggcacgguaauggacaucaucucacggaaggaccagcgcggguccggccaggugggcacauacgggcugaauacauucacaaauauggaggcgcagcugauccggcagauggagggcgaagguguacucagcaaggccgaucuggaaaacccgcaucucccagagaaaaagauuacgcaguggcuggagaccaagggcguugagcgccugaagcggauggcuauauccggcgacgacugcguggucaagcccauugaugauagauucgccaaugcucuucucgcccugaaugacauggggaaggugcggaaggacauaccccaguggcagcccagcaagggcuggcacgacuggcagcaagucccguucugcucccaccacuuccacgagcugaucaugaaggacgggcgcaaacuaguagugcccugccggccccaggacgaguugauuggccgcgcccggaucagccagggugcgggcuggucccugcgcgagaccgccugccugggcaaggccuacgcccagauguggagccugauguacuuccaccggagggaccugcgcuuagcguccaacgccaucuguagcgccguccccguccacugggucccgaccuccaggacaacuuggagcauccacgcccaccaccaguggaugaccaccgaggacaugcugacuguguggaacagagucuggaucgaggacaaccccuggauggaggacaagacccccgugaccaccugggagaacgugcccuaccuggggaagcgggaggaucagugguguggcagccucauagggcuuacgucccgcgccaccugggcccagaacaucccgaccgcaauccagcaaguucggagccugaucggcaacgaagaauuccuagacuacaugcccuccaugaagcgcuuccggaaggaagaggagagcgagggggcgaucugguga

SEQ ID NO: 26073 - RNA, 9873 nt, Artificial Sequence
  derived and/or modified CDS sequence (opt11) from DENV-3__FJ639826__SS-prME
acaagccucugccucaugaugauccuacccgcggcccuggcguuccaccucacuagccgggacggcgagccgcggaugaucguggggaagaacgaacgcggcaagagccugcuauucaagacagccucugggaucaacaugugcacccucauugcaauggaccugggggagaugugcgacgacacgguuaccuacaagugcccccacauaacagagguggagcccgaggacaucgacuguuggugcaaccugacaagcaccugggugaccuaugggacuugcaaccaggccggcgagcaccggagggacaagcgguccgucgcccucgcgccgcacguuggcauggggcuggacaccaggacgcagacauggaugucugcagagggcgccuggcgccagguggagaaggucgagacgugggccuuacgccaucccggguucaccauccucgcguuguuucuggcccacuacauuggcaccucccugacccagaaggugguaaucuuuauccugcugaugcucgucacgcccagcaugaccaugcggugcguuggugugggaaaccgggacuucgucgagggccuguccggugccaccuggguagacgucguccuggagcacggcgggugcgugaccacgauggccaagaauaagcccacccucgacaucgaacuucagaagaccgaggccacccagcuggcgacgcuccggaaguugugcauagagggcaagaucaccaacaucaccaccgacagccgcugccccacgcagggcgaggccguguuaccggaagagcaggaccagaacuacgucugcaagcacacuuacguggaccgggggugggguaacgggugcggccucuucgggaaggggucccuggugaccugcgccaaguuccagugccuggagcccaucgaggguaaggucgugcaauacgaaaaccucaaauacaccgugauuaucacaguucauacgggggaccagcaccaggugggcaacgagacccagggugucaccgccgagaucacuccccaggccagcacgaccgaggcgauccugcccgaguacgggacccuagggcucgagugcuccccacgcaccggccucgauuuuaacgagaugauccugcucacgaugaaaaauaaagccuggauggugcaccggcagugguucuucgaccugccucugcccuggaccagcggcgcaacgaccgagacgcccaccuggaaccgcaaggagcuccugguuaccuucaagaacgcucacgccaaaaagcaggaggucguuguacuugggucccaggagggugcgaugcacacggcccucacgggggccacagagauacagaacuccgggggcaccagcauuuucgccggccaccugaagugcagacuaaagauggacaagcucgagcugaagggcaugagcuacgcgaugugcacaaacacguucguccugaagaaggaggucuccgagacacagcacgggacaauacucaucaagguggaguacaagggcgaggaugucccgugcaagauccccuucucaaccgaggaugggcaggguaaggcccacaacggccgccugaucacagccaaccccguugugaccaagaaagaggagcccgucaacaucgaagccgaaccgcccuucggggagucgaacaucgugaucggcauuggggacaacgcccugaagaucaacugguacaagaaaggcucaagcaucgggaagauguucgaggcgaccgcccggggcgcccgccggauggccauccugggugacaccgccugggacuucgguuccgugggcggaguucucaacagccugggcaagauggugcaccagauuuucgguagugcguacacggcccuguucucaggcguguccugggugaugaagaucggcaucgggguguuacugaccuggauaggccugaacagcaagaacaccuccaugagcuucagcugcaucgccaucggaauaaucacccucuaccugggcgccgugguucaagcugacaccgggugugugaucaacuggaagggcaaggagcugaaaugcgguagcgggaucuucgugaccaacgagguccacaccuggaccgaacaguacaaauuccaggcggacuccccgaagcgccucgcuacggccaucgccggcgccugggagaauggggugugcggcauacgcagcaccacccggauggagaaccugcuguggaagcaaaucgccaacgagcucaacuacauccuaugggagaacaacauaaagcugaccgugguggugggggacaucauaggcgugcucgagcagggcaagcgcacgcugacgccccagccgauggagcugaaguacuccuggaagaccugggggaaggcccggaucgucaccgccgaaacgcagaacagcuccuucaucauagauggcccaaacacgcccgagugccccaacaccucucgcgccuggaaugugugggagguggaggacuacggguucggcguuuucaccaccaauaucuggcucaagcugcgggaagucuacacucagcugugcgaccaucgccucauguccgccgcugugaaggacgagcgugccguccaugccgacaugggcuacuggaucgagagucagaagaacgguagcuggaagcucgagaaggccaguuuaaucgaggugaaaaccuguacuuggcccaagagucacacccuaugguccaacggcguauuagagagcgacaugaucauccccaagucgcuggcggggccaaucucgcagcacaacuaccgcccgggcuaccacacgcagacggccgggcccuggcaccucggcaagcuagaacucgacuuuaauuauugcgagggcaccaccgucguuaucacagagaacugcgggacgcggggccccuccuuacgcaccacuacggugucuggcaagcugauccacgaguggugcugucgguccugcacccugcccccgcuccgcuacaugggcgaggacgggugcugguacgguauggagauccggcccaucagcgaaaaggaggagaacauggucaagucccuggugucggccggguccggggagguggacaacuucaccaugggaguccugugccucgccauccuguucgaggaggugaugcgcgggaaguucggcaagaagcacaugaucgccgggguguucuucaccuucguccugcucuugagcggccagaucacguggcgagacauggcgcacacucugaucaugaucggcuccaacgccaccgaucgcauggggaugggugugaccuaccucgcccugaucgccacguuuaagauucagcccuuccuggccuugggauucuuccugagaaagcugacgagccgugagaaccuacugcucggcgugggccucgcgauggccaccacccugcagcugcccgaggacaucgagcagauggccaacggcauagcccucggccugauggcgcugaagcucaucacgcaguuugagaccuaccagcuguggaccgcccugaucucguuaaccugcagcaacacgaucuucacccugaccguagcauggcggaccgccacgcugauccucgccggcgugagccuucugccggucugccaguccagcaguaugcgcaaaaccgauuggcucccgaugaccguggcggccaugggcguaccuccgcucccgcuguucaucuucagcuugaaggacacccuuaaacgucgguccuggcccuuaaacgaggggguuauggccgugggucucgucagcauuuuagccuccagccugcuccgcaacgacgucccuauggccggcccccugguggccggagggcugcucauugccugcuacgugaucacagggaccuccgccgaccugacagucgaaaaggcagccgacgugaccugggaggaggaggcggagcagaccggggucagccacaaccugaugaucacugucgacgacgacggaacuaugcguauuaaggacgacgagaccgagaacauccucacagugcugcugaaaacggcccuucugaucguguccggcaucuucccguacagcauccccgccaccuuacucgucuggcacacauggcaaaagcaaacacagcgcucgggcgugcugugggacgugcccucuccgcccgagacgcagaaagccgagcuggaggaaggggucuaccguaucaaacagcagggaaucuucgggaagacccaggugggcgucgggguccagaaggagggcguauuccacaccauguggcacgugacccgcggcgccgugcucaccuacaacgggaagagacucgagcccaacugggccucgguuaagaaggaucugaucucauauggcgggggcuggcgccuuuccgcccaguggcagaagggcgaggaggugcaggucaucgccgucgagcccggcaagaaccccaagaacuuucaaacaaugccaggcaccuuccagaccacgaccggugagaucggggccaucgcgcuggacuucaagcccgggaccucgggcucccccaucaucaaccgggagggcaagguggucggccuguacggcaacggcgugguaaccaagaacggcggguacgucagcggcaucgcacagacgaacgccgagccggacggccccacuccugagcuggaggaggagauguucaaaaagcgcaaccugaccaucauggaccuccaccccggcucgggcaagacgcgaaaguaccuuccagccaucgugcgugaggcgaucaagaggaggcugcggacguuaauccuggcgccgacccgcguggucgcagccgagauggaggaggcccucaaaggccugcccauccgguaccagaccacagccacgaaguccgagcauaccggcagggagaucguggaccugaugugccacgcgaccuucaccaugcggcuccucagccccgugagaguucccaacuacaauuugaucaucauggacgaggcccacuucacggaccccgcgucuauagcggcccggggguacaucagcacccgcgugggcaugggcgaggcggccgccauuuucaugaccgcaacgccgccugggacggcggacgcguucccccaauccaacgccccaauccaggacgaggagcgcgacaucccugaacggucauggaacagcggcaacgaguggaucacugacuucacagguaaaaccgugugguucguccccagcauuaaggccggcaacgacaucgccaauugccuccgcaagaacgggaagaaggugauccagcugucccggaagacauucgacaccgaguaucagaagacgaagcugaacgacugggacuucguagucaccaccgacaucagcgagaugggggcgaacuucaaggccgaccgggugaucgacccgcggcgcugucugaaacccguuauccugacggauggccccgagcgggucaucuuagccgggcccaugccggugaccgccgcauccgcggcccaaaggcggggccgcgucgggcggaacccccagaaggagaacgaccaauacaucuucaccgggcagccacucaacaaugacgaggaccacgcccacuggaccgaagcaaagaugcugcuggacaacaucaacacgcccgaggggauuauccccgcccucuucgaacccgaacgcgagaaguccgcggccaucgacggcgaguaccggcugaagggugaaucccgcaaaaccuucgucgagcugaugcgacgcggggaccuccccgugugguuagcccacaaggucgcuagcgagggcaucaaguauacagaccggaaguggugcuucgaugggcagcgcaacaaccagauccuggaggagaacauggacgucgagauauggaccaaggagggcgaaaagaaaaagcuccggccccguuggcuagaugcgcguacguacuccgacccucuggcccucaaagaguucaaggacuucgcagcuggccguaagagcauugcauuggaccuggugacugagaucgggcgcguccccacacaccucgcucaccgaacucgcaacgccuuagacaaccuggugaugcuccauacgucagagcacggcgguaaggccuaccggcacgcgguugaggagcugcccgagaccauggagacucugcuucuucugggccucaugauccugcugaccgggggcgccaugcuauuccugauuagcggcaaggggaucggaaagacguccaucgggcugaucugcgucaucgcgucaagcggcaugcucuggauggccgaaaucccgcugcaguggaucgcguccgcuauaguguuagaguucuucaugaugguccuccuuauccccgagcccgaaaagcagcgcaccccacaagacaaccagcuggcguacgucguaaucgggauccugacucuagcugcaaucaucgccgccaacgagaugggccugcucgagacaacgaagcgggaccugggcaugagcaaggagccagggguggucucccccaccagcuaucuggacguggaccuccacccggcguccgccuggacucuguacgccguggcuacuacggucaucacucccauguugcgccacaccaucgagaacagcacugccaacgugucccuagcggccauugccaaccaggccgugguccugaugggccuugacaagggguggccgaucagcaagauggaccucggcguuccacugcuggcccuaggcugcuauucccaggugaacccccuaacgcuaacugcggccguucuccugcugaucacgcacuacgccauuaucggcccuggccuccaggccaaggccacccgagaggcgcagaagcgcacggccgccgggaucaugaagaauccgaccguggacggcauuaugaccaucgaucuggaccccgucaucuacgacagcaaguucgagaagcaguugggccaggucaugcuccuggugcugugugccgugcagcuccuguugaugaggacauccugggcucucugcgaggcgcugacucuggccaccggacccauuacuacacucugggagggcagccccggaaaguuuuggaauaccaccaucgccguuuccauggccaacaucuuucgcggcucauaccuggcgggagccggccucgccuucuccauaaugaagagugugggaacuggcaagcggggcaccgggucccagggcgagacccuaggagagaaguggaagaagaagcugaaccaacugagucgcaaggaguuugaccuauacaagaaguccggcauaacggagguggaccggacugaggcuaaggaggggcuaaagcgcggagagaucacucaucacgccgucagccggggcagcgcgaagcugcagugguucguagaacgcaacauggugaucccggaggggcgggucaucgauuuaggcugcgggcgcggcgguuggucguacuacugcgccggucugaaaaaagugaccgaggugaggggcuacaccaagggaggcccugggcacgaggaacccguuccuaugagcaccuacgguuggaacaucgugaagcugauguccggaaaggacgucuucuaccucccgcccgagaagugcgacacccugcugugugacaucggcgaguccucgcccucgcccacugucgaggagagccgcaccauccgcgugcugaaaaugguggagcccuggcucaagaacaaucaauucugcauaaaggucuuaaacccuuacaugcccgccgugaucgagcaccuggagcggcuccaacgcaagcacgguggcaugcuggugcgaaacccucuaagccgcaacuccacccacgagauguauuggaucucaaacggcaccgggaauauagucgcgucaguuaacauggugagccggcuccugcugaaccgcuucacaaugacgcaccggcgcccgaccauugaaaaagacguagaccucggcgcaggcacccggcacgugaacgcggagcccgaaaccccaaacauggacgugauuggggagcgcaucaagcggaucaaggaggagcacaacuccacguggcauuacgacgacgagaacccguacaagaccugggccuaccacggcagcuacgagguaaaggccacggguuccgccagcucgaugaucaacggcguggucaagcugcugaccaagcccugggacguggugcccauggucacgcagauggccaugaccgacaccacccccuucgggcagcagcgcguguuuaaagaaaagguggacacgcguacaccgcgcuccaugcccggcacccgccgcgucauggagaucacggccgaguggcucuggcggacgcugggucgcaacaagaagccccgacugugcacccgcgaagaguucaccaagaagguacgcaccaaugccgccaugggugccguguucacggaggagaaccagugggacuccgccaaggccgccgucgaggacgaggacuuuuggaagcucguggaucgggagcgcgaacugcacaagcucggcaagugcgggagcugcguguacaacaugaugggcaagcgggagaagaagcugggggaguucggcaaggcaaagggcagccgugccaucugguacauguggcugggggcgcgguaccuugaguucgaggcccucggcuucuugaacgaggaccacugguucucccgcgagaacagcuauuccgggguugagggcgaagggcugcauaaguuggguuacauccuccgcgauaucagcaagauccccggcggggcgauguacgcugacgacaccgccggcugggacacccgcauuaccgaagacgaccugcacaacgaagagaagaucacccaacagauggauccggagcaucgccaacucgcgaaugccaucuuuaagcugacguaccaaaacaagguggugaagguccagcgccccacccccaccgggaccguaauggacaucaucucuaggaaggaccagaggggcagcggccagguugggacguacggcuuaaacaccuucaccaauauggaggcccagcucauccggcaaauggagggcgagggcguucuguccaaagccgaucuggagaacccccaucucccggagaagaagaucacccagugguuagagacgaaggguguggagcgccugaagcggauggccaucagcggcgacgacuguguugucaagccgaucgaugaccgcuucgcgaacgcccuccuggcccuaaacgacaugggcaaggugaggaaggacauuccucaguggcaacccucgaagggcuggcacgacuggcagcagguacccuucugcagccaccacuuccacgaacuuaucaugaaggacggccgcaagcuggucgugcccugcagaccucaggacgagcuuaucgggcgagcccggauaucccagggcgccggauggagccugcgcgagaccgcgugccuaggcaaggccuacgcucagauguggucccucauguacuuccaccgccgggaccugcgccuggccagcaacgccauaugcuccgccgugcccguccacugggugccgaccagccggaccacauggaguauucacgcccaccaccaauggaugaccaccgaggauaugcugacuguguggaaucgcgucuggaucgaggacaaccccuggauggaggacaagacgccagugaccaccugggagaacgugcccuaccucggcaagcgugaggaccagugguguggcagccugaucggcuugaccuccagggcuaccugggcccagaacaucccgaccgcuauccagcagguccgcagccucaucgggaacgaggaguucuuagacuauaugcccagcaugaaaagguuccgaaaggaagaggaguccgaaggcgccaucugguga

SEQ ID NO: 26074 - RNA, 9873 nt, Artificial Sequence
  derived and/or modified CDS sequence (opt11) from DENV-3__FJ810416__SS-prME
accagccugugccuaaugaugauccuccccgccgcccuggcguuucaccucaccaguagagauggcgagccucggaugauuguagggaagaacgagcggggcaagucgcugcuguucaagacugccucugggaucaacaugugcacucuuauugccauggaccucggggagaugugcgacgacaccgugaccuacaagugcccccacaucacugagguugagcccgaagacaucgacugcuggugcaaccugaccagcaccugggugacauacgggacgugcaaucaggccggggaacaccgacgugacaaacguuccgucgcccucgcgccacacguggggauggggcuggacacacgcacccagaccuggaugucugccgagggcgccuggcgccagguggagaaggucgagacuugggccuugcgccacccaggguucacuauccucgcacuguuccuggcucacuauaucggcaccuccuuaacccagaagguugugaucuucaucuugcuaaugcuuguaacgccuagcaugaccaugcggugcguaggggugggcaaccgcgacuucgucgagggccuguccggcgcgaccuggguggacgugguccuggagcauggcgggugcgugacuaccauggccaaaaacaaacccacccucgacaucgaguugcagaagaccgaggccacccaauuggcgacgcuccgaaagcuaugcaucgaggggaagaucaccaauauaaccacggacucccgcugccccacgcagggcgaggccgugcugccggaagaacaggaucagaacuacgugugcaagcacacauacguggaccgaggguggggcaaugggugcggccucuuugggaaggguucccugguuaccugcgcgaaguuccagugccuggagcccauagagggcaaagucgugcaguacgagaaccucaaguauacuguuauaaucacgguccacaccggugaccagcaucaggugggcaacgagacucaaggugucaccgccgaaaucacuccccaagcaucgaccaccgaggcgaucuuacccgaguacggcacccucgggcucgagugcuccccgcgaaccgggcuggacuuuaacgaaaugauccugcucacgaugaagaauaaggccuggaugguccaccggcagugguucuucgacuugcccuugccauggaccagcggcgccacgaccgagacgccgaccuggaacagaaaggaguuacugguuaccuucaagaacgcccaugccaagaagcaggaggucguggugcuggggucccaggagggugcgaugcacaccgcccucacgggggccaccgagauccagaacucaggcgggaccaguauuuucgccggccacuuaaagugccggcugaagauggacaagcuagagcugaagggcaugagcuaugccauguguacuaacacguucguccugaaaaaggagguguccgagacacagcacggaaccauccugaucaaaguggaauacaagggcgaggaugucccgugcaaaaucccauucuccaccgaggacggacagggcaaggcgcacaacggccgccugaucaccgccaacccaguggugacuaagaaggaggagcccgugaacauugaggccgagccgccuuuuggagagagcaacauagucaucggcaucggggacaacgccuugaagaucaacugguacaagaagggcuccagcaucgggaagauguucgaagcgaccgcccgcggcgccaggcggauggcuauccugggcgacaccgccugggacuucgggagugugggcggggucuuaaacucucugggcaagaugguccaccagaucuucggguccgccuacaccgcccuguucagcggcguguccugggucaugaagaucggcaucggggugcucuuaaccuggaucgggcugaauagcaaaaacaccuccaugucuuucuccugcaucgcaauugggaucaucacccucuaccugggcgcaguuguccaggcugacauggggugcgugaucaacuggaagggcaaggagcugaaaugcggcucugggauuuucgugacgaacgagguccacaccuggaccgaacaguacaaguuccaggccgacuccccgaagcgcuuggcuaccgccaucgcaggcgccugggaaaacggggugugcggcauccgcagcacgacacggauggaaaacuugcuauggaagcagauagcaaacgagcucaacuacauccugugggagaacaacaucaagcucaccguggucgugggggacaucaucggcgugcuagagcagggcaagaggacccugacgccccaaccgauggagcugaaguauuccuggaagaccuggggaaaggccaaaaucgucaccgccgagacgcaaaacagcagcuuuaucauugaugguccgaacacucccgagugccccucugccucgcgugcguggaacguuugggagguagaagacuacggguucggcguauucaccaccaauaucuggcucaagcugcgcgaaguguacacccagcugugcgaccaucggcucaugagcgccgcagugaaagaugagcgcgcagugcaugcggacaugggcuauuggaucgaaagccagaagaacgggagcuggaaauuggagaaggcgagccugauagaggugaagaccuguacguggcccaagucccacacgcucuggagcaacggcgugcuggaguccgacaugaucauccccaagagccuugcggggcccaucucccagcacaacuacaggccgggcuaucacacccagacugccggacccuggcaucuagguaaguuagagcucgacuucaacuacugcgaggguacuaccgucgugaucacagagaauugcgggacccgcggcccuagcuugcggacgaccacaguaagcggcaaguuaauacaugagugguguugccguagcugcaccuugccuccgcuacgguacaugggcgaggaugggugcugguacggcauggagauacgcccaaucuccgagaaggaggagaacauggucaagagccugguaucugccggaagcggggagguggacaacuucacaaugggcguccuuugccucgccauucuguucgaggaggugaugcguggcaaguucggcaagaagcacaugaucgcgggcguguucuucaccuucgucuuacuucuguccggacagaucaccuggcgcgacauggcccacacccugaucaugaucggaagcaacgccuccgaccggauggggaugggcgugacguaccucgcccuuauagcaaccuuuaagauccagccuuuccuggcacugggguucuuccugcgcaagcugaccucgcgggagaaccuacugcugggcguggggcuggccauggcuaccacgcugcagcugcccgaggauauugaacagauggccaacgggaucgcgcucggccugauggcucugaaauugaucacacaguucgagaccuaccagcuguggaccgcccugaucagcuugacguguuccaacaccaucuuuacccugaccguugccuggcgcaccgcgacccugauacucgccggggugagccuucugccagucugccaauccagcuccaugcggaagaccgauuggcuccccaugaccguggcugccaugggggugccgccccucccguuauuuauuuucagccucaaggacacgcugaagcgcagguccuggccccugaaugagggagugauggcggugggccucgugucgauccuggccuccagucugcuccggaaugacgugcccauggcgggcccccugguggccgggggccuacucauagcaugcuacgugaucaccgggaccucugccgaccugaccguggaaaaggccgcggacgucacgugggaggaagaggcggagcaaaccggcgugagucacaaucugaugaucacugucgacgacgacgggaccaugcgaaucaaggacgacgagaccgagaacauccucacggugcuguugaagaccgcccuccugaucguauccgguaucuuccccuacucuauccccgcuacacugcucgucuggcacacguggcagaagcagacucagcguuccggcguucugugggacgucccgagucccccagagacccagaaggccgaacuggaggagggggucuaccgcaucaagcagcagggcaucuucgggaagacccaggugggcgugggaguccagaaggaggggguguuucacaccauguggcacgugacgcggggcgcggugcucacguacaauggaaagcggcuugaaccuaacugggccuccguaaagaaggaccuuaucucauacggagggggcuggcgucucuccgcacaguggcaaaaaggggaggagguccaggucauugccguggagcccggcaagaaccccaaaaauuuccagaccaugcccggcacguuccagacaaccaccggagagaucggagcgaucgcccuggacuucaagccagggaccuccggcuccccaaucauaaaucgcgagggcaaaguggucggucuguacggcaacgggguggucacgaagaacggcggguaugucuccggcaucgcccagaccaacgcagagccggaugggccaacccccgagcuggaggaagagauguucaagaagcggaaccucacuaucauggaccugcaccccgggaguggcaaaacgcgcaaguaccugccggccauuguucgugaggcgaucaagcgccgguugcggacccugauucuggcuccaacuagaguggucgcagccgagauggaggaggcucucaaggggcugcccauacgcuaccagaccacggcgaccaaguccgaacacaccggccgggagaucguagaccugaugugccacgccacuuucacuaugcggcugcugagccccguacgggucccgaacuauaaccucaucaucauggacgaggcacacuuuacggaccccgccaguaucgccgcgcgcgguuacauuagcacgcgggugggcaugggugaggccgcagccaucuucaugacugcgacgccgcccgggaccgcagacgccuucccucagucuaaugcccccauacaggacgaggaacgugacaucccggagcggagcuggaacuccgggaacgaguggauaaccgacuucgccgguaagaccgugugguucgucccuuccaucaaggcgggaaacgauauugccaauugccucaggaaaaaugggaaaaaggugauccaacugucccgcaagacguucgacacagaguaucagaagacuaagcucaaugacugggacuucgucgucaccacggacauuagcgagaugggggccaacuucaaggcagaucggguuaucgacccgcgccgaugccucaagcccgugauccugaccgauggccccgagcgcgucauccuggccggcccuaugccggugaccgcagccuccgccgcucaacggcgaggccgggucgggcgcaauccccagaaggagaacgaccaguacauuuucaccggccagccucucaacaacgacgaagaccacgcccacuggacggaagcgaaaaugcugcuggacaacaucaacacgccagaggggaucaucccggcucucuucgagcccgagcgggagaagucggccgccaucgacggcgaguaccgccugaagggcgaaucccggaagaccuucguagagcuuaugcgccgcggggaccuccccguguggcucgcgcacaaggucgcaagcgagggcaucaaguacacagaccgcaaguggugcuucgacggacagagaaacaaccaaaucuuggaagagaacauggacgucgagauauggaccaaagagggagagaagaagaagcuccgcccccgguggcuagacgcccgcacuuacuccgacccccuggcccugaaggaguuuaaggacuucgcagcgggccgcaagucuaucgcacuggaccugaugaccgagaucgguagagugcccucccaccuagcccaucgaacccggaaugcccuggauaaucuggucaugcuccauaccagcgagcacggcgggaaagcauaccgccacgcgguggaagaacuaccugaaacgauggaaacccuguuacugcugggccucaugauccugcugaccgggggcgcuaugcuguuccugauuagcggcaaggggaucggaaagacgucaaucgggcugaucugcgucauugcgucguccggaaugcucuggauggcagagauaccccugcaguggaucgcuagcgcgaucgucuuggaguucuuuaugauggugcuccugaucccggagcccgagaagcagcggacgccacaggacaaccaguuggccuacguggucauagggauccucacccuggcugccaucaucgccgcuaaugaaaugggucugcucgagaccaccaagcgcgaccugggcauguccaaggagccagggguggugucccccacuucguaucucgacgucgauuuacacccugccucggccuggacccuuuacgccguagcgaccaccgugaucacgcccaugcugaggcacaccauugaaaacuccaccgccaacgugagccuagcagcaaucgccaaucaggcgguggugcugaugggccuggauaagggguggccgauuuccaaaauggaccucggcgucccccugcuggcccucggguguuacucccaggucaauccucugacccugacggccgccgugcuccugcuuauaacucacuacgcgaucaucgggcccggccuccaagcaaaagccacccgcgaggcccagaagcggacugccgccgggaucaugaagaacccgacggucgacgguaucaugacgaucgauuuagaccccgugaucuacgauucaaaguucgaaaagcaguugggacaggugaugcuccugguccucugcgcggugcaguuacugcugaugcgcacaagcugggcccucugcgaggcccugacccuggcgacaggccccaucaccacuuuaugggaagguuccccaggaaaauuuuggaacaccacgaucgcgguguccauggccaacaucuuccggggcuccuaccuggccggggccggcuuggcauucuccaucaugaaaagcgucgggaccggcaagcgcggcacgggaucgcagggagagacccucggggagaaguggaaaaagaaguuaaaccagcugagccggaaggaguucgaucucuacaagaagagugggauaaccgagguggauagaacggaggcgaaggagggacugaagcggggugagauuacucaccacgccgucagucggggcuccgccaagcugcagugguucgucgagcggaacauggugaucccggagggaagggugaucgaccugggaugcgggcggggcggguggagcuacuacugugccggccucaagaaagucaccgaggugcggggcuacaccaaaggcggucccgggcaugaggagcccgugccaaugaguaccuauggcuggaacaucgucaaacucaugagcgggaaggacguguucuaccucccucccgagaagugugacacccugcugugcgacaucggcgaguccucgccuucccccaccguggaggaaagcagaaccauuagggucuuaaagaugguagagccgugguugaagaacaaucaguuuugcaucaagguucugaaccccuacaugcccacggucgucgagcaccucgagaggcuccagcggaagcauggagggaugcuggugcgcaacccccugagccggaacagcacucacgagauguacuggaucuccaauggcaccggcaacaucguugcaagcguuaacauggugucacgccuacugcugaaccguuuuaccaugacgcaccgccggccgaccaucgagaaggacgucgaucuaggggcgggaacccgccaugugaacgccgagcccgaaacccccaauauggacgugaucggggaacguaucaagcgcaucaaggaggagcauaacagcacguggcacuacgacgacgagaacccguauaagaccugggcuuaccacggcuccuaugaggucaaggcgaccgggagcgccucuagcaugaucaauggcguugucaaacuucugaccaagccaugggacguaguccccauggucacgcaaauggcgaugaccgauaccacgcccuucgggcagcagcggguguucaaggagaagguggacacgcgcacuccacggagcaugccgggcacacgccgggucaugggcaucaccgccgaguggcucuggcgcacgcuagggcgaaauaagaagccccgccuaugcacccgggaggaguucaccaagaaggugcgaaccaaugccgcuaugggugcggucuucacagaggagaaucaaugggacuccgcgaaggccgccgucgaagacgaggacuucuggaagcuaguggaccgcgagcgggagcugcacaagcuggggaagugcggaagcugcguuuacaauaugauggggaagagagagaagaagcucggcgaguucggcaaggcgaaaggcagucgggcaauaugguacauguggcuuggggcccgauaucuggaguucgaggcacuugguuuucugaacgaagaccacugguucagccgagaaaauuccuacuccggcgucgagggggagggccugcacaaacucggcuacauccugcgagacauuaguaagauccccggaggggccauguaugccgaugacaccgcggggugggacacgcggaucaccgaggacgaccuccacaacgaggagaagaucacgcagcaaauggaccccgagcaucgccagcucgccaaugccaucuucaagcugaccuaccaaaauaagguggugaaagugcagcggcccacccccacaggcaccgugauggacaucaucagucgcaaggaccaacggggcuccggccagguggguacguacggucugaauaccuuuaccaacauggaggcgcaguugauccgccaaauggagggagaggguguccugucaaaagccgaccuggagaauccccggcuuccggagaagaagaucacccaguggcuggagacgaaggguguugagcgccugaagcggauggcgaucuccggagaugacugcguggugaaacccaucgaugaccgguuugccaacgcccuccuagccuuaaacgacauggggaagguacggaaggauaucccccaguggcaacccucuaagggcuggcacgacuggcagcagguuccguucugcucgcaccacuuucacgagcuaaucaugaaggacggacgcaagcuagucgugccaugccggccccaggacgagcuaaucggucgcgcccggaucagccagggggcgggcuggucucuuagagagaccgccugccugggcaaggccuaugcccagauguggagccugauguacuuccaccgccgggaccuccgccucgcguccaacgccaucuguucagccgugcccguccauuggguacccaccucccgaaccacguggagcauucaugcccaccaccaguggaugacgaccgaggacaugcugacaguguggaaccgcgucuggaucgaggacaaucccuggauggaggacaagacccccaucaccaccugggagaacgugcccuaucucggaaagcgggaggaccaguggugcggcagccugauuggccugaccucgcgcgccacgugggcgcagaacaucccgaccgccauccagcagguccggagccucaucggcaacgaggaguuucuggauuacaugccuuccaugaagcgcuuccggaaagaggaagaaagcgagggggccauuugguga
